United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 7

SEQ ID NO: 19742 - DNA, 834 bp, Artificial Sequence
  chemically treated genomic DNA (Homo sapiens) CpG-island No: 19742
actaaaaactcccccaacccctccaacccctaaacgataatactatctaaaaacgcgccgcgacccctaaacctcgctatctatcctaaatcattccgataaacctctccgactacgtaactccttacccccgcgtcgcttaaacacgaataacatcctaaatctaacctaaacctcccgccgacctactcctaaacccgccgcgtcgcccgccaaataaaaaaaaaaaaaaacccttacgacgaccccgacgacgccctcgcaaaacgaacgcgtacaacaactacgacgcaaaatctcgaaaaaaacgaccgaacgcaacaaacaaacgaccttactacacgtatcgacgccgcgaaccgcgcgccccaaaccccgaataaatccgaattaataaaaaaaacccgaacgactaaaaaccgaaaccgaataaaaataacgaacgcgacgcgcaaaaaccgacgtcccgaaacgaaaataacgaaaaaatcgaatccgatccgcgaccgaaaaatacgcaacgacgaacgcgaaaaacgataaaaacgtccctacccgcgccgacgcgttccccgacctacaaacgcaactaaaaacgcaacactaactaaaactaaaacgaaaccgcgaacgcaaactacaaacgctacaacaaaaaaactcaaaacccgaacccgcgcgccgcctaaaaaccgcctaaaccgaaccgaacgcgccccacccgcttacgaaccaccccctacacccgccgccccaataaaaaatacgacccgcgatacgcgcctcctcttccttaaccgaacccccctcgaccccgacccccctacctccgca

SEQ ID NO: 19743 - DNA, 834 bp, Artificial Sequence
  chemically treated genomic DNA (Homo sapiens) CpG-island No: 19743
gttggagatttttttaatttttttagtttttgagcggtggtattgtttaggagcgcgtcgcggtttttgggtttcgttgtttgttttaaattatttcggtgaattttttcggttgcgtagttttttgttttcgcgtcgtttggatacgggtggtattttgggtttggtttgggtttttcgtcggtttgtttttgagttcgtcgcgtcgttcgttaggtgggaggagaagaaggtttttgcggcggtttcggcggcgttttcgtaggacgagcgcgtgtagtagttgcggcgtaggatttcggagagggcggtcgagcgtagtaggtaggcggttttgttgtacgtgtcggcgtcgcggatcgcgcgttttaagtttcgggtgagttcggattggtgggaggagttcgggcgattgaaagtcggggtcgggtggggatggcgggcgcggcgcgtagggatcggcgtttcggggcggggatggcggggagatcgggttcggttcgcggtcgggagatacgtagcggcgggcgcgggaggcggtgggggcgtttttgttcgcgtcgacgcgtttttcggtttgtaggcgtagttagaggcgtagtattggttggagttggagcggagtcgcgagcgtaggttgtaggcgttgtagtagggaggtttaggattcgggttcgcgcgtcgtttggaggtcgtttgagtcgggtcgagcgcgttttattcgtttgcgggttattttttatattcgtcgttttaataaagagtgcggttcgcggtgcgcgtttttttttttttggtcgggtttttttcggtttcggtttttttgttttcgta

SEQ ID NO: 19744 - DNA, 834 bp, Artificial Sequence
  chemically treated genomic DNA (Homo sapiens) CpG-island No: 19744
tacgaaaacaaaaaaaccgaaaccgaaaaaaacccgaccaaaaaaaaaaaaacgcgcaccgcgaaccgcactctttattaaaacgacgaatataaaaaataacccgcaaacgaataaaacgcgctcgacccgactcaaacgacctccaaacgacgcgcgaacccgaatcctaaacctccctactacaacgcctacaacctacgctcgcgactccgctccaactccaaccaatactacgcctctaactacgcctacaaaccgaaaaacgcgtcgacgcgaacaaaaacgcccccaccgcctcccgcgcccgccgctacgtatctcccgaccgcgaaccgaacccgatctccccgccatccccgccccgaaacgccgatccctacgcgccgcgcccgccatccccacccgaccccgactttcaatcgcccgaactcctcccaccaatccgaactcacccgaaacttaaaacgcgcgatccgcgacgccgacacgtacaacaaaaccgcctacctactacgctcgaccgccctctccgaaatcctacgccgcaactactacacgcgctcgtcctacgaaaacgccgccgaaaccgccgcaaaaaccttcttctcctcccacctaacgaacgacgcgacgaactcaaaaacaaaccgacgaaaaacccaaaccaaacccaaaataccacccgtatccaaacgacgcgaaaacaaaaaactacgcaaccgaaaaaattcaccgaaataatttaaaacaaacaacgaaacccaaaaaccgcgacgcgctcctaaacaataccaccgctcaaaaactaaaaaaattaaaaaaatctccaac

SEQ ID NO: 19745 - DNA, 507 bp, Artificial Sequence
  chemically treated genomic DNA (Homo sapiens) CpG-island No: 19745
tttttcgtcgtcgttatagtggagtcgttaaagtcgtcgtcgtcgtcgtcgttatagttatcggtaggcgggtaggtaggggcggaggtggcggaggaggtaggaataattattgtcgtcgtcgtcgtcgtcgtcgtcgttgtcgcgtaggcggtgtaggaggaggaggaggcggtagagacggtagttttttgaggggaagatttcgtcgttagcggggtgattgtgttcggcgtcgtcgttatcgtagcgaggcgcgcggataattgtatttgcgtttcgatttcgttaagtttttttagtttcgtttttcgttagttttattttttttgtttttttttttaacgttttagttcgagtttcgttttcgttttttagtttattaatcggagagttttaagttcgtcggtcgttttttttttttttattgttttgcgttattttatttttttttggaggggaagtaacgacggttaagggtaaagggtaaaaagcgcgggatgtgaa

SEQ ID NO: 19746 - DNA, 507 bp, Artificial Sequence
  chemically treated genomic DNA (Homo sapiens) CpG-island No: 19746
ttcacatcccgcgctttttaccctttacccttaaccgtcgttacttcccctccaaaaaaaaataaaataacgcaaaacaataaaaaaaaaaaaaacgaccgacgaacttaaaactctccgattaataaactaaaaaacgaaaacgaaactcgaactaaaacgttaaaaaaaaaaacaaaaaaaataaaactaacgaaaaacgaaactaaaaaaacttaacgaaatcgaaacgcaaatacaattatccgcgcgcctcgctacgataacgacgacgccgaacacaatcaccccgctaacgacgaaatcttcccctcaaaaaactaccgtctctaccgcctcctcctcctcctacaccgcctacgcgacaacgacgacgacgacgacgacgacgacaataattattcctacctcctccgccacctccgcccctacctacccgcctaccgataactataacgacgacgacgacgacgactttaacgactccactataacgacgacgaaaaa

SEQ ID NO: 19747 - DNA, 507 bp, Artificial Sequence
  chemically treated genomic DNA (Homo sapiens) CpG-island No: 19747
tttatatttcgcgttttttgttttttgtttttggtcgtcgttgttttttttttaaagggaggtggggtgacgtaaggtagtgggggagggggaaacggtcggcgggtttaaagtttttcgattggtggattgaggagcgagaacgaggttcgagttgaagcgttaaaaagaggaataaagggggtggggttaacggaaggcggggttaaaggagtttaacggaatcgagacgtaagtgtaattgttcgcgcgtttcgttgcgatggcggcggcgtcgagtatagttatttcgttggcggcggagttttttttttaggaagttatcgtttttgtcgtttttttttttttttatatcgtttgcgcggtagcggcggcggcggcggcggcggcggtagtaattgtttttgtttttttcgttattttcgtttttgtttgttcgtttgtcggtggttgtggcgacggcggcggcggcggttttggcggttttattatggcggcggcggggag

SEQ ID NO: 19748 - DNA, 507 bp, Artificial Sequence
  chemically treated genomic DNA (Homo sapiens) CpG-island No: 19748
ctccccgccgccgccataataaaaccgccaaaaccgccgccgccgccgtcgccacaaccaccgacaaacgaacaaacaaaaacgaaaataacgaaaaaaacaaaaacaattactaccgccgccgccgccgccgccgccgctaccgcgcaaacgatataaaaaaaaaaaaaaacgacaaaaacgataacttcctaaaaaaaaaactccgccgccaacgaaataactatactcgacgccgccgccatcgcaacgaaacgcgcgaacaattacacttacgtctcgattccgttaaactcctttaaccccgccttccgttaaccccaccccctttattcctctttttaacgcttcaactcgaacctcgttctcgctcctcaatccaccaatcgaaaaactttaaacccgccgaccgtttccccctcccccactaccttacgtcaccccacctccctttaaaaaaaaaacaacgacgaccaaaaacaaaaaacaaaaaacgcgaaatataaa

SEQ ID NO: 19749 - DNA, 1096 bp, Artificial Sequence
  chemically treated genomic DNA (Homo sapiens) CpG-island No: 19749
aatcggtcggtaggttatgaaaatcggcggcgcgtcgtttcgtatttgtttcgttttcgtatttggcgggcgttcggggtagtcgagtttttttgtcgtcgttatttgttatcgtagtagttttttgggttagttggggttaaggtgttggtagtcgtcgttcgttagttttcggtaggtaggacgtcgcggttgtttggcgtcgttatttagtaatcggcggtacgtttcgtcgttatcgggtggattataatttttataatatatagcgtcgcggcgcggttcgggacgttaagttttgggcgttattttttcgttatgtttttcgggatttgtagttttttggatattcgggcgcggcgggtcgtttcgtcggtagggagcgcgtttcgggcggggtgcggcgttcgcgtagggattgggtcgttttcgtttcgttcgtttcgttcgtagcgcgcggtgggttcggggttcgcggcgttttaggcgtatgtgcggcgcggggcggtcgtgattagcggagcgttgggtgttagtgagtagcgaggagtcgcgcgttttcgtattcgcgtttgttcgtgcgttcgagcgtttattttcgggtttgaggtttgttcggcgcgtcgtttgtagagtatatttagggtcgcgtatttgtttcgcgtatttgttcgtcgttcgttcggcgtttcgggtttcgttagttagtttttttgcgatagcgcgggggtttcggtcgtgttttcgcgttcgtttcgcgttttagtcgggttcgggcgtagcgttgcggagggcgagggtcgttcggagttcggttagggtcggcgcggcgatgatgaataggtttcgaaagtggttttataaatttaaggtgagcggtttcgttcgggtcggacgtttttcgcgtcgcggttttttttttttttaggatcgttcgttcgttttataagacggattttttttttttgttcgtggacgatttttttttttatcgtcgatatttttttttttattttaagatttggatagatttttatcgttttgtttttgaggcggattcgaatttttttttcggttttttaagttcgggtttagg

SEQ ID NO: 19750 - DNA, 1096 bp, Artificial Sequence
  chemically treated genomic DNA (Homo sapiens) CpG-island No: 19750
cctaaacccgaacttaaaaaaccgaaaaaaaaattcgaatccgcctcaaaaacaaaacgataaaaatctatccaaatcttaaaataaaaaaaaaaatatcgacgataaaaaaaaaaatcgtccacgaacaaaaaaaaaaaatccgtcttataaaacgaacgaacgatcctaaaaaaaaaaaaaaccgcgacgcgaaaaacgtccgacccgaacgaaaccgctcaccttaaatttataaaaccactttcgaaacctattcatcatcgccgcgccgaccctaaccgaactccgaacgaccctcgccctccgcaacgctacgcccgaacccgactaaaacgcgaaacgaacgcgaaaacacgaccgaaacccccgcgctatcgcaaaaaaactaactaacgaaacccgaaacgccgaacgaacgacgaacaaatacgcgaaacaaatacgcgaccctaaatatactctacaaacgacgcgccgaacaaacctcaaacccgaaaataaacgctcgaacgcacgaacaaacgcgaatacgaaaacgcgcgactcctcgctactcactaacacccaacgctccgctaatcacgaccgccccgcgccgcacatacgcctaaaacgccgcgaaccccgaacccaccgcgcgctacgaacgaaacgaacgaaacgaaaacgacccaatccctacgcgaacgccgcaccccgcccgaaacgcgctccctaccgacgaaacgacccgccgcgcccgaatatccaaaaaactacaaatcccgaaaaacataacgaaaaaataacgcccaaaacttaacgtcccgaaccgcgccgcgacgctatatattataaaaattataatccacccgataacgacgaaacgtaccgccgattactaaataacgacgccaaacaaccgcgacgtcctacctaccgaaaactaacgaacgacgactaccaacaccttaaccccaactaacccaaaaaactactacgataacaaataacgacgacaaaaaaactcgactaccccgaacgcccgccaaatacgaaaacgaaacaaatacgaaacgacgcgccgccgattttcataacctaccgaccgatt

SEQ ID NO: 19751 - DNA, 1096 bp, Artificial Sequence
  chemically treated genomic DNA (Homo sapiens) CpG-island No: 19751
tttggattcgggtttaggaagtcgggagggaggttcggattcgttttagagatagggcgatgaagatttgtttaagttttggagtggagggaaggatgtcggcggtgggggaagaggtcgtttacggatagggaaagggagttcgttttgtagggcggacgggcggttttggggaagggagaggtcgcgacgcggggggcgttcggttcgagcggggtcgtttattttgggtttgtagagttattttcggaatttgtttattatcgtcgcgtcggttttggtcggatttcgggcggttttcgtttttcgtagcgttgcgttcgggttcggttgaggcgcggggcggacgcggaggtacggtcggagttttcgcgttgtcgtagggaggttggttagcgaagttcggagcgtcgagcgggcggcgggtaggtgcgcggggtaggtgcgcggttttgagtatgttttgtaagcggcgcgtcgggtagattttagattcgggagtgggcgttcgggcgtacggatagacgcgggtacgggggcgcgcggtttttcgttgtttattgatatttagcgtttcgttggttacggtcgtttcgcgtcgtatatgcgtttagggcgtcgcgagtttcgggtttatcgcgcgttgcgggcggggcgggcggggcggaggcggtttaatttttgcgcgggcgtcgtatttcgttcgaggcgcgttttttgtcggcggggcgattcgtcgcgttcgggtatttaagaaattataagtttcgaaaggtatggcggggaggtggcgtttagggtttggcgtttcgggtcgcgtcgcggcgttgtgtattgtgggagttgtagtttattcgatggcggcggagcgtgtcgtcggttgttaggtgacgacgttaaatagtcgcggcgttttgtttatcgggagttgacggacgacgattgttaatattttagttttagttggtttaggaaattgttgcggtggtaggtggcggcggtaggagggttcggttgtttcgagcgttcgttaggtacgggggcgggataggtgcggggcgacgcgtcgtcgatttttatgatttgtcggtcggtt

SEQ ID NO: 19752 - DNA, 1096 bp, Artificial Sequence
  chemically treated genomic DNA (Homo sapiens) CpG-island No: 19752
aaccgaccgacaaatcataaaaatcgacgacgcgtcgccccgcacctatcccgcccccgtacctaacgaacgctcgaaacaaccgaaccctcctaccgccgccacctaccaccgcaacaatttcctaaaccaactaaaactaaaatattaacaatcgtcgtccgtcaactcccgataaacaaaacgccgcgactatttaacgtcgtcacctaacaaccgacgacacgctccgccgccatcgaataaactacaactcccacaatacacaacgccgcgacgcgacccgaaacgccaaaccctaaacgccacctccccgccatacctttcgaaacttataatttcttaaatacccgaacgcgacgaatcgccccgccgacaaaaaacgcgcctcgaacgaaatacgacgcccgcgcaaaaattaaaccgcctccgccccgcccgccccgcccgcaacgcgcgataaacccgaaactcgcgacgccctaaacgcatatacgacgcgaaacgaccgtaaccaacgaaacgctaaatatcaataaacaacgaaaaaccgcgcgcccccgtacccgcgtctatccgtacgcccgaacgcccactcccgaatctaaaatctacccgacgcgccgcttacaaaacatactcaaaaccgcgcacctaccccgcgcacctacccgccgcccgctcgacgctccgaacttcgctaaccaacctccctacgacaacgcgaaaactccgaccgtacctccgcgtccgccccgcgcctcaaccgaacccgaacgcaacgctacgaaaaacgaaaaccgcccgaaatccgaccaaaaccgacgcgacgataataaacaaattccgaaaataactctacaaacccaaaataaacgaccccgctcgaaccgaacgccccccgcgtcgcgacctctcccttccccaaaaccgcccgtccgccctacaaaacgaactccctttccctatccgtaaacgacctcttcccccaccgccgacatccttccctccactccaaaacttaaacaaatcttcatcgccctatctctaaaacgaatccgaacctccctcccgacttcctaaacccgaatccaaa

SEQ ID NO: 19753 - DNA, 819 bp, Artificial Sequence
  chemically treated genomic DNA (Homo sapiens) CpG-island No: 19753
ttttttatttacgttttttggaattcgggataggtttttcgttcggtttttggggcgagcgcgttcgtggttagtagtttcggcggggcgggaggtgcggttttttagtcggcgttcgcgttttttttagcgtcgcggggtcggggttcgggcggcgcgtttcgtgttttagcggttgcgttagtcgtattgcgggcgttgcgttttcgtcgttcgtttggggttcgtgttcgttgtagtcggagtagggtcgggcgcgttcggcgcgggatgaaggcgcggcggtgtttaggatttcggcgtagggtttagggcgtatttgggcgttcgagggtggtattttggggtcggcgtagcggggaggttcgggttttgagattttgggggaggttacggttcgggtggggttatcgcggcgattaagggcgggagtggggttagcgtttcgttcgggtagttcggacgttcgaggttatcgcgttgtcgatttattttttttttttttattggtcgttttttttcgtttagcgttttaggttttcgtttttatcgtgggtgagttgttacggtagaggttttttgaaattcgtgtttcgcgtgcgtttattttaggaaggcgggaggtgggtttggaagatcggtacggaggtttgagggtttatttagggttcgaagggcgcgtgttttacggtttttgaggtcggggaattttgtttgtcgttgtcggagtgttgggttgagggtttacggtatatggggcgttttttgttcggttttggtttgattgggaggggattcggggggatttagggtttttgt

SEQ ID NO: 19754 - DNA, 819 bp, Artificial Sequence
  chemically treated genomic DNA (Homo sapiens) CpG-island No: 19754
acaaaaaccctaaatccccccgaatcccctcccaatcaaaccaaaaccgaacaaaaaacgccccatataccgtaaaccctcaacccaacactccgacaacgacaaacaaaattccccgacctcaaaaaccgtaaaacacgcgcccttcgaaccctaaataaaccctcaaacctccgtaccgatcttccaaacccacctcccgccttcctaaaataaacgcacgcgaaacacgaatttcaaaaaacctctaccgtaacaactcacccacgataaaaacgaaaacctaaaacgctaaacgaaaaaaaacgaccaataaaaaaaaaaaaaataaatcgacaacgcgataacctcgaacgtccgaactacccgaacgaaacgctaaccccactcccgcccttaatcgccgcgataaccccacccgaaccgtaacctcccccaaaatctcaaaacccgaacctccccgctacgccgaccccaaaataccaccctcgaacgcccaaatacgccctaaaccctacgccgaaatcctaaacaccgccgcgccttcatcccgcgccgaacgcgcccgaccctactccgactacaacgaacacgaaccccaaacgaacgacgaaaacgcaacgcccgcaatacgactaacgcaaccgctaaaacacgaaacgcgccgcccgaaccccgaccccgcgacgctaaaaaaaacgcgaacgccgactaaaaaaccgcacctcccgccccgccgaaactactaaccacgaacgcgctcgccccaaaaaccgaacgaaaaacctatcccgaattccaaaaaacgtaaataaaaaa

SEQ ID NO: 19755 - DNA, 819 bp, Artificial Sequence
  chemically treated genomic DNA (Homo sapiens) CpG-island No: 19755
ataggaattttgaattttttcgagtttttttttaattaagttaaggtcgagtaaggggcgttttatgtatcgtaagtttttaatttaatatttcggtaacgataaatagaatttttcgattttaaaggtcgtgaagtacgcgtttttcgggttttgagtgagtttttaaattttcgtgtcgattttttaaatttatttttcgtttttttggaatgggcgtacgcgaggtacggattttaggaaatttttgtcgtgatagtttatttacggtggaggcggaggtttgggacgttggacggagaaaggcggttagtggagggaggaggggtaggtcggtaacgcggtggtttcggacgttcgagttgttcggacgaagcgttggttttattttcgtttttggtcgtcgcggtgattttattcgagtcgtgattttttttaagattttagggttcgggttttttcgttgcgtcggttttagggtgttattttcggacgtttagatgcgttttggattttgcgtcgggattttgaatatcgtcgcgtttttatttcgcgtcgagcgcgttcggttttgtttcggttgtagcgggtacgagttttaggcgggcggcggggacgtagcgttcgtagtgcgattggcgtagtcgttgaggtacggggcgcgtcgttcggatttcgatttcgcggcgttaggagaggcgcgggcgtcggttggagagtcgtatttttcgtttcgtcgaggttgttggttacgggcgcgttcgttttaagggtcgggcggaggatttgtttcggattttagaggacgtgggtggggaa

SEQ ID NO: 19756 - DNA, 819 bp, Artificial Sequence
  chemically treated genomic DNA (Homo sapiens) CpG-island No: 19756
ttccccacccacgtcctctaaaatccgaaacaaatcctccgcccgacccttaaaacgaacgcgcccgtaaccaacaacctcgacgaaacgaaaaatacgactctccaaccgacgcccgcgcctctcctaacgccgcgaaatcgaaatccgaacgacgcgccccgtacctcaacgactacgccaatcgcactacgaacgctacgtccccgccgcccgcctaaaactcgtacccgctacaaccgaaacaaaaccgaacgcgctcgacgcgaaataaaaacgcgacgatattcaaaatcccgacgcaaaatccaaaacgcatctaaacgtccgaaaataacaccctaaaaccgacgcaacgaaaaaacccgaaccctaaaatcttaaaaaaaatcacgactcgaataaaatcaccgcgacgaccaaaaacgaaaataaaaccaacgcttcgtccgaacaactcgaacgtccgaaaccaccgcgttaccgacctacccctcctccctccactaaccgcctttctccgtccaacgtcccaaacctccgcctccaccgtaaataaactatcacgacaaaaatttcctaaaatccgtacctcgcgtacgcccattccaaaaaaacgaaaaataaatttaaaaaatcgacacgaaaatttaaaaactcactcaaaacccgaaaaacgcgtacttcacgacctttaaaatcgaaaaattctatttatcgttaccgaaatattaaattaaaaacttacgatacataaaacgccccttactcgaccttaacttaattaaaaaaaaactcgaaaaaattcaaaattcctat

SEQ ID NO: 19757 - DNA, 1228 bp, Artificial Sequence
  chemically treated genomic DNA (Homo sapiens) CpG-island No: 19757
gggggtcgggggcgtttgtcgcgtatttattttgacgcgtttttagtagtagcgagttggttacgatgttttcgagttttatgttttggcgtcgtcgtcgtcggcggattttgcgagatcgaggagattgaggaggcggaataggaggagacgtcgtcgttttcgtgtatagttcgtcgggtattatttttttttcgagtttcggatacgatttcgggaggttgtttcgtcgttattattgttattaagggcgtcgtcgtcgtcgttttcgtaggtttttattagtaggggagcggtcggggcgaggggagggggtagttcgatcgcggcgggttttagttgttatcgttgtcgcgttatcgtttcggttttttttggttttatcgttttcgtttcgcgcgcgtaattttttttttagtgttttgttttcgggtagtttcgagttaatgtcgtggtttatttcggataggggtttattggtaggggcgttcgtcgcggtcggcgattcgttttcgggcgggttcggcgttaacggtttagttgaagagggagcgtttttcgtcgtcgcggtcggggtattatagtttttagaaggttttgcgttaagagtatacggcgggtcgcggcgcgtggtttgttgggagttgtagtcgttgagtttatcggcgagtaagtcgagtttgcgggcgcggtgtttatttttcgcgagtcggaggtgttgcgttgttttcgcgagacgaggaagcggtttcgcggttcggtacgtgttttagggtagcgcgcgtttgttttttttcgggtttcgggtttttgggcgtagcggggcgcgcgttatggcgaaggcgaagaaggtcggggcgcgaaggaaggttttcggggcgtcggcgggagcgcgagggggttcggcgaaggttaattttaattcgttcgaggtgaaagttaataggtagaagttttagattttgggtcggaagacgcgttacgacgtgggattgttcggggtgtttcgcgtacgggtttttaggaaggtaagcggggggcgtacggggagtcggaaggtaggatttggattttacgttgttttcggtcggttgcgtttttttcggtgcgtcggttttttcgttgagcggtataggtcgtgataggtatacggtattgatttgatagttcgaaagtttttgttgttttttgagttggagtgatttggaaattttcgtcgttttggaga

SEQ ID NO: 19758 - DNA, 1228 bp, Artificial Sequence
  chemically treated genomic DNA (Homo sapiens) CpG-island No: 19758
tctccaaaacgacgaaaatttccaaatcactccaactcaaaaaacaacaaaaactttcgaactatcaaatcaataccgtatacctatcacgacctataccgctcaacgaaaaaaccgacgcaccgaaaaaaacgcaaccgaccgaaaacaacgtaaaatccaaatcctaccttccgactccccgtacgccccccgcttaccttcctaaaaacccgtacgcgaaacaccccgaacaatcccacgtcgtaacgcgtcttccgacccaaaatctaaaacttctacctattaactttcacctcgaacgaattaaaattaaccttcgccgaaccccctcgcgctcccgccgacgccccgaaaaccttccttcgcgccccgaccttcttcgccttcgccataacgcgcgccccgctacgcccaaaaacccgaaacccgaaaaaaaacaaacgcgcgctaccctaaaacacgtaccgaaccgcgaaaccgcttcctcgtctcgcgaaaacaacgcaacacctccgactcgcgaaaaataaacaccgcgcccgcaaactcgacttactcgccgataaactcaacgactacaactcccaacaaaccacgcgccgcgacccgccgtatactcttaacgcaaaaccttctaaaaactataataccccgaccgcgacgacgaaaaacgctccctcttcaactaaaccgttaacgccgaacccgcccgaaaacgaatcgccgaccgcgacgaacgcccctaccaataaacccctatccgaaataaaccacgacattaactcgaaactacccgaaaacaaaacactaaaaaaaaaattacgcgcgcgaaacgaaaacgataaaaccaaaaaaaaccgaaacgataacgcgacaacgataacaactaaaacccgccgcgatcgaactaccccctcccctcgccccgaccgctcccctactaataaaaacctacgaaaacgacgacgacgacgcccttaataacaataataacgacgaaacaacctcccgaaatcgtatccgaaactcgaaaaaaaaataatacccgacgaactatacacgaaaacgacgacgtctcctcctattccgcctcctcaatctcctcgatctcgcaaaatccgccgacgacgacgacgccaaaacataaaactcgaaaacatcgtaaccaactcgctactactaaaaacgcgtcaaaataaatacgcgacaaacgcccccgaccccc

SEQ ID NO: 19759 - DNA, 1228 bp, Artificial Sequence
  chemically treated genomic DNA (Homo sapiens) CpG-island No: 19759
tttttaagacggcgagagtttttaggttattttagtttagagaatagtagaggttttcggattattaagttagtgtcgtgtgtttgttacggtttgtgtcgtttaacgaggaaatcgacgtatcgagaaggacgtagtcggtcgagagtagcgtggggtttagattttgtttttcggtttttcgtgcgtttttcgtttatttttttgagggttcgtgcgcgagatatttcgggtagttttacgtcgtggcgcgtttttcggtttaggatttggaatttttgtttgttaatttttatttcgaacggattggagttggttttcgtcgggttttttcgcgttttcgtcggcgtttcggaggttttttttcgcgtttcgatttttttcgttttcgttatggcgcgcgtttcgttgcgtttaagggttcgagattcgaagagagataggcgcgcgttattttaagatacgtgtcgggtcgcggaatcgttttttcgtttcgcgagaatagcgtagtattttcgattcgcgagaagtaaatatcgcgttcgtaggttcggtttattcgtcgataggtttagcgattataatttttagtaggttacgcgtcgcggttcgtcgtgtatttttggcgtagggttttttgggagttgtagtgtttcggtcgcggcggcgaggggcgttttttttttagttaagtcgttagcgtcgagttcgttcgggagcgggtcgtcggtcgcggcgggcgtttttgttagtgagtttttgttcgaagtgagttacggtattgattcggggttgttcgggggtagggtattgaggagggagttgcgcgcgcgaggcgagggcgatggggttaagaagaatcggggcgatagcgcggtagcggtgatagttgggattcgtcgcggtcgggttgtttttttttttcgtttcgatcgtttttttgttggtgagggtttgcggaggcggcggcggcggcgtttttggtggtagtggtggcggcggagtagtttttcgggatcgtgttcggagttcgaggagagggtggtgttcggcgagttatgtacgggggcggcggcgtttttttttgtttcgtttttttagttttttcggtttcgtagaattcgtcggcggcggcggcgttaggatatggagttcgagaatatcgtggttaattcgttgttgttgaaagcgcgttaaggtgggtgcgcggtaggcgttttcgattttt

SEQ ID NO: 19760 - DNA, 1228 bp, Artificial Sequence
  chemically treated genomic DNA (Homo sapiens) CpG-island No: 19760
aaaaatcgaaaacgcctaccgcgcacccaccttaacgcgctttcaacaacaacgaattaaccacgatattctcgaactccatatcctaacgccgccgccgccgacgaattctacgaaaccgaaaaaactaaaaaaacgaaacaaaaaaaaacgccgccgcccccgtacataactcgccgaacaccaccctctcctcgaactccgaacacgatcccgaaaaactactccgccgccaccactaccaccaaaaacgccgccgccgccgcctccgcaaaccctcaccaacaaaaaaacgatcgaaacgaaaaaaaaaaacaacccgaccgcgacgaatcccaactatcaccgctaccgcgctatcgccccgattcttcttaaccccatcgccctcgcctcgcgcgcgcaactccctcctcaataccctacccccgaacaaccccgaatcaataccgtaactcacttcgaacaaaaactcactaacaaaaacgcccgccgcgaccgacgacccgctcccgaacgaactcgacgctaacgacttaactaaaaaaaaaacgcccctcgccgccgcgaccgaaacactacaactcccaaaaaaccctacgccaaaaatacacgacgaaccgcgacgcgtaacctactaaaaattataatcgctaaacctatcgacgaataaaccgaacctacgaacgcgatatttacttctcgcgaatcgaaaatactacgctattctcgcgaaacgaaaaaacgattccgcgacccgacacgtatcttaaaataacgcgcgcctatctctcttcgaatctcgaacccttaaacgcaacgaaacgcgcgccataacgaaaacgaaaaaaatcgaaacgcgaaaaaaaacctccgaaacgccgacgaaaacgcgaaaaaacccgacgaaaaccaactccaatccgttcgaaataaaaattaacaaacaaaaattccaaatcctaaaccgaaaaacgcgccacgacgtaaaactacccgaaatatctcgcgcacgaaccctcaaaaaaataaacgaaaaacgcacgaaaaaccgaaaaacaaaatctaaaccccacgctactctcgaccgactacgtccttctcgatacgtcgatttcctcgttaaacgacacaaaccgtaacaaacacacgacactaacttaataatccgaaaacctctactattctctaaactaaaataacctaaaaactctcgccgtcttaaaaa

SEQ ID NO: 19761 - DNA, 502 bp, Artificial Sequence
  chemically treated genomic DNA (Homo sapiens) CpG-island No: 19761
gataatcgtaggatgttgaaaaggggaaatttaatataaacgttaagtgagcgtttgaaagtaggtcgcgtcgggcggcgggtaggcgggtaaaggcggatagggcggtcgggggggcgggcgggcgagcggcggcggttatttttcgcgtagttgtaggcggtagcggtggtagcggatttggaagaagaggcgtttagttagcgagagggttatgttcggtagtacgtagtggttattggcgtttatgtgtttgaagtttagcgattcgtagagtttgtgggcggttattttgacggtcgtcgtgtttagtattatcgcggagtagttgtgtattacggcgaattttagtatttttcggtttagcgttttggcgatgtttttgtttcggaaacgtgagtttatagatattcgtagtagttttatcgtgttgtttttttcgtgggttcgtgtagttataatgtttattacgttgttatttagtacggttatttagaagtag

SEQ ID NO: 19762 - DNA, 502 bp, Artificial Sequence
  chemically treated genomic DNA (Homo sapiens) CpG-island No: 19762
ctacttctaaataaccgtactaaataacaacgtaataaacattataactacacgaacccacgaaaaaaacaacacgataaaactactacgaatatctataaactcacgtttccgaaacaaaaacatcgccaaaacgctaaaccgaaaaatactaaaattcgccgtaatacacaactactccgcgataatactaaacacgacgaccgtcaaaataaccgcccacaaactctacgaatcgctaaacttcaaacacataaacgccaataaccactacgtactaccgaacataaccctctcgctaactaaacgcctcttcttccaaatccgctaccaccgctaccgcctacaactacgcgaaaaataaccgccgccgctcgcccgcccgcccccccgaccgccctatccgcctttacccgcctacccgccgcccgacgcgacctactttcaaacgctcacttaacgtttatattaaatttccccttttcaacatcctacgattatc

SEQ ID NO: 19763 - DNA, 502 bp, Artificial Sequence
  chemically treated genomic DNA (Homo sapiens) CpG-island No: 19763
ttgtttttgggtggtcgtgttggatggtaacgtggtgggtattgtggttgtacgggtttacgaggaggataatacggtggagttgttgcggatgtttgtggatttacgttttcgaggtaagggtatcgttaaggcgttgggtcggaaggtgttggagttcgtcgtggtgtataattatttcgcggtggtgttgggtacgacggtcgttaaggtggtcgtttataagttttacgagtcgttgggttttagatatatgggcgttagtgattattacgtgttgtcgggtatgattttttcgttggttgagcgtttttttttttaggttcgttattatcgttatcgtttgtagttgcgcgaggagtgatcgtcgtcgttcgttcgttcgttttttcggtcgttttgttcgtttttgttcgtttgttcgtcgttcggcgcggtttgtttttagacgtttatttggcgtttgtgttgggttttttttttttaatattttgcggttgtt

SEQ ID NO: 19764 - DNA, 502 bp, Artificial Sequence
  chemically treated genomic DNA (Homo sapiens) CpG-island No: 19764
aacaaccgcaaaatattaaaaaaaaaaaacccaacacaaacgccaaataaacgtctaaaaacaaaccgcgccgaacgacgaacaaacgaacaaaaacgaacaaaacgaccgaaaaaacgaacgaacgaacgacgacgatcactcctcgcgcaactacaaacgataacgataataacgaacctaaaaaaaaaaacgctcaaccaacgaaaaaatcatacccgacaacacgtaataatcactaacgcccatatatctaaaacccaacgactcgtaaaacttataaacgaccaccttaacgaccgtcgtacccaacaccaccgcgaaataattatacaccacgacgaactccaacaccttccgacccaacgccttaacgatacccttacctcgaaaacgtaaatccacaaacatccgcaacaactccaccgtattatcctcctcgtaaacccgtacaaccacaatacccaccacgttaccatccaacacgaccacccaaaaacaa

SEQ ID NO: 19765 - DNA, 1289 bp, Artificial Sequence
  chemically treated genomic DNA (Homo sapiens) CpG-island No: 19765
acggatacggagggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatagcgatacggggggaatattaatacgggaggaatagtaatacgtagggaatatcgatatgggtgatgtttgtaaagtatagtattaattttaagtgatt

SEQ ID NO: 19766 - DNA, 1289 bp, Artificial Sequence
  chemically treated genomic DNA (Homo sapiens) CpG-island No: 19766
aatcacttaaaattaatactatactttacaaacatcacccatatcgatattccctacgtattactattcctcccgtattaatattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccccccgtatcgctattccctccgtatccgt

SEQ ID NO: 19767 - DNA, 1289 bp, Artificial Sequence
  chemically treated genomic DNA (Homo sapiens) CpG-island No: 19767
agttatttgggattgatgttgtgttttgtaggtattatttatgtcgatattttttgcgtgttgttgtttttttcgtgttggtatttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgtcgttgtttttttcgtgttcgt

SEQ ID NO: 19768 - DNA, 1289 bp, Artificial Sequence
  chemically treated genomic DNA (Homo sapiens) CpG-island No: 19768
acgaacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaacaacgacacgaaaaaaataccaacacgaaaaaaacaacaacacgcaaaaaatatcgacataaataatacctacaaaacacaacatcaatcccaaataact

SEQ ID NO: 19769 - DNA, 522 bp, Artificial Sequence
  chemically treated genomic DNA (Homo sapiens) CpG-island No: 19769
attacggttttcgtttttaggtttcgttttatcgatcgcgggtcgcgtttattcgttgggtttttttttatagttggtttaatttttttatgcggaattttttttcggattcgcgtttcggggacggtttgggttggtttttttttcgcgagtatttgtcgtcgtggttcgtagcgggttagggttcgaggaagagtagtagtagtagtagcgtcgggagttcgcgtagaaacgatttgatttttcgcggcgttatttttttttgcgattggcgttgcgcggagaaaatttagtttgtcgatgtttcgtttattatttcgtttttatttatcgcgcggttttttgggaattgtagttttttcgtgagcggtcggtagcggcgaggtcgtcggcggattttagcgtttaggaagttttgcgtaggcgtaagcgttttttaggtaattacgtcgcggttcgaggttgtagattttggtaggggatataattggagaatgagggtggtcgggtgggagtagggat

SEQ ID NO: 19770 - DNA, 522 bp, Artificial Sequence
  chemically treated genomic DNA (Homo sapiens) CpG-island No: 19770
atccctactcccacccgaccaccctcattctccaattatatcccctaccaaaatctacaacctcgaaccgcgacgtaattacctaaaaaacgcttacgcctacgcaaaacttcctaaacgctaaaatccgccgacgacctcgccgctaccgaccgctcacgaaaaaactacaattcccaaaaaaccgcgcgataaataaaaacgaaataataaacgaaacatcgacaaactaaattttctccgcgcaacgccaatcgcaaaaaaaaataacgccgcgaaaaatcaaatcgtttctacgcgaactcccgacgctactactactactactcttcctcgaaccctaacccgctacgaaccacgacgacaaatactcgcgaaaaaaaaaccaacccaaaccgtccccgaaacgcgaatccgaaaaaaaattccgcataaaaaaattaaaccaactataaaaaaaaacccaacgaataaacgcgacccgcgatcgataaaacgaaacctaaaaacgaaaaccgtaat

SEQ ID NO: 19771 - DNA, 522 bp, Artificial Sequence
  chemically treated genomic DNA (Homo sapiens) CpG-island No: 19771
atttttgtttttattcggttatttttattttttagttgtattttttgttagagtttgtagtttcgggtcgcggcgtggttgtttgggaaacgtttgcgtttgcgtagggttttttaggcgttggagttcgtcggcggtttcgtcgttgtcggtcgtttacggaggaattataatttttaggagatcgcgcggtgggtgggggcggggtagtgggcggggtatcggtaggttaggtttttttcgcgtagcgttagtcgtagaggaagatggcgtcgcggagggttaggtcgtttttgcgcgggttttcggcgttgttattgttgttgttttttttcgggttttggttcgttgcgagttacggcggtaagtattcgcgggagaagaattagtttaagtcgttttcgaaacgcgagttcggagaggagtttcgtatggagaagttgaattagttgtgggagaaggtttagcgagtgagcgcggttcgcggtcggtggagcggggtttgggggcgggggtcgtggt

SEQ ID NO: 19772 - DNA, 522 bp, Artificial Sequence
  chemically treated genomic DNA (Homo sapiens) CpG-island No: 19772
accacgacccccgcccccaaaccccgctccaccgaccgcgaaccgcgctcactcgctaaaccttctcccacaactaattcaacttctccatacgaaactcctctccgaactcgcgtttcgaaaacgacttaaactaattcttctcccgcgaatacttaccgccgtaactcgcaacgaaccaaaacccgaaaaaaaacaacaacaataacaacgccgaaaacccgcgcaaaaacgacctaaccctccgcgacgccatcttcctctacgactaacgctacgcgaaaaaaacctaacctaccgataccccgcccactaccccgcccccacccaccgcgcgatctcctaaaaattataattcctccgtaaacgaccgacaacgacgaaaccgccgacgaactccaacgcctaaaaaaccctacgcaaacgcaaacgtttcccaaacaaccacgccgcgacccgaaactacaaactctaacaaaaaatacaactaaaaaataaaaataaccgaataaaaacaaaaat

SEQ ID NO: 19773 - DNA, 543 bp, Artificial Sequence
  chemically treated genomic DNA (Homo sapiens) CpG-island No: 19773
gcgcgtaaggacggcgggatgtgttaggaacgagggcgaaggattattttgtcgagtttatttgaggtttgaagagcgaatatcgggtagacgaaggcgggagtttcgggcggggaaacgtatcgagtatttttttttcgaggtttgtacgtagttcgatttgtcgttgcgtacgtagtaggcggagtgtttttcgcgttcgcgcgtcgagcgaatgaagttgtgtatttgcgggttttggcgtatgtagggcgaaaatttggcgtttaggtggatgagggttttttgcgggcgagggagacgagcggtcgtagttcggggttttttgttttcgtcgggtatttttaggtttcgttttcgtcggtttcgtttttagtttcgtttttatcgagttgggttcgatttagaagtttttttgttgtacgtatttgacgttttcgtagatttcgcggtttcgtagtatttgggaggttggggagcgggattagacgggtttcgattttggttttttttttttagagcgggtcgggagggggtttagtg

SEQ ID NO: 19774 - DNA, 543 bp, Artificial Sequence
  chemically treated genomic DNA (Homo sapiens) CpG-island No: 19774
cactaaaccccctcccgacccgctctaaaaaaaaaaaaccaaaatcgaaacccgtctaatcccgctccccaacctcccaaatactacgaaaccgcgaaatctacgaaaacgtcaaatacgtacaacaaaaaaacttctaaatcgaacccaactcgataaaaacgaaactaaaaacgaaaccgacgaaaacgaaacctaaaaatacccgacgaaaacaaaaaaccccgaactacgaccgctcgtctccctcgcccgcaaaaaaccctcatccacctaaacgccaaattttcgccctacatacgccaaaacccgcaaatacacaacttcattcgctcgacgcgcgaacgcgaaaaacactccgcctactacgtacgcaacgacaaatcgaactacgtacaaacctcgaaaaaaaaatactcgatacgtttccccgcccgaaactcccgccttcgtctacccgatattcgctcttcaaacctcaaataaactcgacaaaataatccttcgccctcgttcctaacacatcccgccgtccttacgcgc

SEQ ID NO: 19775 - DNA, 543 bp, Artificial Sequence
  chemically treated genomic DNA (Homo sapiens) CpG-island No: 19775
tattggattttttttcgattcgttttgggaggagagggttagagtcggggttcgtttgatttcgttttttaattttttaggtgttgcggaatcgcggggtttacgagaacgttaagtacgtgtagtaggagaatttttggatcgggtttagttcggtgaggacggggttgggggcggggtcggcgggggcgggatttggaggtgttcggcgggggtaggaggtttcggattgcggtcgttcgtttttttcgttcgtaggaggtttttatttatttgggcgttaagttttcgttttgtatgcgttaggattcgtaggtgtatagttttattcgttcggcgcgcgagcgcgagaagtatttcgtttgttgcgtgcgtaacgataggtcgggttgcgtgtagatttcggaggaggagtgttcggtgcgttttttcgttcgggattttcgttttcgtttgttcggtgttcgttttttagattttagatagattcggtagagtgatttttcgttttcgtttttggtatatttcgtcgtttttacgcgt

SEQ ID NO: 19776 - DNA, 543 bp, Artificial Sequence
  chemically treated genomic DNA (Homo sapiens) CpG-island No: 19776
acgcgtaaaaacgacgaaatataccaaaaacgaaaacgaaaaatcactctaccgaatctatctaaaatctaaaaaacgaacaccgaacaaacgaaaacgaaaatcccgaacgaaaaaacgcaccgaacactcctcctccgaaatctacacgcaacccgacctatcgttacgcacgcaacaaacgaaatacttctcgcgctcgcgcgccgaacgaataaaactatacacctacgaatcctaacgcatacaaaacgaaaacttaacgcccaaataaataaaaacctcctacgaacgaaaaaaacgaacgaccgcaatccgaaacctcctacccccgccgaacacctccaaatcccgcccccgccgaccccgcccccaaccccgtcctcaccgaactaaacccgatccaaaaattctcctactacacgtacttaacgttctcgtaaaccccgcgattccgcaacacctaaaaaattaaaaaacgaaatcaaacgaaccccgactctaaccctctcctcccaaaacgaatcgaaaaaaaatccaata

SEQ ID NO: 19777 - DNA, 670 bp, Artificial Sequence
  chemically treated genomic DNA (Homo sapiens) CpG-island No: 19777
ttcggttgttagcgatttggagtttacgttgattttagtttttcgtcgattttatagttcgcggaggggtacggagtcgcggcgttcgtcggggaggaagtagtaggacggtatataggaaggaggttgaagttttatttatggcgtagatttcgagagaggagttcgatttggatttacggtcgttttagagacgtatcggtttagataaaggttcggcgtttgcggtcggagcgcgggggaggaggagcgatgtttcgcgtaggcgtaggcgtagacgatcgcggttttcgttttaggtcgttcggcggtttcgttttatttttattttagattttcgtttggttggtcgttttgatttatcgtttcgagtcgtgtttatgagttggtttagtagggttcgtatttgcgtttgggcggatatggtagtcggcggaggcgacggggtcggtcgcgacgattttttttaggtaggcggtggtagcggcgtcgataaacgatggtcgcgtcggtttcgagtttattcggttttttttcgtcgcgggggacgtcgggaggaagtacgacggcgtcggcgtacgttttgttgggaaatgtagtttttggggtgggtgtttagggaggttgaggttttgagtggtcgtaagttgtttaacggcggaattaaaat

SEQ ID NO: 19778 - DNA, 670 bp, Artificial Sequence
  chemically treated genomic DNA (Homo sapiens) CpG-island No: 19778
attttaattccgccgttaaacaacttacgaccactcaaaacctcaacctccctaaacacccaccccaaaaactacatttcccaacaaaacgtacgccgacgccgtcgtacttcctcccgacgtcccccgcgacgaaaaaaaaccgaataaactcgaaaccgacgcgaccatcgtttatcgacgccgctaccaccgcctacctaaaaaaaatcgtcgcgaccgaccccgtcgcctccgccgactaccatatccgcccaaacgcaaatacgaaccctactaaaccaactcataaacacgactcgaaacgataaatcaaaacgaccaaccaaacgaaaatctaaaataaaaataaaacgaaaccgccgaacgacctaaaacgaaaaccgcgatcgtctacgcctacgcctacgcgaaacatcgctcctcctcccccgcgctccgaccgcaaacgccgaacctttatctaaaccgatacgtctctaaaacgaccgtaaatccaaatcgaactcctctctcgaaatctacgccataaataaaacttcaacctccttcctatataccgtcctactacttcctccccgacgaacgccgcgactccgtacccctccgcgaactataaaatcgacgaaaaactaaaatcaacgtaaactccaaatcgctaacaaccgaa

SEQ ID NO: 19779 - DNA, 670 bp, Artificial Sequence
  chemically treated genomic DNA (Homo sapiens) CpG-island No: 19779
attttggtttcgtcgttggataatttgcgattatttagagttttagtttttttaagtatttattttagaaattatattttttagtagggcgtgcgtcggcgtcgtcgtattttttttcggcgtttttcgcggcgggaaagagtcgagtgggttcgaggtcgacgcgattatcgtttgtcgacgtcgttgttatcgtttgtttgagagaagtcgtcgcggtcgatttcgtcgttttcgtcggttattatgttcgtttaggcgtagatgcgggttttgttggattagtttatgggtacggttcgggacggtgagttagagcggttaattaggcgagggtttggggtgggagtgaggcgaggtcgtcgggcggtttgaggcgggggtcgcgatcgtttgcgtttgcgtttgcgcggggtatcgttttttttttttcgcgtttcgatcgtaggcgtcgggtttttgtttaagtcggtgcgtttttgaggcggtcgtgggtttaggtcgggtttttttttcggagtttgcgttatggatggggttttagttttttttttatgtatcgttttgttatttttttttcggcgggcgtcgcggtttcgtgttttttcgcgaattgtggagtcggcggagggttggaattagcgtgggttttaggtcgttggtagtcggg

SEQ ID NO: 19780 - DNA, 670 bp, Artificial Sequence
  chemically treated genomic DNA (Homo sapiens) CpG-island No: 19780
cccgactaccaacgacctaaaacccacgctaattccaaccctccgccgactccacaattcgcgaaaaaacacgaaaccgcgacgcccgccgaaaaaaaaataacaaaacgatacataaaaaaaaaactaaaaccccatccataacgcaaactccgaaaaaaaaacccgacctaaacccacgaccgcctcaaaaacgcaccgacttaaacaaaaacccgacgcctacgatcgaaacgcgaaaaaaaaaaaacgataccccgcgcaaacgcaaacgcaaacgatcgcgacccccgcctcaaaccgcccgacgacctcgcctcactcccaccccaaaccctcgcctaattaaccgctctaactcaccgtcccgaaccgtacccataaactaatccaacaaaacccgcatctacgcctaaacgaacataataaccgacgaaaacgacgaaatcgaccgcgacgacttctctcaaacaaacgataacaacgacgtcgacaaacgataatcgcgtcgacctcgaacccactcgactctttcccgccgcgaaaaacgccgaaaaaaaatacgacgacgccgacgcacgccctactaaaaaatataatttctaaaataaatacttaaaaaaactaaaactctaaataatcgcaaattatccaacgacgaaaccaaaat

SEQ ID NO: 19781 - DNA, 556 bp, Artificial Sequence
  chemically treated genomic DNA (Homo sapiens) CpG-island No: 19781
gttatttttgcggcgcgtcgggttaggaattcggggttgggtcgttttcgcgggcgattcgggaaattttaggaagaaaagttcggtcgtttcgggggggtttcgtcgcgattttttttcggtttcggtttcggtttcgatacggtttcggtcgttttgagtagtttcggtttcgggtgttgaggattcgtttcgtttttcggacgtagtttcggaattcgttcgttttcggagttttgcgttttcggtcgcgtttatttattgtcgtcgtcgggggttttggggggttttgagggcgtcggggaggaggttgtcgtcgttggtcgggagggttcgcgtcgagttttcgttcgttcgtcggttcggttcgttcgggaatgttttggagcgaggggcgtgcgttcgggggcgggttcggtcggagcggggcggtcgcgttgatttagagtttaggaatgcgcgtcgttcgtttgttcggtttaagttattttttttcggaaggtcgtcgggtttttttttttttagggttcgtttgcggggatatttggggttgggg

SEQ ID NO: 19782 - DNA, 556 bp, Artificial Sequence
  chemically treated genomic DNA (Homo sapiens) CpG-island No: 19782
ccccaaccccaaatatccccgcaaacgaaccctaaaaaaaaaaaaacccgacgaccttccgaaaaaaaataacttaaaccgaacaaacgaacgacgcgcattcctaaactctaaatcaacgcgaccgccccgctccgaccgaacccgcccccgaacgcacgcccctcgctccaaaacattcccgaacgaaccgaaccgacgaacgaacgaaaactcgacgcgaaccctcccgaccaacgacgacaacctcctccccgacgccctcaaaaccccccaaaacccccgacgacgacaataaataaacgcgaccgaaaacgcaaaactccgaaaacgaacgaattccgaaactacgtccgaaaaacgaaacgaatcctcaacacccgaaaccgaaactactcaaaacgaccgaaaccgtatcgaaaccgaaaccgaaaccgaaaaaaaatcgcgacgaaacccccccgaaacgaccgaacttttcttcctaaaatttcccgaatcgcccgcgaaaacgacccaaccccgaattcctaacccgacgcgccgcaaaaataac

SEQ ID NO: 19783 - DNA, 556 bp, Artificial Sequence
  chemically treated genomic DNA (Homo sapiens) CpG-island No: 19783
ttttagttttaggtgttttcgtaggcggattttggggagaagggagttcggcggtttttcgggaggaggtgatttgggtcgggtaggcgggcggcgcgtatttttgagttttgagttagcgcgatcgtttcgtttcggtcgggttcgttttcgggcgtacgtttttcgttttagggtattttcgggcgggtcggatcggcgggcgggcggggattcggcgcgggttttttcggttagcggcggtagtttttttttcggcgtttttaggattttttagagttttcggcggcggtagtgagtgagcgcggtcgggagcgtagggtttcgggggcgggcgggtttcggggttgcgttcggagggcggggcgagtttttagtattcggggtcggagttgtttagagcggtcggggtcgtgtcggggtcggggtcggggtcggggaggggtcgcggcgaggttttttcggggcggtcgggtttttttttttggagtttttcgagtcgttcgcggaggcggtttagtttcggatttttagttcggcgcgtcgtaaaaatagt

SEQ ID NO: 19784 - DNA, 556 bp, Artificial Sequence
  chemically treated genomic DNA (Homo sapiens) CpG-island No: 19784
actatttttacgacgcgccgaactaaaaatccgaaactaaaccgcctccgcgaacgactcgaaaaactccaaaaaaaaaaacccgaccgccccgaaaaaacctcgccgcgacccctccccgaccccgaccccgaccccgacacgaccccgaccgctctaaacaactccgaccccgaatactaaaaactcgccccgccctccgaacgcaaccccgaaacccgcccgcccccgaaaccctacgctcccgaccgcgctcactcactaccgccgccgaaaactctaaaaaatcctaaaaacgccgaaaaaaaaactaccgccgctaaccgaaaaaacccgcgccgaatccccgcccgcccgccgatccgacccgcccgaaaataccctaaaacgaaaaacgtacgcccgaaaacgaacccgaccgaaacgaaacgatcgcgctaactcaaaactcaaaaatacgcgccgcccgcctacccgacccaaatcacctcctcccgaaaaaccgccgaactcccttctccccaaaatccgcctacgaaaacacctaaaactaaaa

SEQ ID NO: 19785 - DNA, 657 bp, Artificial Sequence
  chemically treated genomic DNA (Homo sapiens) CpG-island No: 19785
tcgttttcgtttcgtaggtatcgtatcgggttcgggaatcggttcggatttggcggtgggcgttgggaagaggatttatttttacgtggttcgtttcgtttcgggggcgtagttagttttcggcgtttattgttttttttttttcggttttcgtttttttttgcgtaggcgtcgtttcgtttcggttttaggggtgttttcgtggtcggcggttgttgggtttcgcgtcggggttcgagttttacgaagtttcggttcgagtcgtcggatgttcgcgcgtagcggggtttaggtgagcgcgcgtttcggtcgtttcgcggaatagacgcgtttatttttaggcgtagtagcgagcgcggtcgcgggagcgggagtgtcggggacgggcgtagcgtttatcgtttcgagggttcggggtagagttagagtataggttaagggttaagttcgggtcgagagtagtggtcgtagcgttcgggggttgaatttacggcgcgttggtagcgcgggtcgagttgcggagacggttacgttagcgttcgttttaggtcgattggtagttttcgttttatattaacgttagtattttcgttaaaaataatgtattttttttatgttaggaggatttaggtgttgttaaagattagtttttcgggt

SEQ ID NO: 19786 - DNA, 657 bp, Artificial Sequence
  chemically treated genomic DNA (Homo sapiens) CpG-island No: 19786
acccgaaaaactaatctttaacaacacctaaatcctcctaacataaaaaaaatacattatttttaacgaaaatactaacgttaatataaaacgaaaactaccaatcgacctaaaacgaacgctaacgtaaccgtctccgcaactcgacccgcgctaccaacgcgccgtaaattcaacccccgaacgctacgaccactactctcgacccgaacttaacccttaacctatactctaactctaccccgaaccctcgaaacgataaacgctacgcccgtccccgacactcccgctcccgcgaccgcgctcgctactacgcctaaaaataaacgcgtctattccgcgaaacgaccgaaacgcgcgctcacctaaaccccgctacgcgcgaacatccgacgactcgaaccgaaacttcgtaaaactcgaaccccgacgcgaaacccaacaaccgccgaccacgaaaacacccctaaaaccgaaacgaaacgacgcctacgcaaaaaaaaacgaaaaccgaaaaaaaaaaaacaataaacgccgaaaactaactacgcccccgaaacgaaacgaaccacgtaaaaataaatcctcttcccaacgcccaccgccaaatccgaaccgattcccgaacccgatacgatacctacgaaacgaaaacga

SEQ ID NO: 19787 - DNA, 657 bp, Artificial Sequence
  chemically treated genomic DNA (Homo sapiens) CpG-island No: 19787
attcggagggttggtttttagtagtatttaagtttttttggtatgggagagatgtattatttttaacgggagtgttgacgttaatgtagaacggagattgttagtcggtttggaacggacgttgacgtgatcgttttcgtagttcggttcgcgttgttagcgcgtcgtgggtttagttttcgggcgttgcggttattgttttcggttcgagtttggtttttggtttatgttttggttttgtttcgaattttcggggcggtgggcgttacgttcgttttcggtattttcgttttcgcggtcgcgttcgttgttgcgtttgggggtgggcgcgtttgtttcgcggggcggtcgaggcgcgcgtttatttgggtttcgttgcgcgcgggtattcggcggttcgggtcggggtttcgtgggattcggatttcggcgcggagtttagtagtcgtcgattacggaagtatttttaggatcggggcggagcggcgtttgcgtagaaggggacggaagtcgggagaaggggggtagtgagcgtcgggaattggttgcgttttcggggcggggcgggttacgtggaggtggattttttttttagcgtttatcgttaggttcggatcgattttcgggttcgatgcggtgtttgcgaggcgagagcgg

SEQ ID NO: 19788 - DNA, 657 bp, Artificial Sequence
  chemically treated genomic DNA (Homo sapiens) CpG-island No: 19788
ccgctctcgcctcgcaaacaccgcatcgaacccgaaaatcgatccgaacctaacgataaacgctaaaaaaaaaatccacctccacgtaacccgccccgccccgaaaacgcaaccaattcccgacgctcactaccccccttctcccgacttccgtccccttctacgcaaacgccgctccgccccgatcctaaaaatacttccgtaatcgacgactactaaactccgcgccgaaatccgaatcccacgaaaccccgacccgaaccgccgaatacccgcgcgcaacgaaacccaaataaacgcgcgcctcgaccgccccgcgaaacaaacgcgcccacccccaaacgcaacaacgaacgcgaccgcgaaaacgaaaataccgaaaacgaacgtaacgcccaccgccccgaaaattcgaaacaaaaccaaaacataaaccaaaaaccaaactcgaaccgaaaacaataaccgcaacgcccgaaaactaaacccacgacgcgctaacaacgcgaaccgaactacgaaaacgatcacgtcaacgtccgttccaaaccgactaacaatctccgttctacattaacgtcaacactcccgttaaaaataatacatctctcccataccaaaaaaacttaaatactactaaaaaccaaccctccgaat

SEQ ID NO: 19789 - DNA, 670 bp, Artificial Sequence
  chemically treated genomic DNA (Homo sapiens) CpG-island No: 19789
ttttatcgtttcgtgtttttgtttttcgttggagtttggtgcggtttcggtgtttagggggcgtttttttcgtatgtcggtttttaggattttttttcgcgttcgggggattcgtcgaagttttggtttagttcgttttgagggcgttcgttttttttttttggtacgtagaattcgttaaaagagagtatttcggggggcgacgggcgttttttatttatcggtaggtggtttagattcgtgatttttttgtttttttagtttttaggtttcgttatggtttcgaggagtcgaacgggagcgggcgattgaattgggtgcgcgtagagtttgaggtggaagcggatgaagagttgaagggaggagagaggaaggaggagggcgggagagaggagtttggggatcggggttcgtggcgtgggagatagaggaggggaaacgtgtagtgaaaagagttgggagtggagggaaatcggagtttgcgaggcgggaaagtaagttgggttaaggcgagagaggagtttgagcgttagttttggagacgaagaagttagaagggtgtttcgtgtcgagagcgttgtgtttgtttcgttagggtgcgttttttttagggtggggaggggggcggtgtaaggagaggggattcgggagtagttcgaaagggattggt

SEQ ID NO: 19790 - DNA, 670 bp, Artificial Sequence
  chemically treated genomic DNA (Homo sapiens) CpG-island No: 19790
accaatccctttcgaactactcccgaatcccctctccttacaccgcccccctccccaccctaaaaaaaacgcaccctaacgaaacaaacacaacgctctcgacacgaaacacccttctaacttcttcgtctccaaaactaacgctcaaactcctctctcgccttaacccaacttactttcccgcctcgcaaactccgatttccctccactcccaactcttttcactacacgtttcccctcctctatctcccacgccacgaaccccgatccccaaactcctctctcccgccctcctccttcctctctcctcccttcaactcttcatccgcttccacctcaaactctacgcgcacccaattcaatcgcccgctcccgttcgactcctcgaaaccataacgaaacctaaaaactaaaaaaacaaaaaaatcacgaatctaaaccacctaccgataaataaaaaacgcccgtcgccccccgaaatactctcttttaacgaattctacgtaccaaaaaaaaaaaacgaacgccctcaaaacgaactaaaccaaaacttcgacgaatcccccgaacgcgaaaaaaaatcctaaaaaccgacatacgaaaaaaacgccccctaaacaccgaaaccgcaccaaactccaacgaaaaacaaaaacacgaaacgataaaa

SEQ ID NO: 19791 - DNA, 670 bp, Artificial Sequence
  chemically treated genomic DNA (Homo sapiens) CpG-island No: 19791
attaatttttttcgagttgttttcgggttttttttttttgtatcgtttttttttttattttgaaagaggcgtattttgacggggtagatatagcgttttcgatacggagtatttttttagttttttcgtttttaggattgacgtttaggtttttttttcgttttagtttaatttgttttttcgtttcgtaaatttcggtttttttttatttttaattttttttattatacgtttttttttttttattttttacgttacgaatttcgatttttagatttttttttttcgtttttttttttttttttttttttttttaattttttattcgtttttattttagattttgcgcgtatttaatttagtcgttcgttttcgttcggtttttcgaagttatggcgggatttgggggttggagggatagggaggttacggatttgggttatttgtcggtgagtagaggacgttcgtcgtttttcgaaatgtttttttttggcgggttttgcgtattagagggagggagcggacgtttttaaaacgggttagattaggatttcgacgggtttttcgggcgcggaaggggattttgggagtcggtatgcggaaaaggcgttttttgggtatcgggatcgtattaaattttaacgaaaggtaaaggtacggggcggtggga

SEQ ID NO: 19792 - DNA, 670 bp, Artificial Sequence
  chemically treated genomic DNA (Homo sapiens) CpG-island No: 19792
tcccaccgccccgtacctttacctttcgttaaaatttaatacgatcccgatacccaaaaaacgccttttccgcataccgactcccaaaatccccttccgcgcccgaaaaacccgtcgaaatcctaatctaacccgttttaaaaacgtccgctccctccctctaatacgcaaaacccgccaaaaaaaaacatttcgaaaaacgacgaacgtcctctactcaccgacaaataacccaaatccgtaacctccctatccctccaacccccaaatcccgccataacttcgaaaaaccgaacgaaaacgaacgactaaattaaatacgcgcaaaatctaaaataaaaacgaataaaaaattaaaaaaaaaaaaaaaaaaaaaaaaaaacgaaaaaaaaaaatctaaaaatcgaaattcgtaacgtaaaaaataaaaaaaaaaaaacgtataataaaaaaaattaaaaataaaaaaaaaccgaaatttacgaaacgaaaaaacaaattaaactaaaacgaaaaaaaaacctaaacgtcaatcctaaaaacgaaaaaactaaaaaaatactccgtatcgaaaacgctatatctaccccgtcaaaatacgcctctttcaaaataaaaaaaaaaacgatacaaaaaaaaaaaacccgaaaacaactcgaaaaaaattaat

SEQ ID NO: 19793 - DNA, 511 bp, Artificial Sequence
  chemically treated genomic DNA (Homo sapiens) CpG-island No: 19793
tcgggtttttagcgcgttgggtttttgtatcgttttcgttttttttcgttcgggtagcggttttttcgggcgtttagtggtggtggagtcgggggagagggaaatttaatcggtcgttttgtgttagagataaaagcgggttgtcggttttattgtttgacggagttttttttttgttttttgttatcgtttcgtcgtttcgttttttcgtagttttggaggtttttttttcggttaggttcgggtttcgcgttcgttatggagaagacggagttgatttagaaggttaagttggtcgagcgttacgacgatatggttatttgtatgaaggtcgggattaagtagggcgtcgagttgtttaaggaggagcgtaatttgtttttcgtggtttataagaacgtggtcggggtcgtaggttcgtttggggcgttatttggagtatcgagtagaatatttatattttcgataagaagttgtagttgattaaggattattatatagttgttttgag

SEQ ID NO: 19794 - DNA, 511 bp, Artificial Sequence
  chemically treated genomic DNA (Homo sapiens) CpG-island No: 19794
ctcaaaacaactatataataatccttaatcaactacaacttcttatcgaaaatataaatattctactcgatactccaaataacgccccaaacgaacctacgaccccgaccacgttcttataaaccacgaaaaacaaattacgctcctccttaaacaactcgacgccctacttaatcccgaccttcatacaaataaccatatcgtcgtaacgctcgaccaacttaaccttctaaatcaactccgtcttctccataacgaacgcgaaacccgaacctaaccgaaaaaaaaacctccaaaactacgaaaaaacgaaacgacgaaacgataacaaaaaacaaaaaaaaaactccgtcaaacaataaaaccgacaacccgcttttatctctaacacaaaacgaccgattaaatttccctctcccccgactccaccaccactaaacgcccgaaaaaaccgctacccgaacgaaaaaaaacgaaaacgatacaaaaacccaacgcgctaaaaacccga

SEQ ID NO: 19795 - DNA, 511 bp, Artificial Sequence
  chemically treated genomic DNA (Homo sapiens) CpG-island No: 19795
tttaaagtaattgtatgatagtttttaattagttgtaattttttgtcggaggtgtaggtattttgttcgatgttttagatgacgttttaggcggatttgcggtttcgattacgtttttgtaggttacggaaagtaggttgcgtttttttttggatagttcggcgttttgtttggtttcggtttttatgtaggtggttatgtcgtcgtagcgttcggttaatttggttttttggattagtttcgttttttttatggcgggcgcggggttcgggtttggtcggggagggagtttttagagttgcggaggggcggggcggcgaggcgataataaaaagtagggagggagtttcgttagataatggggtcggtagttcgtttttatttttggtataaggcggtcggttgaatttttttttttttcgattttattattattgggcgttcggggaggtcgttgttcgggcgggaggaggcgggggcggtgtagaggtttagcgcgttgggagttcga

SEQ ID NO: 19796 - DNA, 511 bp, Artificial Sequence
  chemically treated genomic DNA (Homo sapiens) CpG-island No: 19796
tcgaactcccaacgcgctaaacctctacaccgcccccgcctcctcccgcccgaacaacgacctccccgaacgcccaataataataaaatcgaaaaaaaaaaaaattcaaccgaccgccttataccaaaaataaaaacgaactaccgaccccattatctaacgaaactccctccctactttttattatcgcctcgccgccccgcccctccgcaactctaaaaactccctccccgaccaaacccgaaccccgcgcccgccataaaaaaaacgaaactaatccaaaaaaccaaattaaccgaacgctacgacgacataaccacctacataaaaaccgaaaccaaacaaaacgccgaactatccaaaaaaaaacgcaacctactttccgtaacctacaaaaacgtaatcgaaaccgcaaatccgcctaaaacgtcatctaaaacatcgaacaaaatacctacacctccgacaaaaaattacaactaattaaaaactatcatacaattactttaaa

SEQ ID NO: 19797 - DNA, 989 bp, Artificial Sequence
  chemically treated genomic DNA (Homo sapiens) CpG-island No: 19797
tcggggtcgattttatttttcgcgttttaagtcgattcgtttttttagggtagggtttgttcgcgaatagttcggcgagacgagcgcggtcgcgtttttagtttcgggcgttcgggtttcggcgcggcggcggggtaggagtagattggtcgggtcgggcgtcgaacgcggcggcgcggggggggttgtaatcggtcgcggcgcgtttttttttagggtttgcgtcgttcgttcgcggtttcgcgggaaagaagcgtcggaaaaggtttcgtttcggtttggggcgcggggtcgggggcgcggggttaggggaggcgtttcgggaaggttacgggagcggaggcgcggcgagtggatcgcggcgcggtgggtgcggggagtcgaggcgggcggttttcgtcgtcgggagcgttcgtcggttttggtcgtcgtcgtcgttttcgagatgcgtcggtttttcggagcgttcggcgttcggagttgggcggtcgttgtagtcgtcgcgggtagtcgggcgtcgttggtcggagtcggcgcgcgattttcgtttttcgcgttcggttaggagtgggtcgtcgcgcgggaatcggtaggggcgggcgttggggttcgggtttcgggttggtttcgtcgttttcgcgtgtttagagcgtcggattcgtttagtagttgtagtgattgtgtgtttgtgttatgtttgtgtagtcgggggggatcgcgagtcggggttgggtttcgagcgggggcggggtcggcgttcgcgtcggcgttcgttttcgatttcgtgatcgagcggtcggttaatggtaagcgtcgtagtcgcgcggatcgagagttcgttttcgtataggtttcgtttttcggcgagatttcgtttcggtgtttttttagttcgttggttggtaggtaggcggaagtaatattcggagtcgggatttcgggtcgggtcgggatgaaagggtgtaagttgggagtttttcgtttttttt

SEQ ID NO: 19798 - DNA, 989 bp, Artificial Sequence
  chemically treated genomic DNA (Homo sapiens) CpG-island No: 19798
aaaaaaaacgaaaaactcccaacttacaccctttcatcccgacccgacccgaaatcccgactccgaatattacttccgcctacctaccaaccaacgaactaaaaaaacaccgaaacgaaatctcgccgaaaaacgaaacctatacgaaaacgaactctcgatccgcgcgactacgacgcttaccattaaccgaccgctcgatcacgaaatcgaaaacgaacgccgacgcgaacgccgaccccgcccccgctcgaaacccaaccccgactcgcgatcccccccgactacacaaacataacacaaacacacaatcactacaactactaaacgaatccgacgctctaaacacgcgaaaacgacgaaaccaacccgaaacccgaaccccaacgcccgcccctaccgattcccgcgcgacgacccactcctaaccgaacgcgaaaaacgaaaatcgcgcgccgactccgaccaacgacgcccgactacccgcgacgactacaacgaccgcccaactccgaacgccgaacgctccgaaaaaccgacgcatctcgaaaacgacgacgacgaccaaaaccgacgaacgctcccgacgacgaaaaccgcccgcctcgactccccgcacccaccgcgccgcgatccactcgccgcgcctccgctcccgtaaccttcccgaaacgcctcccctaaccccgcgcccccgaccccgcgccccaaaccgaaacgaaaccttttccgacgcttctttcccgcgaaaccgcgaacgaacgacgcaaaccctaaaaaaaaacgcgccgcgaccgattacaaccccccccgcgccgccgcgttcgacgcccgacccgaccaatctactcctaccccgccgccgcgccgaaacccgaacgcccgaaactaaaaacgcgaccgcgctcgtctcgccgaactattcgcgaacaaaccctaccctaaaaaaacgaatcgacttaaaacgcgaaaaataaaatcgaccccga

SEQ ID NO: 19799 - DNA, 989 bp, Artificial Sequence
  chemically treated genomic DNA (Homo sapiens) CpG-island No: 19799
aagaagggcggggagtttttagtttgtatttttttatttcgattcggttcgggatttcggtttcgggtgttgttttcgtttgtttgttagttagcgagttgaagaagtatcggggcggagtttcgtcggggggcggagtttgtgcgggggcgaattttcggttcgcgcggttgcggcgtttgttattggtcggtcgttcggttacggggtcgggggcgggcgtcgacgcgggcgtcggtttcgttttcgttcggaatttagtttcggttcgcggtttttttcggttgtatagatatgatatagatatatagttattgtagttgttgagcgagttcggcgttttgggtacgcggaggcggcggggttagttcggagttcggattttagcgttcgtttttgtcggttttcgcgcggcggtttatttttggtcgggcgcgggaggcggggatcgcgcgtcggtttcggttagcggcgttcggttgttcgcggcggttgtagcggtcgtttagtttcgagcgtcgggcgtttcgggaagtcggcgtatttcggaggcggcggcggcggttaaggtcggcgagcgttttcggcggcgggggtcgttcgtttcggtttttcgtatttatcgcgtcgcgatttattcgtcgcgttttcgttttcgtgattttttcggggcgttttttttagtttcgcgttttcggtttcgcgttttaggtcggggcgaggtttttttcggcgtttttttttcgcggagtcgcgggcgggcggcgtaggttttgggggagagcgcgtcgcggtcggttgtagtttttttcgcgtcgtcgcgttcggcgttcggttcggttagtttgtttttgtttcgtcgtcgcgtcggagttcgggcgttcgaagttgggggcgcggtcgcgttcgtttcgtcgggttgttcgcgggtaggttttgttttgaagggacgaatcggtttggagcgcgggaggtggagtcggtttcgg

SEQ ID NO: 19800 - DNA, 989 bp, Artificial Sequence
  chemically treated genomic DNA (Homo sapiens) CpG-island No: 19800
ccgaaaccgactccacctcccgcgctccaaaccgattcgtcccttcaaaacaaaacctacccgcgaacaacccgacgaaacgaacgcgaccgcgcccccaacttcgaacgcccgaactccgacgcgacgacgaaacaaaaacaaactaaccgaaccgaacgccgaacgcgacgacgcgaaaaaaactacaaccgaccgcgacgcgctctcccccaaaacctacgccgcccgcccgcgactccgcgaaaaaaaaacgccgaaaaaaacctcgccccgacctaaaacgcgaaaccgaaaacgcgaaactaaaaaaaacgccccgaaaaaatcacgaaaacgaaaacgcgacgaataaatcgcgacgcgataaatacgaaaaaccgaaacgaacgacccccgccgccgaaaacgctcgccgaccttaaccgccgccgccgcctccgaaatacgccgacttcccgaaacgcccgacgctcgaaactaaacgaccgctacaaccgccgcgaacaaccgaacgccgctaaccgaaaccgacgcgcgatccccgcctcccgcgcccgaccaaaaataaaccgccgcgcgaaaaccgacaaaaacgaacgctaaaatccgaactccgaactaaccccgccgcctccgcgtacccaaaacgccgaactcgctcaacaactacaataactatatatctatatcatatctatacaaccgaaaaaaaccgcgaaccgaaactaaattccgaacgaaaacgaaaccgacgcccgcgtcgacgcccgcccccgaccccgtaaccgaacgaccgaccaataacaaacgccgcaaccgcgcgaaccgaaaattcgcccccgcacaaactccgccccccgacgaaactccgccccgatacttcttcaactcgctaactaacaaacaaacgaaaacaacacccgaaaccgaaatcccgaaccgaatcgaaataaaaaaatacaaactaaaaactccccgcccttctt

SEQ ID NO: 19801 - DNA, 513 bp, Artificial Sequence
  chemically treated genomic DNA (Homo sapiens) CpG-island No: 19801
ggtacgggcgggcgggaattggaggtcgcgcgggcggttttatagtttcgggtcgggttagggcggcggttgcgggggcggtcgggttggggtcgggtcggggtttgattgatcggtcggtgatttttcgtagaggatttcgtgttttagtttaagggtatgtgttattttattaacgggatcgagcgcgtgcggggtgtgattagatatatttataatcgagaggagtacgcgcgtttcgatagcgacgtgggggtgtatcgggcggtgacgtcgttggggcggtttgacgtcgagtattggaatagttagaaggatattttggaggaggatcgggcgtcggtggatatcgtatgtagatataattattagttggagtttcgtacgattttgtagcggcgaggtgagcgtcgtcgttcgtttgcgaggtttatttttggtaggggtttagagtttttgcgttaggaggggcgaagggggcgcggtttttggaatttgagttttgttcgtttt

SEQ ID NO: 19802 - DNA, 513 bp, Artificial Sequence
  chemically treated genomic DNA (Homo sapiens) CpG-island No: 19802
aaaacgaacaaaactcaaattccaaaaaccgcgcccccttcgcccctcctaacgcaaaaactctaaacccctaccaaaaataaacctcgcaaacgaacgacgacgctcacctcgccgctacaaaatcgtacgaaactccaactaataattatatctacatacgatatccaccgacgcccgatcctcctccaaaatatccttctaactattccaatactcgacgtcaaaccgccccaacgacgtcaccgcccgatacacccccacgtcgctatcgaaacgcgcgtactcctctcgattataaatatatctaatcacaccccgcacgcgctcgatcccgttaataaaataacacatacccttaaactaaaacacgaaatcctctacgaaaaatcaccgaccgatcaatcaaaccccgacccgaccccaacccgaccgcccccgcaaccgccgccctaacccgacccgaaactataaaaccgcccgcgcgacctccaattcccgcccgcccgtacc

SEQ ID NO: 19803 - DNA, 513 bp, Artificial Sequence
  chemically treated genomic DNA (Homo sapiens) CpG-island No: 19803
ggaacgaataaggtttaggttttagaggtcgcgtttttttcgttttttttggcgtagagattttgggtttttgttaaggatgggtttcgtagacgggcgacgacgtttatttcgtcgttgtaaggtcgtgcggagttttaattggtagttgtgtttgtatacggtgtttatcgacgttcggtttttttttaggatgtttttttggttattttagtattcggcgttaagtcgttttagcggcgttatcgttcgatatatttttacgtcgttgtcgaagcgcgcgtatttttttcggttatagatgtatttggttatatttcgtacgcgttcggtttcgttggtgaagtagtatatgtttttaaattggaatacgaaattttttgcggggaattatcggtcggttagttaggtttcggttcggttttagttcggtcgttttcgtagtcgtcgttttgattcggttcggagttgtggaatcgttcgcgcgatttttagttttcgttcgttcgtgtt

SEQ ID NO: 19804 - DNA, 513 bp, Artificial Sequence
  chemically treated genomic DNA (Homo sapiens) CpG-island No: 19804
aacacgaacgaacgaaaactaaaaatcgcgcgaacgattccacaactccgaaccgaatcaaaacgacgactacgaaaacgaccgaactaaaaccgaaccgaaacctaactaaccgaccgataattccccgcaaaaaatttcgtattccaatttaaaaacatatactacttcaccaacgaaaccgaacgcgtacgaaatataaccaaatacatctataaccgaaaaaaatacgcgcgcttcgacaacgacgtaaaaatatatcgaacgataacgccgctaaaacgacttaacgccgaatactaaaataaccaaaaaaacatcctaaaaaaaaaccgaacgtcgataaacaccgtatacaaacacaactaccaattaaaactccgcacgaccttacaacgacgaaataaacgtcgtcgcccgtctacgaaacccatccttaacaaaaacccaaaatctctacgccaaaaaaaacgaaaaaaacgcgacctctaaaacctaaaccttattcgttcc

SEQ ID NO: 19805 - DNA, 501 bp, Artificial Sequence
  chemically treated genomic DNA (Homo sapiens) CpG-island No: 19805
gatatttatttcgtcgggaaggcgtcgatgtcgggttattgttcggggggttgtcgcgggcgggggcggttcgtcggggcggatgtcggaggattcgcggagtcgttcggcgcgttagtttttttcggtttagtcgtcgtcgtcgtcgtcgtcgtcgcgtttcgttcggtttcggtcgggttttggttttgggttttcgtcgtcgtcgtcgtcgtcgtcgtcgtttttttttcggtttttgttcgttcgttcgttttcgtcgtcggttcgcgcgttttcgtatcgcgcgcgttcgtcggtttttattgagtttcgggttcgttcgttgatgttattttcggttcgtcgtcgtcgtttcggaggatttaaagggttcgcgtttttcgcgttgggggtcgtagttgcgagacgtagttttttagttttagtgtaggcgcgcgggtttacgcgtgggggtgggggagtatatagatattgatattttaatgtagtttagggtat

SEQ ID NO: 19806 - DNA, 501 bp, Artificial Sequence
  chemically treated genomic DNA (Homo sapiens) CpG-island No: 19806
ataccctaaactacattaaaatatcaatatctatatactcccccacccccacgcgtaaacccgcgcgcctacactaaaactaaaaaactacgtctcgcaactacgacccccaacgcgaaaaacgcgaaccctttaaatcctccgaaacgacgacgacgaaccgaaaataacatcaacgaacgaacccgaaactcaataaaaaccgacgaacgcgcgcgatacgaaaacgcgcgaaccgacgacgaaaacgaacgaacgaacaaaaaccgaaaaaaaaacgacgacgacgacgacgacgacgacgaaaacccaaaaccaaaacccgaccgaaaccgaacgaaacgcgacgacgacgacgacgacgacgactaaaccgaaaaaaactaacgcgccgaacgactccgcgaatcctccgacatccgccccgacgaaccgcccccgcccgcgacaaccccccgaacaataacccgacatcgacgccttcccgacgaaataaatatc

SEQ ID NO: 19807 - DNA, 501 bp, Artificial Sequence
  chemically treated genomic DNA (Homo sapiens) CpG-island No: 19807
gtgttttggattgtattagggtgttagtatttgtgtgtttttttatttttacgcgtaagttcgcgcgtttgtattgaggttggggaattgcgtttcgtagttgcggtttttagcgcggagggcgcgggttttttaaatttttcggggcggcggcggcgggtcggggatgatattagcgggcgggttcggggtttaatgggagtcggcgggcgcgcgcggtgcgagagcgcgcgagtcggcggcgggggcgggcgggcgggtagaagtcgggagaggagcggcggcggcggcggcggcggcggcgagagtttagagttagagttcggtcggggtcgagcggagcgcggcggcggcggcggcggcggcggttgggtcgggagaggttggcgcgtcgggcggtttcgcgaatttttcggtattcgtttcggcgggtcgttttcgttcgcggtagtttttcgagtagtggttcggtatcggcgttttttcggcggggtaaatatt

SEQ ID NO: 19808 - DNA, 501 bp, Artificial Sequence
  chemically treated genomic DNA (Homo sapiens) CpG-island No: 19808
aatatttaccccgccgaaaaaacgccgataccgaaccactactcgaaaaactaccgcgaacgaaaacgacccgccgaaacgaataccgaaaaattcgcgaaaccgcccgacgcgccaacctctcccgacccaaccgccgccgccgccgccgccgccgcgctccgctcgaccccgaccgaactctaactctaaactctcgccgccgccgccgccgccgccgccgctcctctcccgacttctacccgcccgcccgcccccgccgccgactcgcgcgctctcgcaccgcgcgcgcccgccgactcccattaaaccccgaacccgcccgctaatatcatccccgacccgccgccgccgccccgaaaaatttaaaaaacccgcgccctccgcgctaaaaaccgcaactacgaaacgcaattccccaacctcaatacaaacgcgcgaacttacgcgtaaaaataaaaaaacacacaaatactaacaccctaatacaatccaaaacac

SEQ ID NO: 19809 - DNA, 1301 bp, Artificial Sequence
  chemically treated genomic DNA (Homo sapiens) CpG-island No: 19809
gaatttttttcgatagaggttcgcgtagtgttgtgttttttttcgggattagaatttttttcgatagaggttcgcgtagtgttgtgttttttttcgggattagaatttttttttatagaggttcgcgtagtgtcgtgttttttttcgggattagaatttttttttgatagaggttcgcgtagtgtcgtgttttttttcgggattagaatttttttttatagaggttcgcgtagtgtcgtgttttttttcgggattagaatttttttttgatagaggttcgcgtagtgtcgtgttttttttcgggattagaatttttttttatagaggttcgcgtagtgtcgtgttttttttcgggattagaatttttttttatagaggttcgcgtagtgtcgtgttttttttcgggattagaatttttttttgatagaggttcgcgtagtgtcgtgttttttttcgggattagaatttttttttatagaggttcgcgtagtgttgtgttttttttcggggttagaatttttttttatagaggttcgcgtagtgttgtgttttttttcgggattagaatttttttttgatagaggttcgcgtagtgtcgtgttttttttcgggattagaatttttttttatagaggttcgcgtagtgttgtgttttttttcggggttagaatttttttttatagaggttcgcgtagtgttgtgttttttttcgggattagaatttttttttgatagaggttcgcgtagtgtcgtgttttttttcgggattagaatttttttttatagaggttcgcgtagtgttgtgttttttttcggggttagaatttttttttataaaagttcgcgtagtgttgtgttttttttcgggattagaatttttttttgatagaggttcgcgtagtgttgtgttttttttcgggattagaatttttttttatagaggttcgcgtagtgttgtgttttttttcgggattagaatttttttttatagaggttcgcgtagtgtcgtgtttttttttgggattagaatttttttttatagaggttcgcgtagtgttgtgttttttttcgggattagaatttttttttgatagaggttcgcgtagtgtcgtgttttttttcgggattagaatttttttttatagaggttcgcgtagtgttgtgttttttttcggggttagaatttttttttatagaggttcgcgtagtgttgtgttttttttcgggattagaatttttttttgatagaggttcgcgtagtgttgtgttttttttcgggattagaatttttttttatagag

SEQ ID NO: 19810 - DNA, 1301 bp, Artificial Sequence
  chemically treated genomic DNA (Homo sapiens) CpG-island No: 19810
ctctataaaaaaaaattctaatcccgaaaaaaaacacaacactacgcgaacctctatcaaaaaaaaattctaatcccgaaaaaaaacacaacactacgcgaacctctataaaaaaaaattctaaccccgaaaaaaaacacaacactacgcgaacctctataaaaaaaaattctaatcccgaaaaaaaacacgacactacgcgaacctctatcaaaaaaaaattctaatcccgaaaaaaaacacaacactacgcgaacctctataaaaaaaaattctaatcccaaaaaaaaacacgacactacgcgaacctctataaaaaaaaattctaatcccgaaaaaaaacacaacactacgcgaacctctataaaaaaaaattctaatcccgaaaaaaaacacaacactacgcgaacctctatcaaaaaaaaattctaatcccgaaaaaaaacacaacactacgcgaacttttataaaaaaaaattctaaccccgaaaaaaaacacaacactacgcgaacctctataaaaaaaaattctaatcccgaaaaaaaacacgacactacgcgaacctctatcaaaaaaaaattctaatcccgaaaaaaaacacaacactacgcgaacctctataaaaaaaaattctaaccccgaaaaaaaacacaacactacgcgaacctctataaaaaaaaattctaatcccgaaaaaaaacacgacactacgcgaacctctatcaaaaaaaaattctaatcccgaaaaaaaacacaacactacgcgaacctctataaaaaaaaattctaaccccgaaaaaaaacacaacactacgcgaacctctataaaaaaaaattctaatcccgaaaaaaaacacgacactacgcgaacctctatcaaaaaaaaattctaatcccgaaaaaaaacacgacactacgcgaacctctataaaaaaaaattctaatcccgaaaaaaaacacgacactacgcgaacctctataaaaaaaaattctaatcccgaaaaaaaacacgacactacgcgaacctctatcaaaaaaaaattctaatcccgaaaaaaaacacgacactacgcgaacctctataaaaaaaaattctaatcccgaaaaaaaacacgacactacgcgaacctctatcaaaaaaaaattctaatcccgaaaaaaaacacgacactacgcgaacctctataaaaaaaaattctaatcccgaaaaaaaacacaacactacgcgaacctctatcgaaaaaaattctaatcccgaaaaaaaacacaacactacgcgaacctctatcgaaaaaaattc

SEQ ID NO: 19811 - DNA, 1301 bp, Artificial Sequence
  chemically treated genomic DNA (Homo sapiens) CpG-island No: 19811
ttttatggaaaaggattttggtttcgggaaggggtatagtattgcgcggatttttattaaaaaaggattttggtttcgggaaggggtatagtattgcgcggatttttatggaaaaggattttggtttcgggaaggggtatagtattgcgcggatttttatggaaaaggattttggtttcgggaaggggtacggtattgcgcggatttttattaaaaaaggattttggtttcgggaaggggtatagtattgcgcggatttttatggaaaaggattttggttttaggaaggggtacggtattgcgcggatttttatggaaaaggattttggtttcgggaaggggtatagtattgcgcggatttttatggaaaaggattttggtttcgggaaggggtatagtattgcgcggatttttattaaaaaaggattttggtttcgggaaggggtatagtattgcgcggatttttatggaaaaggattttggtttcgggaaggggtatagtattgcgcggatttttatggaaaaggattttggtttcgggaaggggtacggtattgcgcggatttttattaaaaaaggattttggtttcgggaaggggtatagtattgcgcggatttttatggaaaaggattttggtttcgggaaggggtatagtattgcgcggatttttatggaaaaggattttggtttcgggaaggggtacggtattgcgcggatttttattaaaaaaggattttggtttcgggaaggggtatagtattgcgcggatttttatggaaaaggattttggtttcgggaaggggtatagtattgcgcggatttttatggaaaaggattttggtttcgggaaggggtacggtattgcgcggatttttattaaaaaaggattttggtttcgggaaggggtacggtattgcgcggatttttatggaaaaggattttggtttcgggaaggggtacggtattgcgcggatttttatggaaaaggattttggtttcgggaaggggtacggtattgcgcggatttttattaaaaaaggattttggtttcgggaaggggtacggtattgcgcggatttttatggaaaaggattttggtttcgggaaggggtacggtattgcgcggatttttattaaaaaaggattttggtttcgggaaggggtacggtattgcgcggatttttatggaaaaggattttggtttcgggaaggggtatagtattgcgcggatttttatcgaaaaggattttggtttcgggaaggggtatagtattgcgcggatttttatcgaaaaggattt

SEQ ID NO: 19812 - DNA, 1301 bp, Artificial Sequence
  chemically treated genomic DNA (Homo sapiens) CpG-island No: 19812
aaatccttttcgataaaaatccgcgcaatactataccccttcccgaaaccaaaatccttttcgataaaaatccgcgcaatactataccccttcccgaaaccaaaatccttttccataaaaatccgcgcaataccgtaccccttcccgaaaccaaaatccttttttaataaaaatccgcgcaataccgtaccccttcccgaaaccaaaatccttttccataaaaatccgcgcaataccgtaccccttcccgaaaccaaaatccttttttaataaaaatccgcgcaataccgtaccccttcccgaaaccaaaatccttttccataaaaatccgcgcaataccgtaccccttcccgaaaccaaaatccttttccataaaaatccgcgcaataccgtaccccttcccgaaaccaaaatccttttttaataaaaatccgcgcaataccgtaccccttcccgaaaccaaaatccttttccataaaaatccgcgcaatactataccccttcccgaaaccaaaatccttttccataaaaatccgcgcaatactataccccttcccgaaaccaaaatccttttttaataaaaatccgcgcaataccgtaccccttcccgaaaccaaaatccttttccataaaaatccgcgcaatactataccccttcccgaaaccaaaatccttttccataaaaatccgcgcaatactataccccttcccgaaaccaaaatccttttttaataaaaatccgcgcaataccgtaccccttcccgaaaccaaaatccttttccataaaaatccgcgcaatactataccccttcccgaaaccaaaatccttttccataaaaatccgcgcaatactataccccttcccgaaaccaaaatccttttttaataaaaatccgcgcaatactataccccttcccgaaaccaaaatccttttccataaaaatccgcgcaatactataccccttcccgaaaccaaaatccttttccataaaaatccgcgcaataccgtaccccttcctaaaaccaaaatccttttccataaaaatccgcgcaatactataccccttcccgaaaccaaaatccttttttaataaaaatccgcgcaataccgtaccccttcccgaaaccaaaatccttttccataaaaatccgcgcaatactataccccttcccgaaaccaaaatccttttccataaaaatccgcgcaatactataccccttcccgaaaccaaaatccttttttaataaaaatccgcgcaatactataccccttcccgaaaccaaaatccttttccataaaa

SEQ ID NO: 19813 - DNA, 780 bp, Artificial Sequence
  chemically treated genomic DNA (Homo sapiens) CpG-island No: 19813
tcgtgttatatattttttttacgttatatattttttttacgttatatatttttttttttacgttatatattttttttacgttatatattttttttacgttatatattttttttacgttatatatttttttatgttatatattttttttacgttttttacgttatatattttttttacgttatatattttttttacgttatatattttttttacgttatatatttttttacgttatatattttttttacgttatatatttttttttttacgttatatattttttttacgttatatattttttttacgttatatattttttttacgttatatatttttttatgttatatattttttttacgttttttacgttatatattttttttacgttatatattttttttacgttatatattttttttacgttatatatttttttacgttatatattttttttacgttatatattttttttatattatatattttttttatgttttttatgttatataagtttttttacgttatatatttttttttacgttatatattttttttacgttttttatgttatatattttttttacgttatatatttttttttacgttatatatttttttttatgttttttacgttatatattttttttacgttttttatattatatattttttttacgttatatattttttttatgttatataattttttttattttatatatttttttttacgttatatatttttttatgtcgtatatttttttttaagttatataattg

SEQ ID NO: 19814 - DNA, 780 bp, Artificial Sequence
  chemically treated genomic DNA (Homo sapiens) CpG-island No: 19814
caattatataacttaaaaaaaaatatacgacataaaaaaatatataacgtaaaaaaaaatatataaaataaaaaaaattatataacataaaaaaaatatataacgtaaaaaaaatatataatataaaaaacgtaaaaaaaatatataacgtaaaaaacataaaaaaaaatatataacgtaaaaaaaaatatataacgtaaaaaaaatatataacataaaaaacgtaaaaaaaatatataacgtaaaaaaaaatatataacgtaaaaaaacttatataacataaaaaacataaaaaaaatatataatataaaaaaaatatataacgtaaaaaaaatatataacgtaaaaaaatatataacgtaaaaaaaatatataacgtaaaaaaaatatataacgtaaaaaaaatatataacgtaaaaaacgtaaaaaaaatatataacataaaaaaatatataacgtaaaaaaaatatataacgtaaaaaaaatatataacgtaaaaaaaatatataacgtaaaaaaaaaaatatataacgtaaaaaaaatatataacgtaaaaaaatatataacgtaaaaaaaatatataacgtaaaaaaaatatataacgtaaaaaaaatatataacgtaaaaaacgtaaaaaaaatatataacataaaaaaatatataacgtaaaaaaaatatataacgtaaaaaaaatatataacgtaaaaaaaatatataacgtaaaaaaaaaaatatataacgtaaaaaaaatatataacgtaaaaaaaatatataacacga

SEQ ID NO: 19815 - DNA, 780 bp, Artificial Sequence
  chemically treated genomic DNA (Homo sapiens) CpG-island No: 19815
tagttgtatggtttgggagggggtgtacggtatggaggggtgtatggcgtgggagggggtgtatggggtgggaggggttgtatggtataggaggggtgtatggcgtgggaggggtgtatggtgtgggaggcgtgggaggggtatatggcgtgggaggtatgggaaggggtgtatggcgtgggagggggtgtatggcgtgggaggggtgtatggtatgggaggcgtgggagggatgtatggcgtgggagggggtgtatggcgtgggagggtttgtatggtatgggaggtatgggaggagtgtatggtgtgggaggggtgtatggcgtgggaggggtgtatggcgtgggagggtgtatggcgtgggaggggtatatggcgtgggaggggtgtatggcgtgggaggggtgtatggcgtgggaggcgtgggaggggtgtatggtatgggagggtgtatggcgtgggaggggtgtatggcgtgggaggagtgtatggcgtgggaggggtgtatggcgtgggagggagggtgtatggcgtgggaggggtgtatggcgtgggagggtgtatggcgtgggaggggtatatggcgtgggaggggtgtatggcgtgggaggggtgtatggcgtgggaggcgtgggaggggtgtatggtatgggagggtgtatggcgtgggaggggtgtatggcgtgggaggagtgtatggcgtgggaggggtgtatggcgtgggagggagggtgtatggcgtgggaggggtgtatggcgtgggaggggtgtatggtacgg

SEQ ID NO: 19816 - DNA, 780 bp, Artificial Sequence
  chemically treated genomic DNA (Homo sapiens) CpG-island No: 19816
ccgtaccatacacccctcccacgccatacacccctcccacgccatacaccctccctcccacgccatacacccctcccacgccatacactcctcccacgccatacacccctcccacgccatacaccctcccataccatacacccctcccacgcctcccacgccatacacccctcccacgccatacacccctcccacgccatatacccctcccacgccatacaccctcccacgccatacacccctcccacgccatacaccctccctcccacgccatacacccctcccacgccatacactcctcccacgccatacacccctcccacgccatacaccctcccataccatacacccctcccacgcctcccacgccatacacccctcccacgccatacacccctcccacgccatatacccctcccacgccatacaccctcccacgccatacacccctcccacgccatacacccctcccacaccatacactcctcccatacctcccataccatacaaaccctcccacgccatacaccccctcccacgccatacatccctcccacgcctcccataccatacacccctcccacgccatacaccccctcccacgccatacaccccttcccatacctcccacgccatatacccctcccacgcctcccacaccatacacccctcccacgccatacacccctcctataccatacaacccctcccaccccatacaccccctcccacgccatacacccctccataccgtacaccccctcccaaaccatacaacta

SEQ ID NO: 19817 - DNA, 690 bp, Artificial Sequence
  chemically treated genomic DNA (Homo sapiens) CpG-island No: 19817
ggtttatacggttttttttggcgtcgagatttagttttttcgggttatttcggttaggtacgattagtagggttatttgcgcgcgtttttcgagacggggttttttgatgtgaagcgattttagtggtattttatacgattttcgagggttgcgggcggtttttttttagttttgtagtttttatacgcggatatcgcgggtttcggttatgtttattgatcgatttttttcgtcggaatttttcgcgtatcgtcggttttttagcggcgattagcgcgcgaatattttggaagacgcgttgtcggttttacgtgagtcgacgttttaaagcgcggttgttggcgtcggttacgagattaaggtcggcgcgtgcgcgtttgcgcgagatcggtatttttagtttcgcgtcggtttttagggagttgggcgtatgcgtcgcgtaaggggttcggtcggcggaaggaggtgttattgtcggaagcgtcggcgcgtttgcgtagtagttgaacgcgggcgttttttttttttttttttttcgaattggttttgggggtagattcgagttataaaatggtcgttcggagcgtgttcggcgcggtttttttagttgtttttggttgaatcggcgttttcgtttttttgtcgaatatagcgtgaggagtttttttagggatatggtgtttgagttt

SEQ ID NO: 19818 - DNA, 690 bp, Artificial Sequence
  chemically treated genomic DNA (Homo sapiens) CpG-island No: 19818
aaactcaaacaccatatccctaaaaaaactcctcacgctatattcgacaaaaaaacgaaaacgccgattcaaccaaaaacaactaaaaaaaccgcgccgaacacgctccgaacgaccattttataactcgaatctacccccaaaaccaattcgaaaaaaaaaaaaaaaaaaaacgcccgcgttcaactactacgcaaacgcgccgacgcttccgacaataacacctccttccgccgaccgaaccccttacgcgacgcatacgcccaactccctaaaaaccgacgcgaaactaaaaataccgatctcgcgcaaacgcgcacgcgccgaccttaatctcgtaaccgacgccaacaaccgcgctttaaaacgtcgactcacgtaaaaccgacaacgcgtcttccaaaatattcgcgcgctaatcgccgctaaaaaaccgacgatacgcgaaaaattccgacgaaaaaaatcgatcaataaacataaccgaaacccgcgatatccgcgtataaaaactacaaaactaaaaaaaaaccgcccgcaaccctcgaaaatcgtataaaataccactaaaatcgcttcacatcaaaaaaccccgtctcgaaaaacgcgcgcaaataaccctactaatcgtacctaaccgaaataacccgaaaaaactaaatctcgacgccaaaaaaaaccgtataaacc

SEQ ID NO: 19819 - DNA, 690 bp, Artificial Sequence
  chemically treated genomic DNA (Homo sapiens) CpG-island No: 19819
agatttaaatattatatttttgggggggttttttacgttgtgttcggtagggaggcgagagcgtcggtttagttagagatagttgggggaatcgcgtcgaatacgtttcgggcggttattttgtaattcgaatttatttttaaaattaattcgaaaaaaagggaggaaagaaacgttcgcgtttagttattgcgtaagcgcgtcggcgttttcggtagtagtattttttttcgtcggtcgggttttttacgcggcgtatgcgtttagttttttggaaatcggcgcggggttgagaatgtcggtttcgcgtaagcgcgtacgcgtcgattttgatttcgtagtcggcgttagtagtcgcgttttggggcgtcggtttacgtggggtcggtaacgcgttttttaggatgttcgcgcgttagtcgtcgttgaggggtcggcgatgcgcgaggagtttcggcgaggaaggtcggttagtggatatggtcgaggttcgcggtgttcgcgtgtgggagttgtagggttgaggagaggtcgttcgtaattttcgggaatcgtgtgaggtgttattggggtcgttttatattaggaggtttcgtttcgggggacgcgcgtaggtgattttgttggtcgtatttggtcggggtggttcggaggggttgggtttcggcgttaggaggggtcgtgtgggtt

SEQ ID NO: 19820 - DNA, 690 bp, Artificial Sequence
  chemically treated genomic DNA (Homo sapiens) CpG-island No: 19820
aacccacacgacccctcctaacgccgaaacccaacccctccgaaccaccccgaccaaatacgaccaacaaaatcacctacgcgcgtcccccgaaacgaaacctcctaatataaaacgaccccaataacacctcacacgattcccgaaaattacgaacgacctctcctcaaccctacaactcccacacgcgaacaccgcgaacctcgaccatatccactaaccgaccttcctcgccgaaactcctcgcgcatcgccgacccctcaacgacgactaacgcgcgaacatcctaaaaaacgcgttaccgaccccacgtaaaccgacgccccaaaacgcgactactaacgccgactacgaaatcaaaatcgacgcgtacgcgcttacgcgaaaccgacattctcaaccccgcgccgatttccaaaaaactaaacgcatacgccgcgtaaaaaacccgaccgacgaaaaaaaatactactaccgaaaacgccgacgcgcttacgcaataactaaacgcgaacgtttctttcctccctttttttcgaattaattttaaaaataaattcgaattacaaaataaccgcccgaaacgtattcgacgcgattcccccaactatctctaactaaaccgacgctctcgcctccctaccgaacacaacgtaaaaaacccccccaaaaatataatatttaaatct

SEQ ID NO: 19821 - DNA, 1060 bp, Artificial Sequence
  chemically treated genomic DNA (Homo sapiens) CpG-island No: 19821
atcgcgttttttttatcggtttcgtagttttttgttcggtttttttttttttatttttatttttgcggcggtaaaatgtagtattcgtagagcgtttgcgcggtttttaggtcgggcggcggcggcggcggtggttatttatagtaggtgacgttattttgaaatagatcgttagggtcggttcgtttttttttttttttattttcgtcgtttttcgtcgttcggtttggttatttttattgcgtaggcgtcgtttcgtttttttattttttagcgcggtcgcgttttttttttcggcgttgttcgcggcgcgagttatagcgcgcggggcgagttagcgagagggcgcgagcggcggcgttgtttgtagtttgtagtttgtagttttcggtcggtcggcgagttagtgcgcgtgcgcggcggcggttttcgtagcgatcggggagcggattgatcggcgggagggttagcgagttagcggtgtgaggcgcgaggcgaggtcgagtcgcgagcgatatgggggatcgggagtagttgttgtagcgggcgcggttggtcgagtaggcggagcgttacgacgatatggttttcgttatgaaggcggtgagcgcgtcgggagttcgggcggttggtcggggggggtttggcgttggggagggacggggatggtcgcgggcgcgtttttttttcggttatgggcgattcggcgattcggttgggcgtggtcgttcgttcgtttttagttcgcgtttttcgttttcgttgggcgtttcgttattttttgaggttgggtttagggtgggggattcgggagggtgtagttcgggatcgcgaaggtagtttcggaaggggggcgggtcggtcggggtcgttatattttagttcggaattcggtcgggggtagagggtgttttaggggacgcgaaggagtcgtattttttttagagcgttttatcggattcgggggttttttttttcgttttttttcgttttttaatttggaataaagaattatttagtaagtggcgttttgttttagttggttttttttgttacgatt

SEQ ID NO: 19822 - DNA, 1060 bp, Artificial Sequence
  chemically treated genomic DNA (Homo sapiens) CpG-island No: 19822
aatcgtaacaaaaaaaaccaactaaaacaaaacgccacttactaaataattctttattccaaattaaaaaacgaaaaaaaacgaaaaaaaaaacccccgaatccgataaaacgctctaaaaaaaatacgactccttcgcgtcccctaaaacaccctctacccccgaccgaattccgaactaaaatataacgaccccgaccgacccgccccccttccgaaactaccttcgcgatcccgaactacaccctcccgaatcccccaccctaaacccaacctcaaaaaataacgaaacgcccaacgaaaacgaaaaacgcgaactaaaaacgaacgaacgaccacgcccaaccgaatcgccgaatcgcccataaccgaaaaaaaaacgcgcccgcgaccatccccgtccctccccaacgccaaaccccccccgaccaaccgcccgaactcccgacgcgctcaccgccttcataacgaaaaccatatcgtcgtaacgctccgcctactcgaccaaccgcgcccgctacaacaactactcccgatcccccatatcgctcgcgactcgacctcgcctcgcgcctcacaccgctaactcgctaaccctcccgccgatcaatccgctccccgatcgctacgaaaaccgccgccgcgcacgcgcactaactcgccgaccgaccgaaaactacaaactacaaactacaaacaacgccgccgctcgcgccctctcgctaactcgccccgcgcgctataactcgcgccgcgaacaacgccgaaaaaaaaaacgcgaccgcgctaaaaaataaaaaaacgaaacgacgcctacgcaataaaaataaccaaaccgaacgacgaaaaacgacgaaaataaaaaaaaaaaaaaacgaaccgaccctaacgatctatttcaaaataacgtcacctactataaataaccaccgccgccgccgccgcccgacctaaaaaccgcgcaaacgctctacgaatactacattttaccgccgcaaaaataaaaataaaaaaaaaaaaaccgaacaaaaaactacgaaaccgataaaaaaaacgcgat

SEQ ID NO: 19823 - DNA, 1060 bp, Artificial Sequence
  chemically treated genomic DNA (Homo sapiens) CpG-island No: 19823
ggtcgtggtagagaaaattagttgagatagggcgttatttattaggtgattttttattttaagttggggaacggaggaagacgagagggggagttttcgggttcggtgaaacgttttaggagaaatgcggttttttcgcgttttttagggtattttttgttttcggtcgggtttcgaattaagatgtggcgatttcgatcggttcgtttttttttcggggttgttttcgcgatttcgaattgtattttttcggattttttattttgggtttagttttaggaagtggcggggcgtttagcgggagcgggaagcgcgggttaagggcgggcgggcggttacgtttagtcgggtcgtcgggtcgtttatggtcgggaggggaacgcgttcgcggttattttcgtttttttttaacgttaggtttttttcggttagtcgttcgggttttcggcgcgtttatcgtttttatagcggaggttatgtcgtcgtagcgtttcgtttgttcggttagtcgcgttcgttgtagtagttgttttcggttttttatgtcgttcgcggttcggtttcgtttcgcgttttatatcgttggttcgttagttttttcgtcggttagttcgtttttcggtcgttgcggaggtcgtcgtcgcgtacgcgtattggttcgtcggtcggtcggaggttgtaggttgtaggttgtaggtagcgtcgtcgttcgcgttttttcgttggttcgtttcgcgcgttgtggttcgcgtcgcggataacgtcgagggaggagacgcggtcgcgttgggggatgggaggacgggacgacgtttgcgtagtgagagtggttaggtcgggcggcggggagcggcgggagtgggaggggggaagggcgggtcggttttaacggtttattttaaggtgacgttatttattataaatagttatcgtcgtcgtcgtcgttcggtttgaaagtcgcgtaggcgttttgcgagtgttgtattttatcgtcgtagagatggaggtggagaagggaaagtcgggtaggagattgcggagtcggtggagggggcgcggt

SEQ ID NO: 19824 - DNA, 1060 bp, Artificial Sequence
  chemically treated genomic DNA (Homo sapiens) CpG-island No: 19824
accgcgccccctccaccgactccgcaatctcctacccgactttcccttctccacctccatctctacgacgataaaatacaacactcgcaaaacgcctacgcgactttcaaaccgaacgacgacgacgacgataactatttataataaataacgtcaccttaaaataaaccgttaaaaccgacccgcccttcccccctcccactcccgccgctccccgccgcccgacctaaccactctcactacgcaaacgtcgtcccgtcctcccatcccccaacgcgaccgcgtctcctccctcgacgttatccgcgacgcgaaccacaacgcgcgaaacgaaccaacgaaaaaacgcgaacgacgacgctacctacaacctacaacctacaacctccgaccgaccgacgaaccaatacgcgtacgcgacgacgacctccgcaacgaccgaaaaacgaactaaccgacgaaaaaactaacgaaccaacgatataaaacgcgaaacgaaaccgaaccgcgaacgacataaaaaaccgaaaacaactactacaacgaacgcgactaaccgaacaaacgaaacgctacgacgacataacctccgctataaaaacgataaacgcgccgaaaacccgaacgactaaccgaaaaaaacctaacgttaaaaaaaaacgaaaataaccgcgaacgcgttcccctcccgaccataaacgacccgacgacccgactaaacgtaaccgcccgcccgcccttaacccgcgcttcccgctcccgctaaacgccccgccacttcctaaaactaaacccaaaataaaaaatccgaaaaaatacaattcgaaatcgcgaaaacaaccccgaaaaaaaaacgaaccgatcgaaatcgccacatcttaattcgaaacccgaccgaaaacaaaaaataccctaaaaaacgcgaaaaaaccgcatttctcctaaaacgtttcaccgaacccgaaaactccccctctcgtcttcctccgttccccaacttaaaataaaaaatcacctaataaataacgccctatctcaactaattttctctaccacgacc

SEQ ID NO: 19825 - DNA, 686 bp, Artificial Sequence
  chemically treated genomic DNA (Homo sapiens) CpG-island No: 19825
  misc_feature (507)..(507): n is either a, c, g or t
  misc_feature (521)..(521): n is either a, c, g or t
  misc_feature (602)..(602): n is either a, c, g or t
  misc_feature (630)..(630): n is either a, c, g or t
gcgcgtgcgtttttttttttgtttttgatttttttatggaagtagttcgttaggcgaaatggcgatcgattaggcgaaacgttggtggattttatggtagcgcgcgtggtaggtagttatattcgggttcggtttcgtttagcgttaagggcgtggagtcgcgtcgtaaatggcgcgcgagttttttgcgtacgcgcgtgtagcgtttggggtcgggttagcggcgcggttgaagcgaaggcggggagggaaagcgagcggcgtttgcgtttcggcggtggacgggttcggtcgtgggcggggattggggcggaatttgatcgttacgcgtagtttcgttttcgcggtttcgtcgtttttgttgaagcggtagtcgtttttcgtcgatttttatcggttggttgggttagttgcgtcgcggtttatagttgacgatgggggattttagtaagtaggatattttgattatttttaagcgttttcgttcggtgtttattaataaggtancggtcgcgggcgantgcgggtttgtttggtatttttgcgggaatcggcgggaagtttcgcgggcgttagtgttcgtggtttgggaagcgggggtngcgtcgtttgttaatacgttttattgtngggtcgtcgtaattttggttcggttcgggtcggtcgggttcggtaatttaaaaggt

SEQ ID NO: 19826 - DNA, 686 bp, Artificial Sequence
  chemically treated genomic DNA (Homo sapiens) CpG-island No: 19826
  misc_feature (57)..(57): n is either a, c, g or t
  misc_feature (85)..(85): n is either a, c, g or t
  misc_feature (166)..(166): n is either a, c, g or t
  misc_feature (180)..(180): n is either a, c, g or t
accttttaaattaccgaacccgaccgacccgaaccgaaccaaaattacgacgacccnacaataaaacgtattaacaaacgacgcnacccccgcttcccaaaccacgaacactaacgcccgcgaaacttcccgccgattcccgcaaaaataccaaacaaacccgcantcgcccgcgaccgntaccttattaataaacaccgaacgaaaacgcttaaaaataatcaaaatatcctacttactaaaatcccccatcgtcaactataaaccgcgacgcaactaacccaaccaaccgataaaaatcgacgaaaaacgactaccgcttcaacaaaaacgacgaaaccgcgaaaacgaaactacgcgtaacgatcaaattccgccccaatccccgcccacgaccgaacccgtccaccgccgaaacgcaaacgccgctcgctttccctccccgccttcgcttcaaccgcgccgctaacccgaccccaaacgctacacgcgcgtacgcaaaaaactcgcgcgccatttacgacgcgactccacgcccttaacgctaaacgaaaccgaacccgaatataactacctaccacgcgcgctaccataaaatccaccaacgtttcgcctaatcgatcgccatttcgcctaacgaactacttccataaaaaaatcaaaaacaaaaaaaaaaacgcacgcgc

SEQ ID NO: 19827 - DNA, 686 bp, Artificial Sequence
  chemically treated genomic DNA (Homo sapiens) CpG-island No: 19827
  misc_feature (57)..(57): n is either a, c, g or t
  misc_feature (85)..(85): n is either a, c, g or t
  misc_feature (166)..(166): n is either a, c, g or t
  misc_feature (180)..(180): n is either a, c, g or t
gttttttaagttgtcgggttcggtcggttcgggtcgggttaaggttgcggcggtttnatagtgggacgtgttaataggcggcgtngttttcgttttttaagttacgggtattggcgttcgcggggtttttcgtcggttttcgtagggatgttaggtaggttcgtantcgttcgcggtcgntattttgttagtgggtatcgagcggaggcgtttgaagatggttaagatgttttgtttgttggggttttttatcgttagttgtgagtcgcggcgtagttggtttagttaatcggtaagagtcgacgaaaagcggttatcgttttagtaggagcgacgaggtcgcgggggcggggttgcgcgtaacggttaggtttcgttttaattttcgtttacgatcgggttcgtttatcgtcggggcgtaggcgtcgttcgtttttttttttcgttttcgttttagtcgcgtcgttggttcgattttaggcgttgtacgcgcgtgcgtaggaggttcgcgcgttatttgcggcgcggttttacgtttttagcgttgggcgaagtcgggttcgggtgtggttgtttgttacgcgcgttgttataggatttattaacgtttcgtttggtcgatcgttatttcgtttaacgggttgtttttatggaaaggttagaggtaggggaaggggcgtacgcgt

SEQ ID NO: 19828 - DNA, 686 bp, Artificial Sequence
  chemically treated genomic DNA (Homo sapiens) CpG-island No: 19828
  misc_feature (507)..(507): n is either a, c, g or t
  misc_feature (521)..(521): n is either a, c, g or t
  misc_feature (602)..(602): n is either a, c, g or t
  misc_feature (630)..(630): n is either a, c, g or t
acgcgtacgccccttcccctacctctaacctttccataaaaacaacccgttaaacgaaataacgatcgaccaaacgaaacgttaataaatcctataacaacgcgcgtaacaaacaaccacacccgaacccgacttcgcccaacgctaaaaacgtaaaaccgcgccgcaaataacgcgcgaacctcctacgcacgcgcgtacaacgcctaaaatcgaaccaacgacgcgactaaaacgaaaacgaaaaaaaaaaacgaacgacgcctacgccccgacgataaacgaacccgatcgtaaacgaaaattaaaacgaaacctaaccgttacgcgcaaccccgcccccgcgacctcgtcgctcctactaaaacgataaccgcttttcgtcgactcttaccgattaactaaaccaactacgccgcgactcacaactaacgataaaaaaccccaacaaacaaaacatcttaaccatcttcaaacgcctccgctcgatacccactaacaaaatancgaccgcgaacgantacgaacctacctaacatccctacgaaaaccgacgaaaaaccccgcgaacgccaatacccgtaacttaaaaaacgaaaacnacgccgcctattaacacgtcccactatnaaaccgccgcaaccttaacccgacccgaaccgaccgaacccgacaacttaaaaaac

SEQ ID NO: 19829 - DNA, 508 bp, Artificial Sequence
  chemically treated genomic DNA (Homo sapiens) CpG-island No: 19829
cgttttcgagttttggattattttttttgtttcgcgcggggtcgagttttacggtacgtgttttggtttggatcgggaaggttcgtagttttatagtgttcggggaggacggttcgcgttttttacgatttcgcgtcgttcgcgtggttgtagcgtcgtggttcggggacgcgaggttatagttcgggagcgaggagcgcgggaggatcggtttgtttgtgttcggtaaagggggttttttcgaggcgggttttttttttcgtcgttttcgtaagcgcgggagttagaggattttagattcgtcgcggtttattttaagtttcgattaagttttgtagcgcgggagggatttttgtaggcgcggggttagacgggcgataaagcggcggattgcgagggttttgaggaagtcggcggcgcggggttaggagtaatttgttattcgtagggttaggagtttacgcgtttttattgcggagggcggggtcgtagttaggttttttcgttt

SEQ ID NO: 19830 - DNA, 508 bp, Artificial Sequence
  chemically treated genomic DNA (Homo sapiens) CpG-island No: 19830
aaacgaaaaaacctaactacgaccccgccctccgcaataaaaacgcgtaaactcctaaccctacgaataacaaattactcctaaccccgcgccgccgacttcctcaaaaccctcgcaatccgccgctttatcgcccgtctaaccccgcgcctacaaaaatccctcccgcgctacaaaacttaatcgaaacttaaaataaaccgcgacgaatctaaaatcctctaactcccgcgcttacgaaaacgacgaaaaaaaaaacccgcctcgaaaaaaccccctttaccgaacacaaacaaaccgatcctcccgcgctcctcgctcccgaactataacctcgcgtccccgaaccacgacgctacaaccacgcgaacgacgcgaaatcgtaaaaaacgcgaaccgtcctccccgaacactataaaactacgaaccttcccgatccaaaccaaaacacgtaccgtaaaactcgaccccgcgcgaaacaaaaaaaataatccaaaactcgaaaacg

SEQ ID NO: 19831 - DNA, 508 bp, Artificial Sequence
  chemically treated genomic DNA (Homo sapiens) CpG-island No: 19831
aaacggggaggtttggttgcgatttcgtttttcgtagtggggacgcgtgggtttttgattttacgaatagtaggttgtttttgatttcgcgtcgtcggtttttttagggttttcgtagttcgtcgttttgtcgttcgtttggtttcgcgtttgtaggggtttttttcgcgttgtaggatttgatcggggtttggggtgggtcgcggcgggtttggggttttttggttttcgcgtttacgggagcggcggggaagggagttcgtttcggaagggttttttttgtcgggtataggtaggtcggttttttcgcgtttttcgttttcgggttgtggtttcgcgttttcgggttacggcgttgtagttacgcgggcggcgcgaagtcgtggaaggcgcggatcgtttttttcgggtattgtgggattgcgggttttttcggtttaagttaaagtacgtgtcgtggagttcggtttcgcgcggggtagagggagtggtttagggttcgggagcg

SEQ ID NO: 19832 - DNA, 508 bp, Artificial Sequence
  chemically treated genomic DNA (Homo sapiens) CpG-island No: 19832
cgctcccgaaccctaaaccactccctctaccccgcgcgaaaccgaactccacgacacgtactttaacttaaaccgaaaaaacccgcaatcccacaatacccgaaaaaaacgatccgcgccttccacgacttcgcgccgcccgcgtaactacaacgccgtaacccgaaaacgcgaaaccacaacccgaaaacgaaaaacgcgaaaaaaccgacctacctatacccgacaaaaaaaacccttccgaaacgaactcccttccccgccgctcccgtaaacgcgaaaaccaaaaaaccccaaacccgccgcgacccaccccaaaccccgatcaaatcctacaacgcgaaaaaaacccctacaaacgcgaaaccaaacgaacgacaaaacgacgaactacgaaaaccctaaaaaaaccgacgacgcgaaatcaaaaacaacctactattcgtaaaatcaaaaacccacgcgtccccactacgaaaaacgaaatcgcaaccaaacctccccgttt

SEQ ID NO: 19833 - DNA, 998 bp, Artificial Sequence
  chemically treated genomic DNA (Homo sapiens) CpG-island No: 19833
gtgcggcgtcgggtgtcggttttgcgggaatatcgcgttggcggcggtcggggttttgtttttcggtaatttaatttttcggttaatttttaattttaatttcgtcgaggaaaattaagtcggaaagttaggtagaagcggggagcgaggtggttacgtacgtaggcgcgttaggtcgggcgtatcggttattcggcgttcgtagttgtttcggttttcgttttcgtcggtgcgggtttcggtttttagggttatattagtgggcgttttaggtttagttgttttaataatttgcgcggagacgtcgggcgttcggggattgtgcgcgggggtagtgttttaatttttcggttttagtcgttcgggcggggaggcgggggcgcggtgatttcgatcgtatttttttcggggattcgcgtgcgcggcgttagttttgggtaaataaatttagacgggttgtttttttttgttttttttttggttcgtttttttttcgggtttttttcgaggcggcggcgggcgaggcgtaggtggcgcggcggttttcgttaattttatataaattcgacgttttcggggcgattttcgtaagattcggttgcgttttcggttcgggtgttcgtagggtttcgggacgtaaaagggagagaggttgaggacgcggcggaggtttttggtcggggagcgagggatgattaggcggggaaagtgcggagggcgcgtcggaaggcggttcggtacgtttcgtgcgattagtattcggtgtttttcgcggttgtataaattttcgggttcgacggggttattttatcgagagtagtttcgtaaatggtcgttgtttttcgagttcggggagtattagggcgtcgcgtttcgcgcgtattcgttttgtacggtcggttcggtcgtttcggatttttttttcgagttttttttttttcggttttttttttttttttttttagtttttttttttttttttttcggttttttttttt

SEQ ID NO: 19834 - DNA, 998 bp, Artificial Sequence
  chemically treated genomic DNA (Homo sapiens) CpG-island No: 19834
aaaaaaaaaaaccgaaaaaaaaaaaaaaaaaaactaaaaaaaaaaaaaaaaaaaaccgaaaaaaaaaaaactcgaaaaaaaaatccgaaacgaccgaaccgaccgtacaaaacgaatacgcgcgaaacgcgacgccctaatactccccgaactcgaaaaacaacgaccatttacgaaactactctcgataaaataaccccgtcgaacccgaaaatttatacaaccgcgaaaaacaccgaatactaatcgcacgaaacgtaccgaaccgccttccgacgcgccctccgcactttccccgcctaatcatccctcgctccccgaccaaaaacctccgccgcgtcctcaacctctctcccttttacgtcccgaaaccctacgaacacccgaaccgaaaacgcaaccgaatcttacgaaaatcgccccgaaaacgtcgaatttatataaaattaacgaaaaccgccgcgccacctacgcctcgcccgccgccgcctcgaaaaaaacccgaaaaaaaaacgaaccaaaaaaaaaacaaaaaaaaacaacccgtctaaatttatttacccaaaactaacgccgcgcacgcgaatccccgaaaaaaatacgatcgaaatcaccgcgcccccgcctccccgcccgaacgactaaaaccgaaaaattaaaacactacccccgcgcacaatccccgaacgcccgacgtctccgcgcaaattattaaaacaactaaacctaaaacgcccactaatataaccctaaaaaccgaaacccgcaccgacgaaaacgaaaaccgaaacaactacgaacgccgaataaccgatacgcccgacctaacgcgcctacgtacgtaaccacctcgctccccgcttctacctaactttccgacttaattttcctcgacgaaattaaaattaaaaattaaccgaaaaattaaattaccgaaaaacaaaaccccgaccgccgccaacgcgatattcccgcaaaaccgacacccgacgccgcac

SEQ ID NO: 19835 - DNA, 998 bp, Artificial Sequence
  chemically treated genomic DNA (Homo sapiens) CpG-island No: 19835
aagaaagaagatcgaggaagaaaagaaagaagattgaggaagaaaagaaagaagatcgaggaagaaggggttcggaagaagggttcggagcggtcgggtcggtcgtgtagggcgagtgcgcgcgaggcgcggcgttttgatgtttttcgagttcgaggagtagcggttatttgcgggattgttttcggtggagtagtttcgtcgggttcggaggtttgtgtaatcgcggagaatatcgagtgttggtcgtacggggcgtgtcgagtcgtttttcggcgcgtttttcgtatttttttcgtttagttatttttcgtttttcggttaggagttttcgtcgcgtttttaattttttttttttttgcgtttcgggattttgcgagtattcgggtcgagggcgtagtcgagttttgcgggagtcgtttcgaaagcgtcgggtttgtgtggggttagcgggggtcgtcgcgttatttgcgtttcgttcgtcgtcgtttcggggaaaattcgaagaggaggcggattaggagaagagtaaagaaaagtagttcgtttggatttgtttgtttaggattggcgtcgcgtacgcggattttcgaggggagtgcggtcggagttatcgcgttttcgttttttcgttcgggcgattgaggtcggggggttggagtattgttttcgcgtatagttttcgaacgttcgacgttttcgcgtaggttattgaagtagttgggtttggggcgtttattaatgtggttttgagggtcggagttcgtatcgacgggagcgggagtcggagtagttgcgggcgtcgagtggtcggtacgttcggtttagcgcgtttgcgtgcgtggttatttcgtttttcgtttttgtttggtttttcggtttaatttttttcggcgggattaaagttggaaattgatcggagaattgagttgtcggggaatagagtttcggtcgtcgttagcgcgatgttttcgtagagtcggtattcgacgtcgtat

SEQ ID NO: 19836 - DNA, 998 bp, Artificial Sequence
  chemically treated genomic DNA (Homo sapiens) CpG-island No: 19836
atacgacgtcgaataccgactctacgaaaacatcgcgctaacgacgaccgaaactctattccccgacaactcaattctccgatcaatttccaactttaatcccgccgaaaaaaattaaaccgaaaaaccaaacaaaaacgaaaaacgaaataaccacgcacgcaaacgcgctaaaccgaacgtaccgaccactcgacgcccgcaactactccgactcccgctcccgtcgatacgaactccgaccctcaaaaccacattaataaacgccccaaacccaactacttcaataacctacgcgaaaacgtcgaacgttcgaaaactatacgcgaaaacaatactccaaccccccgacctcaatcgcccgaacgaaaaaacgaaaacgcgataactccgaccgcactcccctcgaaaatccgcgtacgcgacgccaatcctaaacaaacaaatccaaacgaactacttttctttactcttctcctaatccgcctcctcttcgaattttccccgaaacgacgacgaacgaaacgcaaataacgcgacgacccccgctaaccccacacaaacccgacgctttcgaaacgactcccgcaaaactcgactacgccctcgacccgaatactcgcaaaatcccgaaacgcaaaaaaaaaaaaaattaaaaacgcgacgaaaactcctaaccgaaaaacgaaaaataactaaacgaaaaaaatacgaaaaacgcgccgaaaaacgactcgacacgccccgtacgaccaacactcgatattctccgcgattacacaaacctccgaacccgacgaaactactccaccgaaaacaatcccgcaaataaccgctactcctcgaactcgaaaaacatcaaaacgccgcgcctcgcgcgcactcgccctacacgaccgacccgaccgctccgaacccttcttccgaaccccttcttcctcgatcttctttcttttcttcctcaatcttctttcttttcttcctcgatcttctttctt

SEQ ID NO: 19837 - DNA, 533 bp, Artificial Sequence
  chemically treated genomic DNA (Homo sapiens) CpG-island No: 19837
ttgtaaagtttttttattattcgagggacgatatttacgagatggtgggagaaatagtaggagtgcgtttcgttaatcggttatttttttcggcgggtaaattttgtcggcgagttcggagtagttatagcggtgcggttagcggagattttggtcgtcgcgggacgacggaggttcgggttggtggcgcgggtttcgttcggtcgtgcgagggtggggtggcgtagtcggttgttttcgggacgtagagtatagagtattcgtcgttgtttttgttgttgttgtttttgtagtcgtcgtttttatcgtcgtcgtcgtcgttcgcgtttttggcgtgggttatattaatacgcggttttatatttaggagttaattagcgtcggtttcgttcggtttcgtttagtttcgtttagtttcgtttagtttcgtttagtttcgtttagtttcgtttagtttcgtttagtttcgatcgggcgggggacgttagttcgtagttttatatagtttttattatgttgaggtatgttttttt

SEQ ID NO: 19838 - DNA, 533 bp, Artificial Sequence
  chemically treated genomic DNA (Homo sapiens) CpG-island No: 19838
aaaaaaacatacctcaacataataaaaactatataaaactacgaactaacgtcccccgcccgatcgaaactaaacgaaactaaacgaaactaaacgaaactaaacgaaactaaacgaaactaaacgaaactaaacgaaaccgaacgaaaccgacgctaattaactcctaaatataaaaccgcgtattaatataacccacgccaaaaacgcgaacgacgacgacgacgataaaaacgacgactacaaaaacaacaacaacaaaaacaacgacgaatactctatactctacgtcccgaaaacaaccgactacgccaccccaccctcgcacgaccgaacgaaacccgcgccaccaacccgaacctccgtcgtcccgcgacgaccaaaatctccgctaaccgcaccgctataactactccgaactcgccgacaaaatttacccgccgaaaaaaataaccgattaacgaaacgcactcctactatttctcccaccatctcgtaaatatcgtccctcgaataataaaaaaactttacaa

SEQ ID NO: 19839 - DNA, 533 bp, Artificial Sequence
  chemically treated genomic DNA (Homo sapiens) CpG-island No: 19839
gaaagaatatattttaatataataaaagttatatagggttgcgggttagcgtttttcgttcgatcggggttgaacggggttgggcggggttgggcggggttgggcggggttgggcggggttgggcgggattgggcggggtcgggcggggtcggcgttggttagtttttgagtgtgaaatcgcgtgttagtgtaatttacgttagaggcgcgggcggcggcggcggcggtaggagcggcggttgtaggagtagtagtagtagaagtagcggcgggtattttgtgttttgcgtttcggaggtagtcgattgcgttattttattttcgtacggtcgggcgggattcgcgttattagttcggattttcgtcgtttcgcggcgattaaaattttcgttggtcgtatcgttgtgattatttcggattcgtcggtagagtttgttcgtcggggagggtggtcgattggcggagcgtatttttgttgttttttttattatttcgtggatgtcgtttttcgggtggtgagagaattttgtag

SEQ ID NO: 19840 - DNA, 533 bp, Artificial Sequence
  chemically treated genomic DNA (Homo sapiens) CpG-island No: 19840
ctacaaaattctctcaccacccgaaaaacgacatccacgaaataataaaaaaaacaacaaaaatacgctccgccaatcgaccaccctccccgacgaacaaactctaccgacgaatccgaaataatcacaacgatacgaccaacgaaaattttaatcgccgcgaaacgacgaaaatccgaactaataacgcgaatcccgcccgaccgtacgaaaataaaataacgcaatcgactacctccgaaacgcaaaacacaaaatacccgccgctacttctactactactactcctacaaccgccgctcctaccgccgccgccgccgcccgcgcctctaacgtaaattacactaacacgcgatttcacactcaaaaactaaccaacgccgaccccgcccgaccccgcccaatcccgcccaaccccgcccaaccccgcccaaccccgcccaaccccgcccaaccccgttcaaccccgatcgaacgaaaaacgctaacccgcaaccctatataacttttattatattaaaatatattctttc

SEQ ID NO: 19841 - DNA, 888 bp, Artificial Sequence
  chemically treated genomic DNA (Homo sapiens) CpG-island No: 19841
gttagttcgcggtttcgttttttttttagattttcgtttttattggttgtaggttacgtcgtcgtttcgtttttcggtttttttagcgcgttaattggcggttgcgtggaacgtgttagggagagcgcgtcgtgttcgcggagagagcgcggcgcgggaggtcggcggtcggtcggttgtatggcgcgttgcgagaggttgcgcggagcggttttgcgcgacgtgttgggtcgggcgtagggggttttgttcgattgtgacggggtgttgtggaacggcgagcgcgtcgtgtcgggcgtttcggagttgttggagcggttggcgcgggtcggtaaggcggttttgtttgtgagtaataatagtcggcgcgcgcggttcgagttggttttgcgtttcgcgcgtttcggtttcggggggttgcgcgtcgagtagttttttagtttcgcgttgtgcgtcgcgcgtttgttgcgttagcgtttgttcgggttttcggacgcgtcgggcgtcgtgttcgtgttgggcggcgaggggttgcgcgtcgagttgcgcgtcgcggggttgcgtttggtcggggattcgagcgcgggggacggcgcggtttcgcgcgtgcgcgtcgtgtttgtgggttacgacgagtatttttttttcgttaagttgagggaggcgtgcgcgtatttgcgcgatttcgagtgtttattcgtggttatcgatcgtgatttatggtattcgttgagcgacggtagtcggatttttggtgagcgcgggaatggcggggaaattgagatgggggcgatttgcgtattcgtttttacgtttaagggtgaggggcggggaagaggcgtttttaggtggtaggtggggaataggagagtgcgagggaggtttagg

SEQ ID NO: 19842 - DNA, 888 bp, Artificial Sequence
  chemically treated genomic DNA (Homo sapiens) CpG-island No: 19842
cctaaacctccctcgcactctcctattccccacctaccacctaaaaacgcctcttccccgcccctcacccttaaacgtaaaaacgaatacgcaaatcgcccccatctcaatttccccgccattcccgcgctcaccaaaaatccgactaccgtcgctcaacgaataccataaatcacgatcgataaccacgaataaacactcgaaatcgcgcaaatacgcgcacgcctccctcaacttaacgaaaaaaaaatactcgtcgtaacccacaaacacgacgcgcacgcgcgaaaccgcgccgtcccccgcgctcgaatccccgaccaaacgcaaccccgcgacgcgcaactcgacgcgcaacccctcgccgcccaacacgaacacgacgcccgacgcgtccgaaaacccgaacaaacgctaacgcaacaaacgcgcgacgcacaacgcgaaactaaaaaactactcgacgcgcaaccccccgaaaccgaaacgcgcgaaacgcaaaaccaactcgaaccgcgcgcgccgactattattactcacaaacaaaaccgccttaccgacccgcgccaaccgctccaacaactccgaaacgcccgacacgacgcgctcgccgttccacaacaccccgtcacaatcgaacaaaaccccctacgcccgacccaacacgtcgcgcaaaaccgctccgcgcaacctctcgcaacgcgccatacaaccgaccgaccgccgacctcccgcgccgcgctctctccgcgaacacgacgcgctctccctaacacgttccacgcaaccgccaattaacgcgctaaaaaaaccgaaaaacgaaacgacgacgtaacctacaaccaataaaaacgaaaatctaaaaaaaaaacgaaaccgcgaactaac

SEQ ID NO: 19843 - DNA, 888 bp, Artificial Sequence
  chemically treated genomic DNA (Homo sapiens) CpG-island No: 19843
tttgggtttttttcgtatttttttgttttttatttgttatttggagacgtttttttttcgttttttatttttaggcgtggaggcgaatgcgtaggtcgtttttattttagttttttcgttattttcgcgtttattaggggttcggttgtcgtcgtttagcgggtgttatgggttacggtcggtggttacgagtaggtattcggggtcgcgtaggtgcgcgtacgttttttttagtttggcgaaggagaagtgttcgtcgtagtttataagtacggcgcgtacgcgcggggtcgcgtcgtttttcgcgttcgggttttcggttaggcgtagtttcgcggcgcgtagttcggcgcgtagtttttcgtcgtttagtacgaatacggcgttcggcgcgttcggaggttcgggtaggcgttggcgtagtaggcgcgcggcgtatagcgcggagttgaagagttgttcggcgcgtagtttttcgaagtcgaggcgcgcgaagcgtagggttagttcgggtcgcgcgcgtcggttgttgttgtttataaatagagtcgttttgtcggttcgcgttagtcgttttagtagtttcggggcgttcggtacggcgcgttcgtcgttttatagtatttcgttatagtcgaataggattttttgcgttcggtttagtacgtcgcgtagggtcgtttcgcgtagtttttcgtagcgcgttatgtagtcggtcggtcgtcggtttttcgcgtcgcgtttttttcgcgggtacggcgcgttttttttggtacgttttacgtagtcgttaattggcgcgttggaaggatcggggggcggggcgacggcgtggtttgtagttaatgggggcgagagtttgggagaggagcgaagtcgcgagttaat

SEQ ID NO: 19844 - DNA, 888 bp, Artificial Sequence
  chemically treated genomic DNA (Homo sapiens) CpG-island No: 19844
attaactcgcgacttcgctcctctcccaaactctcgcccccattaactacaaaccacgccgtcgccccgccccccgatccttccaacgcgccaattaacgactacgtaaaacgtaccaaaaaaaacgcgccgtacccgcgaaaaaaacgcgacgcgaaaaaccgacgaccgaccgactacataacgcgctacgaaaaactacgcgaaacgaccctacgcgacgtactaaaccgaacgcaaaaaatcctattcgactataacgaaatactataaaacgacgaacgcgccgtaccgaacgccccgaaactactaaaacgactaacgcgaaccgacaaaacgactctatttataaacaacaacaaccgacgcgcgcgacccgaactaaccctacgcttcgcgcgcctcgacttcgaaaaactacgcgccgaacaactcttcaactccgcgctatacgccgcgcgcctactacgccaacgcctacccgaacctccgaacgcgccgaacgccgtattcgtactaaacgacgaaaaactacgcgccgaactacgcgccgcgaaactacgcctaaccgaaaacccgaacgcgaaaaacgacgcgaccccgcgcgtacgcgccgtacttataaactacgacgaacacttctccttcgccaaactaaaaaaaacgtacgcgcacctacgcgaccccgaatacctactcgtaaccaccgaccgtaacccataacacccgctaaacgacgacaaccgaacccctaataaacgcgaaaataacgaaaaaactaaaataaaaacgacctacgcattcgcctccacgcctaaaaataaaaaacgaaaaaaaaacgtctccaaataacaaataaaaaacaaaaaaatacgaaaaaaacccaaa

SEQ ID NO: 19845 - DNA, 507 bp, Artificial Sequence
  chemically treated genomic DNA (Homo sapiens) CpG-island No: 19845
aatttcggtgcgacgttaaagtgtgcgttcgggaggatgagtacgttatattcggaagtgtttttagggagaggaagtcggcggttttattgttatgggtcgtaataagaagaagaagcgagatggtgacgatcggcggtcgaggttcgtttttagtttcgacgaggagaagaggcggtgagtggtaaagtcggatcggatttttttcgagttgtttttcgcggttaaggttaggtttggggtcgagtacgttttcgtcgggggttttttcggtttcgttttttggcgtggttagagaatttttttcggttttttagttcgcgttttcgttttttttttttcggtcgttattttttttttttttgatttttttatttcgtttagtgtttgtgcgtcgttagatagtcggaagttcgggttttagagtagtggtttcgattattttagtttagtttagtttatcggttcggtatatagtaggcgtttagtcgtggttgataaatgatg

SEQ ID NO: 19846 - DNA, 507 bp, Artificial Sequence
  chemically treated genomic DNA (Homo sapiens) CpG-island No: 19846
catcatttatcaaccacgactaaacgcctactatataccgaaccgataaactaaactaaactaaaataatcgaaaccactactctaaaacccgaacttccgactatctaacgacgcacaaacactaaacgaaataaaaaaatcaaaaaaaaaaaaaataacgaccgaaaaaaaaaaaacgaaaacgcgaactaaaaaaccgaaaaaaattctctaaccacgccaaaaaacgaaaccgaaaaaacccccgacgaaaacgtactcgaccccaaacctaaccttaaccgcgaaaaacaactcgaaaaaaatccgatccgactttaccactcaccgcctcttctcctcgtcgaaactaaaaacgaacctcgaccgccgatcgtcaccatctcgcttcttcttcttattacgacccataacaataaaaccgccgacttcctctccctaaaaacacttccgaatataacgtactcatcctcccgaacgcacactttaacgtcgcaccgaaatt

SEQ ID NO: 19847 - DNA, 507 bp, Artificial Sequence
  chemically treated genomic DNA (Homo sapiens) CpG-island No: 19847
tattatttattaattacggttgggcgtttgttgtgtgtcggatcgatggattgggttgggttagggtggtcgaagttattgttttgagattcgagttttcggttatttggcggcgtatagatattaggcgaggtggggaggttaagaagggagaaggtggcggtcgagaagggagaagcgggaacgcgggttggaaggtcgagaggggttttttagttacgttagggggcgggatcggaagagttttcggcgggagcgtgttcggttttagatttggttttggtcgcgaagaatagttcgaggggagttcggttcggttttgttatttatcgtttttttttttcgtcgaagttaagaacgagtttcggtcgtcggtcgttattatttcgttttttttttttgttgcggtttatagtagtgaggtcgtcggttttttttttttgaagatattttcgggtgtagcgtatttattttttcgggcgtatattttagcgtcgtatcgaagtt

SEQ ID NO: 19848 - DNA, 507 bp, Artificial Sequence
  chemically treated genomic DNA (Homo sapiens) CpG-island No: 19848
aacttcgatacgacgctaaaatatacgcccgaaaaaataaatacgctacacccgaaaatatcttcaaaaaaaaaaaaccgacgacctcactactataaaccgcaacaaaaaaaaaaaacgaaataataacgaccgacgaccgaaactcgttcttaacttcgacgaaaaaaaaaaacgataaataacaaaaccgaaccgaactcccctcgaactattcttcgcgaccaaaaccaaatctaaaaccgaacacgctcccgccgaaaactcttccgatcccgccccctaacgtaactaaaaaacccctctcgaccttccaacccgcgttcccgcttctcccttctcgaccgccaccttctcccttcttaacctccccacctcgcctaatatctatacgccgccaaataaccgaaaactcgaatctcaaaacaataacttcgaccaccctaacccaacccaatccatcgatccgacacacaacaaacgcccaaccgtaattaataaataata

SEQ ID NO: 19849 - DNA, 734 bp, Artificial Sequence
  chemically treated genomic DNA (Homo sapiens) CpG-island No: 19849
cgtcgagttttagcggatttatcgtttcggggtcgggtcgggaagcgtagtttgggcgagtcgtgtttacgttcggtcgttcgtatttttcgttttcgcgttattgtcggagttatttgtattttgggtttttttttttttttagcgcgttcgcggttcgggttcgttcgtttttcggtcgttatcgtttttttttttttgcggttttattcgtttatttcgtcgtttcgtcgtttcgtcgtttcgtcgttttagcgcgttcgtttcgttgcggtaggtttcgttttcggttcgtttcgcgtttttattggttcgtcgcggttttcgtcgttgtttgtttcggttttttcgttatttattggttcgttcgggtttttttaggaagtttgaaaaaaaaaaaaaaaaagttttatgggcggatggaaggggtcggggtagcgtcggggaaaggaagggtcggaggcgcggcggcgggcggtcgagaggggcggcggcggcggcggcggcggggttttcgcgtcgcggagttcggttcgagagtcgcgtttacgtttttgttttttgttttcgtcgttttggggcgtcgttatgacggtgagtgttttagttagtcgttcgcgttcgaggtcgggagaagggcgacgattcgaggtagagtttagtttttttttttcggggtagttttttttttatttttcgaaggcgagaggagggttgggtcggaagacggggtt

SEQ ID NO: 19850 - DNA, 734 bp, Artificial Sequence
  chemically treated genomic DNA (Homo sapiens) CpG-island No: 19850
aaccccgtcttccgacccaaccctcctctcgccttcgaaaaataaaaaaaaaactaccccgaaaaaaaaaaactaaactctacctcgaatcgtcgcccttctcccgacctcgaacgcgaacgactaactaaaacactcaccgtcataacgacgccccaaaacgacgaaaacaaaaaacaaaaacgtaaacgcgactctcgaaccgaactccgcgacgcgaaaaccccgccgccgccgccgccgccgcccctctcgaccgcccgccgccgcgcctccgacccttcctttccccgacgctaccccgaccccttccatccgcccataaaactttttttttttttttttcaaacttcctaaaaaaacccgaacgaaccaataaataacgaaaaaaccgaaacaaacaacgacgaaaaccgcgacgaaccaataaaaacgcgaaacgaaccgaaaacgaaacctaccgcaacgaaacgaacgcgctaaaacgacgaaacgacgaaacgacgaaacgacgaaataaacgaataaaaccgcaaaaaaaaaaaaacgataacgaccgaaaaacgaacgaacccgaaccgcgaacgcgctaaaaaaaaaaaaaaacccaaaatacaaataactccgacaataacgcgaaaacgaaaaatacgaacgaccgaacgtaaacacgactcgcccaaactacgcttcccgacccgaccccgaaacgataaatccgctaaaactcgacg

SEQ ID NO: 19851 - DNA, 734 bp, Artificial Sequence
  chemically treated genomic DNA (Homo sapiens) CpG-island No: 19851
ggtttcgtttttcggtttagtttttttttcgttttcgggaaatgaggagggggttgtttcggaggggagaggttgggttttgtttcgggtcgtcgtttttttttcggtttcgggcgcgggcggttgattggggtatttatcgttatggcggcgttttagggcggcgggagtaggaggtaggaacgtggacgcggttttcgggtcgggtttcgcggcgcgggaatttcgtcgtcgtcgtcgtcgtcgtttttttcggtcgttcgtcgtcgcgttttcggtttttttttttttcgacgttgtttcggttttttttattcgtttataaaatttttttttttttttttttaaattttttgggaggattcgagcgggttaatgggtggcggggaagtcgagataaatagcggcgggggtcgcggcgggttaatggaagcgcgagacgggtcgggggcgggatttgtcgtaacgggacgggcgcgttagggcggcggggcggcgggacggcgggacggcggggtgggcggatggggtcgtagggaagggagggcggtggcggtcggagggcgggcgggttcgggtcgcgggcgcgttgggaggaaggaagggtttagggtgtaggtgatttcggtaatggcgcgggggcggaggatgcgggcggtcgggcgtgggtacgattcgtttaggttgcgtttttcgattcggtttcggagcgatgggttcgttagggttcggcg

SEQ ID NO: 19852 - DNA, 734 bp, Artificial Sequence
  chemically treated genomic DNA (Homo sapiens) CpG-island No: 19852
cgccgaaccctaacgaacccatcgctccgaaaccgaatcgaaaaacgcaacctaaacgaatcgtacccacgcccgaccgcccgcatcctccgcccccgcgccattaccgaaatcacctacaccctaaacccttccttcctcccaacgcgcccgcgacccgaacccgcccgccctccgaccgccaccgccctcccttccctacgaccccatccgcccaccccgccgtcccgccgtcccgccgccccgccgccctaacgcgcccgtcccgttacgacaaatcccgcccccgacccgtctcgcgcttccattaacccgccgcgacccccgccgctatttatctcgacttccccgccacccattaacccgctcgaatcctcccaaaaaatttaaaaaaaaaaaaaaaaaaattttataaacgaataaaaaaaaccgaaacaacgtcgaaaaaaaaaaaaaccgaaaacgcgacgacgaacgaccgaaaaaaacgacgacgacgacgacgacgaaattcccgcgccgcgaaacccgacccgaaaaccgcgtccacgttcctacctcctactcccgccgccctaaaacgccgccataacgataaataccccaatcaaccgcccgcgcccgaaaccgaaaaaaaaacgacgacccgaaacaaaacccaacctctcccctccgaaacaaccccctcctcatttcccgaaaacgaaaaaaaaactaaaccgaaaaacgaaacc

SEQ ID NO: 19853 - DNA, 1364 bp, Artificial Sequence
  chemically treated genomic DNA (Homo sapiens) CpG-island No: 19853
gagaaattcgggacgtcgggtatataatagggatgggaggattgtatagagaagttaacgggtcggttagttcgaagggcggagatcgttgttgggggcggcggtgtttagcgggttagagtcgtggggttggcgaggattttaggtcgcgttcgttcgataggtttttcggcgaggttttaaatcgtcgttttcgcgaggcgtttagtcgattggaagttttataacgatcgttattatttagggtcggagcggtaatttcgtagcggagttttgtttgttcgttgcgtttttttaagagattagattttataaattttttttttatcgcggttttaattcgagttttttcgtcgttttcgagtattcggagggcgtttttttgggacgggatcgacgtttcggatcgggttgcgtcgcgggagttcgaggtacgcgacggggtcgcgcgggggaggcgggcggaacgggcgtttttcggagtcggtgttcggacgtaatttcgcgatttttttcgtttcgtttttcgggtacggttcgattgggattcgatttatttatttcgttaggtcgcgggtagggcgaggattcgagcgagtttatttttttcgtttttgtttttatttattttttcgtttcgttttgtagacgtgatcgtaggtgtcgcgttttattttgtatttttcgtatttaaataaattttttattcgttttcgtttcgtcgttagtttcgttttgaaattataatttattgtttgttttttttatagaggtacgggacgcgggggtcgtcgtcgtttagtttttttttttttttttttcgcgatcgtcgttttatttttttaatagtcgtttttcgcgcgcgcgcgcgcgtcgttcgtcgttcgtcgtttcgcggttcgtttttagtaagggatttttcggcggttatagtagttattttttttatttttttttttttttttttcgcgacggcggcggcggttttcgtaggtatttttagtttcgttttttttttttatttttttgttttggaatttggtgggtcgcgtcgtggttttttcgagtttattagcgaatttattggttcgttttatggtcgcggaggtttttgggaaatgaagtcgcgaaggttttagcggtttgggcggttttgtcggcgtaagaaatatagtttttaggttatttcgggttattatagtttcgtttttataaagtatgcgcgtttgcgtattagggtcgttttttttttttaggtagcgtacggttttcggtttttgtgaaggtagaaagttcgaagttttagtgtgttttttgcggttttcggggagatattggaaagaagtgttttattttagtgggaa

SEQ ID NO: 19854 - DNA, 1364 bp, Artificial Sequence
  chemically treated genomic DNA (Homo sapiens) CpG-island No: 19854
ttcccactaaaataaaacacttctttccaatatctccccgaaaaccgcaaaaaacacactaaaacttcgaactttctaccttcacaaaaaccgaaaaccgtacgctacctaaaaaaaaaaaacgaccctaatacgcaaacgcgcatactttataaaaacgaaactataataacccgaaataacctaaaaactatatttcttacgccgacaaaaccgcccaaaccgctaaaaccttcgcgacttcatttcccaaaaacctccgcgaccataaaacgaaccaataaattcgctaataaactcgaaaaaaccacgacgcgacccaccaaattccaaaacaaaaaaataaaaaaaaaaaacgaaactaaaaatacctacgaaaaccgccgccgccgtcgcgaaaaaaaaaaaaaaaaaaataaaaaaaataactactataaccgccgaaaaatcccttactaaaaacgaaccgcgaaacgacgaacgacgaacgacgcgcgcgcgcgcgcgaaaaacgactattaaaaaaataaaacgacgatcgcgaaaaaaaaaaaaaaaaaaactaaacgacgacgacccccgcgtcccgtacctctataaaaaaaacaaacaataaattataatttcaaaacgaaactaacgacgaaacgaaaacgaataaaaaatttatttaaatacgaaaaatacaaaataaaacgcgacacctacgatcacgtctacaaaacgaaacgaaaaaataaataaaaacaaaaacgaaaaaaataaactcgctcgaatcctcgccctacccgcgacctaacgaaataaataaatcgaatcccaatcgaaccgtacccgaaaaacgaaacgaaaaaaatcgcgaaattacgtccgaacaccgactccgaaaaacgcccgttccgcccgcctcccccgcgcgaccccgtcgcgtacctcgaactcccgcgacgcaacccgatccgaaacgtcgatcccgtcccaaaaaaacgccctccgaatactcgaaaacgacgaaaaaactcgaattaaaaccgcgataaaaaaaaaatttataaaatctaatctcttaaaaaaacgcaacgaacaaacaaaactccgctacgaaattaccgctccgaccctaaataataacgatcgttataaaacttccaatcgactaaacgcctcgcgaaaacgacgatttaaaacctcgccgaaaaacctatcgaacgaacgcgacctaaaatcctcgccaaccccacgactctaacccgctaaacaccgccgcccccaacaacgatctccgcccttcgaactaaccgacccgttaacttctctatacaatcctcccatccctattatatacccgacgtcccgaatttctc

SEQ ID NO: 19855 - DNA, 1364 bp, Artificial Sequence
  chemically treated genomic DNA (Homo sapiens) CpG-island No: 19855
tttttattagagtaaggtatttttttttagtgttttttcgagaatcgtagaaagtatattggaatttcgagttttttatttttataggaatcgggagtcgtgcgttatttgagggggaggggcggttttggtacgtaggcgcgtatgttttgtgggggcgaggttgtggtggttcgaggtaatttgggagttgtattttttacgtcggtaaaatcgtttaggtcgttgaggttttcgcgattttattttttaggagttttcgcgattatggggcgggttagtgagttcgttaatgagttcgaggaagttacggcgcggtttattaggttttaaaataaggaaatgaaggagggaggcgggattgggggtgtttgcgggagtcgtcgtcgtcgtcgcggaggaggaggaggaagaggtggaggaggtggttgttgtggtcgtcgaggagttttttgttgaaggcggatcgcggagcggcgggcggcgggcggcgcgcgcgcgcgcgcgagaggcggttgttggagaagtggagcggcggtcgcggggggaggaggaggagggattgagcggcggcggttttcgcgtttcgtgtttttatgggggaagtagataatggattatgattttaaggcgaagttggcggcggagcgggagcgggtggaggatttgtttgagtacgaagggtgtaaagtgggacgcggtatttacggttacgtttataaggcgaggcggaaagatgggtaagagtaggggcgggaggagtaggttcgttcgggttttcgttttgttcgcgatttggcgggatgggtgggtcggattttagtcgggtcgtgttcgaggggcgaggcggagggggtcgcggggttgcgttcggatatcgatttcgaggggcgttcgtttcgttcgtttttttcgcgcggtttcgtcgcgtatttcgaattttcgcggcgtagttcggttcgaggcgtcggtttcgttttagaggggcgtttttcgagtgttcggagacggcggggggattcgagttgggatcgcggtggaggaggagtttgtggggtttagttttttgggggaacgtagcgggtaggtagagtttcgttgcggagttgtcgtttcggttttgggtagtgacggtcgttgtggaatttttaatcggttgagcgtttcgcgggggcggcggtttgaaatttcgtcggggagtttgtcgggcgaacgcggtttggggttttcgttagttttacggttttgattcgttgggtatcgtcgtttttagtagcgattttcgtttttcgggttggtcggttcgttggtttttttatgtagtttttttatttttgttgtatgttcggcgtttcgggtttttt

SEQ ID NO: 19856 - DNA, 1364 bp, Artificial Sequence
  chemically treated genomic DNA (Homo sapiens) CpG-island No: 19856
aaaaaacccgaaacgccgaacatacaacaaaaataaaaaaactacataaaaaaaccaacgaaccgaccaacccgaaaaacgaaaatcgctactaaaaacgacgatacccaacgaatcaaaaccgtaaaactaacgaaaaccccaaaccgcgttcgcccgacaaactccccgacgaaatttcaaaccgccgcccccgcgaaacgctcaaccgattaaaaattccacaacgaccgtcactacccaaaaccgaaacgacaactccgcaacgaaactctacctacccgctacgttcccccaaaaaactaaaccccacaaactcctcctccaccgcgatcccaactcgaatccccccgccgtctccgaacactcgaaaaacgcccctctaaaacgaaaccgacgcctcgaaccgaactacgccgcgaaaattcgaaatacgcgacgaaaccgcgcgaaaaaaacgaacgaaacgaacgcccctcgaaatcgatatccgaacgcaaccccgcgaccccctccgcctcgcccctcgaacacgacccgactaaaatccgacccacccatcccgccaaatcgcgaacaaaacgaaaacccgaacgaacctactcctcccgcccctactcttacccatctttccgcctcgccttataaacgtaaccgtaaataccgcgtcccactttacacccttcgtactcaaacaaatcctccacccgctcccgctccgccgccaacttcgccttaaaatcataatccattatctacttcccccataaaaacacgaaacgcgaaaaccgccgccgctcaatccctcctcctcctccccccgcgaccgccgctccacttctccaacaaccgcctctcgcgcgcgcgcgcgcgccgcccgccgcccgccgctccgcgatccgccttcaacaaaaaactcctcgacgaccacaacaaccacctcctccacctcttcctcctcctcctccgcgacgacgacgacgactcccgcaaacacccccaatcccgcctccctccttcatttccttattttaaaacctaataaaccgcgccgtaacttcctcgaactcattaacgaactcactaacccgccccataatcgcgaaaactcctaaaaaataaaatcgcgaaaacctcaacgacctaaacgattttaccgacgtaaaaaatacaactcccaaattacctcgaaccaccacaacctcgcccccacaaaacatacgcgcctacgtaccaaaaccgcccctccccctcaaataacgcacgactcccgattcctataaaaataaaaaactcgaaattccaatatactttctacgattctcgaaaaaacactaaaaaaaaataccttactctaataaaaa

SEQ ID NO: 19857 - DNA, 591 bp, Artificial Sequence
  chemically treated genomic DNA (Homo sapiens) CpG-island No: 19857
atggcggcggtagcggtgtcgttttgttttcgcggtttttgcggcggtggtagtggtagcggtttttgagttgtggggaggttttagtagtagttatagtgacgattaagattttagtgtatttttatcgtaatcgggcgcgggggagcgtagatcggcgtttagtaattatagaagtcgataaggcgtttaagcgaaaatatgatcgttgagtttatgaggtaaaacgtaatttcgttttatgggttttagcggtttgggtttaggtatcgtttgagtcgggtgtttgggaaggcgttcgtttggtgggttaggtttgtgtgttgtttagtcgaaagaggtatcgttttttttttaggtgagaagggtttcggggtatcggcgtaaggtttcgacgggggtgggggtggggatggggtggggggaggtggggggggcgcggtttagggtatggggcgttttttgtaattttttttaaacggtgacgtttggtcgggtttttttgtttattttttggtgtttgtgggattgagatttcgaagtcggaggcggtttttggtatttcggttatttttgttaatttttgggttt

SEQ ID NO: 19858 - DNA, 591 bp, Artificial Sequence
  chemically treated genomic DNA (Homo sapiens) CpG-island No: 19858
aaacccaaaaattaacaaaaataaccgaaataccaaaaaccgcctccgacttcgaaatctcaatcccacaaacaccaaaaaataaacaaaaaaacccgaccaaacgtcaccgtttaaaaaaaattacaaaaaacgccccataccctaaaccgcgccccccccacctccccccaccccatccccacccccacccccgtcgaaaccttacgccgataccccgaaacccttctcacctaaaaaaaaaacgatacctctttcgactaaacaacacacaaacctaacccaccaaacgaacgccttcccaaacacccgactcaaacgatacctaaacccaaaccgctaaaacccataaaacgaaattacgttttacctcataaactcaacgatcatattttcgcttaaacgccttatcgacttctataattactaaacgccgatctacgctcccccgcgcccgattacgataaaaatacactaaaatcttaatcgtcactataactactactaaaacctccccacaactcaaaaaccgctaccactaccaccgccgcaaaaaccgcgaaaacaaaacgacaccgctaccgccgccat

SEQ ID NO: 19859 - DNA, 591 bp, Artificial Sequence
  chemically treated genomic DNA (Homo sapiens) CpG-island No: 19859
aggtttaaagattagtaaaaatgatcgggatattaaagatcgttttcgatttcgaggttttaattttataggtattaaagaataaatagaggagttcgattaagcgttatcgtttaggggagattgtaagaagcgttttatattttaggtcgcgttttttttatttttttttattttatttttatttttattttcgtcggagttttgcgtcgatatttcgaaattttttttatttaaagagaaaacgatgtttttttcggttaagtaatatataggtttaatttattaagcgaacgtttttttaaatattcgatttagacggtgtttgggtttagatcgttggggtttatgagacggggttgcgttttattttatgggtttagcggttatgttttcgtttgaacgttttgtcggtttttgtgattgttgggcgtcgatttgcgttttttcgcgttcggttacgatagaaatgtattggagttttagtcgttattgtagttgttgttggaatttttttatagtttaaaggtcgttattattgttatcgtcgtaggagtcgcggaaataaagcgatatcgttgtcgtcgttat

SEQ ID NO: 19860 - DNA, 591 bp, Artificial Sequence
  chemically treated genomic DNA (Homo sapiens) CpG-island No: 19860
ataacgacgacaacgatatcgctttatttccgcgactcctacgacgataacaataataacgacctttaaactataaaaaaattccaacaacaactacaataacgactaaaactccaatacatttctatcgtaaccgaacgcgaaaaaacgcaaatcgacgcccaacaatcacaaaaaccgacaaaacgttcaaacgaaaacataaccgctaaacccataaaataaaacgcaaccccgtctcataaaccccaacgatctaaacccaaacaccgtctaaatcgaatatttaaaaaaacgttcgcttaataaattaaacctatatattacttaaccgaaaaaaacatcgttttctctttaaataaaaaaaatttcgaaatatcgacgcaaaactccgacgaaaataaaaataaaaataaaataaaaaaaaataaaaaaaacgcgacctaaaatataaaacgcttcttacaatctcccctaaacgataacgcttaatcgaactcctctatttattctttaatacctataaaattaaaacctcgaaatcgaaaacgatctttaatatcccgatcatttttactaatctttaaacct

SEQ ID NO: 19861 - DNA, 536 bp, Artificial Sequence
  chemically treated genomic DNA (Homo sapiens) CpG-island No: 19861
gaggtgttcgtgaattttttttaaaaggttaatagatcgtcgttagatattagatttattaaacgttaaatttgttgtttaattttattttattttatcgttaaattagttttgtttgattcggttaagattgggttacggcggtattaatagcgtataaattgataatttgtatttttttttacgagtagtagtcgagtcgttattatcgttttaaaatcgtcgtttaatttttttcgcgcgatcgagtcgatagttgcgtcgtaatagtagcgcgtcggggtcgtttagtatttttaatacggcgttttatatttttgtgtcgtcgttttgtaatattttttttttatacgcggttcgcggaaacgtatttattgtggggagttacgttttgtagtattttgatcgtaaggaatcggcgttgtttttagtcgcggaaagttcgggtggtttcggttttttttatcgttcggtttagtataattcgttaagttggggggaggtcgttttttttgggtttttaggcgataaatttt

SEQ ID NO: 19862 - DNA, 536 bp, Artificial Sequence
  chemically treated genomic DNA (Homo sapiens) CpG-island No: 19862
aaaatttatcgcctaaaaacccaaaaaaaacgacctccccccaacttaacgaattatactaaaccgaacgataaaaaaaaccgaaaccacccgaactttccgcgactaaaaacaacgccgattccttacgatcaaaatactacaaaacgtaactccccacaataaatacgtttccgcgaaccgcgtataaaaaaaaaatattacaaaacgacgacacaaaaatataaaacgccgtattaaaaatactaaacgaccccgacgcgctactattacgacgcaactatcgactcgatcgcgcgaaaaaaattaaacgacgattttaaaacgataataacgactcgactactactcgtaaaaaaaaatacaaattatcaatttatacgctattaataccgccgtaacccaatcttaaccgaatcaaacaaaactaatttaacgataaaataaaataaaattaaacaacaaatttaacgtttaataaatctaatatctaacgacgatctattaaccttttaaaaaaaattcacgaacacctc

SEQ ID NO: 19863 - DNA, 536 bp, Artificial Sequence
  chemically treated genomic DNA (Homo sapiens) CpG-island No: 19863
ggggtttgtcgtttggaggtttaagaggaacggtttttttttaatttagcgggttatgttggatcgggcggtgaggggaatcgaggttattcggatttttcgcggttgagggtagcgtcggttttttgcggttaagatgttgtaaaacgtgattttttataataagtacgttttcgcgagtcgcgtgtgggaaggggatgttgtagggcggcggtataggggtgtggggcgtcgtgttgggagtattgagcggtttcggcgcgttgttgttgcggcgtagttgtcgattcggtcgcgcggagggaattgagcgacggttttggaacggtggtggcggttcggttattgttcgtggaggggaatataggttgttaatttatacgttattaatgtcgtcgtggtttagttttaatcgagttaggtagagttagtttgacggtggagtggagtgaggttgaatagtaggtttggcgtttggtgggtttggtatttagcggcggtttgttagttttttaggggggatttacggatatttt

SEQ ID NO: 19864 - DNA, 536 bp, Artificial Sequence
  chemically treated genomic DNA (Homo sapiens) CpG-island No: 19864
aaaatatccgtaaatcccccctaaaaaactaacaaaccgccgctaaataccaaacccaccaaacgccaaacctactattcaacctcactccactccaccgtcaaactaactctacctaactcgattaaaactaaaccacgacgacattaataacgtataaattaacaacctatattcccctccacgaacaataaccgaaccgccaccaccgttccaaaaccgtcgctcaattccctccgcgcgaccgaatcgacaactacgccgcaacaacaacgcgccgaaaccgctcaatactcccaacacgacgccccacacccctataccgccgccctacaacatccccttcccacacgcgactcgcgaaaacgtacttattataaaaaatcacgttttacaacatcttaaccgcaaaaaaccgacgctaccctcaaccgcgaaaaatccgaataacctcgattcccctcaccgcccgatccaacataacccgctaaattaaaaaaaaaccgttcctcttaaacctccaaacgacaaacccc

SEQ ID NO: 19865 - DNA, 784 bp, Artificial Sequence
  chemically treated genomic DNA (Homo sapiens) CpG-island No: 19865
ggagggagtgatttttgcgttttttagttttttttacgacgtcgtttttatagtttgcggagaagcggagattgcgcgtttcgttttatagcgaaacgtcgcgtattcggagtcggtacggttcggcggtgagtgaggtgcggcggtcgcgtcgttttttttttttttcgcgtttcgtcgggacggagcggggcggtcgggggtcggcgagggcgttttcgggggcgcgcggcgcggttcggggcggtgagcggaggcgcggcgtgtgcgtgttttcgcgagggagcgcgcgtggggcggggagcgggtcggggagggggcgtgagcgcgcgcggggttggtgcggtcggcggcgttgagcgcgcgtttcgcgggagcgggcgtcgtcgagatttgagtcgaggggcggggagggattcggggcgacgttcggcgcgcgggtcggggcgtttcgaacggtcgggtaggtattggcgggcgcgcgcgcggtttcgggcgttacgcgttagtaggtgtgagttgggggagggttttcgggtgggttggttcggtcgtcgagttcgtttttcgttttcggggggtttcggcgcggggatattttttcggttcgcggaggcgcgttcgtttttggttggcggtggtagagggaggcgttaggtttcggattttcgggtttttgcgtagcgtttcggtttgtgtgtaggatttgcgtgataaggtgaatgcgttttatatttttcgttagggttttgcgtgtgcggttatttggggaggcggtttagat

SEQ ID NO: 19866 - DNA, 784 bp, Artificial Sequence
  chemically treated genomic DNA (Homo sapiens) CpG-island No: 19866
atctaaaccgcctccccaaataaccgcacacgcaaaaccctaacgaaaaatataaaacgcattcaccttatcacgcaaatcctacacacaaaccgaaacgctacgcaaaaacccgaaaatccgaaacctaacgcctccctctaccaccgccaaccaaaaacgaacgcgcctccgcgaaccgaaaaaatatccccgcgccgaaaccccccgaaaacgaaaaacgaactcgacgaccgaaccaacccacccgaaaaccctcccccaactcacacctactaacgcgtaacgcccgaaaccgcgcgcgcgcccgccaatacctacccgaccgttcgaaacgccccgacccgcgcgccgaacgtcgccccgaatccctccccgcccctcgactcaaatctcgacgacgcccgctcccgcgaaacgcgcgctcaacgccgccgaccgcaccaaccccgcgcgcgctcacgccccctccccgacccgctccccgccccacgcgcgctccctcgcgaaaacacgcacacgccgcgcctccgctcaccgccccgaaccgcgccgcgcgcccccgaaaacgccctcgccgacccccgaccgccccgctccgtcccgacgaaacgcgaaaaaaaaaaaaaacgacgcgaccgccgcacctcactcaccgccgaaccgtaccgactccgaatacgcgacgtttcgctataaaacgaaacgcgcaatctccgcttctccgcaaactataaaaacgacgtcgtaaaaaaaactaaaaaacgcaaaaatcactccctcc

SEQ ID NO: 19867 - DNA, 784 bp, Artificial Sequence
  chemically treated genomic DNA (Homo sapiens) CpG-island No: 19867
gtttgagtcgtttttttaagtggtcgtatacgtagggttttggcgaggggtgtggaacgtatttattttgttacgtaggttttgtatataggtcgggacgttgcgtagggattcgaggattcgaggtttgacgtttttttttgttatcgttagttaggggcggacgcgttttcgcgggtcgggaaggtgttttcgcgtcgaggtttttcggagacgggaagcgaattcgacggtcgggttagtttattcggaagtttttttttagtttatatttgttggcgcgtgacgttcggagtcgcgcgcgcgttcgttagtgtttgttcggtcgttcggggcgtttcggttcgcgcgtcggacgtcgtttcgagttttttttcgtttttcgatttaaatttcggcggcgttcgttttcgcggagcgcgcgtttagcgtcgtcggtcgtattagtttcgcgcgcgtttacgtttttttttcggttcgtttttcgttttacgcgcgttttttcgcgaggatacgtatacgtcgcgttttcgtttatcgtttcgggtcgcgtcgcgcgttttcgggggcgttttcgtcgattttcggtcgtttcgtttcgtttcggcggggcgcgggggaggggaaggacggcgcggtcgtcgtattttatttatcgtcgagtcgtgtcggtttcgagtgcgcggcgtttcgttgtgaggcgaggcgcgtagttttcgttttttcgtagattatggaggcgacgtcgtaggggggattgaggggcgtaggggttatttttttt

SEQ ID NO: 19868 - DNA, 784 bp, Artificial Sequence
  chemically treated genomic DNA (Homo sapiens) CpG-island No: 19868
aaaaaaaataacccctacgcccctcaatcccccctacgacgtcgcctccataatctacgaaaaaacgaaaactacgcgcctcgcctcacaacgaaacgccgcgcactcgaaaccgacacgactcgacgataaataaaatacgacgaccgcgccgtccttcccctcccccgcgccccgccgaaacgaaacgaaacgaccgaaaatcgacgaaaacgcccccgaaaacgcgcgacgcgacccgaaacgataaacgaaaacgcgacgtatacgtatcctcgcgaaaaaacgcgcgtaaaacgaaaaacgaaccgaaaaaaaaacgtaaacgcgcgcgaaactaatacgaccgacgacgctaaacgcgcgctccgcgaaaacgaacgccgccgaaatttaaatcgaaaaacgaaaaaaaactcgaaacgacgtccgacgcgcgaaccgaaacgccccgaacgaccgaacaaacactaacgaacgcgcgcgcgactccgaacgtcacgcgccaacaaatataaactaaaaaaaaacttccgaataaactaacccgaccgtcgaattcgcttcccgtctccgaaaaacctcgacgcgaaaacaccttcccgacccgcgaaaacgcgtccgcccctaactaacgataacaaaaaaaaacgtcaaacctcgaatcctcgaatccctacgcaacgtcccgacctatatacaaaacctacgtaacaaaataaatacgttccacacccctcgccaaaaccctacgtatacgaccacttaaaaaaacgactcaaac

SEQ ID NO: 19869 - DNA, 987 bp, Artificial Sequence
  chemically treated genomic DNA (Homo sapiens) CpG-island No: 19869
tttcggtagcgtcgttcgtttttcgcgatttgcggttgttttttgagcgcgtatttcggtcgggaagtcgttggttgggtttcgatcgtcgggtagggacgggtcgcgttattcggggtttggagttcgggttttgtcggggagttagggaagggaggttcgggtcggggcgttcgatttcgaagtgttcgagcgttcggaattcgggtggattttttcgttcgtttagcgtagcgttggatcggtcgggattcgggggattatgcgttcggcgttcgtaatttcgcgtcgatttcgggaggttcgcggggcgtttgtcggggtcggaggagggggttcggggtttagagggtcgtgtcggggtcggggtcgcgcggtatttattgtagtaggcgatgagtaggttggttaggattatgaacgtttagaaagttgaggatatgttgggtagggcggtcgtattttgtcggttgtcggttttgggcgatggcgttattgaagtcgcggcgttcgcgcggggggtagtagcgcgttttagtagtcggttttgttcgcgttttcgcgtcggtttttacgtgcgggtttcgcgcgcgttatttttcgtcgtcgtcgtcgtcgcgttcgggtttcggtttatcgcgtttcgcgtcgcgttcgcgtcgttcgcgttcgcgttcgcgttcgtcgatttcgcgtcggttcgttagggggacgtcggtttcgttttgggcgttattgcgcgtttcggttacgcgcgtttcggtattcgcgagagaggcgcgcgttcgttatcgttgggggttttagtcgttcgtcgattcgggtttggtagaggggacgcggcgtttaagtcgttttttcggatggcgatagagacggtttgacgcgttcgtagtttgggttttttacggggaggacggtcgggttaggtgaagttcgcgtatttgggtttttcgcgtttttatttatcgtagttagggtttggaa

SEQ ID NO: 19870 - DNA, 987 bp, Artificial Sequence
  chemically treated genomic DNA (Homo sapiens) CpG-island No: 19870
ttccaaaccctaactacgataaataaaaacgcgaaaaacccaaatacgcgaacttcacctaacccgaccgtcctccccgtaaaaaacccaaactacgaacgcgtcaaaccgtctctatcgccatccgaaaaaacgacttaaacgccgcgtcccctctaccaaacccgaatcgacgaacgactaaaacccccaacgataacgaacgcgcgcctctctcgcgaataccgaaacgcgcgtaaccgaaacgcgcaataacgcccaaaacgaaaccgacgtccccctaacgaaccgacgcgaaatcgacgaacgcgaacgcgaacgcgaacgacgcgaacgcgacgcgaaacgcgataaaccgaaacccgaacgcgacgacgacgacgacgaaaaataacgcgcgcgaaacccgcacgtaaaaaccgacgcgaaaacgcgaacaaaaccgactactaaaacgcgctactaccccccgcgcgaacgccgcgacttcaataacgccatcgcccaaaaccgacaaccgacaaaatacgaccgccctacccaacatatcctcaactttctaaacgttcataatcctaaccaacctactcatcgcctactacaataaataccgcgcgaccccgaccccgacacgaccctctaaaccccgaaccccctcctccgaccccgacaaacgccccgcgaacctcccgaaatcgacgcgaaattacgaacgccgaacgcataatcccccgaatcccgaccgatccaacgctacgctaaacgaacgaaaaaatccacccgaattccgaacgctcgaacacttcgaaatcgaacgccccgacccgaacctcccttccctaactccccgacaaaacccgaactccaaaccccgaataacgcgacccgtccctacccgacgatcgaaacccaaccaacgacttcccgaccgaaatacgcgctcaaaaaacaaccgcaaatcgcgaaaaacgaacgacgctaccgaaa

SEQ ID NO: 19871 - DNA, 987 bp, Artificial Sequence
  chemically treated genomic DNA (Homo sapiens) CpG-island No: 19871
ttttaggttttggttgcggtggatgggggcgcggaaggtttaagtgcgcgaattttatttggttcggtcgtttttttcgtggggggtttaggttgcgggcgcgttaggtcgtttttgtcgttattcggaggagcggtttgggcgtcgcgttttttttgttaggttcgggtcggcgggcggttggagtttttagcggtggcgggcgcgcgtttttttcgcggatgtcggggcgcgcgtagtcggggcgcgtagtgacgtttagagcggggtcggcgtttttttggcgggtcggcgcggggtcggcgggcgcgggcgcgagcgcgggcggcgcgggcgcggcgcggggcgcggtgggtcggggttcgggcgcggcggcggcggcggcggaggatggcgcgcgcggggttcgtacgtggaggtcggcgcgggggcgcgggtagggtcggttgttgagacgcgttgttgtttttcgcgcgggcgtcgcggttttaatggcgttatcgtttaggatcggtagtcggtaagatgcgatcgttttgtttagtatgtttttaattttttgggcgtttatgattttggttagtttgtttatcgtttattgtagtgagtatcgcgcggtttcggtttcggtacggttttttgggtttcggattttttttttcggtttcggtaggcgtttcgcgggtttttcggagtcggcgcggagttacgagcgtcgggcgtatggtttttcgagtttcggtcggtttaacgttgcgttgggcgggcgagagggtttattcgggtttcgggcgttcgagtatttcggggtcggacgtttcggttcgagttttttttttttgatttttcggtagggttcgggttttaggtttcgggtggcgcggttcgtttttgttcggcggtcggagtttagttagcggtttttcggtcgagatgcgcgtttaggaggtagtcgtaggtcgcggagggcgggcggcgttgtcgggg

SEQ ID NO: 19872 - DNA, 987 bp, Artificial Sequence
  chemically treated genomic DNA (Homo sapiens) CpG-island No: 19872
ccccgacaacgccgcccgccctccgcgacctacgactacctcctaaacgcgcatctcgaccgaaaaaccgctaactaaactccgaccgccgaacaaaaacgaaccgcgccacccgaaacctaaaacccgaaccctaccgaaaaatcaaaaaaaaaaaactcgaaccgaaacgtccgaccccgaaatactcgaacgcccgaaacccgaataaaccctctcgcccgcccaacgcaacgttaaaccgaccgaaactcgaaaaaccatacgcccgacgctcgtaactccgcgccgactccgaaaaacccgcgaaacgcctaccgaaaccgaaaaaaaaaatccgaaacccaaaaaaccgtaccgaaaccgaaaccgcgcgatactcactacaataaacgataaacaaactaaccaaaatcataaacgcccaaaaaattaaaaacatactaaacaaaacgatcgcatcttaccgactaccgatcctaaacgataacgccattaaaaccgcgacgcccgcgcgaaaaacaacaacgcgtctcaacaaccgaccctacccgcgcccccgcgccgacctccacgtacgaaccccgcgcgcgccatcctccgccgccgccgccgccgcgcccgaaccccgacccaccgcgccccgcgccgcgcccgcgccgcccgcgctcgcgcccgcgcccgccgaccccgcgccgacccgccaaaaaaacgccgaccccgctctaaacgtcactacgcgccccgactacgcgcgccccgacatccgcgaaaaaaacgcgcgcccgccaccgctaaaaactccaaccgcccgccgacccgaacctaacaaaaaaaacgcgacgcccaaaccgctcctccgaataacgacaaaaacgacctaacgcgcccgcaacctaaaccccccacgaaaaaaacgaccgaaccaaataaaattcgcgcacttaaaccttccgcgcccccatccaccgcaaccaaaacctaaaa

SEQ ID NO: 19873 - DNA, 902 bp, Artificial Sequence
  chemically treated genomic DNA (Homo sapiens) CpG-island No: 19873
cgagggcgaggattttcgtgttttttcgtttcgcgtagtatagttttgttaggtagtgtataggtgtacgatcgcgttcgttcgttcggttcggttcgggttttagtttcggtatagtgatcgtcgttttgcgatttcggtttcgagggtaggggtagaaggtcggtaagaagagggtaggggacgcgagggtcgtttcgttcgatttttcgaggacgcgcgtagtagggtcgggggggaaaaaggatgttttaggcggggcgaggtcgcggtgggggaggggtttttaattcggatttttatttatcgtttcgcgcggttttcggtcgggtttcgcggttcgttttatttcggttttagtcgttcgcgttttttttcgaggtttattgtttagttcgggcgtacggagttgagaagtcgtcgttagcggagggcgtgtggttagcggtaattaagagggtgggaaagatgggatcgtcgttttcgtcgtcgcggttattatagatattgtcgtcgtcggttttttttagttacggaagttgcgggttcgtttattacgttcgtttttcgttttgaagattgttcgttggagaagtgacggcggcgttagttaattagaggtttgatcggggtcgtgatcggcggattaaagggcgggcggagaaggaagcggtatgaagaaggcgaaaacggcggtttgattttttgtgattgacggtacggcgtagttaatgggtaacggggagatgattttatttttgaggaaagtttggaattggttgagttgcggcgagggggttggcgacgagtcgggggcggagttttgggttttaaagaggtcgtagttttgtggttattttgtgaagggaagggcggtggattttgtcggattttgcgaagtt

SEQ ID NO: 19874 - DNA, 902 bp, Artificial Sequence
  chemically treated genomic DNA (Homo sapiens) CpG-island No: 19874
aacttcgcaaaatccgacaaaatccaccgcccttcccttcacaaaataaccacaaaactacgacctctttaaaacccaaaactccgcccccgactcgtcgccaaccccctcgccgcaactcaaccaattccaaactttcctcaaaaataaaatcatctccccgttacccattaactacgccgtaccgtcaatcacaaaaaatcaaaccgccgttttcgccttcttcataccgcttccttctccgcccgccctttaatccgccgatcacgaccccgatcaaacctctaattaactaacgccgccgtcacttctccaacgaacaatcttcaaaacgaaaaacgaacgtaataaacgaacccgcaacttccgtaactaaaaaaaaccgacgacgacaatatctataataaccgcgacgacgaaaacgacgatcccatctttcccaccctcttaattaccgctaaccacacgccctccgctaacgacgacttctcaactccgtacgcccgaactaaacaataaacctcgaaaaaaaacgcgaacgactaaaaccgaaataaaacgaaccgcgaaacccgaccgaaaaccgcgcgaaacgataaataaaaatccgaattaaaaacccctcccccaccgcgacctcgccccgcctaaaacatcctttttcccccccgaccctactacgcgcgtcctcgaaaaatcgaacgaaacgaccctcgcgtcccctaccctcttcttaccgaccttctacccctaccctcgaaaccgaaatcgcaaaacgacgatcactataccgaaactaaaacccgaaccgaaccgaacgaacgaacgcgatcgtacacctatacactacctaacaaaactatactacgcgaaacgaaaaaacacgaaaatcctcgccctcg

SEQ ID NO: 19875 - DNA, 902 bp, Artificial Sequence
  chemically treated genomic DNA (Homo sapiens) CpG-island No: 19875
aatttcgtaagattcggtagggtttatcgtttttttttttatagggtgattatagggttgcggtttttttaaggtttagagtttcgttttcggttcgtcgttaattttttcgtcgtagtttagttagttttagattttttttagagatgaggttattttttcgttgtttattggttgcgtcgtgtcgttagttataggaagttaggtcgtcgttttcgttttttttatgtcgttttttttttcgttcgttttttagttcgtcgattacgatttcgattaggtttttgattggttagcgtcgtcgttatttttttagcggatagtttttaggacgggaggcgggcgtggtgggcgggttcgtagttttcgtggttgagaggagtcggcggcggtagtgtttgtggtggtcgcggcggcgagagcgacggttttattttttttatttttttggttgtcgttggttatacgtttttcgttggcggcgattttttagtttcgtgcgttcgggttggatagtgagtttcgagaggagacgcgggcggttagagtcggagtggggcgagtcgcggaattcggtcgggagtcgcgcgaggcggtgagtgagagttcgggttggggattttttttttatcgcggtttcgtttcgtttggagtattttttttttttttcgattttgttgcgcgcgttttcggggggtcgggcgaggcggttttcgcgttttttgttttttttttgtcggttttttgtttttgttttcggggtcggagtcgtagagcggcggttattgtgtcggggttgggattcgggtcgggtcgggcgggcgggcgcggtcgtgtatttgtgtattgtttggtagggttgtgttgcgcggggcggggaggtacggaggttttcgttttcg

SEQ ID NO: 19876 - DNA, 902 bp, Artificial Sequence
  chemically treated genomic DNA (Homo sapiens) CpG-island No: 19876
cgaaaacgaaaacctccgtacctccccgccccgcgcaacacaaccctaccaaacaatacacaaatacacgaccgcgcccgcccgcccgacccgacccgaatcccaaccccgacacaataaccgccgctctacgactccgaccccgaaaacaaaaacaaaaaaccgacaaaaaaaaaacaaaaaacgcgaaaaccgcctcgcccgaccccccgaaaacgcgcgcaacaaaatcgaaaaaaaaaaaaaatactccaaacgaaacgaaaccgcgataaaaaaaaaatccccaacccgaactctcactcaccgcctcgcgcgactcccgaccgaattccgcgactcgccccactccgactctaaccgcccgcgtctcctctcgaaactcactatccaacccgaacgcacgaaactaaaaaatcgccgccaacgaaaaacgtataaccaacgacaaccaaaaaaataaaaaaaataaaaccgtcgctctcgccgccgcgaccaccacaaacactaccgccgccgactcctctcaaccacgaaaactacgaacccgcccaccacgcccgcctcccgtcctaaaaactatccgctaaaaaaataacgacgacgctaaccaatcaaaaacctaatcgaaatcgtaatcgacgaactaaaaaacgaacgaaaaaaaaaacgacataaaaaaaacgaaaacgacgacctaacttcctataactaacgacacgacgcaaccaataaacaacgaaaaaataacctcatctctaaaaaaaatctaaaactaactaaactacgacgaaaaaattaacgacgaaccgaaaacgaaactctaaaccttaaaaaaaccgcaaccctataatcaccctataaaaaaaaaaacgataaaccctaccgaatcttacgaaatt

SEQ ID NO: 19877 - DNA, 502 bp, Artificial Sequence
  chemically treated genomic DNA (Homo sapiens) CpG-island No: 19877
gcgcgggcggtattttgcggtgaattaagaaggtttcgtcgaggttaaagcgtaatatcgcgatagtttttaacgtatgcgggagtcggtcgtggtaggttggtttcgttttttattgtttcgttaggttgtgcgttatttgtttttcgtttcgcgtagggtgaagttgtagttatttcggttttggtgggagggaggaggggtttggaaagggttgggtttaggtttttttcgttcggtagaggttttcgcgggatcgcgcggaggcggcggtggttcggttattgattgtagtagtcgcggaggcggcggtaaggttttcggttcgtgtcgttttaagtcggagaattttcgcgggagtagggttacgttttcgtgggattcgttggcggtggttgaggtagttcgcgggtggggggtgggggggtagtgattagggtcggttcgtttgttgttaagatggcggcggaggttgatgtttgttcggttaggatttagtata

SEQ ID NO: 19878 - DNA, 502 bp, Artificial Sequence
  chemically treated genomic DNA (Homo sapiens) CpG-island No: 19878
tatactaaatcctaaccgaacaaacatcaacctccgccgccatcttaacaacaaacgaaccgaccctaatcactacccccccaccccccacccgcgaactacctcaaccaccgccaacgaatcccacgaaaacgtaaccctactcccgcgaaaattctccgacttaaaacgacacgaaccgaaaaccttaccgccgcctccgcgactactacaatcaataaccgaaccaccgccgcctccgcgcgatcccgcgaaaacctctaccgaacgaaaaaaacctaaacccaaccctttccaaacccctcctccctcccaccaaaaccgaaataactacaacttcaccctacgcgaaacgaaaaacaaataacgcacaacctaacgaaacaataaaaaacgaaaccaacctaccacgaccgactcccgcatacgttaaaaactatcgcgatattacgctttaacctcgacgaaaccttcttaattcaccgcaaaataccgcccgcgc

SEQ ID NO: 19879 - DNA, 502 bp, Artificial Sequence
  chemically treated genomic DNA (Homo sapiens) CpG-island No: 19879
tgtgttgggttttggtcggatagatattagttttcgtcgttattttaatagtaggcggatcgattttagttattgtttttttattttttattcgcgagttattttagttatcgttaacgaattttacgaggacgtaattttgttttcgcgagaatttttcggtttagaacggtacgagtcgaagattttgtcgtcgttttcgcggttattgtagttagtaatcgagttatcgtcgttttcgcgcgatttcgcgagaatttttatcggacgggaaaagtttgagtttagttttttttagatttttttttttttttattaaagtcgaagtagttatagttttattttacgcgaagcgaaaagtaaatgacgtataatttaacgaagtagtgaggggcggagttaatttattacggtcggttttcgtatgcgttgagaattatcgcgatattacgttttagtttcggcgagatttttttaatttatcgtaggatgtcgttcgcgt

SEQ ID NO: 19880 - DNA, 502 bp, Artificial Sequence
  chemically treated genomic DNA (Homo sapiens) CpG-island No: 19880
acgcgaacgacatcctacgataaattaaaaaaatctcgccgaaactaaaacgtaatatcgcgataattctcaacgcatacgaaaaccgaccgtaataaattaactccgcccctcactacttcgttaaattatacgtcatttacttttcgcttcgcgtaaaataaaactataactacttcgactttaataaaaaaaaaaaaaaatctaaaaaaaactaaactcaaacttttcccgtccgataaaaattctcgcgaaatcgcgcgaaaacgacgataactcgattactaactacaataaccgcgaaaacgacgacaaaatcttcgactcgtaccgttctaaaccgaaaaattctcgcgaaaacaaaattacgtcctcgtaaaattcgttaacgataactaaaataactcgcgaataaaaaataaaaaaacaataactaaaatcgatccgcctactattaaaataacgacgaaaactaatatctatccgaccaaaacccaacaca

SEQ ID NO: 19881 - DNA, 1301 bp, Artificial Sequence
  chemically treated genomic DNA (Homo sapiens) CpG-island No: 19881
gcgtttcgttagggttcggtaggatttcgtttttaagtcgggaaaagttggtcggcgtttttttttttcgacgaagtcgttttagggttgtttttagaggacgcgcggtaggtaaagagaatgaatttgagcgtttacgaaacgttttgtacggttttcgggagttgggagaaataggtgttttttttcgacgttcgcgggcgacgtttgtcgtattttgttcgttgtcgcgtttttttcgggtatttttcgttttcggcgtttttgtttttatttttagtgttagggcggaggtagtttcggttcgtaggtaattattgttagcggagttcgtcggggagcgggggtgggcgcgtcggcggtgggcgggcgggcgcggcggggcgcgggtataaaggggcgcggcgcggggtttcggagtttggttttcgcgtagtatgttcgttagcgtttcgtcgcgtcgttcgcggtcgtcgtcgtcgtcgttgtcgttgttgttggtgttgttgggtttgggcggtcgtcgtttgcgtgcggagtcgggcgacggcgcgtagatttgggttcgtttttcgcggttttttgttttcgaggtcgcgggttttttttagggtatttttttcgacggttttttttgggtcgtgggtagcgtcgtttattagatcgagggcggttggtagtagtacggtaagggtgcgtttatttgggatacgtttatttattattttttggtattttcgggagattttcggaacgttagtttgtcgttgggcgtttcgtcgtcgttgtagttcgttatcggggacgtagttagcgatagttataataacgtttttcgcgatacggaggcgttgcgcgagttcggggttatttattatcgtttttttatttcgtgggcgcgagtgttttttaatggtagcgcgggcgtttttaatcgcgaggggttgcgttattatcggcgtttgttggagcggttgcgggagttgggcgtgtagttcgtggttattttgtattattgggatttgttttagcgtttgtaggacgtttacggcggttgggttaatcgcgttttggtcgattattttagggattacgcggagttttgttttcgttatttcggcggttaggttaagtattggattattatcgataatttttacgtggtggtttggtacggttacgttatcgggcgtttggttttcggtattcggggtagttcgcggttcgggtatttggtggcgtataatttttttttggtgagtgcgaggggttaggcggagggttacgtaggggagatagag

SEQ ID NO: 19882 - DNA, 1301 bp, Artificial Sequence
  chemically treated genomic DNA (Homo sapiens) CpG-island No: 19882
ctctatctcccctacgtaaccctccgcctaacccctcgcactcaccaaaaaaaaattatacgccaccaaatacccgaaccgcgaactaccccgaataccgaaaaccaaacgcccgataacgtaaccgtaccaaaccaccacgtaaaaattatcgataataatccaatacttaacctaaccgccgaaataacgaaaacaaaactccgcgtaatccctaaaataatcgaccaaaacgcgattaacccaaccgccgtaaacgtcctacaaacgctaaaacaaatcccaataatacaaaataaccacgaactacacgcccaactcccgcaaccgctccaacaaacgccgataataacgcaacccctcgcgattaaaaacgcccgcgctaccattaaaaaacactcgcgcccacgaaataaaaaaacgataataaataaccccgaactcgcgcaacgcctccgtatcgcgaaaaacgttattataactatcgctaactacgtccccgataacgaactacaacgacgacgaaacgcccaacgacaaactaacgttccgaaaatctcccgaaaataccaaaaaataataaataaacgtatcccaaataaacgcacccttaccgtactactaccaaccgccctcgatctaataaacgacgctacccacgacccaaaaaaaaccgtcgaaaaaaataccctaaaaaaaacccgcgacctcgaaaacaaaaaaccgcgaaaaacgaacccaaatctacgcgccgtcgcccgactccgcacgcaaacgacgaccgcccaaacccaacaacaccaacaacaacgacaacgacgacgacgacgaccgcgaacgacgcgacgaaacgctaacgaacatactacgcgaaaaccaaactccgaaaccccgcgccgcgcccctttatacccgcgccccgccgcgcccgcccgcccaccgccgacgcgcccacccccgctccccgacgaactccgctaacaataattacctacgaaccgaaactacctccgccctaacactaaaaataaaaacaaaaacgccgaaaacgaaaaatacccgaaaaaaacgcgacaacgaacaaaatacgacaaacgtcgcccgcgaacgtcgaaaaaaaacacctatttctcccaactcccgaaaaccgtacaaaacgtttcgtaaacgctcaaattcattctctttacctaccgcgcgtcctctaaaaacaaccctaaaacgacttcgtcgaaaaaaaaaaacgccgaccaacttttcccgacttaaaaacgaaatcctaccgaaccctaacgaaacgc

SEQ ID NO: 19883 - DNA, 1301 bp, Artificial Sequence
  chemically treated genomic DNA (Homo sapiens) CpG-island No: 19883
ttttgttttttttgcgtggtttttcgtttggtttttcgtatttattaggaggaggttgtgcgttattaggtattcgagtcgcgggttgtttcggatgtcgggggttaggcgttcggtggcgtagtcgtgttaggttattacgtaggggttgtcgatggtgatttagtatttgatttgatcgtcgaagtggcggaagtagagtttcgcgtaatttttgaagtggtcggttagggcgcggttggtttagtcgtcgtaggcgttttgtaggcgttggggtaggttttagtggtatagggtgattacgggttgtacgtttagttttcgtagtcgttttagtaggcgtcggtagtagcgtagtttttcgcggttggggacgttcgcgttgttattggggagtattcgcgtttacgagatggagaagcggtagtgagtgatttcgagttcgcgtagcgttttcgtgtcgcggaagacgttgttgtagttgtcgttggttacgttttcggtggcgggttgtagcggcgacggggcgtttaacggtagattggcgtttcgggagtttttcgggggtgttagggggtggtgggtgaacgtgttttagatggacgtatttttgtcgtgttgttgttagtcgttttcggtttggtaggcggcgttgtttacggtttagaggaagtcgtcggggaaggtgttttggaagaggttcgcggtttcgggggtaggaggtcgcgagaaacgggtttaggtttgcgcgtcgtcgttcggtttcgtacgtaggcggcggtcgtttaggtttagtagtattagtagtagcgatagcgacggcggcggcggtcgcgggcggcgcggcggggcgttggcgggtatgttgcgcgggagttaggtttcggggtttcgcgtcgcgtttttttatgttcgcgtttcgtcgcgttcgttcgtttatcgtcggcgcgtttattttcgtttttcggcgggtttcgttggtaataattatttgcgagtcgggattgttttcgttttggtattgggggtgggggtaggggcgtcgagggcgaggggtgttcgggaggggcgcggtagcgggtaaggtgcggtaggcgtcgttcgcggacgtcggagaaaggtatttgttttttttagttttcgggagtcgtgtaggacgtttcgtggacgtttaggtttattttttttgtttgtcgcgcgttttttgagagtagttttggagcggtttcgtcggggagaaaaggcgtcgattaatttttttcgatttgggggcgggattttgtcgggttttagcggagcgt

SEQ ID NO: 19884 - DNA, 1301 bp, Artificial Sequence
  chemically treated genomic DNA (Homo sapiens) CpG-island No: 19884
acgctccgctaaaacccgacaaaatcccgcccccaaatcgaaaaaaattaatcgacgccttttctccccgacgaaaccgctccaaaactactctcaaaaaacgcgcgacaaacaaaaaaaataaacctaaacgtccacgaaacgtcctacacgactcccgaaaactaaaaaaaacaaatacctttctccgacgtccgcgaacgacgcctaccgcaccttacccgctaccgcgcccctcccgaacacccctcgccctcgacgcccctacccccacccccaataccaaaacgaaaacaatcccgactcgcaaataattattaccaacgaaacccgccgaaaaacgaaaataaacgcgccgacgataaacgaacgaacgcgacgaaacgcgaacataaaaaaacgcgacgcgaaaccccgaaacctaactcccgcgcaacatacccgccaacgccccgccgcgccgcccgcgaccgccgccgccgtcgctatcgctactactaatactactaaacctaaacgaccgccgcctacgtacgaaaccgaacgacgacgcgcaaacctaaacccgtttctcgcgacctcctacccccgaaaccgcgaacctcttccaaaacaccttccccgacgacttcctctaaaccgtaaacaacgccgcctaccaaaccgaaaacgactaacaacaacacgacaaaaatacgtccatctaaaacacgttcacccaccaccccctaacacccccgaaaaactcccgaaacgccaatctaccgttaaacgccccgtcgccgctacaacccgccaccgaaaacgtaaccaacgacaactacaacaacgtcttccgcgacacgaaaacgctacgcgaactcgaaatcactcactaccgcttctccatctcgtaaacgcgaatactccccaataacaacgcgaacgtccccaaccgcgaaaaactacgctactaccgacgcctactaaaacgactacgaaaactaaacgtacaacccgtaatcaccctataccactaaaacctaccccaacgcctacaaaacgcctacgacgactaaaccaaccgcgccctaaccgaccacttcaaaaattacgcgaaactctacttccgccacttcgacgatcaaatcaaatactaaatcaccatcgacaacccctacgtaataacctaacacgactacgccaccgaacgcctaacccccgacatccgaaacaacccgcgactcgaatacctaataacgcacaacctcctcctaataaatacgaaaaaccaaacgaaaaaccacgcaaaaaaaacaaaa

SEQ ID NO: 19885 - DNA, 532 bp, Artificial Sequence
  chemically treated genomic DNA (Homo sapiens) CpG-island No: 19885
cgcgcgagggacgaagggcggtttattgtaaggggaaatgttgaggattattgggtttttttcggttttttgaacgtaagttagtaagtgggcgggatttggggcgggcggagcggcgaaagtatttgtttttgcgttttgtggttttttgttttcggttttttcgtttgcgacgtcgaagggggcgtggtttgcgtagaggttggtgggggtgcgggcgtcgcgggatttgggtgacgcgtttttttttagtttagcggtgtgtgaggtgtcgcggtttcgtcggcgattggttgttgagaggcgagtacgcggcggtcgttggtcgttggttttacggagtaaggttttcggcgggcggggaggatatggggcggtagtggcggttgtaggaggcgggcgtggacgagtcggtggttgtagcggcggcggttttcggagttttgtgaagcgtttttgttcgcgtttttgtggggtttttagagagggttgttaggacgcgagttattgaggagtcgtttagttagcgtta

SEQ ID NO: 19886 - DNA, 532 bp, Artificial Sequence
  chemically treated genomic DNA (Homo sapiens) CpG-island No: 19886
taacgctaactaaacgactcctcaataactcgcgtcctaacaaccctctctaaaaaccccacaaaaacgcgaacaaaaacgcttcacaaaactccgaaaaccgccgccgctacaaccaccgactcgtccacgcccgcctcctacaaccgccactaccgccccatatcctccccgcccgccgaaaaccttactccgtaaaaccaacgaccaacgaccgccgcgtactcgcctctcaacaaccaatcgccgacgaaaccgcgacacctcacacaccgctaaactaaaaaaaaacgcgtcacccaaatcccgcgacgcccgcacccccaccaacctctacgcaaaccacgcccccttcgacgtcgcaaacgaaaaaaccgaaaacaaaaaaccacaaaacgcaaaaacaaatactttcgccgctccgcccgccccaaatcccgcccacttactaacttacgttcaaaaaaccgaaaaaaacccaataatcctcaacatttccccttacaataaaccgcccttcgtccctcgcgcg

SEQ ID NO: 19887 - DNA, 532 bp, Artificial Sequence
  chemically treated genomic DNA (Homo sapiens) CpG-island No: 19887
tggcgttggttgagcggttttttagtggttcgcgttttggtagttttttttgagggttttatagaggcgcggataggggcgttttataggatttcggggatcgtcgtcgttgtagttatcggttcgtttacgttcgttttttgtagtcgttattgtcgttttatatttttttcgttcgtcgggggttttgtttcgtgaggttagcgattaacggtcgtcgcgtattcgttttttaatagttaatcgtcggcggggtcgcgatattttatatatcgttgagttggaaagggacgcgttatttaagtttcgcggcgttcgtatttttattagtttttgcgtaggttacgtttttttcgacgtcgtaggcggagaagtcggaggtaggagattataaagcgtaggagtagatgttttcgtcgtttcgttcgttttaggtttcgtttatttgttggtttgcgtttagaaagtcgggaggagtttagtgatttttagtatttttttttatagtggatcgtttttcgtttttcgcgcg

SEQ ID NO: 19888 - DNA, 532 bp, Artificial Sequence
  chemically treated genomic DNA (Homo sapiens) CpG-island No: 19888
cgcgcgaaaaacgaaaaacgatccactataaaaaaaaatactaaaaatcactaaactcctcccgactttctaaacgcaaaccaacaaataaacgaaacctaaaacgaacgaaacgacgaaaacatctactcctacgctttataatctcctacctccgacttctccgcctacgacgtcgaaaaaaacgtaacctacgcaaaaactaataaaaatacgaacgccgcgaaacttaaataacgcgtccctttccaactcaacgatatataaaatatcgcgaccccgccgacgattaactattaaaaaacgaatacgcgacgaccgttaatcgctaacctcacgaaacaaaacccccgacgaacgaaaaaaatataaaacgacaataacgactacaaaaaacgaacgtaaacgaaccgataactacaacgacgacgatccccgaaatcctataaaacgcccctatccgcgcctctataaaaccctcaaaaaaaactaccaaaacgcgaaccactaaaaaaccgctcaaccaacgcca

SEQ ID NO: 19889 - DNA, 1139 bp, Artificial Sequence
  chemically treated genomic DNA (Homo sapiens) CpG-island No: 19889
tttagcgtttgggtcgtgggggtttgcgttcgcgtttgtttcgtcgtttgcgtttgtagtatcgtggagcgcggttgttcggtgcgttgcgatcgcgcgggttttttgcgggtgtcggtcgagttttcgtgcgaggcggtttttatcgatttggatcggaacggtttgcgttttttgggcgagcgagttttcggtacgttgtcgtttttgcgtcgtttgtcgttgcgttataataatttgttttttattacgttcggcgtttttaagggtttgtcgcgtttggttgagttgcgtttggcgtataacggcgatttgcgttatttgtacgcgcgtattttcgcggcgtttagtcgtttgcgtcgtttagatttagtagtttgtcgtttttttagcgtgttcgagcgttttttggtcgaattgtcggttttgcgcgaattcgtcgttttcgataatttgtttcgtcgcgtgtcgggcgcgttgcgcggtttggttaatttgacgtacgcgtatttggagcgcggtcgtatcgaggcggtggtttttagttcgttgtagggtttgcgtcgtttgcgttcgtttagtttgtaggttaatcgcgttcgtgtcgtgtacgttggcgttttcggggattgtggcgttttggagtatttgttgtttaacgataatttgttggtcgagttttcggtcgacgtttttcgcggtttgcggcgtttgcgtacgtttaatttgggtggtaacgcgttggatcgcgtggcgcgcgtttggttcgttgatttggtcgagttcgagttgttttatttggatcgtaatagtatcgttttcgtggaggagggcgttttttagaatttttcgggttttttcgcgttgtattttaacggtaatcgttttatcgtgttcgtttgggtcgttttttagttcggtttttttttgggtcgtttttttttttttcgtaattcgtggtgttgcgattgtcgtttggagtggttgagggattggatggagggtttcggacgtgttatcgacgtgtcgtgcgttttttcgggtttcgtggtcggtttggattttagttaggtgattttcgggcgttttttcgatggtttttgtgtggatttcgaggagttgaattttattacgtttag

SEQ ID NO: 19890 - DNA, 1139 bp, Artificial Sequence
  chemically treated genomic DNA (Homo sapiens) CpG-island No: 19890
ctaaacgtaataaaattcaactcctcgaaatccacacaaaaaccatcgaaaaaacgcccgaaaatcacctaactaaaatccaaaccgaccacgaaacccgaaaaaacgcacgacacgtcgataacacgtccgaaaccctccatccaatccctcaaccactccaaacgacaatcgcaacaccacgaattacgaaaaaaaaaaaaacgacccaaaaaaaaaccgaactaaaaaacgacccaaacgaacacgataaaacgattaccgttaaaatacaacgcgaaaaaacccgaaaaattctaaaaaacgccctcctccacgaaaacgatactattacgatccaaataaaacaactcgaactcgaccaaatcaacgaaccaaacgcgcgccacgcgatccaacgcgttaccacccaaattaaacgtacgcaaacgccgcaaaccgcgaaaaacgtcgaccgaaaactcgaccaacaaattatcgttaaacaacaaatactccaaaacgccacaatccccgaaaacgccaacgtacacgacacgaacgcgattaacctacaaactaaacgaacgcaaacgacgcaaaccctacaacgaactaaaaaccaccgcctcgatacgaccgcgctccaaatacgcgtacgtcaaattaaccaaaccgcgcaacgcgcccgacacgcgacgaaacaaattatcgaaaacgacgaattcgcgcaaaaccgacaattcgaccaaaaaacgctcgaacacgctaaaaaaacgacaaactactaaatctaaacgacgcaaacgactaaacgccgcgaaaatacgcgcgtacaaataacgcaaatcgccgttatacgccaaacgcaactcaaccaaacgcgacaaacccttaaaaacgccgaacgtaataaaaaacaaattattataacgcaacgacaaacgacgcaaaaacgacaacgtaccgaaaactcgctcgcccaaaaaacgcaaaccgttccgatccaaatcgataaaaaccgcctcgcacgaaaactcgaccgacacccgcaaaaaacccgcgcgatcgcaacgcaccgaacaaccgcgctccacgatactacaaacgcaaacgacgaaacaaacgcgaacgcaaacccccacgacccaaacgctaaa

SEQ ID NO: 19891 - DNA, 1139 bp, Artificial Sequence
  chemically treated genomic DNA (Homo sapiens) CpG-island No: 19891
ttggacgtggtgaggtttagtttttcggggtttatatagaggttatcggaggagcgttcgaaggttatttggttgaggtttaggtcggttacggagttcggggaggcgtacggtacgtcggtgatacgttcggagttttttatttagttttttagttattttagacggtagtcgtagtattacgggttgcggaagaggaagaggcggtttaggaagaagtcgggttggaaggcgatttaggcgagtacggtgaggcggttgtcgttgaggtgtagcgcgaggagattcgagaggttttggaaggcgtttttttttacgaaggcgatgttgttgcggtttaggtagagtagttcgagttcggttaggttagcgaattaggcgcgcgttacgcggtttagcgcgttgttatttaggttgagcgtgcgtaggcgtcgtaggtcgcggaaggcgtcggtcgggagttcggttagtaggttgtcgttgagtagtagatgttttaggacgttatagttttcgaaggcgttagcgtgtacggtacggacgcggttggtttgtaggttgagcgagcgtaggcggcgtaggttttgtagcgagttggaggttatcgtttcgatgcggtcgcgttttaggtgcgcgtgcgttaggttggttaggtcgcgtagcgcgttcggtacgcggcggaataggttgtcgaaggcggcgagttcgcgtagggtcggtagttcggttaggaggcgttcgggtacgttgaagaggcggtaggttgttaggtttaggcggcgtaggcggttgagcgtcgcgaaggtgcgcgcgtgtaggtagcgtaggtcgtcgttgtgcgttaggcgtagtttagttaggcgcggtaggtttttgaaggcgtcgggcgtgatgaaggataggttgttgtggcgtagcgataggcggcgtaaggacggtagcgtgtcgaaggttcgttcgtttaggaagcgtaggtcgtttcggtttaggtcgatggagatcgtttcgtacgggagttcggtcggtattcgtaggaggttcgcgcggtcgtagcgtatcgagtagtcgcgttttacggtgttgtaggcgtaggcggcgggataagcgcgggcgtaggtttttacggtttaggcgttggg

SEQ ID NO: 19892 - DNA, 1139 bp, Artificial Sequence
  chemically treated genomic DNA (Homo sapiens) CpG-island No: 19892
cccaacgcctaaaccgtaaaaacctacgcccgcgcttatcccgccgcctacgcctacaacaccgtaaaacgcgactactcgatacgctacgaccgcgcgaacctcctacgaataccgaccgaactcccgtacgaaacgatctccatcgacctaaaccgaaacgacctacgcttcctaaacgaacgaaccttcgacacgctaccgtccttacgccgcctatcgctacgccacaacaacctatccttcatcacgcccgacgccttcaaaaacctaccgcgcctaactaaactacgcctaacgcacaacgacgacctacgctacctacacgcgcgcaccttcgcgacgctcaaccgcctacgccgcctaaacctaacaacctaccgcctcttcaacgtacccgaacgcctcctaaccgaactaccgaccctacgcgaactcgccgccttcgacaacctattccgccgcgtaccgaacgcgctacgcgacctaaccaacctaacgcacgcgcacctaaaacgcgaccgcatcgaaacgataacctccaactcgctacaaaacctacgccgcctacgctcgctcaacctacaaaccaaccgcgtccgtaccgtacacgctaacgccttcgaaaactataacgtcctaaaacatctactactcaacgacaacctactaaccgaactcccgaccgacgccttccgcgacctacgacgcctacgcacgctcaacctaaataacaacgcgctaaaccgcgtaacgcgcgcctaattcgctaacctaaccgaactcgaactactctacctaaaccgcaacaacatcgccttcgtaaaaaaaaacgccttccaaaacctctcgaatctcctcgcgctacacctcaacgacaaccgcctcaccgtactcgcctaaatcgccttccaacccgacttcttcctaaaccgcctcttcctcttccgcaacccgtaatactacgactaccgtctaaaataactaaaaaactaaataaaaaactccgaacgtatcaccgacgtaccgtacgcctccccgaactccgtaaccgacctaaacctcaaccaaataaccttcgaacgctcctccgataacctctatataaaccccgaaaaactaaacctcaccacgtccaa

SEQ ID NO: 19893 - DNA, 1474 bp, Artificial Sequence
  chemically treated genomic DNA (Homo sapiens) CpG-island No: 19893
acgcgggtcgcgtagttcgggatttcggaaagatttgggcgttcgatttttagcggtttcgatcgggagcgacgtggcgcggttttcgtagagaagttattcggtttagcgtagtttgttcggggtcgtttcgtcgcgttggggtataaagtgggaatcgttttttaaaggtggtcgtagttggaggaataaatacgcgcgttttcgttcgacggtagaagtcgggcgtatttatttagggtcggtttgttcggggttcgggttttttcgtttcggagatttttggaggtttcggaaagtattttttgagtcggcgacgttttagtttcgttgcgtcgaggaaagggtaagtttcgatgttttcgttcgtgggtttttttttcgaggggataattcgaagatttagagtcgttgcggtttttagattcgattttcgcgtagcgttaaattttagggatagtcgcggattcgggtttcgggtaggtttttagcgttaggagggaggtcgagttgggtttcgagatttttcgtaagagttttcggtgtgtgttttcgtttttcgtttttaggtttttagtcgcgtatttcgggttttcgggttttcgggattcggagatttcgagatttcgggtttcgcgtatgcgtcgtttagtttttgtttttttttcgttcgtcgtttttcgggtttcgggatttgggaagttcggatcgcggattttcgcgcgcgttttcgttcgttcgttcgttcgttttcgggtatttgggtcgcggttcgtcgtttgtcggttcgtggggcgaacgtcgaaggaggcggcgtcgggtagggcgttagcggtcgttttcgttttcgtcgttcgttgttttcgtcgcggggtcgtcgcgtttacggtttatgttcggcgtcgttttcgcgcgttcgtgttagtcgcgttttcgcgatacgtatcgtttttcggttcgttttttgtttcggttcgcgcgagttagtgtttcgaggttcgattcggaagtttcgttcgtttcgcgcgtttttcgggtttcgggtttcggtttcgggatatatttttcggagggcggcgttcgattggttgttcgcggtgggcggggtttcgggagcgtttagcggtttttatttagcgtttcgcggtcgttgtagttaagggaaattgaggtcggagaggtggagggatcgtttaaggttatcgatgggatatcgttgagcgttagcgtttttttagttcggcgtatcggggcggggttgaattcgaggcggggacgcgcggtcgcggggcgggtggaggttttcgtcgggcgttcgtgttacgttggcgagttttttttgttttttcgatgagttcggttttgttattttgtgcgatgagtcggtttagattcgggattcgggatcgggtgtttttgaggtttagaagtgcgtagggtgggaggcggttcgggagggattttgtttttggaa

SEQ ID NO: 19894 - DNA, 1474 bp, Artificial Sequence
  chemically treated genomic DNA (Homo sapiens) CpG-island No: 19894
ttccaaaaacaaaatccctcccgaaccgcctcccaccctacgcacttctaaacctcaaaaacacccgatcccgaatcccgaatctaaaccgactcatcgcacaaaataacaaaaccgaactcatcgaaaaaacaaaaaaaactcgccaacgtaacacgaacgcccgacgaaaacctccacccgccccgcgaccgcgcgtccccgcctcgaattcaaccccgccccgatacgccgaactaaaaaaacgctaacgctcaacgatatcccatcgataaccttaaacgatccctccacctctccgacctcaatttcccttaactacaacgaccgcgaaacgctaaataaaaaccgctaaacgctcccgaaaccccgcccaccgcgaacaaccaatcgaacgccgccctccgaaaaatatatcccgaaaccgaaacccgaaacccgaaaaacgcgcgaaacgaacgaaacttccgaatcgaacctcgaaacactaactcgcgcgaaccgaaacaaaaaacgaaccgaaaaacgatacgtatcgcgaaaacgcgactaacacgaacgcgcgaaaacgacgccgaacataaaccgtaaacgcgacgaccccgcgacgaaaacaacgaacgacgaaaacgaaaacgaccgctaacgccctacccgacgccgcctccttcgacgttcgccccacgaaccgacaaacgacgaaccgcgacccaaatacccgaaaacgaacgaacgaacgaacgaaaacgcgcgcgaaaatccgcgatccgaacttcccaaatcccgaaacccgaaaaacgacgaacgaaaaaaaaacaaaaactaaacgacgcatacgcgaaacccgaaatctcgaaatctccgaatcccgaaaacccgaaaacccgaaatacgcgactaaaaacctaaaaacgaaaaacgaaaacacacaccgaaaactcttacgaaaaatctcgaaacccaactcgacctccctcctaacgctaaaaacctacccgaaacccgaatccgcgactatccctaaaatttaacgctacgcgaaaatcgaatctaaaaaccgcaacgactctaaatcttcgaattatcccctcgaaaaaaaaacccacgaacgaaaacatcgaaacttaccctttcctcgacgcaacgaaactaaaacgtcgccgactcaaaaaatactttccgaaacctccaaaaatctccgaaacgaaaaaacccgaaccccgaacaaaccgaccctaaataaatacgcccgacttctaccgtcgaacgaaaacgcgcgtatttattcctccaactacgaccacctttaaaaaacgattcccactttataccccaacgcgacgaaacgaccccgaacaaactacgctaaaccgaataacttctctacgaaaaccgcgccacgtcgctcccgatcgaaaccgctaaaaatcgaacgcccaaatctttccgaaatcccgaactacgcgacccgcgt

SEQ ID NO: 19895 - DNA, 1474 bp, Artificial Sequence
  chemically treated genomic DNA (Homo sapiens) CpG-island No: 19895
ttttagggataaggtttttttcgggtcgttttttattttacgtatttttgagttttaagggtattcggtttcgggtttcgggtttagatcggtttatcgtatagagtagtagagtcgggtttatcgaggaggtaggaggggttcgttagcgtggtacgggcgttcggcgggaatttttattcgtttcgcggtcgcgcgttttcgtttcgaatttagtttcgtttcggtgcgtcgggttggaggggcgttgacgtttagcggtgttttatcggtgattttggacggtttttttattttttcggttttagttttttttggttgtagcggtcgcggggcgttaggtgggagtcgttgagcgttttcggggtttcgtttatcgcgagtagttaatcgggcgtcgtttttcggggggtgtgtttcggggtcgaggttcggggttcggagggcgcgcggggcgggcggggttttcgggtcgggtttcgggatattggttcgcgcggatcggggtagggggcgggtcgaggggcggtgcgtgtcgcgggggcgcggttggtacggacgcgcggaggcggcgtcgggtatgggtcgtggacgcggcggtttcgcggcgggggtagcgggcggcgggggcggaggcggtcgttagcgttttgttcggcgtcgtttttttcggcgttcgttttacggatcggtaggcggcggatcgcggtttaggtgttcgggggcgggcgggcgggcgggcgggaacgcgcgcgggggttcgcggttcgggttttttaggtttcgggattcggagggcggcggacgggggaggggtaggggttgggcggcgtatgcgcggggttcggggtttcggggttttcgggtttcggggattcgggggttcggggtgcgcggttggggatttgagggcgaggagcgaggatatatatcgaggatttttgcgagggatttcggggtttagttcggttttttttttagcgttgggggtttgttcggaattcgagttcgcggttgtttttggggtttggcgttgcgcggaggtcgggtttggggatcgtagcgattttgggttttcgggttgttttttcggagggagggtttacgggcggggatatcgggatttgtttttttttcggcgtagcggagttggggcgtcgtcgatttagaaggtgtttttcgagatttttagggattttcgaggcgaggaaattcgggtttcggatagatcgattttgggtgggtgcgttcggtttttgtcgtcggacggagacgcgcgtgtttgtttttttagttgcgattatttttgaggaacggtttttattttgtgttttaacgcggcggggcgatttcggataggttgcgttgggtcgggtggtttttttgcggaagtcgcgttacgtcgttttcggtcggggtcgttgagggtcgggcgtttaggttttttcggagtttcgggttgcgcggttcgcgt

SEQ ID NO: 19896 - DNA, 1474 bp, Artificial Sequence
  chemically treated genomic DNA (Homo sapiens) CpG-island No: 19896
acgcgaaccgcgcaacccgaaactccgaaaaaacctaaacgcccgaccctcaacgaccccgaccgaaaacgacgtaacgcgacttccgcaaaaaaaccacccgacccaacgcaacctatccgaaatcgccccgccgcgttaaaacacaaaataaaaaccgttcctcaaaaataatcgcaactaaaaaaacaaacacgcgcgtctccgtccgacgacaaaaaccgaacgcacccacccaaaatcgatctatccgaaacccgaatttcctcgcctcgaaaatccctaaaaatctcgaaaaacaccttctaaatcgacgacgccccaactccgctacgccgaaaaaaaaacaaatcccgatatccccgcccgtaaaccctccctccgaaaaaacaacccgaaaacccaaaatcgctacgatccccaaacccgacctccgcgcaacgccaaaccccaaaaacaaccgcgaactcgaattccgaacaaacccccaacgctaaaaaaaaaaccgaactaaaccccgaaatccctcgcaaaaatcctcgatatatatcctcgctcctcgccctcaaatccccaaccgcgcaccccgaacccccgaatccccgaaacccgaaaaccccgaaaccccgaaccccgcgcatacgccgcccaacccctacccctcccccgtccgccgccctccgaatcccgaaacctaaaaaacccgaaccgcgaacccccgcgcgcgttcccgcccgcccgcccgcccgcccccgaacacctaaaccgcgatccgccgcctaccgatccgtaaaacgaacgccgaaaaaaacgacgccgaacaaaacgctaacgaccgcctccgcccccgccgcccgctacccccgccgcgaaaccgccgcgtccacgacccatacccgacgccgcctccgcgcgtccgtaccaaccgcgcccccgcgacacgcaccgcccctcgacccgccccctaccccgatccgcgcgaaccaatatcccgaaacccgacccgaaaaccccgcccgccccgcgcgccctccgaaccccgaacctcgaccccgaaacacaccccccgaaaaacgacgcccgattaactactcgcgataaacgaaaccccgaaaacgctcaacgactcccacctaacgccccgcgaccgctacaaccaaaaaaaactaaaaccgaaaaaataaaaaaaccgtccaaaatcaccgataaaacaccgctaaacgtcaacgcccctccaacccgacgcaccgaaacgaaactaaattcgaaacgaaaacgcgcgaccgcgaaacgaataaaaattcccgccgaacgcccgtaccacgctaacgaacccctcctacctcctcgataaacccgactctactactctatacgataaaccgatctaaacccgaaacccgaaaccgaatacccttaaaactcaaaaatacgtaaaataaaaaacgacccgaaaaaaaccttatccctaaaa

SEQ ID NO: 19897 - DNA, 1016 bp, Artificial Sequence
  chemically treated genomic DNA (Homo sapiens) CpG-island No: 19897
tttttcgggattatacgaacgaacgagtcgattttttttgtggggcgggtaggacggaggttatgtcggggcgcgtttttagtgttcgtcggtttcggtttttcgttagggaggcggttttttcgtcgcgatcgttgtgacgttcgttgtttacgtaagttttgcggattcgttaggttcggttttagttttcggttttattttgatgcggtttaggatttcgttgttttttagcgtttgtattagtaggtttcgtagtttcgtgtttttttcggttattattgcggtcgtcgtcgtcgttattttgtttttttaagataatcgtcgaagtcgcgttaacggttaacggtcgtagtagggtacgtttcgcgcgcgggttacgcggtcgacgtagttaaagtttcgtttcgacgcgtagcgcgttggttttgttttttggcgtcgggaggcggggtatagagatttcggggttgacgttggatatcgagttttggggagcgtcggattattgagcgtcgaaatttagggtcggcgttgggggcggggttgcggggcgcgggtgggtacgtaaggggcggggcgtcggcggggtttttagtcggtaattcgttggttgtcgtcgtttgaggcgcgagttttgaagtcggcgagcggtgaggaggaggcgttttcgcgtgtggagagcggatttcgtttggattttatcgtttacggtcgtattttatcgtcgtataagatcgtcggagttatattatcgacgtagttaaagtttattagtttaaagtcgggcggattgcggtaaggaggtttcgagatcgaatttgtagtttttgtagtttcgggggggcgtcggggaagggattttcgagaggtcgcgaggggcggaaggttttgtaggttgttattcggaaataacgttttgaggttttttagttaggcgaacgtattttgttcggttacggttttcgaggttaatcggaaaggtgttaggtcgaggtgtaggggcgggatggttt

SEQ ID NO: 19898 - DNA, 1016 bp, Artificial Sequence
  chemically treated genomic DNA (Homo sapiens) CpG-island No: 19898
aaaccatcccgcccctacacctcgacctaacacctttccgattaacctcgaaaaccgtaaccgaacaaaatacgttcgcctaactaaaaaacctcaaaacgttatttccgaataacaacctacaaaaccttccgcccctcgcgacctctcgaaaatcccttccccgacgcccccccgaaactacaaaaactacaaattcgatctcgaaacctccttaccgcaatccgcccgactttaaactaataaactttaactacgtcgataatataactccgacgatcttatacgacgataaaatacgaccgtaaacgataaaatccaaacgaaatccgctctccacacgcgaaaacgcctcctcctcaccgctcgccgacttcaaaactcgcgcctcaaacgacgacaaccaacgaattaccgactaaaaaccccgccgacgccccgccccttacgtacccacccgcgccccgcaaccccgcccccaacgccgaccctaaatttcgacgctcaataatccgacgctccccaaaactcgatatccaacgtcaaccccgaaatctctataccccgcctcccgacgccaaaaaacaaaaccaacgcgctacgcgtcgaaacgaaactttaactacgtcgaccgcgtaacccgcgcgcgaaacgtaccctactacgaccgttaaccgttaacgcgacttcgacgattatcttaaaaaaacaaaataacgacgacgacgaccgcaataataaccgaaaaaaacacgaaactacgaaacctactaatacaaacgctaaaaaacaacgaaatcctaaaccgcatcaaaataaaaccgaaaactaaaaccgaacctaacgaatccgcaaaacttacgtaaacaacgaacgtcacaacgatcgcgacgaaaaaaccgcctccctaacgaaaaaccgaaaccgacgaacactaaaaacgcgccccgacataacctccgtcctacccgccccacaaaaaaaatcgactcgttcgttcgtataatcccgaaaaa

SEQ ID NO: 19899 - DNA, 1016 bp, Artificial Sequence
  chemically treated genomic DNA (Homo sapiens) CpG-island No: 19899
gggttatttcgtttttgtatttcggtttggtattttttcggttagtttcggaggtcgtggtcgagtagggtgcgttcgtttggttggggggttttagaacgttattttcgggtgataatttgtagggtttttcgtttttcgcgatttttcgggagtttttttttcggcgttttttcggggttgtaggggttgtaggttcggtttcggggtttttttatcgtagttcgttcggttttaggttagtgggttttaattacgtcgataatatgatttcggcgattttgtgcggcgatgggatgcggtcgtgggcggtggagtttaggcggagttcgttttttatacgcgagggcgttttttttttatcgttcgtcggttttaaagttcgcgttttaggcgacggtagttaacgggttgtcggttggaggtttcgtcgacgtttcgttttttgcgtgtttattcgcgtttcgtagtttcgtttttagcgtcgattttaagtttcggcgtttagtggttcggcgttttttaaggttcggtgtttagcgttaatttcgaggtttttatgtttcgtttttcgacgttagggggtagggttagcgcgttgcgcgtcggggcggggttttggttgcgtcggtcgcgtagttcgcgcgcggagcgtattttgttgcggtcgttggtcgttagcgcggtttcggcggttgttttggagaagtaagatggcggcgacggcggtcgtagtggtggtcgaggaggatacggagttgcgggatttgttggtgtagacgttggagaatagcggggttttgaatcgtattaaggtgaggtcggaggttggggtcgggtttggcggattcgtagggtttgcgtggatagcgggcgttataacggtcgcggcgaggaggtcgtttttttggcgagggatcggggtcggcgggtattgggggcgcgtttcggtatggttttcgttttgttcgttttatagagggggtcggttcgttcgttcgtgtggtttcggaggg

SEQ ID NO: 19900 - DNA, 1016 bp, Artificial Sequence
  chemically treated genomic DNA (Homo sapiens) CpG-island No: 19900
ccctccgaaaccacacgaacgaacgaaccgaccccctctataaaacgaacaaaacgaaaaccataccgaaacgcgcccccaatacccgccgaccccgatccctcgccaaaaaaacgacctcctcgccgcgaccgttataacgcccgctatccacgcaaaccctacgaatccgccaaacccgaccccaacctccgacctcaccttaatacgattcaaaaccccgctattctccaacgtctacaccaacaaatcccgcaactccgtatcctcctcgaccaccactacgaccgccgtcgccgccatcttacttctccaaaacaaccgccgaaaccgcgctaacgaccaacgaccgcaacaaaatacgctccgcgcgcgaactacgcgaccgacgcaaccaaaaccccgccccgacgcgcaacgcgctaaccctaccccctaacgtcgaaaaacgaaacataaaaacctcgaaattaacgctaaacaccgaaccttaaaaaacgccgaaccactaaacgccgaaacttaaaatcgacgctaaaaacgaaactacgaaacgcgaataaacacgcaaaaaacgaaacgtcgacgaaacctccaaccgacaacccgttaactaccgtcgcctaaaacgcgaactttaaaaccgacgaacgataaaaaaaaaacgccctcgcgtataaaaaacgaactccgcctaaactccaccgcccacgaccgcatcccatcgccgcacaaaatcgccgaaatcatattatcgacgtaattaaaacccactaacctaaaaccgaacgaactacgataaaaaaaccccgaaaccgaacctacaacccctacaaccccgaaaaaacgccgaaaaaaaaactcccgaaaaatcgcgaaaaacgaaaaaccctacaaattatcacccgaaaataacgttctaaaaccccccaaccaaacgaacgcaccctactcgaccacgacctccgaaactaaccgaaaaaataccaaaccgaaatacaaaaacgaaataaccc

SEQ ID NO: 19901 - DNA, 645 bp, Artificial Sequence
  chemically treated genomic DNA (Homo sapiens) CpG-island No: 19901
tcgtttcggttttttggtgtgatgtggtgttggtgcgtgttgttgcgaaggttttgtgtgaaagtcgtttgggttttcgggtgtgatgtggtattggtgtcgtgttgttgcgaaggttttgtgtgaaagtcgtttgggttttcgggtgtgatgtggtgttggcgtcgtgttgttgcgaaggttttgtgtgaaagtcgtttgggttttcgggtgtgatgtggtgttggcgtcgtgttgttgcgaaggttttgtgtgaaagtcgtttcggttttcgggtgtgatgtggtgttggtgtcgtgttgttgcgaaggttttgtgtgaaagtcgtcggggttttcgggtgtgatgtggtgttggtgtcgtgttgttgcgaaggttttgtgtgaaggtcgtttgggttttcgggtgtgatgtggtgttggtgtcgtgttgttgcgaaggttttgtgtgaaggtcgtttgggttttcgggtgtgatgtggtgttggtgtcgtgttgttgcgaaggttttgtgtgaaagtcgtttgggttttcgggtgtgatgtggtgttggcgtcgtgttgttgtaaaggtttgtttttaggtgtacgaggaggtatttttaaatgtaggaatgtgatgtttgggatttgcgttatggtaaaat

SEQ ID NO: 19902 - DNA, 645 bp, Artificial Sequence
  chemically treated genomic DNA (Homo sapiens) CpG-island No: 19902
attttaccataacgcaaatcccaaacatcacattcctacatttaaaaatacctcctcgtacacctaaaaacaaacctttacaacaacacgacgccaacaccacatcacacccgaaaacccaaacgactttcacacaaaaccttcgcaacaacacgacaccaacaccacatcacacccgaaaacccaaacgaccttcacacaaaaccttcgcaacaacacgacaccaacaccacatcacacccgaaaacccaaacgaccttcacacaaaaccttcgcaacaacacgacaccaacaccacatcacacccgaaaaccccgacgactttcacacaaaaccttcgcaacaacacgacaccaacaccacatcacacccgaaaaccgaaacgactttcacacaaaaccttcgcaacaacacgacgccaacaccacatcacacccgaaaacccaaacgactttcacacaaaaccttcgcaacaacacgacgccaacaccacatcacacccgaaaacccaaacgactttcacacaaaaccttcgcaacaacacgacaccaataccacatcacacccgaaaacccaaacgactttcacacaaaaccttcgcaacaacacgcaccaacaccacatcacaccaaaaaaccgaaacga

SEQ ID NO: 19903 - DNA, 645 bp, Artificial Sequence
  chemically treated genomic DNA (Homo sapiens) CpG-island No: 19903
gttttgttatgacgtagattttaggtattatatttttgtatttggaaatgttttttcgtatatttgaagataggtttttgtaataatacgacgttaatattatattatattcgaaaatttaggcgatttttatatagggttttcgtaataatacgatattaatattatattatattcgaaaatttaggcgatttttatatagggttttcgtaataatacgatattaatattatattatattcgaaaatttaggcgatttttatatagggttttcgtaataatacgatattaatattatattatattcgaaaatttcggcgatttttatatagggttttcgtaataatacgatattaatattatattatattcgaaaatcgaggcgatttttatatagggttttcgtaataatacgacgttaatattatattatattcgaaaatttaggcgatttttatatagggttttcgtaataatacgacgttaatattatattatattcgaaaatttaggcgatttttatatagggttttcgtaataatacgatattaatattatattatattcgaaaatttaggcgatttttatatagggttttcgtaataatacgtattaatattatattatattagaaaatcgaggcga

SEQ ID NO: 19904 - DNA, 645 bp, Artificial Sequence
  chemically treated genomic DNA (Homo sapiens) CpG-island No: 19904
tcgcctcgattttctaatataatataatattaatacgtattattacgaaaaccctatataaaaatcgcctaaattttcgaatataatataatattaatatcgtattattacgaaaaccctatataaaaatcgcctaaattttcgaatataatataatattaacgtcgtattattacgaaaaccctatataaaaatcgcctaaattttcgaatataatataatattaacgtcgtattattacgaaaaccctatataaaaatcgcctcgattttcgaatataatataatattaatatcgtattattacgaaaaccctatataaaaatcgccgaaattttcgaatataatataatattaatatcgtattattacgaaaaccctatataaaaatcgcctaaattttcgaatataatataatattaatatcgtattattacgaaaaccctatataaaaatcgcctaaattttcgaatataatataatattaatatcgtattattacgaaaaccctatataaaaatcgcctaaattttcgaatataatataatattaacgtcgtattattacaaaaacctatcttcaaatatacgaaaaaacatttccaaatacaaaaatataatacctaaaatctacgtcataacaaaac

SEQ ID NO: 19905 - DNA, 1067 bp, Artificial Sequence
  chemically treated genomic DNA (Homo sapiens) CpG-island No: 19905
taattgggcgtttcgtttcgcgcggttatttgtatttcgtcgttatcgtcggtcgtcgtttttttagtgcgcggtcgtttgtttaggtcgggatcggtttcgttttttttcgtttcgggtatcggtagttttagtttcgattttcgttttatgtttcgggcggcggcgtcgggttcgagttgaggcggttgatgcggttgggcgtttttcgttattcgttcgcgtttttttcgttttcgggagtcgggcgattcgcgataggttatttttttttgggtttcggtttcgattgtcgcgataggcgggcgcgcgtttgttttcgttttcgcgtgcgtgcgtgcgtgcgcgcgagcggatttcgcgttttttcgcgtttcgcggtcgtcgttttttgtttgatcgtttgtttttcgttcgttcgttcgtcgggttgtcggcgcggggttattggcgggtcgtgatgagtattcgttcgcgttttcgtacgtatacgcgaaattcggttcggttcgtcgcgtcgtttcgtttttcgtattttcggagttcgtttatcggtcgcgttggtttatatttttttttatagtacgtcggtcgagggaggaagggggcggttcgggttttcgaggcgtggggagggttgtttattttggggggaggaggggcgcgaggtaggaacgagttgattggtcgggatttttcgattcgttattgtggtagtatcgggaaggcggggagagagaaagagggagggagggagggatcgggatgtagaattttagttcgcgcgggaggttacggcgaggggggcggtggcggttcgcggggggggcggggttaggttttttcggtaattttcgtagttttttcgttggttgttcgagggaggtcgggaagcgatcggggaagttcgggaattttcggtacgggtttgggattgttttggaggtatagcgcggttggagtgcggggtagcgcggggggggcggggtttgttttttttttgggcggggtcgtattttggagtaggcggggtttgagagattcgaaggttagggagtggtttttgt

SEQ ID NO: 19906 - DNA, 1067 bp, Artificial Sequence
  chemically treated genomic DNA (Homo sapiens) CpG-island No: 19906
acaaaaaccactccctaaccttcgaatctctcaaaccccgcctactccaaaatacgaccccgcccaaaaaaaaaacaaaccccgccccccccgcgctaccccgcactccaaccgcgctatacctccaaaacaatcccaaacccgtaccgaaaattcccgaacttccccgatcgcttcccgacctccctcgaacaaccaacgaaaaaactacgaaaattaccgaaaaaacctaaccccgccccccccgcgaaccgccaccgcccccctcgccgtaacctcccgcgcgaactaaaattctacatcccgatccctccctccctccctctttctctctccccgccttcccgatactaccacaataacgaatcgaaaaatcccgaccaatcaactcgttcctacctcgcgcccctcctccccccaaaataaacaaccctccccacgcctcgaaaacccgaaccgcccccttcctccctcgaccgacgtactataaaaaaaaatataaaccaacgcgaccgataaacgaactccgaaaatacgaaaaacgaaacgacgcgacgaaccgaaccgaatttcgcgtatacgtacgaaaacgcgaacgaatactcatcacgacccgccaataaccccgcgccgacaacccgacgaacgaacgaacgaaaaacaaacgatcaaacaaaaaacgacgaccgcgaaacgcgaaaaaacgcgaaatccgctcgcgcgcacgcacgcacgcacgcgaaaacgaaaacaaacgcgcgcccgcctatcgcgacaatcgaaaccgaaacccaaaaaaaaataacctatcgcgaatcgcccgactcccgaaaacgaaaaaaacgcgaacgaataacgaaaaacgcccaaccgcatcaaccgcctcaactcgaacccgacgccgccgcccgaaacataaaacgaaaatcgaaactaaaactaccgatacccgaaacgaaaaaaaacgaaaccgatcccgacctaaacaaacgaccgcgcactaaaaaaacgacgaccgacgataacgacgaaatacaaataaccgcgcgaaacgaaacgcccaatta

SEQ ID NO: 19907 - DNA, 1067 bp, Artificial Sequence
  chemically treated genomic DNA (Homo sapiens) CpG-island No: 19907
gtaggagttattttttggttttcgggttttttaagtttcgtttgttttaggatacggtttcgtttagaaaggagatagatttcgtttttttcgcgttgtttcgtattttagtcgcgttgtgtttttaggataattttaggttcgtgtcggagattttcgagttttttcgatcgtttttcggtttttttcgggtagttagcgaggagattacggagattgtcgagggggtttggtttcgtttttttcgcgggtcgttatcgtttttttcgtcgtagtttttcgcgcgggttggagttttatatttcggttttttttttttttttttttttttttttttcgttttttcggtgttgttatagtggcgggtcggaggatttcggttagttagttcgtttttgtttcgcgttttttttttttttaaaataaatagttttttttacgtttcgggagttcggatcgttttttttttttttcggtcggcgtgttgtgagggagagtgtgagttagcgcggtcggtgggcgagtttcgggagtgcgagaggcggggcggcgcggcgggtcgggtcgggtttcgcgtgtgcgtgcgggggcgcgagcgagtgtttattacgattcgttagtggtttcgcgtcgataattcggcgggcgggcgggcggggagtaagcggttaggtaaggagcggcggtcgcgaggcgcggaggggcgcggagttcgttcgcgcgtacgtacgtacgtacgcgggggcgggggtaggcgcgcgttcgtttgtcgcgatagtcggggtcgaggtttagggggaggtggtttgtcgcgggtcgttcggttttcggaggcgaggggggcgcgggcggatggcggagggcgtttagtcgtattagtcgttttagttcgggttcggcgtcgtcgttcggggtatgaagcgggagtcggagttggagttgtcggtgttcggagcgggaggagacggagtcgatttcggtttgagtaagcggtcgcgtattgaggaggcggcggtcgacggtggcggcgggatgtaggtgatcgcgcgggacggggcgtttagtta

SEQ ID NO: 19908 - DNA, 1067 bp, Artificial Sequence
  chemically treated genomic DNA (Homo sapiens) CpG-island No: 19908
taactaaacgccccgtcccgcgcgatcacctacatcccgccgccaccgtcgaccgccgcctcctcaatacgcgaccgcttactcaaaccgaaatcgactccgtctcctcccgctccgaacaccgacaactccaactccgactcccgcttcataccccgaacgacgacgccgaacccgaactaaaacgactaatacgactaaacgccctccgccatccgcccgcgcccccctcgcctccgaaaaccgaacgacccgcgacaaaccacctccccctaaacctcgaccccgactatcgcgacaaacgaacgcgcgcctacccccgcccccgcgtacgtacgtacgtacgcgcgaacgaactccgcgcccctccgcgcctcgcgaccgccgctccttacctaaccgcttactccccgcccgcccgcccgccgaattatcgacgcgaaaccactaacgaatcgtaataaacactcgctcgcgcccccgcacgcacacgcgaaacccgacccgacccgccgcgccgccccgcctctcgcactcccgaaactcgcccaccgaccgcgctaactcacactctccctcacaacacgccgaccgaaaaaaaaaaaaaacgatccgaactcccgaaacgtaaaaaaaactatttattttaaaaaaaaaaaaaacgcgaaacaaaaacgaactaactaaccgaaatcctccgacccgccactataacaacaccgaaaaaacgaaaaaaaaaaaaaaaaaaaaaaaaaaaaaaccgaaatataaaactccaacccgcgcgaaaaactacgacgaaaaaaacgataacgacccgcgaaaaaaacgaaaccaaaccccctcgacaatctccgtaatctcctcgctaactacccgaaaaaaaccgaaaaacgatcgaaaaaactcgaaaatctccgacacgaacctaaaattatcctaaaaacacaacgcgactaaaatacgaaacaacgcgaaaaaaacgaaatctatctcctttctaaacgaaaccgtatcctaaaacaaacgaaacttaaaaaacccgaaaaccaaaaaataactcctac

SEQ ID NO: 19909 - DNA, 1226 bp, Artificial Sequence
  chemically treated genomic DNA (Homo sapiens) CpG-island No: 19909
tttcgtagtaaaaggcgttattgaaacgtacgtaaaaatgtagcgagaacgttgttcggtgtttaatatggtagaaagttcgagttggtgcggttatttcggggttgggtattggggggtatcggggttttcggggcgtcgacgtatatttattcggtttcgggggggatgcggggttggtcgcgcgttataaagaggagttcggcgtaatttggtaaaatttaattttttattaggttcgttagggtcgttagatacgttaatagaatttatttttcgaagggtttggaaggcgtcgggtttttcgggtcggggtagaacggtagattcggagattgttcggtgcggtgtttgggcgcggagttcgtcgtgtatcgttttttgcgttcgatgttagtgcgggcggcggttcgaaatttatttcggggttttcgtttcgtcggtcggcgtcgttttttcggtagttttcggtttcgtcggttagtgcgcggcgtcgggaacgggagcggggtttcggcgcgttatacgggcggcggtttcggttcgcgttttcgttttcgttcggtttttttagtcggtttcggttttcgggcgtcgttttgttttcgggagtaggttttttttcgggcgtcgggtttcgttaggcgcgtttagttcggcgcgttttttgcgtttcggtggtagtttcgcgcggggagggcgggggtgatttcggttcgtacgggggcgtcgcggttattatttcgtaatcgcggtcgtcgtttttaggaagtcgcggggtggtcgagtgtgttggaatttttcggtttggtttcgtcgtcggtcgtttgaagggggtgcgtcgcggtgggagtcgtcgtcgtcgttgttatcgagtcgttgtcgtcgtcgtcgttgttggttgtgcgtgagcgtgtgtgcgtttgtgttttggcgagtgtgtgtttgcgtgcggcgttcggtttttattatatatattaaggggtgggaggaggcggggaaggggagggtttgggggaggcggcggaggagggggagtaggaggggggcgaaagggtattcgaggaggcggcggcggaggagggataggtgatttcgtttacggggagggcgtggtcgtgggcggcgcggggtgttaggaagaaggggtgtcggggcggggaggaggattttggggggagcgtcgggggagggtcggaggagttgggattttattgtttttcggt

SEQ ID NO: 19910 - DNA, 1226 bp, Artificial Sequence
  chemically treated genomic DNA (Homo sapiens) CpG-island No: 19910
accgaaaaacaataaaatcccaactcctccgaccctcccccgacgctccccccaaaatcctcctccccgccccgacaccccttcttcctaacaccccgcgccgcccacgaccacgccctccccgtaaacgaaatcacctatccctcctccgccgccgcctcctcgaataccctttcgcccccctcctactccccctcctccgccgcctcccccaaaccctccccttccccgcctcctcccaccccttaatatatataataaaaaccgaacgccgcacgcaaacacacactcgccaaaacacaaacgcacacacgctcacgcacaaccaacaacgacgacgacgacaacgactcgataacaacgacgacgacgactcccaccgcgacgcacccccttcaaacgaccgacgacgaaaccaaaccgaaaaattccaacacactcgaccaccccgcgacttcctaaaaacgacgaccgcgattacgaaataataaccgcgacgcccccgtacgaaccgaaatcacccccgccctccccgcgcgaaactaccaccgaaacgcaaaaaacgcgccgaactaaacgcgcctaacgaaacccgacgcccgaaaaaaaacctactcccgaaaacaaaacgacgcccgaaaaccgaaaccgactaaaaaaaccgaacgaaaacgaaaacgcgaaccgaaaccgccgcccgtataacgcgccgaaaccccgctcccgttcccgacgccgcgcactaaccgacgaaaccgaaaactaccgaaaaaacgacgccgaccgacgaaacgaaaaccccgaaataaatttcgaaccgccgcccgcactaacatcgaacgcaaaaaacgatacacgacgaactccgcgcccaaacaccgcaccgaacaatctccgaatctaccgttctaccccgacccgaaaaacccgacgccttccaaacccttcgaaaaataaattctattaacgtatctaacgaccctaacgaacctaataaaaaattaaattttaccaaattacgccgaactcctctttataacgcgcgaccaaccccgcatcccccccgaaaccgaataaatatacgtcgacgccccgaaaaccccgataccccccaatacccaaccccgaaataaccgcaccaactcgaactttctaccatattaaacaccgaacaacgttctcgctacatttttacgtacgtttcaataacgccttttactacgaaa

SEQ ID NO: 19911 - DNA, 1226 bp, Artificial Sequence
  chemically treated genomic DNA (Homo sapiens) CpG-island No: 19911
gtcgggaggtagtagggttttagttttttcggttttttttcggcgttttttttaaggttttttttttcgtttcgatattttttttttttggtatttcgcgtcgtttacggttacgtttttttcgtgggcgagattatttgtttttttttcgtcgtcgttttttcgggtattttttcgttttttttttgttttttttttttcgtcgttttttttaagtttttttttttttcgtttttttttattttttggtgtatatagtaaaggtcgggcgtcgtacgtagatatatattcgttaggatataggcgtatatacgtttacgtataattagtagcggcggcggcgatagcgattcggtgatagcggcgacggcggtttttatcgcggcgtattttttttaggcggtcggcggcgaggttagatcggagagttttagtatattcgattatttcgcggttttttggaggcggcggtcgcgattgcgaggtagtggtcgcggcgttttcgtgcgggtcggggttattttcgtttttttcgcgcggagttgttatcgggacgtagggggcgcgtcgggttgggcgcgtttggcggggttcggcgttcggggaggggtttgttttcgggggtaggacggcgttcggaggtcggggtcggttgggagggtcgggcgggggcggggacgcgggtcgaggtcgtcgttcgtgtggcgcgtcggggtttcgttttcgttttcggcgtcgcgtattggtcggcggggtcggggattgtcggggaggcggcgtcggtcggcggggcgggggtttcgaagtgggtttcgggtcgtcgttcgtattggtatcgggcgtagagggcggtgtacggcggatttcgcgtttaggtatcgtatcgggtagttttcggatttgtcgttttgtttcggttcggaaaattcggcgttttttaggtttttcgaaagatggattttgttgacgtatttggcggttttggcgagtttggtggaaagttgggttttgttagattgcgtcgggtttttttttgtgacgcgcggttagtttcgtatttttttcggagtcgggtgagtgtgcgtcggcgtttcgggagtttcggtgttttttaatgtttagtttcggggtggtcgtattagttcgggttttttgttatgttaggtatcgagtaacgttttcgttgtatttttgcgtgcgttttagtggcgttttttgttgcggag

SEQ ID NO: 19912 - DNA, 1226 bp, Artificial Sequence
  chemically treated genomic DNA (Homo sapiens) CpG-island No: 19912
ctccgcaacaaaaaacgccactaaaacgcacgcaaaaatacaacgaaaacgttactcgatacctaacataacaaaaaacccgaactaatacgaccaccccgaaactaaacattaaaaaacaccgaaactcccgaaacgccgacgcacactcacccgactccgaaaaaaatacgaaactaaccgcgcgtcacaaaaaaaaacccgacgcaatctaacaaaacccaactttccaccaaactcgccaaaaccgccaaatacgtcaacaaaatccatctttcgaaaaacctaaaaaacgccgaattttccgaaccgaaacaaaacgacaaatccgaaaactacccgatacgatacctaaacgcgaaatccgccgtacaccgccctctacgcccgataccaatacgaacgacgacccgaaacccacttcgaaacccccgccccgccgaccgacgccgcctccccgacaatccccgaccccgccgaccaatacgcgacgccgaaaacgaaaacgaaaccccgacgcgccacacgaacgacgacctcgacccgcgtccccgcccccgcccgaccctcccaaccgaccccgacctccgaacgccgtcctacccccgaaaacaaacccctccccgaacgccgaaccccgccaaacgcgcccaacccgacgcgccccctacgtcccgataacaactccgcgcgaaaaaaacgaaaataaccccgacccgcacgaaaacgccgcgaccactacctcgcaatcgcgaccgccgcctccaaaaaaccgcgaaataatcgaatatactaaaactctccgatctaacctcgccgccgaccgcctaaaaaaaatacgccgcgataaaaaccgccgtcgccgctatcaccgaatcgctatcgccgccgccgctactaattatacgtaaacgtatatacgcctatatcctaacgaatatatatctacgtacgacgcccgacctttactatatacaccaaaaaataaaaaaaaacgaaaaaaaaaaaaacttaaaaaaaacgacgaaaaaaaaaaaacaaaaaaaaaacgaaaaaatacccgaaaaaacgacgacgaaaaaaaaacaaataatctcgcccacgaaaaaaacgtaaccgtaaacgacgcgaaataccaaaaaaaaaaaatatcgaaacgaaaaaaaaaaccttaaaaaaaacgccgaaaaaaaaccgaaaaaactaaaaccctactacctcccgac

SEQ ID NO: 19913 - DNA, 1046 bp, Artificial Sequence
  chemically treated genomic DNA (Homo sapiens) CpG-island No: 19913
aatttgtcgcgggagtatagggttcggaatttttgcgggggcggggaggggatttagtggtcgggtttagtacgggcgagagtggtcggggacggacgggtacgcgtttatcgagttgttcgtgagtttttgtaggatgacgggtttgacgaaggcgtatttggaaagaagggtagagtcgcggttaggtcggatcgttagtttcgtcgttttagttttacgcgtgcgcgcgaggttaggggaaggcggttttgggcggtcggggtagacgggtcggtgaataggacgcgattttcgcgattaggggcgtacgtattgttgtacgaatttcgcgtaggtgaggtcggttcgacgttttatcgtgtagcgtttttttttcgttacggttttcggttcgttcgggcgtttgcgggtatagttgggttagttcgcgtttcgttcgtcgtacgtgattttatcgttcggtttttttcgggtcgtttattattcgtcgtcgtttttcgtttcggagtcgggtagagttatagtcgttagcgtttagagcgcgagtaatcgcgacgtcggcgttatgagtttgtcgtttttaggtagtcgcgttgtacgtcgggaattttgggtttattcgttagttattggtcggtagtttcgtcgtcgtggtaacggtcgggaatcgggacggatttcggaagtgattttttttggttcgtttcggaagaggtttttacgggaggtattgggaaggtcgtttcgagagcgattatgggcgtcgtcggttattatggcgataatttcgtcgaaagttttcgttcgttagttgtttcgcgggtttacggcgagttcgtcgcgttatggggtgatacgtagtgtcgatagcggttttattttttttattgaggttttaagttttagttttcgttcgtttcgggtataagattaggcggggttttgtacgcggtcgttcgggtaagtttagtagatgtttcgttaggagtattcgtagaggtggtcgtagtttgcgggatagtgggagttgttttttagttatt

SEQ ID NO: 19914 - DNA, 1046 bp, Artificial Sequence
  chemically treated genomic DNA (Homo sapiens) CpG-island No: 19914
aataactaaaaaacaactcccactatcccgcaaactacgaccacctctacgaatactcctaacgaaacatctactaaacttacccgaacgaccgcgtacaaaaccccgcctaatcttatacccgaaacgaacgaaaactaaaacttaaaacctcaataaaaaaaataaaaccgctatcgacactacgtatcaccccataacgcgacgaactcgccgtaaacccgcgaaacaactaacgaacgaaaactttcgacgaaattatcgccataataaccgacgacgcccataatcgctctcgaaacgaccttcccaatacctcccgtaaaaacctcttccgaaacgaaccaaaaaaaatcacttccgaaatccgtcccgattcccgaccgttaccacgacgacgaaactaccgaccaataactaacgaataaacccaaaattcccgacgtacaacgcgactacctaaaaacgacaaactcataacgccgacgtcgcgattactcgcgctctaaacgctaacgactataactctacccgactccgaaacgaaaaacgacgacgaataataaacgacccgaaaaaaaccgaacgataaaatcacgtacgacgaacgaaacgcgaactaacccaactatacccgcaaacgcccgaacgaaccgaaaaccgtaacgaaaaaaaaacgctacacgataaaacgtcgaaccgacctcacctacgcgaaattcgtacaacaatacgtacgcccctaatcgcgaaaatcgcgtcctattcaccgacccgtctaccccgaccgcccaaaaccgccttcccctaacctcgcgcgcacgcgtaaaactaaaacgacgaaactaacgatccgacctaaccgcgactctacccttctttccaaatacgccttcgtcaaacccgtcatcctacaaaaactcacgaacaactcgataaacgcgtacccgtccgtccccgaccactctcgcccgtactaaacccgaccactaaatcccctccccgcccccgcaaaaattccgaaccctatactcccgcgacaaatt

SEQ ID NO: 19915 - DNA, 1046 bp, Artificial Sequence
  chemically treated genomic DNA (Homo sapiens) CpG-island No: 19915
agtggttggaaggtagtttttattgtttcgtaggttgcggttatttttgcgagtatttttgacggggtatttgttgggtttgttcgggcggtcgcgtgtagaatttcgtttggttttgtgttcgagacgggcggaggttggaatttgagattttaataaaggaagtagagtcgttgtcggtattgcgtgttattttatagcgcggcgggttcgtcgtaggttcgcggggtagttggcgggcgggggttttcggcggggttgtcgttatggtaatcggcggcgtttatagtcgttttcggggcggtttttttagtgtttttcgtagaggtttttttcggggcgggttaaaggaggttattttcggggttcgtttcggttttcggtcgttgttacgacgacgaagttgtcggttaatggttggcggatgggtttaaggttttcggcgtgtagcgcggttgtttgagggcggtaggtttatggcgtcggcgtcgcggttgttcgcgttttgggcgttggcggttgtggttttattcggtttcggggcggagggcgacggcgggtggtgagcggttcgggaggggtcgggcggtggggttacgtgcggcgggcggggcgcgggttgatttagttgtgttcgtaggcgttcgggcgggtcgggggtcgtggcggaggaggagcgttgtacggtggagcgtcgggtcgattttatttacgcggagttcgtgtagtagtacgtgcgtttttgatcgcggaggtcgcgttttgtttatcggttcgtttgtttcgatcgtttaaggtcgtttttttttgatttcgcgcgtacgcgtggggttggggcggcgaggttggcggttcggtttggtcgcgattttgtttttttttttaggtacgttttcgttaggttcgttattttgtagggatttacggataattcggtgagcgcgtgttcgttcgttttcggttattttcgttcgtgttgggttcggttattaagtttttttttcgttttcgtagaggtttcgggttttgtgttttcgcgataggtt

SEQ ID NO: 19916 - DNA, 1046 bp, Artificial Sequence
  chemically treated genomic DNA (Homo sapiens) CpG-island No: 19916
aacctatcgcgaaaacacaaaacccgaaacctctacgaaaacgaaaaaaaaacttaataaccgaacccaacacgaacgaaaataaccgaaaacgaacgaacacgcgctcaccgaattatccgtaaatccctacaaaataacgaacctaacgaaaacgtacctaaaaaaaaaaacaaaatcgcgaccaaaccgaaccgccaacctcgccgccccaaccccacgcgtacgcgcgaaatcaaaaaaaaacgaccttaaacgatcgaaacaaacgaaccgataaacaaaacgcgacctccgcgatcaaaaacgcacgtactactacacgaactccgcgtaaataaaatcgacccgacgctccaccgtacaacgctcctcctccgccacgacccccgacccgcccgaacgcctacgaacacaactaaatcaacccgcgccccgcccgccgcacgtaaccccaccgcccgacccctcccgaaccgctcaccacccgccgtcgccctccgccccgaaaccgaataaaaccacaaccgccaacgcccaaaacgcgaacaaccgcgacgccgacgccataaacctaccgccctcaaacaaccgcgctacacgccgaaaaccttaaacccatccgccaaccattaaccgacaacttcgtcgtcgtaacaacgaccgaaaaccgaaacgaaccccgaaaataacctcctttaacccgccccgaaaaaaacctctacgaaaaacactaaaaaaaccgccccgaaaacgactataaacgccgccgattaccataacgacaaccccgccgaaaacccccgcccgccaactaccccgcgaacctacgacgaacccgccgcgctataaaataacacgcaataccgacaacgactctacttcctttattaaaatctcaaattccaacctccgcccgtctcgaacacaaaaccaaacgaaattctacacgcgaccgcccgaacaaacccaacaaataccccgtcaaaaatactcgcaaaaataaccgcaacctacgaaacaataaaaactaccttccaaccact

SEQ ID NO: 19917 - DNA, 746 bp, Artificial Sequence
  chemically treated genomic DNA (Homo sapiens) CpG-island No: 19917
tgcggttttgcggtttttattttttaggtttcgagggttttgttcgtcgcgttatagttttagtttcgtcggaagttttcgttttcggtttcgtgtagtttcgtttcgtttcgtttcgtgtagtttcgttcggtttagtttcgttcggcgcggttcgggggcgcgtatttgtcgagtacgagtttttttaggcggtgtaggtcgtaggttacgtattttagcgttatgtcggtgatgcgtgggtattacgagaggttaaggttgcgtagtttgcgtaggttttcggttacgagttttacgtcgtcgtcggtgattttggagtagttcgagaggttgagcgcggtgaggttgggtaggttgtgtattacgttgattacgtcgtggttggtgattttttagtaggagagtaggcgtagcgtgtgcgtgttgtggttttggcgcgtcgtgaagtaggttagcgtcgtgttcgttacgtggtaggtttgtaggtttagtttcgttaggttgggtagtagttgcgagatggtcgcgatggcgtcgtcggttacgttgatgtagttatttacgtttagcgaggtgatgcgcgcgtttaggttggattatagttcggtttcggtgaagtcgttgtagttcgatagttttagacgtattacgttttgtatttgtttaagtataatttgtaggcgggcgggcgtcgggttaggattgtaggagaaggggtggagttcgtagggaggaagtagtat

SEQ ID NO: 19918 - DNA, 746 bp, Artificial Sequence
  chemically treated genomic DNA (Homo sapiens) CpG-island No: 19918
atactacttcctccctacgaactccaccccttctcctacaatcctaacccgacgcccgcccgcctacaaattatacttaaacaaatacaaaacgtaatacgtctaaaactatcgaactacaacgacttcaccgaaaccgaactataatccaacctaaacgcgcgcatcacctcgctaaacgtaaataactacatcaacgtaaccgacgacgccatcgcgaccatctcgcaactactacccaacctaacgaaactaaacctacaaacctaccacgtaacgaacacgacgctaacctacttcacgacgcgccaaaaccacaacacgcacacgctacgcctactctcctactaaaaaatcaccaaccacgacgtaatcaacgtaatacacaacctacccaacctcaccgcgctcaacctctcgaactactccaaaatcaccgacgacgacgtaaaactcgtaaccgaaaacctacgcaaactacgcaaccttaacctctcgtaatacccacgcatcaccgacataacgctaaaatacgtaacctacgacctacaccgcctaaaaaaactcgtactcgacaaatacgcgcccccgaaccgcgccgaacgaaactaaaccgaacgaaactacacgaaacgaaacgaaacgaaactacacgaaaccgaaaacgaaaacttccgacgaaactaaaactataacgcgacgaacaaaaccctcgaaacctaaaaaataaaaaccgcaaaaccgca

SEQ ID NO: 19919 - DNA, 746 bp, Artificial Sequence
  chemically treated genomic DNA (Homo sapiens) CpG-island No: 19919
atattgttttttttttgcgggttttatttttttttttgtaattttgattcggcgttcgttcgtttgtaggttatgtttgaatagatgtagggcgtggtgcgtttggagttgtcgggttgtaacgattttatcgaggtcgggttgtggtttagtttgagcgcgcgtattatttcgttgagcgtgagtgattgtattaacgtggtcgacgacgttatcgcggttatttcgtagttgttgtttaatttggcggagttgagtttgtaggtttattacgtgacggatacggcgttggtttattttacggcgcgttagggttatagtacgtatacgttgcgtttgtttttttgttgggagattattaattacggcgtggttaacgtggtgtatagtttgtttaattttatcgcgtttagtttttcgggttgttttaaggttatcgacgacggcgtggagttcgtggtcgagaatttgcgtaagttgcgtagttttgatttttcgtggtgtttacgtattatcgatatggcgttggagtacgtggtttgcgatttgtatcgtttagaggagttcgtgttcgataggtgcgcgttttcgggtcgcgtcgggcggggttgggtcgggcggggttgtacggggcggggcggggcggggttgtacggggtcgggggcgggggttttcggcggggttggggttgtggcgcggcgggtagagttttcggagtttggggagtgggaatcgtagaatcgta

SEQ ID NO: 19920 - DNA, 746 bp, Artificial Sequence
  chemically treated genomic DNA (Homo sapiens) CpG-island No: 19920
tacgattctacgattcccactccccaaactccgaaaactctacccgccgcgccacaaccccaaccccgccgaaaacccccgcccccgaccccgtacaaccccgccccgccccgccccgtacaaccccgcccgacccaaccccgcccgacgcgacccgaaaacgcgcacctatcgaacacgaactcctctaaacgatacaaatcgcaaaccacgtactccaacgccatatcgataatacgtaaacaccacgaaaaatcaaaactacgcaacttacgcaaattctcgaccacgaactccacgccgtcgtcgataaccttaaaacaacccgaaaaactaaacgcgataaaattaaacaaactatacaccacgttaaccacgccgtaattaataatctcccaacaaaaaaacaaacgcaacgtatacgtactataaccctaacgcgccgtaaaataaaccaacgccgtatccgtcacgtaataaacctacaaactcaactccgccaaattaaacaacaactacgaaataaccgcgataacgtcgtcgaccacgttaatacaatcactcacgctcaacgaaataatacgcgcgctcaaactaaaccacaacccgacctcgataaaatcgttacaacccgacaactccaaacgcaccacgccctacatctattcaaacataacctacaaacgaacgaacgccgaatcaaaattacaaaaaaaaaaataaaacccgcaaaaaaaaaacaatat

SEQ ID NO: 19921 - DNA, 841 bp, Artificial Sequence
  chemically treated genomic DNA (Homo sapiens) CpG-island No: 19921
attaaaatttcggttttattagaggttttaggatttcgatcgggatagcgcggggggcgaggttagggtgagggcgcggcgaaggagagacgtatagcgcggggcgggtaaggagtttttttttcgcgttaaggttttttttaattttcgaggcgtttggatcgtgggatagtttttcggcggcgttcgagtttcggtttcgttttcgtttcgtttcgcgtttgttattggcggaaagtttcgggtcgcgtcgcgattggtcgatacgtcgtaggtttcgtttttttttcgattcgttttaaggcggtttcggcgttggggttgcgcggtaggcggagcggtcgcgggtttgggggtttcgtcggggtcgggcggtcggcgttttcggttgttttcgtcgtcgttcggattcgcgtttcgtcggggtagcggtggtgagagtttcgatttttcggacgtcgttcgtcgtgttatggggttttcggtcgcggcgttgttttgcgcgttgtgttgcggttttttggtttcggttgttcgcgtcggttatttcgaggagcgttgtagttggaggggtaggtacggttcggggggttgttttcgtatttaggacggggtgcgttgcggttaggattttttaggcgtttttcggagcgcgtagagcgttgggtcggtttttttattcgcgaggcggtttcgggagggagcgggggttgcgtcgggcggggattcgttttcgttttagcgtttcgtttcgttttgtttttagcggttttatttaggagttcggtagcgtggggtagttggttttggtttgtgcggagggcgcggttgagtggttgta

SEQ ID NO: 19922 - DNA, 841 bp, Artificial Sequence
  chemically treated genomic DNA (Homo sapiens) CpG-island No: 19922
tacaaccactcaaccgcgccctccgcacaaaccaaaaccaactaccccacgctaccgaactcctaaataaaaccgctaaaaacaaaacgaaacgaaacgctaaaacgaaaacgaatccccgcccgacgcaacccccgctccctcccgaaaccgcctcgcgaataaaaaaaccgacccaacgctctacgcgctccgaaaaacgcctaaaaaatcctaaccgcaacgcaccccgtcctaaatacgaaaacaaccccccgaaccgtacctacccctccaactacaacgctcctcgaaataaccgacgcgaacaaccgaaaccaaaaaaccgcaacacaacgcgcaaaacaacgccgcgaccgaaaaccccataacacgacgaacgacgtccgaaaaatcgaaactctcaccaccgctaccccgacgaaacgcgaatccgaacgacgacgaaaacaaccgaaaacgccgaccgcccgaccccgacgaaacccccaaacccgcgaccgctccgcctaccgcgcaaccccaacgccgaaaccgccttaaaacgaatcgaaaaaaaaacgaaacctacgacgtatcgaccaatcgcgacgcgacccgaaactttccgccaataacaaacgcgaaacgaaacgaaaacgaaaccgaaactcgaacgccgccgaaaaactatcccacgatccaaacgcctcgaaaattaaaaaaaaccttaacgcgaaaaaaaaactccttacccgccccgcgctatacgtctctccttcgccgcgccctcaccctaacctcgccccccgcgctatcccgatcgaaatcctaaaacctctaataaaaccgaaattttaat

SEQ ID NO: 19923 - DNA, 841 bp, Artificial Sequence
  chemically treated genomic DNA (Homo sapiens) CpG-island No: 19923
tatagttatttaatcgcgtttttcgtataggttagggttagttgttttacgttgtcgggtttttgggtgaggtcgttggggataggacgggacggggcgttgagacgggggcgggttttcgttcggcgtagttttcgttttttttcgaggtcgtttcgcggatggggaaatcggtttagcgttttgcgcgtttcgaggggcgtttggggggttttagtcgtagcgtatttcgttttaagtgcggggatagtttttcggatcgtatttgtttttttagttgtagcgtttttcggagtagtcggcgcgggtagtcggggttaggaggtcgtagtatagcgcgtagagtagcgtcgcggtcgggaattttatggtacggcgggcggcgttcggggagtcggggtttttattatcgttgtttcggcggggcgcgggttcgggcggcggcgggagtagtcgggggcgtcggtcgttcggtttcggcgaagtttttaagttcgcggtcgtttcgtttgtcgcgtagttttagcgtcggggtcgttttggagcgggtcgggaagggggcggggtttgcggcgtgtcggttagtcgcggcgcggttcggaatttttcgttaatagtaggcgcggggcggagcgggggcggggtcggagttcgggcgtcgtcggaggattattttacggtttaagcgtttcgagggttggggggggttttggcgcggaagggaggttttttgttcgtttcgcgttgtgcgtttttttttcgtcgcgtttttattttggtttcgtttttcgcgttgtttcgatcggagttttggagtttttgatggagtcgaggttttgat

SEQ ID NO: 19924 - DNA, 841 bp, Artificial Sequence
  chemically treated genomic DNA (Homo sapiens) CpG-island No: 19924
atcaaaacctcgactccatcaaaaactccaaaactccgatcgaaacaacgcgaaaaacgaaaccaaaataaaaacgcgacgaaaaaaaaacgcacaacgcgaaacgaacaaaaaacctcccttccgcgccaaaaccccccccaaccctcgaaacgcttaaaccgtaaaataatcctccgacgacgcccgaactccgaccccgcccccgctccgccccgcgcctactattaacgaaaaattccgaaccgcgccgcgactaaccgacacgccgcaaaccccgcccccttcccgacccgctccaaaacgaccccgacgctaaaactacgcgacaaacgaaacgaccgcgaacttaaaaacttcgccgaaaccgaacgaccgacgcccccgactactcccgccgccgcccgaacccgcgccccgccgaaacaacgataataaaaaccccgactccccgaacgccgcccgccgtaccataaaattcccgaccgcgacgctactctacgcgctatactacgacctcctaaccccgactacccgcgccgactactccgaaaaacgctacaactaaaaaaacaaatacgatccgaaaaactatccccgcacttaaaacgaaatacgctacgactaaaaccccccaaacgcccctcgaaacgcgcaaaacgctaaaccgatttccccatccgcgaaacgacctcgaaaaaaaacgaaaactacgccgaacgaaaacccgcccccgtctcaacgccccgtcccgtcctatccccaacgacctcacccaaaaacccgacaacgtaaaacaactaaccctaacctatacgaaaaacgcgattaaataactata

SEQ ID NO: 19925 - DNA, 780 bp, Artificial Sequence
  chemically treated genomic DNA (Homo sapiens) CpG-island No: 19925
  misc_feature (314)..(314): n is either a, c, g or t
  misc_feature (675)..(675): n is either a, c, g or t
ttgtagtttttgttgcgttttgttgcgtttcgcgggggttcgtattcggtcgttatgtttacgattcgagagtcgttttaaaattagtttttttttttatatattttttttttttttttttttagttcgatcgaggtcgcggtattgtaaagcggtttttaattttatttttaattttttcgttgtaaaattcgattcgacggttgcgaagtgtgcgtttgcgcgcggcgcgggtagggcgcgggaatgggggtgggtgtgggaagtttacgggttttcggtcgcggtttgaaaaggtcggagttacggggaancgggggatgggtttgggtttcggtcggaattttttttttttttttagcgggttttcgtttcgggtttggttcggtttttatacgtgcgcgttaaaaatttattttaaagtttgttttcggtacgggggtcgttttttttgcgttattttttgggtaatcgcgcgggcgaataattagtttttaggtttcgtcgttttttttattttaggcgttgcgaaaaggttggaggggtcgagcgagagaggacgttcgttgatgagttttcgggagtcgtaagcggttttcgggtggacgaatgtttttttgtttttaatttttatcgttttagaaaattgaattgaatataaagtttgcggttagncgttacgtagtggttttcggagtttattattgtttgggttcgtattgattttaggttcggattaggtagaggttgatttttgttttatagtttcgtcggtttaat

SEQ ID NO: 19926 - DNA, 780 bp, Artificial Sequence
  chemically treated genomic DNA (Homo sapiens) CpG-island No: 19926
  misc_feature (106)..(106): n is either a, c, g or t
  misc_feature (467)..(467): n is either a, c, g or t
attaaaccgacgaaactataaaacaaaaatcaacctctacctaatccgaacctaaaatcaatacgaacccaaacaataataaactccgaaaaccactacgtaacgnctaaccgcaaactttatattcaattcaattttctaaaacgataaaaattaaaaacaaaaaaacattcgtccacccgaaaaccgcttacgactcccgaaaactcatcaacgaacgtcctctctcgctcgacccctccaaccttttcgcaacgcctaaaataaaaaaaacgacgaaacctaaaaactaattattcgcccgcgcgattacccaaaaaataacgcaaaaaaaacgacccccgtaccgaaaacaaactttaaaataaatttttaacgcgcacgtataaaaaccgaaccaaacccgaaacgaaaacccgctaaaaaaaaaaaaaaaattccgaccgaaacccaaacccatcccccgnttccccgtaactccgaccttttcaaaccgcgaccgaaaacccgtaaacttcccacacccacccccattcccgcgccctacccgcgccgcgcgcaaacgcacacttcgcaaccgtcgaatcgaattttacaacgaaaaaattaaaaataaaattaaaaaccgctttacaataccgcgacctcgatcgaactaaaaaaaaaaaaaaaaaaaatatataaaaaaaaaaactaattttaaaacgactctcgaatcgtaaacataacgaccgaatacgaacccccgcgaaacgcaacaaaacgcaacaaaaactacaa

SEQ ID NO: 19927 - DNA, 780 bp, Artificial Sequence
  chemically treated genomic DNA (Homo sapiens) CpG-island No: 19927
  misc_feature (106)..(106): n is either a, c, g or t
  misc_feature (467)..(467): n is either a, c, g or t
attaggtcggcggggttgtaaagtaggaattagtttttgtttaattcggatttggggttaatacgagtttaaataatggtgagtttcgaaggttattgcgtagcgnttggtcgtaaattttgtgtttaatttaattttttaaagcggtgggggttgggggtagggaggtattcgtttattcgaaagtcgtttgcggttttcgggggtttattagcgaacgttttttttcgttcggtttttttagttttttcgtagcgtttgggatagagggggcggcgaggtttggggattggttgttcgttcgcgcggttgtttagggggtggcgtaaaaggggcggttttcgtgtcgggaatagattttgaagtgggtttttagcgcgtacgtgtgagagtcgggttaggttcggagcggggattcgttgggaggaaagaggaggtttcggtcggggtttaaatttatttttcgntttttcgtggtttcggtttttttaagtcgcggtcgggggttcgtaggttttttatatttatttttattttcgcgttttgttcgcgtcgcgcgtaggcgtatatttcgtagtcgtcgagtcggattttgtagcgagggggttggggatagagttgaaagtcgttttgtagtgtcgcggtttcggtcgagttgggagggaggggaggggaggtatgtgggaaggggggttggttttggggcggttttcgagtcgtgaatatggcggtcggatgcgaattttcgcggagcgtagtaaagcgtagtaaaggttgtag

SEQ ID NO: 19928 - DNA, 780 bp, Artificial Sequence
  chemically treated genomic DNA (Homo sapiens) CpG-island No: 19928
  misc_feature (314)..(314): n is either a, c, g or t
  misc_feature (675)..(675): n is either a, c, g or t
ctacaacctttactacgctttactacgctccgcgaaaattcgcatccgaccgccatattcacgactcgaaaaccgccccaaaaccaaccccccttcccacatacctcccctcccctccctcccaactcgaccgaaaccgcgacactacaaaacgactttcaactctatccccaaccccctcgctacaaaatccgactcgacgactacgaaatatacgcctacgcgcgacgcgaacaaaacgcgaaaataaaaataaatataaaaaacctacgaacccccgaccgcgacttaaaaaaaccgaaaccacgaaaaancgaaaaataaatttaaaccccgaccgaaacctcctctttcctcccaacgaatccccgctccgaacctaacccgactctcacacgtacgcgctaaaaacccacttcaaaatctattcccgacacgaaaaccgccccttttacgccaccccctaaacaaccgcgcgaacgaacaaccaatccccaaacctcgccgccccctctatcccaaacgctacgaaaaaactaaaaaaaccgaacgaaaaaaaacgttcgctaataaacccccgaaaaccgcaaacgactttcgaataaacgaatacctccctacccccaacccccaccgctttaaaaaattaaattaaacacaaaatttacgaccaancgctacgcaataaccttcgaaactcaccattatttaaactcgtattaaccccaaatccgaattaaacaaaaactaattcctactttacaaccccgccgacctaat

SEQ ID NO: 19929 - DNA, 865 bp, Artificial Sequence
  chemically treated genomic DNA (Homo sapiens) CpG-island No: 19929
gcgtcgcgcgtcggttatgtttttttttattttagtttttcgggattcgagagtcgtgcggggtcgagtttcgtgtttcgaggtacgtcgagttaagttatttttgtagttcgcggcgtcggaatttgggggcgtagtgagtgggggtagggcgtcgggtcggcgggcggtggtcgtggttgggtgtcggtttttggttttagaagttttttcgtattttgttgaattcggggttgtattggtttttcgagtttttcggattggtaacgtcgtagagataataggttttgattcgggatagattttatattcgcgtttaggacgtgggtttttttttttttttaggcgagaggttttcggattgggcgtcgcggcgagtttttcgtggtttttgtttgtttttgtacggttttttttttttttattattttgtttcggttttattcgggttttggttttatcgcgaaggggcgaggagttttcggaagggtcgcgatggtcggggagttcgggatttcggttttgggtaggcgcgtttcgcgatttagcggcggcgtgggcgaggggcgttgcgtaaattacgcgttttcgttggggaaacgttagtttaggcgggcggcggcggtgaaggggatgaggattaggatttcgtgttcggcgggattggtttcgtattttacgtcgtttttttgcggtgcgtatcgtatttgcgttttaggtcgaggttaggtttcgatttttttttcgtatcgacgtgattcggatcgcgcggtgttggcgtcgtttttatgcgttttgtttggtttttatttggtttttttttttttttaggtggaggagatgtcgttgtttcgtcggtttgggg

SEQ ID NO: 19930 - DNA, 865 bp, Artificial Sequence
  chemically treated genomic DNA (Homo sapiens) CpG-island No: 19930
ccccaaaccgacgaaacaacgacatctcctccacctaaaaaaaaaaaaaaaccaaataaaaaccaaacaaaacgcataaaaacgacgccaacaccgcgcgatccgaatcacgtcgatacgaaaaaaaaatcgaaacctaacctcgacctaaaacgcaaatacgatacgcaccgcaaaaaaacgacgtaaaatacgaaaccaatcccgccgaacacgaaatcctaatcctcatccccttcaccgccgccgcccgcctaaactaacgtttccccaacgaaaacgcgtaatttacgcaacgcccctcgcccacgccgccgctaaatcgcgaaacgcgcctacccaaaaccgaaatcccgaactccccgaccatcgcgacccttccgaaaactcctcgccccttcgcgataaaaccaaaacccgaataaaaccgaaacaaaataataaaaaaaaaaaaaaccgtacaaaaacaaacaaaaaccacgaaaaactcgccgcgacgcccaatccgaaaacctctcgcctaaaaaaaaaaaaaaacccacgtcctaaacgcgaatataaaatctatcccgaatcaaaacctattatctctacgacgttaccaatccgaaaaactcgaaaaaccaatacaaccccgaattcaacaaaatacgaaaaaacttctaaaaccaaaaaccgacacccaaccacgaccaccgcccgccgacccgacgccctacccccactcactacgcccccaaattccgacgccgcgaactacaaaaataacttaactcgacgtacctcgaaacacgaaactcgaccccgcacgactctcgaatcccgaaaaactaaaataaaaaaaaacataaccgacgcgcgacgc

SEQ ID NO: 19931 - DNA, 865 bp, Artificial Sequence
  chemically treated genomic DNA (Homo sapiens) CpG-island No: 19931
ttttagatcgacgggatagcggtattttttttatttgaaaaggaaagaggattaggtgggggttaggtagggcgtatgaaggcggcgttagtatcgcgcgattcgaattacgtcggtgcgggggaggggtcggagtttggtttcggtttagggcgtagatgcggtgcgtatcgtaggggggcggcgtggggtgcggggttagtttcgtcgggtacggggttttggtttttattttttttatcgtcgtcgttcgtttgggttggcgtttttttagcgagagcgcgtagtttgcgtagcgtttttcgtttacgtcgtcgttgggtcgcggggcgcgtttatttagagtcgaggtttcggatttttcggttatcgcgattttttcggggatttttcgttttttcgcggtgggattaaggttcgggtggggtcgggatagggtggtggggggaagggggatcgtataaaagtaaatagaaattacggggggttcgtcgcgacgtttagttcgagggtttttcgtttggaagagggaagaaatttacgttttggacgcgggtgtggggtttgtttcgggttaggatttgttgtttttgcgacgttgttagttcggagagttcggagggttaatgtagtttcggatttaataagatgcgaaaggatttttaaagttaggaatcggtatttagttacggttatcgttcgtcggttcggcgttttgtttttatttattgcgtttttaagtttcggcgtcgcgggttgtaggggtgatttggttcggcgtgtttcggggtacgaggttcggtttcgtacggttttcgggtttcggggggttggggtgggaagggatatggtcggcgcgcggcgt

SEQ ID NO: 19932 - DNA, 865 bp, Artificial Sequence
  chemically treated genomic DNA (Homo sapiens) CpG-island No: 19932
acgccgcgcgccgaccatatcccttcccaccccaaccccccgaaacccgaaaaccgtacgaaaccgaacctcgtaccccgaaacacgccgaaccaaatcacccctacaacccgcgacgccgaaacttaaaaacgcaataaataaaaacaaaacgccgaaccgacgaacgataaccgtaactaaataccgattcctaactttaaaaatcctttcgcatcttattaaatccgaaactacattaaccctccgaactctccgaactaacaacgtcgcaaaaacaacaaatcctaacccgaaacaaaccccacacccgcgtccaaaacgtaaatttcttccctcttccaaacgaaaaaccctcgaactaaacgtcgcgacgaaccccccgtaatttctatttacttttatacgatcccccttccccccaccaccctatcccgaccccacccgaaccttaatcccaccgcgaaaaaacgaaaaatccccgaaaaaatcgcgataaccgaaaaatccgaaacctcgactctaaataaacgcgccccgcgacccaacgacgacgtaaacgaaaaacgctacgcaaactacgcgctctcgctaaaaaaacgccaacccaaacgaacgacgacgataaaaaaaataaaaaccaaaaccccgtacccgacgaaactaaccccgcaccccacgccgcccccctacgatacgcaccgcatctacgccctaaaccgaaaccaaactccgacccctcccccgcaccgacgtaattcgaatcgcgcgatactaacgccgccttcatacgccctacctaacccccacctaatcctctttccttttcaaataaaaaaaataccgctatcccgtcgatctaaaa

SEQ ID NO: 19933 - DNA, 677 bp, Artificial Sequence
  chemically treated genomic DNA (Homo sapiens) CpG-island No: 19933
gcgttttatttcgtcgtaggtcgaggttggcgtagagagataggaagcgttagttttgggcgtttgggttttcgttttttcggtcgtagtttcgcggcggcgcgttcgcggtgtattgtgggcgttgtagttcggtcggaatttgtttgcgatttcgagttttatgatatcgtttttttttatattttagttcgtagtgtttttttttagtttcggtcgggtttttcgggagtcgggcgtggcgttttagttagtgagtcgttttttttttgggttcggaggcggaagtttgaggggcgcggggaggagtttcgcgtgcggggtgaacgttcgttttacgtgttcgtttttttcgcgatcgttgcgcgcgagtttcgtgtttttacggcgggtagtagcggcggcggcggcggttgaacgcggagggggcggagggagttcgcggcggcggtagtagttatagcgaaatggcggagatcgtggttgatattcggcggttgattattaagtcgtagaatttgaatgacgtttacggattttttagtaattttttcgagatcgatgtgagtaattcgtaaacggtgggggtcggtcggggtcgttttattatttacgaaattagggttaaggtgaggtcgtttttttttttttttaagaaatttttttcgttggttttg

SEQ ID NO: 19934 - DNA, 677 bp, Artificial Sequence
  chemically treated genomic DNA (Homo sapiens) CpG-island No: 19934
caaaaccaacgaaaaaaatttcttaaaaaaaaaaaaaaacgacctcaccttaaccctaatttcgtaaataataaaacgaccccgaccgacccccaccgtttacgaattactcacatcgatctcgaaaaaattactaaaaaatccgtaaacgtcattcaaattctacgacttaataatcaaccgccgaatatcaaccacgatctccgccatttcgctataactactaccgccgccgcgaactccctccgccccctccgcgttcaaccgccgccgccgccgctactacccgccgtaaaaacacgaaactcgcgcgcaacgatcgcgaaaaaaacgaacacgtaaaacgaacgttcaccccgcacgcgaaactcctccccgcgcccctcaaacttccgcctccgaacccaaaaaaaaaacgactcactaactaaaacgccacgcccgactcccgaaaaacccgaccgaaactaaaaaaaaacactacgaactaaaatataaaaaaaaacgatatcataaaactcgaaatcgcaaacaaattccgaccgaactacaacgcccacaatacaccgcgaacgcgccgccgcgaaactacgaccgaaaaaacgaaaacccaaacgcccaaaactaacgcttcctatctctctacgccaacctcgacctacgacgaaataaaacgc

SEQ ID NO: 19935 - DNA, 677 bp, Artificial Sequence
  chemically treated genomic DNA (Homo sapiens) CpG-island No: 19935
tagagttagcgggaggggttttttgggagaggggagagacggttttattttgattttgatttcgtaagtggtgaagcggtttcggtcgatttttatcgtttgcgggttgtttatatcgatttcgaggaagttgttggggggttcgtaggcgttatttaggttttgcggtttggtgattagtcgtcgggtgttagttacggttttcgttatttcgttgtagttgttgtcgtcgtcgcgggtttttttcgtttttttcgcgtttagtcgtcgtcgtcgtcgttgttgttcgtcgtggggatacggggttcgcgcgtagcggtcgcgaagagaacgagtacgtagagcgggcgtttatttcgtacgcgaagttttttttcgcgttttttaagttttcgttttcgagtttaggggagaaacggtttattagttggaacgttacgttcggttttcgggaggttcggtcgaggttggggaggggtattgcggattggggtgtgaggagaagcggtgttatgggattcggggtcgtaaataggtttcggtcggattatagcgtttataatgtatcgcgagcgcgtcgtcgcggggttgcggtcgaggaggcgaggatttagacgtttagagttggcgttttttgtttttttgcgttagtttcggtttgcggcggggtagagcgt

SEQ ID NO: 19936 - DNA, 677 bp, Artificial Sequence
  chemically treated genomic DNA (Homo sapiens) CpG-island No: 19936
acgctctaccccgccgcaaaccgaaactaacgcaaaaaaacaaaaaacgccaactctaaacgtctaaatcctcgcctcctcgaccgcaaccccgcgacgacgcgctcgcgatacattataaacgctataatccgaccgaaacctatttacgaccccgaatcccataacaccgcttctcctcacaccccaatccgcaatacccctccccaacctcgaccgaacctcccgaaaaccgaacgtaacgttccaactaataaaccgtttctcccctaaactcgaaaacgaaaacttaaaaaacgcgaaaaaaaacttcgcgtacgaaataaacgcccgctctacgtactcgttctcttcgcgaccgctacgcgcgaaccccgtatccccacgacgaacaacaacgacgacgacgacgactaaacgcgaaaaaaacgaaaaaaacccgcgacgacgacaacaactacaacgaaataacgaaaaccgtaactaacacccgacgactaatcaccaaaccgcaaaacctaaataacgcctacgaaccccccaacaacttcctcgaaatcgatataaacaacccgcaaacgataaaaatcgaccgaaaccgcttcaccacttacgaaatcaaaatcaaaataaaaccgtctctcccctctcccaaaaaacccctcccgctaactcta

SEQ ID NO: 19937 - DNA, 755 bp, Artificial Sequence
  chemically treated genomic DNA (Homo sapiens) CpG-island No: 19937
gattttcgggatagggattgagtttgatcgtttgatttgttttttcggtttttagcgtttcgtttaggtcggggtttggggagggggcgttttttggacgtttgcggttcgtcgaggggtggggtgagggcgttacgggtcgattcgggtcgtcgggtgattcgggacgttttttgtttcggcgggcgtcgtttatagtttgcgtagtgtttaggggcggaggtcgggagggggtttaagcgttagttttttagtttcggcggattcgggtgggcgtgttcgcggattcgtttgtcgtatttaggcgagttttttttgtagcgtttcgagtttttgggggttgcggcggttgcgggcgttttcgcgcgggttcgaggggcgggacgcggcggagcggggcggggcggggttttcgcggttttttttttcggtttcgggtttcggtttcggtttcggttttggttttgcgcggtggtagcggcggcggcggcgcggggatcgaggtgagcggcggttacgggttcggaggttcggtcggagaggggatcgggtggttggggttggggggcggtacgcgcgattttgcggaagggggggtttcggggcggtgtcggcggagcggcgcgcgcgtgtgtgtgcgcgcgtaggtgcgcgcgcgcgcgacgtcgattgcggggttttagggtggggtaggggtcggacggaatttgcggggtaggggcggtttttttgggtgaaggtttagttttttttat

SEQ ID NO: 19938 - DNA, 755 bp, Artificial Sequence
  chemically treated genomic DNA (Homo sapiens) CpG-island No: 19938
ataaaaaaaactaaaccttcacccaaaaaaaccgcccctaccccgcaaattccgtccgacccctaccccaccctaaaaccccgcaatcgacgtcgcgcgcgcgcgcacctacgcgcgcacacacacgcgcgcgccgctccgccgacaccgccccgaaacccccccttccgcaaaatcgcgcgtaccgccccccaaccccaaccacccgatcccctctccgaccgaacctccgaacccgtaaccgccgctcacctcgatccccgcgccgccgccgccgctaccaccgcgcaaaaccaaaaccgaaaccgaaaccgaaacccgaaaccgaaaaaaaaaaccgcgaaaaccccgccccgccccgctccgccgcgtcccgcccctcgaacccgcgcgaaaacgcccgcaaccgccgcaacccccaaaaactcgaaacgctacaaaaaaaactcgcctaaatacgacaaacgaatccgcgaacacgcccacccgaatccgccgaaactaaaaaactaacgcttaaaccccctcccgacctccgcccctaaacactacgcaaactataaacgacgcccgccgaaacaaaaaacgtcccgaatcacccgacgacccgaatcgacccgtaacgccctcaccccacccctcgacgaaccgcaaacgtccaaaaaacgccccctccccaaaccccgacctaaacgaaacgctaaaaaccgaaaaaacaaatcaaacgatcaaactcaatccctatcccgaaaatc

SEQ ID NO: 19939 - DNA, 755 bp, Artificial Sequence
  chemically treated genomic DNA (Homo sapiens) CpG-island No: 19939
gtgggagaggttggatttttatttaagggggtcgtttttgtttcgtagatttcgttcgatttttattttattttagggtttcgtagtcggcgtcgcgcgcgcgcgtatttacgcgcgtatatatacgcgcgcgtcgtttcgtcggtatcgtttcggggttttttttttcgtagggtcgcgcgtgtcgttttttaattttagttattcggtttttttttcggtcgggttttcggattcgtagtcgtcgtttatttcggttttcgcgtcgtcgtcgtcgttgttatcgcgtagagttagagtcggagtcggagtcggagttcggggtcgggggagggggtcgcggaggtttcgtttcgtttcgtttcgtcgcgtttcgtttttcgggttcgcgcgggggcgttcgtagtcgtcgtagtttttagggattcggggcgttgtaggggagattcgtttaagtgcggtaagcgggttcgcgggtacgtttattcgggttcgtcggagttggggggttggcgtttgggttttttttcggttttcgtttttgagtattgcgtaggttgtgggcggcgttcgtcggggtagggggcgtttcgggttattcggcggttcggatcggttcgtgacgtttttattttatttttcggcgggtcgtaaacgtttagagagcgttttttttttaagtttcgatttgagcggggcgttagaagtcgggaggataaattagacggttagatttagtttttgtttcggggatt

SEQ ID NO: 19940 - DNA, 755 bp, Artificial Sequence
  chemically treated genomic DNA (Homo sapiens) CpG-island No: 19940
aatccccgaaacaaaaactaaatctaaccgtctaatttatcctcccgacttctaacgccccgctcaaatcgaaacttaaaaaaaaaacgctctctaaacgtttacgacccgccgaaaaataaaataaaaacgtcacgaaccgatccgaaccgccgaataacccgaaacgccccctaccccgacgaacgccgcccacaacctacgcaatactcaaaaacgaaaaccgaaaaaaaacccaaacgccaaccccccaactccgacgaacccgaataaacgtacccgcgaacccgcttaccgcacttaaacgaatctcccctacaacgccccgaatccctaaaaactacgacgactacgaacgcccccgcgcgaacccgaaaaacgaaacgcgacgaaacgaaacgaaacgaaacctccgcgaccccctcccccgaccccgaactccgactccgactccgactctaactctacgcgataacaacgacgacgacgacgcgaaaaccgaaataaacgacgactacgaatccgaaaacccgaccgaaaaaaaaaccgaataactaaaattaaaaaacgacacgcgcgaccctacgaaaaaaaaaaccccgaaacgataccgacgaaacgacgcgcgcgtatatatacgcgcgtaaatacgcgcgcgcgcgacgccgactacgaaaccctaaaataaaataaaaatcgaacgaaatctacgaaacaaaaacgacccccttaaataaaaatccaacctctcccac

SEQ ID NO: 19941 - DNA, 1035 bp, Artificial Sequence
  chemically treated genomic DNA (Homo sapiens) CpG-island No: 19941
gaggcgtcgtggtagttgcggtcgcggagacgtcggtttcgttttttgtatacgttttttcgtttgaggtttcgtttcgttcgcgatgttttcgttttttttttcgtttcgtttttcggggcgtcgagattcgtttttgggttcgttttcgggttcgttttcggttttcgtttgcgtcgggtttgtgttggtcgcgcgtttggcgttttacgttgagttttttcgtgtaatgattaattcggcggggcggtcggcgcgggattcgagacggaggcgcggggtcggggcgggatttcgtaggatcgttcggttttttgttttcgtcggagttttcgcgtagagggcgtatcgtcggttcggggtttttggtgcggcgtggcgtagggcgcggcgtggggcgcgcgtgggcgcggcgtaggcggttcgggttattatgaggatttttcgtaggttgaagtttatgagttcgtttagttttagtgatttgggtaagagagagtcggtcgtcgtcgcggacgagcggggtacgtagtagcgtcgggtttgcgttaacgttatttggaataggtaaggtcgcgttttttcggttattcggaggttttggagtcgggggaggggatttttgagtcgttcgcgggttaggggtcgtttcgagttaggaacgttgtcgaaggcggcgcggcgttttatagtttgtaaagaatttgtttcgtcggagtggtgcgggtttggaggaaagtttagtgtagcgtggttttagaatttagggaagggagcgaggttcgttagcgttcggggttggtttagaagcgttcggcgggtgggcggcggggtgggtcgggaagtcgcgtgttcgttttttattcggggtttttttacgtttttattgcggtgttcgtgataatttgggaggttaacggagtaggaagtattttttttattttgcggttgagtacgggagtttcggggtttagtgggtgggtcgcgtaggttttttgtgtttttttaagtttttttcggtttttttttgagagg

SEQ ID NO: 19942 - DNA, 1035 bp, Artificial Sequence
  chemically treated genomic DNA (Homo sapiens) CpG-island No: 19942
cctctcaaaaaaaaaccgaaaaaaacttaaaaaaacacaaaaaacctacgcgacccacccactaaaccccgaaactcccgtactcaaccgcaaaataaaaaaaatacttcctactccgttaacctcccaaattatcacgaacaccgcaataaaaacgtaaaaaaaccccgaataaaaaacgaacacgcgacttcccgacccaccccgccgcccacccgccgaacgcttctaaaccaaccccgaacgctaacgaacctcgctcccttccctaaattctaaaaccacgctacactaaactttcctccaaacccgcaccactccgacgaaacaaattctttacaaactataaaacgccgcgccgccttcgacaacgttcctaactcgaaacgacccctaacccgcgaacgactcaaaaatcccctcccccgactccaaaacctccgaataaccgaaaaaacgcgaccttacctattccaaataacgttaacgcaaacccgacgctactacgtaccccgctcgtccgcgacgacgaccgactctctcttacccaaatcactaaaactaaacgaactcataaacttcaacctacgaaaaatcctcataataacccgaaccgcctacgccgcgcccacgcgcgccccacgccgcgccctacgccacgccgcaccaaaaaccccgaaccgacgatacgccctctacgcgaaaactccgacgaaaacaaaaaaccgaacgatcctacgaaatcccgccccgaccccgcgcctccgtctcgaatcccgcgccgaccgccccgccgaattaatcattacacgaaaaaactcaacgtaaaacgccaaacgcgcgaccaacacaaacccgacgcaaacgaaaaccgaaaacgaacccgaaaacgaacccaaaaacgaatctcgacgccccgaaaaacgaaacgaaaaaaaaaacgaaaacatcgcgaacgaaacgaaacctcaaacgaaaaaacgtatacaaaaaacgaaaccgacgtctccgcgaccgcaactaccacgacgcctc

SEQ ID NO: 19943 - DNA, 1035 bp, Artificial Sequence
  chemically treated genomic DNA (Homo sapiens) CpG-island No: 19943
ttttttaagggaaagtcgaagggagtttaaagagatataggaagtttgcgcgatttatttattgagtttcgaggttttcgtgtttagtcgtaaaatgggaaaaatattttttgtttcgttagttttttaggttgttacgagtatcgtagtggagacgtggaaagatttcgggtaggaggcgggtacgcggtttttcggtttatttcgtcgtttattcgtcgggcgtttttgggttagtttcgggcgttggcgggtttcgtttttttttttgggttttggaattacgttgtattgaatttttttttaggttcgtattatttcggcggggtaagttttttgtaaattgtgaagcgtcgcgtcgttttcggtagcgtttttggttcggggcggtttttagttcgcggacggtttaggggttttttttttcggttttagggttttcgggtggtcgggagggcgcggttttatttgttttaggtggcgttggcgtaggttcggcgttgttgcgtgtttcgttcgttcgcggcggcggtcggtttttttttgtttaggttattgaggttgggcgaatttatgaattttaatttgcggagagtttttatggtgattcgggtcgtttgcgtcgcgtttacgcgcgttttacgtcgcgttttgcgttacgtcgtattaagggtttcgggtcggcgatgcgttttttacgcggaaatttcggcgagagtaggaagtcgagcggttttgcggggtttcgtttcggtttcgcgttttcgtttcgggtttcgcgtcggtcgtttcgtcgggttaattattgtacggagaggtttagcgtggagcgttaggcgcgcggttagtatagattcggcgtaaacggaggtcgggggcggattcgggggcgggtttaggggcgggtttcggcgtttcggggggcggggcggggaagggggcgggggtatcgcgggcggggcggggttttaggcgagggggcgtgtgtaagaggcggagtcggcgttttcgcggtcgtagttgttacgacgtttt

SEQ ID NO: 19944 - DNA, 1035 bp, Artificial Sequence
  chemically treated genomic DNA (Homo sapiens) CpG-island No: 19944
aaaacgtcgtaacaactacgaccgcgaaaacgccgactccgcctcttacacacgccccctcgcctaaaaccccgccccgcccgcgatacccccgcccccttccccgccccgccccccgaaacgccgaaacccgcccctaaacccgcccccgaatccgcccccgacctccgtttacgccgaatctatactaaccgcgcgcctaacgctccacgctaaacctctccgtacaataattaacccgacgaaacgaccgacgcgaaacccgaaacgaaaacgcgaaaccgaaacgaaaccccgcaaaaccgctcgacttcctactctcgccgaaatttccgcgtaaaaaacgcatcgccgacccgaaacccttaatacgacgtaacgcaaaacgcgacgtaaaacgcgcgtaaacgcgacgcaaacgacccgaatcaccataaaaactctccgcaaattaaaattcataaattcgcccaacctcaataacctaaacaaaaaaaaaccgaccgccgccgcgaacgaacgaaacacgcaacaacgccgaacctacgccaacgccacctaaaacaaataaaaccgcgccctcccgaccacccgaaaaccctaaaaccgaaaaaaaaaacccctaaaccgtccgcgaactaaaaaccgccccgaaccaaaaacgctaccgaaaacgacgcgacgcttcacaatttacaaaaaacttaccccgccgaaataatacgaacctaaaaaaaaattcaatacaacgtaattccaaaacccaaaaaaaaaaacgaaacccgccaacgcccgaaactaacccaaaaacgcccgacgaataaacgacgaaataaaccgaaaaaccgcgtacccgcctcctacccgaaatctttccacgtctccactacgatactcgtaacaacctaaaaaactaacgaaacaaaaaatatttttcccattttacgactaaacacgaaaacctcgaaactcaataaataaatcgcgcaaacttcctatatctctttaaactcccttcgactttcccttaaaaaa

SEQ ID NO: 19945 - DNA, 719 bp, Artificial Sequence
  chemically treated genomic DNA (Homo sapiens) CpG-island No: 19945
agcgcggcgtttttcggggatcgaggtttcgggttcggtcgtttttagtagcgagggtaggagaagtggttcgggcggtcggcggattgggagggcgttattcgaggattataattttcggtttgtttcgcgtaggtatcgtttcgagttttcgtttcgtcggcgtcgcgtagttttgtgggagtcgtagttcgggcgcgcgatttatagcgtcgcgtgcgtttcgggcgcgtcgtagtcgcggggttcgggtcgggcgttacgttacgaaggtagcgtaaggcgggcgtcggacgcgggtaggggtcggggtcggagtcgggtcggggcgtttcgcggttgaggagcgggaggtcgttcgggtagcgcggtcggcggcgagaggggtttcgtcgtttttcggaggtagaagttgtggatcggtcggcgggggcgagcgggttcgggggtcggggtcgcgttgttcgggtcgcgaggacgaggcggcgtcgtcgggttgtggaggtgagtttcgtcggtcgggttcggtcgggcgtttagtcggggatttcgggcggggagcgcgggttcggagggcggcggggagcgcgggttcggcggggcgtaggaggtttcgggggtcgggcgcgtcgggtttcgagttagggtagggacggtagggttttcggagtggggttagttcgtcgttcgttggcgtttttaggttggtgggggttagg

SEQ ID NO: 19946 - DNA, 719 bp, Artificial Sequence
  chemically treated genomic DNA (Homo sapiens) CpG-island No: 19946
cctaacccccaccaacctaaaaacgccaacgaacgacgaactaaccccactccgaaaaccctaccgtccctaccctaactcgaaacccgacgcgcccgacccccgaaacctcctacgccccgccgaacccgcgctccccgccgccctccgaacccgcgctccccgcccgaaatccccgactaaacgcccgaccgaacccgaccgacgaaactcacctccacaacccgacgacgccgcctcgtcctcgcgacccgaacaacgcgaccccgacccccgaacccgctcgcccccgccgaccgatccacaacttctacctccgaaaaacgacgaaacccctctcgccgccgaccgcgctacccgaacgacctcccgctcctcaaccgcgaaacgccccgacccgactccgaccccgacccctacccgcgtccgacgcccgccttacgctaccttcgtaacgtaacgcccgacccgaaccccgcgactacgacgcgcccgaaacgcacgcgacgctataaatcgcgcgcccgaactacgactcccacaaaactacgcgacgccgacgaaacgaaaactcgaaacgatacctacgcgaaacaaaccgaaaattataatcctcgaataacgccctcccaatccgccgaccgcccgaaccacttctcctaccctcgctactaaaaacgaccgaacccgaaacctcgatccccgaaaaacgccgcgct

SEQ ID NO: 19947 - DNA, 719 bp, Artificial Sequence
  chemically treated genomic DNA (Homo sapiens) CpG-island No: 19947
tttggtttttattagtttggaggcgttagcgggcggcgggttgattttatttcgggggttttgtcgtttttgttttggttcggagttcggcgcgttcggttttcgaggttttttgcgtttcgtcgagttcgcgtttttcgtcgtttttcgggttcgcgtttttcgttcggggttttcggttgggcgttcggtcgggttcggtcgacgggatttatttttatagttcggcggcgtcgtttcgttttcgcggttcgggtagcgcggtttcggttttcgggttcgttcgttttcgtcggtcgatttataatttttgttttcggagagcggcggggtttttttcgtcgtcggtcgcgttgttcggacggtttttcgttttttagtcgcggggcgtttcgattcggtttcggtttcggtttttgttcgcgttcggcgttcgttttacgttgttttcgtagcgtagcgttcggttcgggtttcgcggttacggcgcgttcggggcgtacgcggcgttgtgaatcgcgcgttcggattacggtttttatagggttgcgcggcgtcgacggggcggaagttcggggcggtgtttgcgcgaggtaggtcgggagttgtagttttcgggtggcgtttttttagttcgtcgatcgttcgggttattttttttgttttcgttgttggagacggtcgggttcgaggtttcggttttcgggaggcgtcgcgtt

SEQ ID NO: 19948 - DNA, 719 bp, Artificial Sequence
  chemically treated genomic DNA (Homo sapiens) CpG-island No: 19948
aacgcgacgcctcccgaaaaccgaaacctcgaacccgaccgtctccaacaacgaaaacaaaaaaaataacccgaacgatcgacgaactaaaaaaacgccacccgaaaactacaactcccgacctacctcgcgcaaacaccgccccgaacttccgccccgtcgacgccgcgcaaccctataaaaaccgtaatccgaacgcgcgattcacaacgccgcgtacgccccgaacgcgccgtaaccgcgaaacccgaaccgaacgctacgctacgaaaacaacgtaaaacgaacgccgaacgcgaacaaaaaccgaaaccgaaaccgaatcgaaacgccccgcgactaaaaaacgaaaaaccgtccgaacaacgcgaccgacgacgaaaaaaaccccgccgctctccgaaaacaaaaattataaatcgaccgacgaaaacgaacgaacccgaaaaccgaaaccgcgctacccgaaccgcgaaaacgaaacgacgccgccgaactataaaaataaatcccgtcgaccgaacccgaccgaacgcccaaccgaaaaccccgaacgaaaaacgcgaacccgaaaaacgacgaaaaacgcgaactcgacgaaacgcaaaaaacctcgaaaaccgaacgcgccgaactccgaaccaaaacaaaaacgacaaaacccccgaaataaaatcaacccgccgcccgctaacgcctccaaactaataaaaaccaaa

SEQ ID NO: 19949 - DNA, 1871 bp, Artificial Sequence
  chemically treated genomic DNA (Homo sapiens) CpG-island No: 19949
ggtaggattatttttacgacggtaggattttttcgttattttagaaagaattacgtgtttatttaattttcgattttacgtcggggttcgcggacgtagtcgtttcgttcgtttacgtatttgcggtagtcgggttcggtagggacgagggttcggcggcgttttcgggaagagcgcggttcgggttttgggttttcgtttaggaggcgtcgttgtcgtagtgagtacgtcgggtcgggttttgagttcgcgtcggtcgcgtttttcgcgtttcgagttgtggcggtcgcgttttcgggcggaaggtttacgttcggtgacgtcgcgttgttttagaattttagcgattttgtagatttattggtgatttaacggtgcgtttcgtcgtcgtcgggcggaagtttcgtttttgtttcggagaggaagtttcgttttatcgagcgtcgattggtcgtatcgttttagagaggacgcgttcggggttatttcgtcgtttttttcgagggttttgcggaagtaggcggtatagtttgcgaggggttttcgtttttcggatttagtcgtatcgtttcggttcgggcgcgtttgtattttgtcgttcgttcgcgcgttgaaggggcggatataaataacgtggattttcgagtttttgattggcgagcgtgtaggaaaggggcggggttagtagagtcgtgatggatatgtaagcgatttaatggcgtcggcgacggggcgggcgaggataacggcgttgtgggtcgggggcggggcggtcggcggttttgggatttttttgggaggtagtcgtagggaagggaatgattttggtgaatttataatcgaattaatggtttcgggaaagtaggaggcgagtggttaatggcgacggcgatgaggtaggcgttcgttgttttcgtaacgtcgtgtgggaaaggcgggggaggggcggttatgatagacgtgtagataggttaatggttgagggaaggagggcggcgggcgatttttggtgattacgggaaggtagggcggggtggtgaagaggcggtgcgatcggaggtttggcggcgtcgtgtggaacgtcgtgagggcggggaagtcgtgacggacgggcgggtgggttaatgggttcgggagggcgggcgaagggtggttaatggcggcggcgcggtcgggggtggggcggcgcggcggttttggtggtgcgggaagcggcggggcggcggcgaggttgaggtgcgttcgggcgcgggcggggcggggtcggcgttgggtttcgggcgcgtttattcggtcgtcgtggggcggacgtaacgggcgtaggtgcggggcgcgggtttttttacgtcgcggttttattcggcggtgtttcggtaggcggtcggcgcggggcgtaggcggcgcggttatgggttcgtagggtagttcggtgaagagttacgattatttgtttaagtttttgttggtgggcgatagcgacgtgggtaagggcgagattttggagagtttgtaggacggcgcggtagagttttcgtacgtttatagtaacggtaaggttcggttcgcggcgcgcgttgttacgcggggttcgagttcggcgagttgggtacggagttcgttttcggttcggtttttttaagcgtcgtcgaacgtttttaggaacgtttttgtttggtttttagattcggtagttcggtggttgcggggtgttcgtgttttagtttcgaggtgacgtcggggggtaggaggacggattagagggacgcgtttagcggggacggtgttatggattcggggtttgggggacggtgttacgggttcgggattttaggggaaggtgttatgggttcgggatttggagtttaggggaa

SEQ ID NO: 19950 - DNA, 1871 bp, Artificial Sequence
  chemically treated genomic DNA (Homo sapiens) CpG-island No: 19950
ttcccctaaactccaaatcccgaacccataacaccttcccctaaaatcccgaacccgtaacaccgtcccccaaaccccgaatccataacaccgtccccgctaaacgcgtccctctaatccgtcctcctaccccccgacgtcacctcgaaactaaaacacgaacaccccgcaaccaccgaactaccgaatctaaaaaccaaacaaaaacgttcctaaaaacgttcgacgacgcttaaaaaaaccgaaccgaaaacgaactccgtacccaactcgccgaactcgaaccccgcgtaacaacgcgcgccgcgaaccgaaccttaccgttactataaacgtacgaaaactctaccgcgccgtcctacaaactctccaaaatctcgcccttacccacgtcgctatcgcccaccaacaaaaacttaaacaaataatcgtaactcttcaccgaactaccctacgaacccataaccgcgccgcctacgccccgcgccgaccgcctaccgaaacaccgccgaataaaaccgcgacgtaaaaaaacccgcgccccgcacctacgcccgttacgtccgccccacgacgaccgaataaacgcgcccgaaacccaacgccgaccccgccccgcccgcgcccgaacgcacctcaacctcgccgccgccccgccgcttcccgcaccaccaaaaccgccgcgccgccccacccccgaccgcgccgccgccattaaccacccttcgcccgccctcccgaacccattaacccacccgcccgtccgtcacgacttccccgccctcacgacgttccacacgacgccgccaaacctccgatcgcaccgcctcttcaccaccccgccctaccttcccgtaatcaccaaaaatcgcccgccgccctccttccctcaaccattaacctatctacacgtctatcataaccgcccctcccccgcctttcccacacgacgttacgaaaacaacgaacgcctacctcatcgccgtcgccattaaccactcgcctcctactttcccgaaaccattaattcgattataaattcaccaaaatcattcccttccctacgactacctcccaaaaaaatcccaaaaccgccgaccgccccgcccccgacccacaacgccgttatcctcgcccgccccgtcgccgacgccattaaatcgcttacatatccatcacgactctactaaccccgcccctttcctacacgctcgccaatcaaaaactcgaaaatccacgttatttatatccgccccttcaacgcgcgaacgaacgacaaaatacaaacgcgcccgaaccgaaacgatacgactaaatccgaaaaacgaaaacccctcgcaaactataccgcctacttccgcaaaaccctcgaaaaaaacgacgaaataaccccgaacgcgtcctctctaaaacgatacgaccaatcgacgctcgataaaacgaaacttcctctccgaaacaaaaacgaaacttccgcccgacgacgacgaaacgcaccgttaaatcaccaataaatctacaaaatcgctaaaattctaaaacaacgcgacgtcaccgaacgtaaaccttccgcccgaaaacgcgaccgccacaactcgaaacgcgaaaaacgcgaccgacgcgaactcaaaacccgacccgacgtactcactacgacaacgacgcctcctaaacgaaaacccaaaacccgaaccgcgctcttcccgaaaacgccgccgaaccctcgtccctaccgaacccgactaccgcaaatacgtaaacgaacgaaacgactacgtccgcgaaccccgacgtaaaatcgaaaattaaataaacacgtaattctttctaaaataacgaaaaaatcctaccgtcgtaaaaataatcctacc

SEQ ID NO: 19951 - DNA, 1871 bp, Artificial Sequence
  chemically treated genomic DNA (Homo sapiens) CpG-island No: 19951
tttttttgggttttagatttcggatttatgatatttttttttgagatttcggattcgtgatatcgttttttagatttcgggtttatggtatcgttttcgttgggcgcgtttttttggttcgtttttttgtttttcggcgttatttcgggattggagtacgggtatttcgtagttatcgagttatcgagtttggaagttaggtaaaggcgtttttgggaacgttcggcggcgtttggaagggtcgggtcgagggcgagtttcgtgtttagttcgtcgggttcgggtttcgcgtagtagcgcgcgtcgcgggtcgggttttatcgttattgtaggcgtacggggattttgtcgcgtcgttttgtaggttttttaggatttcgtttttgtttacgtcgttgtcgtttattagtaggaatttgagtaggtagtcgtagttttttatcggattgttttgcgagtttatggtcgcgtcgtttgcgtttcgcgtcggtcgtttgtcgaagtatcgtcgggtgaggtcgcggcgtgagagagttcgcgtttcgtatttgcgttcgttgcgttcgttttacggcggtcgagtgggcgcgttcgaagtttagcgtcggtttcgtttcgttcgcgttcgggcgtattttagtttcgtcgtcgtttcgtcgtttttcgtattattagggtcgtcgcgtcgttttattttcggtcgcgtcgtcgttattggttatttttcgttcgttttttcgagtttattggtttattcgttcgttcgttacgattttttcgtttttacggcgttttatacggcgtcgttagattttcggtcgtatcgtttttttattatttcgttttgttttttcgtagttattagaggtcgttcgtcgtttttttttttttagttattggtttgtttgtacgtttgttatgatcgtttttttttcgttttttttatacggcgttgcggagatagcggacgtttgttttatcgtcgtcgttattggttattcgttttttgttttttcggaattattggttcgattataagtttattaagattatttttttttttgcggttgttttttagagaaattttagagtcgtcggtcgtttcgttttcggtttataacgtcgttgttttcgttcgtttcgtcgtcggcgttattgggtcgtttgtatgtttattacggttttgttaatttcgttttttttttatacgttcgttaattaggggttcggaagtttacgttgtttgtattcgtttttttaacgcgcggacgggcggtaggatgtaggcgcgttcgagtcgaggcgatgcggttgagttcgggaaacgaaagtttttcgtaggttgtgtcgtttgttttcgtagaattttcggagggagcggcggggtggtttcgggcgcgttttttttaaggcggtgcggttaatcggcgttcgatgaggcggaatttttttttcggggtaggggcgggattttcgttcggcggcggcggggcgtatcgttgggttattagtgagtttgtaaagtcgttgaggttttgggatagcgcggcgttatcgagcgtgagtttttcgttcggggacgcggtcgttatagttcgggacgcggggagcgcggtcggcgcgagtttaagattcggttcgacgtgtttattgcggtagcggcgttttttggacggggatttagggttcggatcgcgtttttttcgggggcgtcgtcgagttttcgtttttgtcgggttcggttgtcgtaggtgcgtgggcgagcgaggcggttgcgttcgcgggtttcggcgtggggtcgggggttgagtgggtacgtggttttttttggggtgacgagaaggttttatcgtcgtggggatggttttgtt

SEQ ID NO: 19952 - DNA, 1871 bp, Artificial Sequence
  chemically treated genomic DNA (Homo sapiens) CpG-island No: 19952
aacaaaaccatccccacgacgataaaaccttctcgtcaccccaaaaaaaaccacgtacccactcaacccccgaccccacgccgaaacccgcgaacgcaaccgcctcgctcgcccacgcacctacgacaaccgaacccgacaaaaacgaaaactcgacgacgcccccgaaaaaaacgcgatccgaaccctaaatccccgtccaaaaaacgccgctaccgcaataaacacgtcgaaccgaatcttaaactcgcgccgaccgcgctccccgcgtcccgaactataacgaccgcgtccccgaacgaaaaactcacgctcgataacgccgcgctatcccaaaacctcaacgactttacaaactcactaataacccaacgatacgccccgccgccgccgaacgaaaatcccgcccctaccccgaaaaaaaaattccgcctcatcgaacgccgattaaccgcaccgccttaaaaaaaacgcgcccgaaaccaccccgccgctccctccgaaaattctacgaaaacaaacgacacaacctacgaaaaactttcgtttcccgaactcaaccgcatcgcctcgactcgaacgcgcctacatcctaccgcccgtccgcgcgttaaaaaaacgaatacaaacaacgtaaacttccgaacccctaattaacgaacgtataaaaaaaaaacgaaattaacaaaaccgtaataaacatacaaacgacccaataacgccgacgacgaaacgaacgaaaacaacgacgttataaaccgaaaacgaaacgaccgacgactctaaaatttctctaaaaaacaaccgcaaaaaaaaaaataatcttaataaacttataatcgaaccaataattccgaaaaaacaaaaaacgaataaccaataacgacgacgataaaacaaacgtccgctatctccgcaacgccgtataaaaaaaacgaaaaaaaaacgatcataacaaacgtacaaacaaaccaataactaaaaaaaaaaaaacgacgaacgacctctaataactacgaaaaaacaaaacgaaataataaaaaaacgatacgaccgaaaatctaacgacgccgtataaaacgccgtaaaaacgaaaaaatcgtaacgaacgaacgaataaaccaataaactcgaaaaaacgaacgaaaaataaccaataacgacgacgcgaccgaaaataaaacgacgcgacgaccctaataatacgaaaaacgacgaaacgacgacgaaactaaaatacgcccgaacgcgaacgaaacgaaaccgacgctaaacttcgaacgcgcccactcgaccgccgtaaaacgaacgcaacgaacgcaaatacgaaacgcgaactctctcacgccgcgacctcacccgacgatacttcgacaaacgaccgacgcgaaacgcaaacgacgcgaccataaactcgcaaaacaatccgataaaaaactacgactacctactcaaattcctactaataaacgacaacgacgtaaacaaaaacgaaatcctaaaaaacctacaaaacgacgcgacaaaatccccgtacgcctacaataacgataaaacccgacccgcgacgcgcgctactacgcgaaacccgaacccgacgaactaaacacgaaactcgccctcgacccgacccttccaaacgccgccgaacgttcccaaaaacgcctttacctaacttccaaactcgataactcgataactacgaaatacccgtactccaatcccgaaataacgccgaaaaacaaaaaaacgaaccaaaaaaacgcgcccaacgaaaacgataccataaacccgaaatctaaaaaacgatatcacgaatccgaaatctcaaaaaaaaatatcataaatccgaaatctaaaacccaaaaaaa

SEQ ID NO: 19953 - DNA, 581 bp, Artificial Sequence
  chemically treated genomic DNA (Homo sapiens) CpG-island No: 19953
tcgcgggggtcgagattaatgtttttattttttttttttttttaatatcgcgggggtcgagattaatgtttttattttttttttttttttaatatcgcgggggtcgagattaatgtttttatttttttttattttttaatatcgcgggggtcgagattaatgtttttattttttttttttttttaatatcgcgggggtcgagattaatgtttttattttttttttttttttaatatcgcgggggtcgagattaatgtttttattttttttttttttttaatatcgcgggggtcgagattaatgtttttatttttttttattttttaatatcgtaggggtcgagattaatgtttttattttttttttttttttaatatcgcgggggtcgagattaatgtttttattttttttttttttttaatatcgcgggggtcgagattaatgtttttattttttttttttttttaatatcgcgggggtcgagattaatgtttttattttttttttttttttaatatcgcgggggtcgagattaatgtttttagtttttagagtttttcgtcgtttagttattttttgat

SEQ ID NO: 19954 - DNA, 581 bp, Artificial Sequence
  chemically treated genomic DNA (Homo sapiens) CpG-island No: 19954
atcaaaaaataactaaacgacgaaaaactctaaaaactaaaaacattaatctcgacccccgcgatattaaaaaaaaaaaaaaaataaaaacattaatctcgacccccgcgatattaaaaaaaaaaaaaaaataaaaacattaatctcgacccccgcgatattaaaaaaaaaaaaaaaataaaaacattaatctcgacccccgcgatattaaaaaaaaaaaaaaaataaaaacattaatctcgacccctacgatattaaaaaataaaaaaaaataaaaacattaatctcgacccccgcgatattaaaaaaaaaaaaaaaataaaaacattaatctcgacccccgcgatattaaaaaaaaaaaaaaaataaaaacattaatctcgacccccgcgatattaaaaaaaaaaaaaaaataaaaacattaatctcgacccccgcgatattaaaaaataaaaaaaaataaaaacattaatctcgacccccgcgatattaaaaaaaaaaaaaaaataaaaacattaatctcgacccccgcgatattaaaaaaaaaaaaaaaataaaaacattaatctcgacccccgcga

SEQ ID NO: 19955 - DNA, 581 bp, Artificial Sequence
  chemically treated genomic DNA (Homo sapiens) CpG-island No: 19955
gttaggaagtggttgagcggcgggaagttttgggggttggaggtattggtttcggttttcgcgatgttggggaaaggaagagagtggaggtattggtttcggttttcgcgatgttggggaaaggaagagagtggaggtattggtttcggttttcgcgatgttggggaaaggaagagagtggaggtattggtttcggttttcgcgatgttggggaaaggaagagagtggaggtattggtttcggtttttgcgatgttggggaatggaagagagtggaggtattggtttcggttttcgcgatgttggggaaaggaagagagtggaggtattggtttcggttttcgcgatgttggggaaaggaagagagtggaggtattggtttcggttttcgcgatgttggggaaaggaagagagtggaggtattggtttcggttttcgcgatgttggggaatggaagagagtggaggtattggtttcggttttcgcgatgttggggaaaggaagagagtggaggtattggtttcggttttcgcgatgttggggaaaggaagagagtggaggtattggtttcggttttcgcga

SEQ ID NO: 19956 - DNA, 581 bp, Artificial Sequence
  chemically treated genomic DNA (Homo sapiens) CpG-island No: 19956
tcgcgaaaaccgaaaccaatacctccactctcttcctttccccaacatcgcgaaaaccgaaaccaatacctccactctcttcctttccccaacatcgcgaaaaccgaaaccaatacctccactctcttccattccccaacatcgcgaaaaccgaaaccaatacctccactctcttcctttccccaacatcgcgaaaaccgaaaccaatacctccactctcttcctttccccaacatcgcgaaaaccgaaaccaatacctccactctcttcctttccccaacatcgcgaaaaccgaaaccaatacctccactctcttccattccccaacatcgcaaaaaccgaaaccaatacctccactctcttcctttccccaacatcgcgaaaaccgaaaccaatacctccactctcttcctttccccaacatcgcgaaaaccgaaaccaatacctccactctcttcctttccccaacatcgcgaaaaccgaaaccaatacctccactctcttcctttccccaacatcgcgaaaaccgaaaccaatacctccaacccccaaaacttcccgccgctcaaccacttcctaac

SEQ ID NO: 19957 - DNA, 1549 bp, Artificial Sequence
  chemically treated genomic DNA (Homo sapiens) CpG-island No: 19957
ttgcgggttataggcggggaaggttgtttataagacggtcgtttttatttttttatcgttcgtttagggagaagtcggttacgcgtcgggtttttcggttaaggttataggggtcgcggtcgttgagttgtgcgaagttgtgtgtagtatatagtattcgggacggcgttgggtcggttaaataaaaatattcgtcgattttattaattatataattatttggcgatagatttttaaaaatagatacgggcggtcgcgttttttggggagacggggtcgtatttcgcggggtagggggtttcgttgttacggatttttagaattttcgcgttcgtttataagagtcgcgtttttcgtgaattgcgttttaatcgtgttattcgttttaaaaggttcggggaagtttcgcgttcgtcgcgaggcgtttttttgtaaacgttcggggaggtcgcggtgtcggtttttaagttcggtcgtcgtaggtcgcgcggtttttgggcgatttcggggcgcgtttttgtttatagggagttttcgttttggtagagttcggcgggtttgtttgttatataaggggcggttcggtcggttcggcggttgttcgaggttcgattcgattcgagcgcggatttcgggtaggcgttcgcggtttaggtcgtcgagatttatagttcgattcggtttttttcgatttttcggtttgatttattcggttttttcgttcggttttttcgttttttcgttcgttttttcggtcgttcggttcgattttttcggttttttcgttcggttttttcggtatttcgggttttcggttcgtagataatgcggagtcgtcgtcgtcgtcgtcgtcgttaaatatggcgtcggtattataatttcgagaggtcgggtcgaggcggcggcggcggtcgggcggttcgcgaggcggcggggaggttttttcggttaggttttcgtttatttattttcggggcgtcgcggtcgcgggagttcggtaagcgggcgggcgcgggggtcggcgcggtcgaggcggtgttaatggcgttcgcggttttttcgttaacggtcgcgtaggtcgggtttcgtcgtcgtttttgggcgcgggtttttttcggtcgcggcggtttcgggttcggtagcggcggtcgcggattttcgggtagcggttcgcgcggcgcgggttcgggttcggggtttagttggaggttcggttcggggggttcggtcggcgggcgcgggcgcgggcgcgggagcgggcggcgggcggcgggcgcgggacgcggggttggttcggattttagggtcgggtcgttcgttcgttttttagcgaagtaaataatgcggcgagcgtttcgttcggcgcgttgcgtgcgagacgcgtttcgttcgtcgtcgttatgacgcgcggatttcgttgtttcggtcgcgcgcgggggagggggcgtcgcgaggagcgggggttaaagggggttttgaggcggcggggatcgggttgggagtggggggtcgggaggatggagagtgggggtttttgagttagggagga

SEQ ID NO: 19958 - DNA, 1549 bp, Artificial Sequence
  chemically treated genomic DNA (Homo sapiens) CpG-island No: 19958
tcctccctaactcaaaaacccccactctccatcctcccgaccccccactcccaacccgatccccgccgcctcaaaaccccctttaacccccgctcctcgcgacgccccctcccccgcgcgcgaccgaaacaacgaaatccgcgcgtcataacgacgacgaacgaaacgcgtctcgcacgcaacgcgccgaacgaaacgctcgccgcattatttacttcgctaaaaaacgaacgaacgacccgaccctaaaatccgaaccaaccccgcgtcccgcgcccgccgcccgccgcccgctcccgcgcccgcgcccgcgcccgccgaccgaaccccccgaaccgaacctccaactaaaccccgaacccgaacccgcgccgcgcgaaccgctacccgaaaatccgcgaccgccgctaccgaacccgaaaccgccgcgaccgaaaaaaacccgcgcccaaaaacgacgacgaaacccgacctacgcgaccgttaacgaaaaaaccgcgaacgccattaacaccgcctcgaccgcgccgacccccgcgcccgcccgcttaccgaactcccgcgaccgcgacgccccgaaaataaataaacgaaaacctaaccgaaaaaacctccccgccgcctcgcgaaccgcccgaccgccgccgccgcctcgacccgacctctcgaaattataataccgacgccatatttaacgacgacgacgacgacgacgactccgcattatctacgaaccgaaaacccgaaataccgaaaaaaccgaacgaaaaaaccgaaaaaatcgaaccgaacgaccgaaaaaacgaacgaaaaaacgaaaaaaccgaacgaaaaaaccgaataaatcaaaccgaaaaatcgaaaaaaaccgaatcgaactataaatctcgacgacctaaaccgcgaacgcctacccgaaatccgcgctcgaatcgaatcgaacctcgaacaaccgccgaaccgaccgaaccgccccttatataacaaacaaacccgccgaactctaccaaaacgaaaactccctataaacaaaaacgcgccccgaaatcgcccaaaaaccgcgcgacctacgacgaccgaacttaaaaaccgacaccgcgacctccccgaacgtttacaaaaaaacgcctcgcgacgaacgcgaaacttccccgaaccttttaaaacgaataacacgattaaaacgcaattcacgaaaaacgcgactcttataaacgaacgcgaaaattctaaaaatccgtaacaacgaaaccccctaccccgcgaaatacgaccccgtctccccaaaaaacgcgaccgcccgtatctatttttaaaaatctatcgccaaataattatataattaataaaatcgacgaatatttttatttaaccgacccaacgccgtcccgaatactatatactacacacaacttcgcacaactcaacgaccgcgacccctataaccttaaccgaaaaacccgacgcgtaaccgacttctccctaaacgaacgataaaaaaataaaaacgaccgtcttataaacaaccttccccgcctataacccgcaa

SEQ ID NO: 19959 - DNA, 1549 bp, Artificial Sequence
  chemically treated genomic DNA (Homo sapiens) CpG-island No: 19959
ttttttttaatttaagggtttttattttttattttttcgattttttatttttagttcggttttcgtcgttttagggttttttttggttttcgtttttcgcggcgttttttttttcgcgcgcggtcgaggtagcggagttcgcgcgttatggcggcggcgggcggggcgcgtttcgtacgtagcgcgtcgggcggagcgttcgtcgtattgtttgtttcgttggggagcgagcgagcgattcggttttggagttcgagttagtttcgcgtttcgcgttcgtcgttcgtcgttcgttttcgcgttcgcgttcgcgttcgtcggtcgggtttttcgagtcgggtttttagttgggtttcgagttcgagttcgcgtcgcgcgagtcgttgttcgagagttcgcggtcgtcgttgtcgggttcggagtcgtcgcggtcgagaggggttcgcgtttaggagcggcggcggggttcggtttgcgcggtcgttggcggaggagtcgcgggcgttattagtatcgtttcggtcgcgtcggttttcgcgttcgttcgtttgtcgggttttcgcggtcgcggcgtttcgaaggtgagtgggcgggggtttggtcggggaggttttttcgtcgtttcgcgggtcgttcggtcgtcgtcgtcgtttcggttcggtttttcggggttgtggtgtcgacgttatgtttggcggcggcggcggcggcggcggtttcgtattgtttgcgggtcgggagttcgggatgtcggggaggtcgggcggggagatcggggaggtcgggtcgggcggtcggggagacgggcgggaagacggggaggtcgggcggggagatcgggtaggttaggtcggggagtcgagggaggtcgagtcgggttgtgggtttcggcggtttgggtcgcgggcgtttgttcggagttcgcgttcgagtcgggtcgggtttcgggtagtcgtcgagtcggtcgggtcgttttttatgtaatagataggttcgtcgagttttgttaagacgggaattttttgtgagtagggacgcgtttcgagatcgtttaggagtcgcgcggtttgcggcggtcgggtttgggaatcggtatcgcggttttttcgggcgtttgtagggagacgtttcgcgacgaacgcgaggttttttcgggttttttaaaacgagtgatacgattgaggcgtagtttacgggaaacgcggtttttgtgagcggacgcgggagttttgagaattcgtagtagcgggattttttgtttcgcggggtgcggtttcgtttttttagaaagcgcggtcgttcgtgtttgtttttgagggtttgtcgttaggtggttgtgtagttagtggaatcggcggatgtttttgtttggtcggtttagcgtcgtttcgagtgttgtgtgttgtatataatttcgtatagtttagcggtcgcggtttttgtggttttgatcgagaggttcggcgcgtggtcggtttttttttgggcgggcggtgggaagatggaagcggtcgttttgtgggtagtttttttcgtttgtggttcgtag

SEQ ID NO: 19960 - DNA, 1549 bp, Artificial Sequence
  chemically treated genomic DNA (Homo sapiens) CpG-island No: 19960
ctacgaaccacaaacgaaaaaaactacccacaaaacgaccgcttccatcttcccaccgcccgcccaaaaaaaaaccgaccacgcgccgaacctctcgatcaaaaccacaaaaaccgcgaccgctaaactatacgaaattatatacaacacacaacactcgaaacgacgctaaaccgaccaaacaaaaacatccgccgattccactaactacacaaccacctaacgacaaaccctcaaaaacaaacacgaacgaccgcgctttctaaaaaaacgaaaccgcaccccgcgaaacaaaaaatcccgctactacgaattctcaaaactcccgcgtccgctcacaaaaaccgcgtttcccgtaaactacgcctcaatcgtatcactcgttttaaaaaacccgaaaaaacctcgcgttcgtcgcgaaacgtctccctacaaacgcccgaaaaaaccgcgataccgattcccaaacccgaccgccgcaaaccgcgcgactcctaaacgatctcgaaacgcgtccctactcacaaaaaattcccgtcttaacaaaactcgacgaacctatctattacataaaaaacgacccgaccgactcgacgactacccgaaacccgacccgactcgaacgcgaactccgaacaaacgcccgcgacccaaaccgccgaaacccacaacccgactcgacctccctcgactccccgacctaacctacccgatctccccgcccgacctccccgtcttcccgcccgtctccccgaccgcccgacccgacctccccgatctccccgcccgacctccccgacatcccgaactcccgacccgcaaacaatacgaaaccgccgccgccgccgccgccgccaaacataacgtcgacaccacaaccccgaaaaaccgaaccgaaacgacgacgacgaccgaacgacccgcgaaacgacgaaaaaacctccccgaccaaacccccgcccactcaccttcgaaacgccgcgaccgcgaaaacccgacaaacgaacgaacgcgaaaaccgacgcgaccgaaacgatactaataacgcccgcgactcctccgccaacgaccgcgcaaaccgaaccccgccgccgctcctaaacgcgaacccctctcgaccgcgacgactccgaacccgacaacgacgaccgcgaactctcgaacaacgactcgcgcgacgcgaactcgaactcgaaacccaactaaaaacccgactcgaaaaacccgaccgacgaacgcgaacgcgaacgcgaaaacgaacgacgaacgacgaacgcgaaacgcgaaactaactcgaactccaaaaccgaatcgctcgctcgctccccaacgaaacaaacaatacgacgaacgctccgcccgacgcgctacgtacgaaacgcgccccgcccgccgccgccataacgcgcgaactccgctacctcgaccgcgcgcgaaaaaaaaaacgccgcgaaaaacgaaaaccaaaaaaaaccctaaaacgacgaaaaccgaactaaaaataaaaaatcgaaaaaataaaaaataaaaacccttaaattaaaaaaaa

SEQ ID NO: 19961 - DNA, 714 bp, Artificial Sequence
  chemically treated genomic DNA (Homo sapiens) CpG-island No: 19961
cgggggcggttgcgggtttcggcgaggcggtcggtcgtggggttggcggtttacggggcgtagagtagcgttcgggcgggatgcgtcggaggggttttaggtcgggttagggggcgggcgggtgggggtttgcgtcgttcgttaagggtcgggttttggagtggttttaaggcgcgagtcggtttggcggggaataaggggcggttacggtcggcgttagaggacgttcggattgaggggcgcggattcgtagtttagaggtagggggtgtggggcggcgttattttagtggaggggcgtcgtacgttcgggaatcgaatcgcggtagttaagcgaagttttcggcgttgattcgggtttcgtttcggcgattattgtttttcgtggcggaggtcgttttatcgtttattttttcgttttatggtgagatcggtaatcgttaggcgtttgcgtattcgagtggcggcgattttcgttttcgtcgcggtttaaaatcgagttcgtttatatttcgtttttagtttcgttttattttcgttttacgatgtcgcgcgtttgcgcgttgggcgcggagtttattatttgttttcgaggagggggcggtaaggagagggagggggcgtagcggggaggaacgtcggggtgaacgttgaaggagtgttagagatttaagtttggaaatttggtaaggttagttttgttttatttgtttag

SEQ ID NO: 19962 - DNA, 714 bp, Artificial Sequence
  chemically treated genomic DNA (Homo sapiens) CpG-island No: 19962
ctaaacaaataaaacaaaactaaccttaccaaatttccaaacttaaatctctaacactccttcaacgttcaccccgacgttcctccccgctacgccccctccctctccttaccgccccctcctcgaaaacaaataataaactccgcgcccaacgcgcaaacgcgcgacatcgtaaaacgaaaataaaacgaaactaaaaacgaaatataaacgaactcgattttaaaccgcgacgaaaacgaaaatcgccgccactcgaatacgcaaacgcctaacgattaccgatctcaccataaaacgaaaaaataaacgataaaacgacctccgccacgaaaaacaataatcgccgaaacgaaacccgaatcaacgccgaaaacttcgcttaactaccgcgattcgattcccgaacgtacgacgcccctccactaaaataacgccgccccacaccccctacctctaaactacgaatccgcgcccctcaatccgaacgtcctctaacgccgaccgtaaccgccccttattccccgccaaaccgactcgcgccttaaaaccactccaaaacccgacccttaacgaacgacgcaaacccccacccgcccgccccctaacccgacctaaaacccctccgacgcatcccgcccgaacgctactctacgccccgtaaaccgccaaccccacgaccgaccgcctcgccgaaacccgcaaccgcccccg

SEQ ID NO: 19963 - DNA, 714 bp, Artificial Sequence
  chemically treated genomic DNA (Homo sapiens) CpG-island No: 19963
ttaaataaatagaataaaattaattttgttaggtttttaagtttggatttttaatatttttttaacgtttatttcggcgttttttttcgttgcgttttttttttttttttgtcgtttttttttcgggagtaggtggtaggtttcgcgtttaacgcgtaagcgcgcggtatcgtggggcgggggtggggcgggattgagggcggagtgtgagcgggttcggttttgggtcgcggcgggagcgggagtcgtcgttattcgagtgcgtaggcgtttggcgattatcggttttattatggagcggaaaggtgagcggtggagcggttttcgttacgaggggtaatggtcgtcggggcgaggttcgggttagcgtcgggagtttcgtttaattgtcgcggttcggttttcggacgtgcggcgtttttttattgaggtggcgtcgttttatattttttgtttttgggttgcgggttcgcgttttttagttcgggcgttttttggcgtcggtcgtagtcgttttttgtttttcgttaggtcggttcgcgttttggggttattttagggttcggtttttggcgggcgacgtagatttttattcgttcgttttttgattcggtttgagattttttcggcgtatttcgttcgggcgttgttttgcgtttcgtgggtcgttagttttacggtcggtcgtttcgtcggagttcgtagtcgttttcg

SEQ ID NO: 19964 - DNA, 714 bp, Artificial Sequence
  chemically treated genomic DNA (Homo sapiens) CpG-island No: 19964
cgaaaacgactacgaactccgacgaaacgaccgaccgtaaaactaacgacccacgaaacgcaaaacaacgcccgaacgaaatacgccgaaaaaatctcaaaccgaatcaaaaaacgaacgaataaaaatctacgtcgcccgccaaaaaccgaaccctaaaataaccccaaaacgcgaaccgacctaacgaaaaacaaaaaacgactacgaccgacgccaaaaaacgcccgaactaaaaaacgcgaacccgcaacccaaaaacaaaaaatataaaacgacgccacctcaataaaaaaacgccgcacgtccgaaaaccgaaccgcgacaattaaacgaaactcccgacgctaacccgaacctcgccccgacgaccattacccctcgtaacgaaaaccgctccaccgctcacctttccgctccataataaaaccgataatcgccaaacgcctacgcactcgaataacgacgactcccgctcccgccgcgacccaaaaccgaacccgctcacactccgccctcaatcccgccccacccccgccccacgataccgcgcgcttacgcgttaaacgcgaaacctaccacctactcccgaaaaaaaaacgacaaaaaaaaaaaaaaaacgcaacgaaaaaaaacgccgaaataaacgttaaaaaaatattaaaaatccaaacttaaaaacctaacaaaattaattttattctatttatttaa

SEQ ID NO: 19965 - DNA, 645 bp, Artificial Sequence
  chemically treated genomic DNA (Homo sapiens) CpG-island No: 19965
ggatcgcgtttttttttcggttttggttttagtcgagtttttcggacgtagagatggaaatttcgaagttgttttcggttcgcgggatattatagggcggcggcggcggcggtattttcgcgggtggcggtcgagtttatcgaggttttgattcgtcggttggttaggtttttacgcgtcgttttttgttgtttcggggtttttaagatggcgggttcgggcggcggcgcgaggaggttagtacggtattacggggttttggtttaagtttgttggcgtcgaggatcgattaatttagcggcggcggcggcggcggcggcgacgatttttttttggtgttgtttgattcggtgggtggcgacgtggagatcgcgggtttcggttaggtcgtagggtttgtgttgagggaggaggtcgaggagggttcggggttttaggggggcgagagcggcgcgaatttcgcggggtttattgcgttaggttttcgttgtttgttcgcggtttttatttcggtttcgattttcgttttcggtttcgtcgcggttttcgcgggtatagttattatttataattaggatttgttgttgcgttttgagaacggcgtttttattttggttacgtttttattatacgtttgggagttag

SEQ ID NO: 19966 - DNA, 645 bp, Artificial Sequence
  chemically treated genomic DNA (Homo sapiens) CpG-island No: 19966
ctaactcccaaacgtataataaaaacgtaaccaaaataaaaacgccgttctcaaaacgcaacaacaaatcctaattataaataataactatacccgcgaaaaccgcgacgaaaccgaaaacgaaaatcgaaaccgaaataaaaaccgcgaacaaacaacgaaaacctaacgcaataaaccccgcgaaattcgcgccgctctcgcccccctaaaaccccgaaccctcctcgacctcctccctcaacacaaaccctacgacctaaccgaaacccgcgatctccacgtcgccacccaccgaatcaaacaacaccaaaaaaaaatcgtcgccgccgccgccgccgccgccgctaaattaatcgatcctcgacgccaacaaacttaaaccaaaaccccgtaataccgtactaacctcctcgcgccgccgcccgaacccgccatcttaaaaaccccgaaacaacaaaaaacgacgcgtaaaaacctaaccaaccgacgaatcaaaacctcgataaactcgaccgccacccgcgaaaataccgccgccgccgccgccctataatatcccgcgaaccgaaaacaacttcgaaatttccatctctacgtccgaaaaactcgactaaaaccaaaaccgaaaaaaaaacgcgatcc

SEQ ID NO: 19967 - DNA, 645 bp, Artificial Sequence
  chemically treated genomic DNA (Homo sapiens) CpG-island No: 19967
ttggtttttaggcgtgtggtgggggcgtggttagggtgaggacgtcgtttttaaagcgtaatagtaggttttggttgtggatagtgattgtgttcgcgaaggtcgcggcggggtcgggggcggagatcggggtcggagtgggaatcgcggataggtagcgggggtttagcgtagtgggtttcgcgggattcgcgtcgttttcgtttttttggagtttcgggtttttttcggtttttttttttaatataggttttgcggtttgatcggagttcgcggtttttacgtcgttatttatcgggttaagtagtattaggaagaagtcgtcgtcgtcgtcgtcgtcgtcgtcgttaggttgatcggttttcggcgttaataggtttgggttagggtttcgtgatgtcgtgttggttttttcgcgtcgtcgttcgggttcgttattttgggggtttcggagtagtaggaggcggcgcgtggggatttggttagtcggcgagttagggtttcggtggattcggtcgttattcgcggggatatcgtcgtcgtcgtcgttttgtagtgtttcgcgagtcgggagtagtttcgggatttttatttttgcgttcgagaggttcggttggaattagagtcgaggaggaggcgcgattt

SEQ ID NO: 19968 - DNA, 645 bp, Artificial Sequence
  chemically treated genomic DNA (Homo sapiens) CpG-island No: 19968
aaatcgcgcctcctcctcgactctaattccaaccgaacctctcgaacgcaaaaataaaaatcccgaaactactcccgactcgcgaaacactacaaaacgacgacgacgacgatatccccgcgaataacgaccgaatccaccgaaaccctaactcgccgactaaccaaatccccacgcgccgcctcctactactccgaaacccccaaaataacgaacccgaacgacgacgcgaaaaaaccaacacgacatcacgaaaccctaacccaaacctattaacgccgaaaaccgatcaacctaacgacgacgacgacgacgacgacgacgacttcttcctaatactacttaacccgataaataacgacgtaaaaaccgcgaactccgatcaaaccgcaaaacctatattaaaaaaaaaaaccgaaaaaaacccgaaactccaaaaaaacgaaaacgacgcgaatcccgcgaaacccactacgctaaacccccgctacctatccgcgattcccactccgaccccgatctccgcccccgaccccgccgcgaccttcgcgaacacaatcactatccacaaccaaaacctactattacgctttaaaaacgacgtcctcaccctaaccacgcccccaccacacgcctaaaaaccaa

SEQ ID NO: 19969 - DNA, 525 bp, Artificial Sequence
  chemically treated genomic DNA (Homo sapiens) CpG-island No: 19969
agggggttcgcggcggcgggcgggtatttggttgatcgcggcgtgtttttttagtgttaggttttagaagtagtagtcgatttggttttcgtattggtcgattgcgatcggaggagaggaaggaaagagaataggatattaagtaggaaatatggtcgttggatttcgcggcgattaggtttttattcgttcggcgtagtttattttgtacgattatcgattgggttatggtggtgcgtcgtcggtttcgggagtttgttagttcgcggtcgtttttgtatttttttagtaacggcgttttgttagagagttgtcgtaagttacgttattgtcgtaagtttttgtcgtcgttaagtacgtttgtaggtttaggttaaggtttttcgttagaaggtcgcgtaagtgtatttgcgtgttatcgttatcgtagcgattgggtttttggattgtatattttagttgttttgttaatattttcgagtatcggtagtttcggaggtcggggtaattggtaggtaattaggt

SEQ ID NO: 19970 - DNA, 525 bp, Artificial Sequence
  chemically treated genomic DNA (Homo sapiens) CpG-island No: 19970
acctaattacctaccaattaccccgacctccgaaactaccgatactcgaaaatattaacaaaacaactaaaatatacaatccaaaaacccaatcgctacgataacgataacacgcaaatacacttacgcgaccttctaacgaaaaaccttaacctaaacctacaaacgtacttaacgacgacaaaaacttacgacaataacgtaacttacgacaactctctaacaaaacgccgttactaaaaaaatacaaaaacgaccgcgaactaacaaactcccgaaaccgacgacgcaccaccataacccaatcgataatcgtacaaaataaactacgccgaacgaataaaaacctaatcgccgcgaaatccaacgaccatatttcctacttaatatcctattctctttccttcctctcctccgatcgcaatcgaccaatacgaaaaccaaatcgactactacttctaaaacctaacactaaaaaaacacgccgcgatcaaccaaatacccgcccgccgccgcgaaccccct

SEQ ID NO: 19971 - DNA, 525 bp, Artificial Sequence
  chemically treated genomic DNA (Homo sapiens) CpG-island No: 19971
gtttagttatttgttagttatttcggttttcggagttgtcgatgttcgaagatgttgataaggtagttaggatatatagtttagaagtttagtcgttacggtaacggtgatacgtaagtgtatttgcgcggttttttgacggaaaattttagtttgaatttatagacgtgtttagcgacggtagaggtttgcggtagtagcgtgatttacggtagttttttagtagagcgtcgttgttgggggaatgtagaagcggtcgcgggttagtaagttttcggagtcggcggcgtattattatgatttagtcggtggtcgtatagggtaagttacgtcgggcgggtagagatttggtcgtcgcggaatttagcggttatgttttttgtttaatgttttatttttttttttttttttttttcggtcgtagtcggttagtgcggaaattagatcggttgttgtttttgggatttggtattaagggagtacgtcgcggttaattaggtattcgttcgtcgtcgcgagtttttt

SEQ ID NO: 19972 - DNA, 525 bp, Artificial Sequence
  chemically treated genomic DNA (Homo sapiens) CpG-island No: 19972
aaaaaactcgcgacgacgaacgaatacctaattaaccgcgacgtactcccttaataccaaatcccaaaaacaacaaccgatctaatttccgcactaaccgactacgaccgaaaaaaaaaaaaaaaaaaaaataaaacattaaacaaaaaacataaccgctaaattccgcgacgaccaaatctctacccgcccgacgtaacttaccctatacgaccaccgactaaatcataataatacgccgccgactccgaaaacttactaacccgcgaccgcttctacattcccccaacaacgacgctctactaaaaaactaccgtaaatcacgctactaccgcaaacctctaccgtcgctaaacacgtctataaattcaaactaaaattttccgtcaaaaaaccgcgcaaatacacttacgtatcaccgttaccgtaacgactaaacttctaaactatatatcctaactaccttatcaacatcttcgaacatcgacaactccgaaaaccgaaataactaacaaataactaaac

SEQ ID NO: 19973 - DNA, 1162 bp, Artificial Sequence
  chemically treated genomic DNA (Homo sapiens) CpG-island No: 19973
ttcgttttatacggtgatttcggttttgttattggtttttaggtatcgggattcgcggttcgcgttgtcgtaaaggtcggggagttgcgggttgaaggttttaggtatttttatattgaattggcgtcgggtcgcgtgttcgggtcgtcggggtatttggaaggttcgagtcgtcgggtggttgagcggggcgggtcgggtcgggcgattggaggtttaggcggtataggggttcggcgcggtagggggcgcgtagatcggcggggtttaggggtaggcgtttagcggcgtaggtaagttcggggatggtcgcggagttcgcgtcgggggttgtcgcggggacggttcgagggcggggaaacgttgatagaagtttcgcggggcggtttttgcggggatagggtagggaagagtgacgtcgcgtcgagtatttaagtttaggattggataaggggtttcggtcggggattgggacggggatcgggtcggggcgggtcgggggcggggttcgttggggcgagggagtcgattggtcgagcggcgggcgcgcggaattgggaatttggcgtttggagttgcggtttcgcgtttcgtagttcgggagttcgtgcgtttaggtgttttgacgttgttcgtattcgttatttatttgcggttttgagcgcggcggttttgaacgtggcgtatttggcgtagtttggttgtagcgttaggttgtcgtcgttttgtagtcgcgggtcgcgcgggggtttcggggcggtcgattttcggggcgcgttgttgaggcgttttttgtttggagcgaggagtgagacgcggttcggttcgatgtttcggtttatttcgttttcgttgttattttttcgtagtttttttttcgaggtcgttcggtgagaatttgggggatcgtttttcgggcgaggttgcgagttaagtttgttttcgtcgtagtttttagcgtttggaatagggtttggtttcgagttacgcgtagcggcggcggtagttagttcggggggtgttatttttatgaacggttcgttcggaggcgacgttcgagttaggcgcggagttttgggatttgttttcgtcgagacgggggatgtttgaggaatagaatttagacggggcgtgggggttgttaagtttgtttgtttttcga

SEQ ID NO: 19974 - DNA, 1162 bp, Artificial Sequence
  chemically treated genomic DNA (Homo sapiens) CpG-island No: 19974
tcgaaaaacaaacaaacttaacaacccccacgccccgtctaaattctattcctcaaacatcccccgtctcgacgaaaacaaatcccaaaactccgcgcctaactcgaacgtcgcctccgaacgaaccgttcataaaaataacaccccccgaactaactaccgccgccgctacgcgtaactcgaaaccaaaccctattccaaacgctaaaaactacgacgaaaacaaacttaactcgcaacctcgcccgaaaaacgatcccccaaattctcaccgaacgacctcgaaaaaaaaactacgaaaaaataacaacgaaaacgaaataaaccgaaacatcgaaccgaaccgcgtctcactcctcgctccaaacaaaaaacgcctcaacaacgcgccccgaaaatcgaccgccccgaaacccccgcgcgacccgcgactacaaaacgacgacaacctaacgctacaaccaaactacgccaaatacgccacgttcaaaaccgccgcgctcaaaaccgcaaataaataacgaatacgaacaacgtcaaaacacctaaacgcacgaactcccgaactacgaaacgcgaaaccgcaactccaaacgccaaattcccaattccgcgcgcccgccgctcgaccaatcgactccctcgccccaacgaaccccgcccccgacccgccccgacccgatccccgtcccaatccccgaccgaaaccccttatccaatcctaaacttaaatactcgacgcgacgtcactcttccctaccctatccccgcaaaaaccgccccgcgaaacttctatcaacgtttccccgccctcgaaccgtccccgcgacaacccccgacgcgaactccgcgaccatccccgaacttacctacgccgctaaacgcctacccctaaaccccgccgatctacgcgccccctaccgcgccgaacccctataccgcctaaacctccaatcgcccgacccgacccgccccgctcaaccacccgacgactcgaaccttccaaataccccgacgacccgaacacgcgacccgacgccaattcaatataaaaatacctaaaaccttcaacccgcaactccccgacctttacgacaacgcgaaccgcgaatcccgatacctaaaaaccaataacaaaaccgaaatcaccgtataaaacgaa

SEQ ID NO: 19975 - DNA, 1162 bp, Artificial Sequence
  chemically treated genomic DNA (Homo sapiens) CpG-island No: 19975
tcgagaggtaggtaggtttggtagtttttacgtttcgtttgggttttgttttttagatatttttcgtttcggcgggagtaggttttaggatttcgcgtttggttcgagcgtcgttttcgggcgagtcgtttatgagggtggtatttttcgggttggttgtcgtcgtcgttgcgcgtgattcggagttaggttttgttttaggcgttggaggttgcggcgaagataggtttggttcgtagtttcgttcggagaacggttttttaggtttttatcgaacggtttcggggagaggattacggagaggtgatagcgagggcggagtgaatcggggtatcggatcgagtcgcgttttatttttcgttttagataagaagcgttttaataacgcgtttcgggggtcggtcgtttcggggttttcgcgcggttcgcggttgtagggcggcggtagtttgacgttgtagttagattacgttaagtacgttacgtttaaggtcgtcgcgtttaaggtcgtaggtgagtggcgggtgcgggtagcgttagggtatttgggcgtacgagttttcggattgcgaagcgcggggtcgtagttttaagcgttaaatttttagtttcgcgcgttcgtcgttcggttaatcggttttttcgttttagcgggtttcgttttcggttcgtttcggttcggttttcgttttagttttcggtcgggattttttgtttagttttgagtttgggtgttcggcgcggcgttatttttttttgttttgttttcgtagaggtcgtttcgcgggatttttgttagcgttttttcgttttcgagtcgttttcgcggtaattttcggcgcgggtttcgcgattattttcggatttgtttgcgtcgttggacgtttgtttttgggtttcgtcggtttacgcgttttttgtcgcgtcgggtttttatgtcgtttggatttttagtcgttcggttcggttcgtttcgtttagttattcgacggttcgggttttttaggtatttcggcgattcgggtacgcggttcggcgttagtttagtgtgaagatgtttgagatttttaattcgtagtttttcggtttttacggtagcgcgggtcgcgggtttcggtatttaaggattaatagtaagatcgaggttatcgtgtgaagcggg

SEQ ID NO: 19976 - DNA, 1162 bp, Artificial Sequence
  chemically treated genomic DNA (Homo sapiens) CpG-island No: 19976
cccgcttcacacgataacctcgatcttactattaatccttaaataccgaaacccgcgacccgcgctaccgtaaaaaccgaaaaactacgaattaaaaatctcaaacatcttcacactaaactaacgccgaaccgcgtacccgaatcgccgaaatacctaaaaaacccgaaccgtcgaataactaaacgaaacgaaccgaaccgaacgactaaaaatccaaacgacataaaaacccgacgcgacaaaaaacgcgtaaaccgacgaaacccaaaaacaaacgtccaacgacgcaaacaaatccgaaaataatcgcgaaacccgcgccgaaaattaccgcgaaaacgactcgaaaacgaaaaaacgctaacaaaaatcccgcgaaacgacctctacgaaaacaaaacaaaaaaaaataacgccgcgccgaacacccaaactcaaaactaaacaaaaaatcccgaccgaaaactaaaacgaaaaccgaaccgaaacgaaccgaaaacgaaacccgctaaaacgaaaaaaccgattaaccgaacgacgaacgcgcgaaactaaaaatttaacgcttaaaactacgaccccgcgcttcgcaatccgaaaactcgtacgcccaaataccctaacgctacccgcacccgccactcacctacgaccttaaacgcgacgaccttaaacgtaacgtacttaacgtaatctaactacaacgtcaaactaccgccgccctacaaccgcgaaccgcgcgaaaaccccgaaacgaccgacccccgaaacgcgttattaaaacgcttcttatctaaaacgaaaaataaaacgcgactcgatccgataccccgattcactccgccctcgctatcacctctccgtaatcctctccccgaaaccgttcgataaaaacctaaaaaaccgttctccgaacgaaactacgaaccaaacctatcttcgccgcaacctccaacgcctaaaacaaaacctaactccgaatcacgcgcaacgacgacgacaaccaacccgaaaaataccaccctcataaacgactcgcccgaaaacgacgctcgaaccaaacgcgaaatcctaaaacctactcccgccgaaacgaaaaatatctaaaaaacaaaacccaaacgaaacgtaaaaactaccaaacctacctacctctcga

SEQ ID NO: 19977 - DNA, 1402 bp, Artificial Sequence
  chemically treated genomic DNA (Homo sapiens) CpG-island No: 19977
cggcgggaaggattagcgggtagggagagtagttcgaggagtaggcgggggtttttgggcggcgcgtgtttatttggttattgtgcgtcgcgcgcgcgggttgtgcgttttttttagttttaggcgcgtttcgatgtcggttagtattagtagcgttgcgacgtcgtatatagcgtagacggtcgtatggttgcgttcgcggtcggggtttcggggcgttgcggtgtcgcgggcgcgggcgggcggtcggtttgtttggatttaggtcggcgtgtcgtagttggaatagcggttttggtcgaggcgtcgcggttcgtcgtggtagtagaagcggtagtcgtacgtgtcgtagtagaagttgtaggtttcggagttgtagttgaagggcgggttttattggtttattacgtcgtagtagtcgcggtagcggtcgttttttttcggggttgtcgtgtcgggcgtcgcgggattttgcgtttcgggggttttcgcgcggttcgacggcggtcgcgttagtagtaacgcgagtcgaagcgcgagcgcgagtcggaggtcgggaggacggcggtcgtcgagtagttttcgcgtttcggttcgcgttatcgggttcgcgtttttcgttattgcgttcggtgtatggtcgggcgtcgcggtttttttcggttcggttttttcgttttcgtagggatcgcgttggttttcggcgtacgtcgtttcggtcgtcggttttttttggggattttagtttcgagtgggttgggtttggagtttcgaggtcgtattttcggtgggcgcgtttttcgttcgggtttatttcggattcgagttgttcggttcgcgttttgagatttttttcgggtcgggcggcgggttttcgtttgcgcgcggttttcggttttttttcggttcggtaggtgtgcgggttttggttttagcggaggtcgcgtcggggtcgcgggtcgttcgattgcgttattttttcgtcgcgtttttagtatagttcgcgttttggtttcggtttcggtttcggttttcgttcgggttcggcgcgggttcgggcgggcgggggagggagagaggagggagggcggaagggaggtagagtcgggggaggagcgcggttgtcgcgaggggcgagaggaggtagtaggtttcgcggagtcgggaggttttatagggaatttttttttataaagattgtttcgaaatatttatcggaattgggcgttcgaaggggattagttttagggttcgcgattagagcgtttttgttttataggtgcggggatttgtattttataggcgcggaggttaaagtagttcggaattgtttcgggacgggtagggttatttttttatttttttttcgttttttttgttcgttttgattataatataagga

SEQ ID NO: 19978 - DNA, 1402 bp, Artificial Sequence
  chemically treated genomic DNA (Homo sapiens) CpG-island No: 19978
tccttatattataatcaaaacgaacaaaaaaaacgaaaaaaaaataaaaaaataaccctacccgtcccgaaacaattccgaactactttaacctccgcgcctataaaatacaaatccccgcacctataaaacaaaaacgctctaatcgcgaaccctaaaactaatccccttcgaacgcccaattccgataaatatttcgaaacaatctttataaaaaaaaattccctataaaacctcccgactccgcgaaacctactacctcctctcgcccctcgcgacaaccgcgctcctcccccgactctacctcccttccgccctccctcctctctccctcccccgcccgcccgaacccgcgccgaacccgaacgaaaaccgaaaccgaaaccgaaaccaaaacgcgaactatactaaaaacgcgacgaaaaaataacgcaatcgaacgacccgcgaccccgacgcgacctccgctaaaaccaaaacccgcacacctaccgaaccgaaaaaaaaccgaaaaccgcgcgcaaacgaaaacccgccgcccgacccgaaaaaaatctcaaaacgcgaaccgaacaactcgaatccgaaataaacccgaacgaaaaacgcgcccaccgaaaatacgacctcgaaactccaaacccaacccactcgaaactaaaatccccaaaaaaaaccgacgaccgaaacgacgtacgccgaaaaccaacgcgatccctacgaaaacgaaaaaaccgaaccgaaaaaaaccgcgacgcccgaccatacaccgaacgcaataacgaaaaacgcgaacccgataacgcgaaccgaaacgcgaaaactactcgacgaccgccgtcctcccgacctccgactcgcgctcgcgcttcgactcgcgttactactaacgcgaccgccgtcgaaccgcgcgaaaacccccgaaacgcaaaatcccgcgacgcccgacacgacaaccccgaaaaaaaacgaccgctaccgcgactactacgacgtaataaaccaataaaacccgcccttcaactacaactccgaaacctacaacttctactacgacacgtacgactaccgcttctactaccacgacgaaccgcgacgcctcgaccaaaaccgctattccaactacgacacgccgacctaaatccaaacaaaccgaccgcccgcccgcgcccgcgacaccgcaacgccccgaaaccccgaccgcgaacgcaaccatacgaccgtctacgctatatacgacgtcgcaacgctactaatactaaccgacatcgaaacgcgcctaaaactaaaaaaaacgcacaacccgcgcgcgcgacgcacaataaccaaataaacacgcgccgcccaaaaacccccgcctactcctcgaactactctccctacccgctaatccttcccgccg

SEQ ID NO: 19979 - DNA, 1402 bp, Artificial Sequence
  chemically treated genomic DNA (Homo sapiens) CpG-island No: 19979
tttttatgttatgattagaacggatagaggggacgggaaggaggtgagagggtggttttgttcgtttcggggtaatttcgggttgttttgattttcgcgtttgtaaggtataggttttcgtatttgtaagatagggacgttttagtcgcgggttttagaattgatttttttcgagcgtttagtttcgatgaatgtttcggggtagtttttgtggaggggggttttttgtggggtttttcggtttcgcggggtttgttgttttttttcgtttttcgcggtagtcgcgtttttttttcggttttgtttttttttcgtttttttttttttttttttttttcgttcgttcgagttcgcgtcgagttcgagcgggagtcggagtcggagtcggagttagagcgcgggttgtattgagagcgcggcgggaaggtagcgtagtcgggcggttcgcggtttcggcgcggttttcgttagggttaagattcgtatatttgtcgggtcggggagaagtcgggggtcgcgcgtaggcgaggattcgtcgttcggttcggggaagattttaggacgcggatcgggtagttcgggttcgaggtgagttcgggcggaggacgcgtttatcggaggtgcggtttcggagttttagatttagtttattcggggttggggtttttagaggaggtcgacggtcgaggcggcgtgcgtcgggagttagcgcgatttttgcgggagcggaggagtcgagtcggagggagtcgcggcgttcggttatgtatcgggcgtagtagcgggaggcgcgggttcgatggcgcgggtcggggcgcggggattgttcggcggtcgtcgttttttcggttttcggttcgcgttcgcgtttcggttcgcgttgttgttggcgcggtcgtcgtcgggtcgcgcgggagttttcgaggcgtagggtttcgcggcgttcggtacgatagtttcggaggggggcgatcgttgtcgcggttattacgacgtgatgggttagtgggattcgttttttaattgtagtttcggagtttatagtttttgttgcggtacgtgcggttatcgtttttgttgttacgacgggtcgcggcgtttcgattagagtcgttgttttaattacgatacgtcggtttgggtttagataggtcggtcgttcgttcgcgttcgcgatatcgtagcgtttcgggatttcggtcgcgagcgtagttatacggtcgtttacgttgtgtgcggcgtcgtagcgttgttggtgttggtcggtatcggggcgcgtttgggattggagagggcgtatagttcgcgcgcgcggcgtatagtgattaggtgagtacgcgtcgtttagggattttcgtttgtttttcggattgttttttttgttcgttgatttttttcgtcg

SEQ ID NO: 19980 - DNA, 1402 bp, Artificial Sequence
  chemically treated genomic DNA (Homo sapiens) CpG-island No: 19980
cgacgaaaaaaatcaacgaacaaaaaaaacaatccgaaaaacaaacgaaaatccctaaacgacgcgtactcacctaatcactatacgccgcgcgcgcgaactatacgccctctccaatcccaaacgcgccccgataccgaccaacaccaacaacgctacgacgccgcacacaacgtaaacgaccgtataactacgctcgcgaccgaaatcccgaaacgctacgatatcgcgaacgcgaacgaacgaccgacctatctaaacccaaaccgacgtatcgtaattaaaacaacgactctaatcgaaacgccgcgacccgtcgtaacaacaaaaacgataaccgcacgtaccgcaacaaaaactataaactccgaaactacaattaaaaaacgaatcccactaacccatcacgtcgtaataaccgcgacaacgatcgcccccctccgaaactatcgtaccgaacgccgcgaaaccctacgcctcgaaaactcccgcgcgacccgacgacgaccgcgccaacaacaacgcgaaccgaaacgcgaacgcgaaccgaaaaccgaaaaaacgacgaccgccgaacaatccccgcgccccgacccgcgccatcgaacccgcgcctcccgctactacgcccgatacataaccgaacgccgcgactccctccgactcgactcctccgctcccgcaaaaatcgcgctaactcccgacgcacgccgcctcgaccgtcgacctcctctaaaaaccccaaccccgaataaactaaatctaaaactccgaaaccgcacctccgataaacgcgtcctccgcccgaactcacctcgaacccgaactacccgatccgcgtcctaaaatcttccccgaaccgaacgacgaatcctcgcctacgcgcgacccccgacttctccccgacccgacaaatatacgaatcttaaccctaacgaaaaccgcgccgaaaccgcgaaccgcccgactacgctaccttcccgccgcgctctcaatacaacccgcgctctaactccgactccgactccgactcccgctcgaactcgacgcgaactcgaacgaacgaaaaaaaaaaaaaaaaaaaaaaacgaaaaaaaaacaaaaccgaaaaaaaaacgcgactaccgcgaaaaacgaaaaaaaacaacaaaccccgcgaaaccgaaaaaccccacaaaaaacccccctccacaaaaactaccccgaaacattcatcgaaactaaacgctcgaaaaaaatcaattctaaaacccgcgactaaaacgtccctatcttacaaatacgaaaacctataccttacaaacgcgaaaatcaaaacaacccgaaattaccccgaaacgaacaaaaccaccctctcacctccttcccgtcccctctatccgttctaatcataacataaaaa

SEQ ID NO: 19981 - DNA, 680 bp, Artificial Sequence
  chemically treated genomic DNA (Homo sapiens) CpG-island No: 19981
ttcggcgggggtttttattttgatttcgtttcgtttttcgggtattgttttattacgtgattcggtttcgtttttttttttttttttttttacgttataattttcgtttttttttttagaatcgcgttttatagttcggcgtaggtttcgtttttttttatttacggggcggtaggaggttcgaagtaagatggcggtgaattagagttatatcgagaatcgtcgcggagtttttatttttaacggtgaaaggtgtttgaggggaagtacggcgtgttgtcggaggagaggagacgaatgagatagatatggcggttcgtaaatttttagcgagttagggattttgtcgttttttttgggcgcggcgtttttagtttcgttttcgatttttgggagcgcgcgttttttattggtgtttcggtatgtggaggtggcggaggtcggaacgcgtggtttcgcgcgtttgaggggtgggggtgggaatgcgtttttttaaggcgcggggtttagacgtatgtttttttagggcggggcggggagggggtgcgagacgcgtgtgtttttcgaagagaggtcggagttgatcggcggttgtgagtagtcgggggttttcggtggtagcgtggttgtttttgggtgtttgcgattttgttggatgaggataggtattgggtgtgtat

SEQ ID NO: 19982 - DNA, 680 bp, Artificial Sequence
  chemically treated genomic DNA (Homo sapiens) CpG-island No: 19982
atacacacccaatacctatcctcatccaacaaaatcgcaaacacccaaaaacaaccacgctaccaccgaaaacccccgactactcacaaccgccgatcaactccgacctctcttcgaaaaacacacgcgtctcgcaccccctccccgccccgccctaaaaaaacatacgtctaaaccccgcgccttaaaaaaacgcattcccacccccacccctcaaacgcgcgaaaccacgcgttccgacctccgccacctccacataccgaaacaccaataaaaaacgcgcgctcccaaaaatcgaaaacgaaactaaaaacgccgcgcccaaaaaaaacgacaaaatccctaactcgctaaaaatttacgaaccgccatatctatctcattcgtctcctctcctccgacaacacgccgtacttcccctcaaacacctttcaccgttaaaaataaaaactccgcgacgattctcgatataactctaattcaccgccatcttacttcgaacctcctaccgccccgtaaataaaaaaaaacgaaacctacgccgaactataaaacgcgattctaaaaaaaaaaacgaaaattataacgtaaaaaaaaaaaaaaaaaaaaacgaaaccgaatcacgtaataaaacaatacccgaaaaacgaaacgaaatcaaaataaaaacccccgccgaa

SEQ ID NO: 19983 - DNA, 680 bp, Artificial Sequence
  chemically treated genomic DNA (Homo sapiens) CpG-island No: 19983
atatatatttagtatttgtttttatttaataaagtcgtaggtatttaagggtagttacgttgttatcgaaggttttcggttgtttataatcgtcggttagtttcggttttttttcgaaggatatacgcgtttcgtatttttttttcgtttcgttttgaggagatatgcgtttgggtttcgcgttttgaaaaggcgtatttttatttttattttttaaacgcgcgaggttacgcgtttcggttttcgttatttttatatgtcggaatattagtgaggggcgcgcgtttttaaaggtcgggggcggagttaagagcgtcgcgtttaaaaaaggcggtaaagtttttgattcgttgagagtttgcgagtcgttatgtttattttattcgttttttttttttcgatagtacgtcgtgtttttttttaggtattttttatcgttagggatgagggtttcgcggcggttttcggtgtggttttgatttatcgttattttgtttcgggttttttgtcgtttcgtagatggaaaggggcgggatttgcgtcgagttgtggggcgcggttttgaaggggagggcggagattatgacgtaaggaggaggaggaggaggagcgagatcgggttacgtggtggggtagtgttcggggagcggggcggagttagggtagaggttttcgtcgag

SEQ ID NO: 19984 - DNA, 680 bp, Artificial Sequence
  chemically treated genomic DNA (Homo sapiens) CpG-island No: 19984
ctcgacgaaaacctctaccctaactccgccccgctccccgaacactaccccaccacgtaacccgatctcgctcctcctcctcctcctccttacgtcataatctccgccctccccttcaaaaccgcgccccacaactcgacgcaaatcccgcccctttccatctacgaaacgacaaaaaacccgaaacaaaataacgataaatcaaaaccacaccgaaaaccgccgcgaaaccctcatccctaacgataaaaaatacctaaaaaaaaacacgacgtactatcgaaaaaaaaaaaacgaataaaataaacataacgactcgcaaactctcaacgaatcaaaaactttaccgccttttttaaacgcgacgctcttaactccgcccccgacctttaaaaacgcgcgcccctcactaatattccgacatataaaaataacgaaaaccgaaacgcgtaacctcgcgcgtttaaaaaataaaaataaaaatacgccttttcaaaacgcgaaacccaaacgcatatctcctcaaaacgaaacgaaaaaaaaatacgaaacgcgtatatccttcgaaaaaaaaccgaaactaaccgacgattataaacaaccgaaaaccttcgataacaacgtaactacccttaaatacctacgactttattaaataaaaacaaatactaaatatatat

SEQ ID NO: 19985 - DNA, 959 bp, Artificial Sequence
  chemically treated genomic DNA (Homo sapiens) CpG-island No: 19985
ttattttttcgtatttgtttttttttcgggtttttttttgtttgttttttcggcgtcggtttttttgttcgtttgtttcgtatttttcgtttcgtttcggtttttcggttcgttttttttttcgtttattttttggcgtgttttttttcgttcgtttcgtttcgcgtttttttttttaggaggagcgtttttttgcgttcggggtttcgtttcgtttaggttcgtacgcggggttttcgggaatcgtcgtttttttttttcgttttcgcgttcgcgttttttttttcggggtttcggtttatttatttttggtgcggtttcgtcggatttaggagtttcggtcgttcgggttgcggggagggggcgtttcgggtcggttttagaagttattttgtaaagaggtagggggcgcggggtcgcgcggggcgagttcgggattcgcggggaagaagtttttcgggatcgcgtttcggtcgttcgagtttttcgcgttcgtcgttttttatttcggtcgggggtttatttgggagttcgttgttttcggttagtcgttcgcgtgtgtttagggttagtagtacgtataagtgttagcgtacggtcgtcgcgtttatgtttaatgcgggtttcgttgggcgtgcgggcgtgcggggcgcggggattcgatcgatcggtcgttttcgtaggcgttgttcgttgttcgtcgtttcgttatcgttcgggttttcgagtcgtttagttagttcggttgatgagttgatagcgcgcgtttattggttcgtggcgtcggaggggcggggcgtcgtttagggtcggttaatgggcgtcggttttcggtttttcgaggaagaggggggttcgggcgtcgtcggggggattttttttttggggcgggcggtaggtggggggtgtgggtttggtcggtcggttcgttaggcgcggggtttaggttaggttggggt

SEQ ID NO: 19986 - DNA, 959 bp, Artificial Sequence
  chemically treated genomic DNA (Homo sapiens) CpG-island No: 19986
accccaacctaacctaaaccccgcgcctaacgaaccgaccgaccaaacccacaccccccacctaccgcccgccccaaaaaaaaaatccccccgacgacgcccgaacccccctcttcctcgaaaaaccgaaaaccgacgcccattaaccgaccctaaacgacgccccgcccctccgacgccacgaaccaataaacgcgcgctatcaactcatcaaccgaactaactaaacgactcgaaaacccgaacgataacgaaacgacgaacaacgaacaacgcctacgaaaacgaccgatcgatcgaatccccgcgccccgcacgcccgcacgcccaacgaaacccgcattaaacataaacgcgacgaccgtacgctaacacttatacgtactactaaccctaaacacacgcgaacgactaaccgaaaacaacgaactcccaaataaacccccgaccgaaataaaaaacgacgaacgcgaaaaactcgaacgaccgaaacgcgatcccgaaaaacttcttccccgcgaatcccgaactcgccccgcgcgaccccgcgccccctacctctttacaaaataacttctaaaaccgacccgaaacgccccctccccgcaacccgaacgaccgaaactcctaaatccgacgaaaccgcaccaaaaataaataaaccgaaaccccgaaaaaaaaaacgcgaacgcgaaaacgaaaaaaaaaaacgacgattcccgaaaaccccgcgtacgaacctaaacgaaacgaaaccccgaacgcaaaaaaacgctcctcctaaaaaaaaaaacgcgaaacgaaacgaacgaaaaaaaacacgccaaaaaataaacgaaaaaaaaaacgaaccgaaaaaccgaaacgaaacgaaaaatacgaaacaaacgaacaaaaaaaccgacgccgaaaaaacaaacaaaaaaaaacccgaaaaaaaaacaaatacgaaaaaataa

SEQ ID NO: 19987 - DNA, 959 bp, Artificial Sequence
  chemically treated genomic DNA (Homo sapiens) CpG-island No: 19987
gttttagtttggtttagatttcgcgtttagcgagtcggtcggttaggtttatattttttatttgtcgttcgttttaggggaagggttttttcgacgacgttcgagtttttttttttttcggagggtcggaggtcggcgtttattggtcggttttgggcgacgtttcgttttttcgacgttacgggttaatgagcgcgcgttgttagtttattagtcgggttggttgggcggttcgggagttcgagcggtggcggagcggcgagtagcgagtagcgtttgcgggagcggtcggtcggtcgggttttcgcgtttcgtacgttcgtacgtttagcggggttcgtattgagtatgggcgcggcggtcgtgcgttggtatttgtgcgtgttgttggttttgggtatacgcgggcggttggtcgggggtagcgggtttttaggtaagttttcgatcgaggtggggggcggcgggcgcggggggttcgggcggtcgaggcgcggtttcggagggtttttttttcgcggatttcgagttcgtttcgcgcggtttcgcgttttttgtttttttgtaaagtaatttttagggtcggttcggggcgtttttttttcgtagttcgggcggtcggggtttttgagttcggcggggtcgtattaggggtgggtgggtcggggtttcgggaggggaagcgcgagcgcgggagcgaggaagaaaggcggcggttttcggggatttcgcgtgcggatttgggcggggcgggatttcgagcgtagaggggcgttttttttgggagagggggcgcggggcggggcgggcggagggggatacgttaggaggtggacggggaaagggacggatcgagagatcgggacggggcgggaggtgcgggatagacggatagaagagtcggcgtcgagggagtagataaaaggaagttcggagaaaagatagatgcggaagggtag

SEQ ID NO: 19988 - DNA, 959 bp, Artificial Sequence
  chemically treated genomic DNA (Homo sapiens) CpG-island No: 19988
ctacccttccgcatctatcttttctccgaacttccttttatctactccctcgacgccgactcttctatccgtctatcccgcacctcccgccccgtcccgatctctcgatccgtccctttccccgtccacctcctaacgtatccccctccgcccgccccgccccgcgccccctctcccaaaaaaaacgcccctctacgctcgaaatcccgccccgcccaaatccgcacgcgaaatccccgaaaaccgccgcctttcttcctcgctcccgcgctcgcgcttcccctcccgaaaccccgacccacccacccctaatacgaccccgccgaactcaaaaaccccgaccgcccgaactacgaaaaaaaaacgccccgaaccgaccctaaaaattactttacaaaaaaacaaaaaacgcgaaaccgcgcgaaacgaactcgaaatccgcgaaaaaaaaaccctccgaaaccgcgcctcgaccgcccgaaccccccgcgcccgccgccccccacctcgatcgaaaacttacctaaaaacccgctacccccgaccaaccgcccgcgtatacccaaaaccaacaacacgcacaaataccaacgcacgaccgccgcgcccatactcaatacgaaccccgctaaacgtacgaacgtacgaaacgcgaaaacccgaccgaccgaccgctcccgcaaacgctactcgctactcgccgctccgccaccgctcgaactcccgaaccgcccaaccaacccgactaataaactaacaacgcgcgctcattaacccgtaacgtcgaaaaaacgaaacgtcgcccaaaaccgaccaataaacgccgacctccgaccctccgaaaaaaaaaaaaactcgaacgtcgtcgaaaaaacccttcccctaaaacgaacgacaaataaaaaatataaacctaaccgaccgactcgctaaacgcgaaatctaaaccaaactaaaac

SEQ ID NO: 19989 - DNA, 587 bp, Artificial Sequence
  chemically treated genomic DNA (Homo sapiens) CpG-island No: 19989
gagaaaaaaaaaaaaaagagtggaaggaggtgagcgtagcgaggatcgaggcgaaggagggttagtgcggaaattcggtgtgaggggtcgagtgaggaaggtttttgtagggcggcgatcgggttttaggaggtcgcggttttgtttttatcggagggcgagttttcgttaagttcgggttttggagatggatcgaagaggggagggaggattaggtatagaaataaatcgcggagtaagaagtatatagtgtcgaagatagaaagtcggaggagaagtcgaaatcgtttttttagtttttgcgggagcgtggtaggggaagagttatagattgattttgcgtttttcgtcgggaattaattgtagtggtatattttacggaaagttacgtttttttatcgattgcgtacgtttttaatagattataatttttagaagttttcgttcgcgtttcggcgattgcgtggtagtacgggtcgtttttttattcggtaaagtgcgggggttgggtgggagggaaattttaagcgtttgcgttggttcgaataggtttttgggaattataattttcggcgtgttttggggtt

SEQ ID NO: 19990 - DNA, 587 bp, Artificial Sequence
  chemically treated genomic DNA (Homo sapiens) CpG-island No: 19990
aaccccaaaacacgccgaaaattataattcccaaaaacctattcgaaccaacgcaaacgcttaaaatttccctcccacccaacccccgcactttaccgaataaaaaaacgacccgtactaccacgcaatcgccgaaacgcgaacgaaaacttctaaaaattataatctattaaaaacgtacgcaatcgataaaaaaacgtaactttccgtaaaatataccactacaattaattcccgacgaaaaacgcaaaatcaatctataactcttcccctaccacgctcccgcaaaaactaaaaaaacgatttcgacttctcctccgactttctatcttcgacactatatacttcttactccgcgatttatttctatacctaatcctccctcccctcttcgatccatctccaaaacccgaacttaacgaaaactcgccctccgataaaaacaaaaccgcgacctcctaaaacccgatcgccgccctacaaaaaccttcctcactcgacccctcacaccgaatttccgcactaaccctccttcgcctcgatcctcgctacgctcacctccttccactcttttttttttttttctc

SEQ ID NO: 19991 - DNA, 587 bp, Artificial Sequence
  chemically treated genomic DNA (Homo sapiens) CpG-island No: 19991
agttttagagtacgtcgggagttgtagtttttaaaggtttgttcgggttagcgtaggcgtttggggttttttttttatttaattttcgtattttatcggataaggaagcggttcgtgttgttacgtagtcgtcggaacgcgggcgggggtttttgggagttgtagtttgttgggggcgtgcgtagtcggtaaggagacgtagtttttcgtggggtgtattattgtagttggttttcggcgggagacgtagggttagtttgtgattttttttttattacgttttcgtagaggttgaggaggcggtttcgatttttttttcggttttttgttttcggtattgtgtgttttttgtttcgcggtttatttttgtatttagttttttttttttttttcggtttatttttaaagttcgggtttggcggggattcgtttttcggtaaaggtagggtcgcgattttttaaaattcggtcgtcgttttgtaggaattttttttattcggttttttatatcgggttttcgtattgattttttttcgtttcggttttcgttgcgtttatttttttttatttttttttttttttttttt

SEQ ID NO: 19992 - DNA, 587 bp, Artificial Sequence
  chemically treated genomic DNA (Homo sapiens) CpG-island No: 19992
aaaaaaaaaaaaaaaaaaaataaaaaaaaataaacgcaacgaaaaccgaaacgaaaaaaaatcaatacgaaaacccgatataaaaaaccgaataaaaaaaattcctacaaaacgacgaccgaattttaaaaaatcgcgaccctacctttaccgaaaaacgaatccccgccaaacccgaactttaaaaataaaccgaaaaaaaaaaaaaaaactaaatacaaaaataaaccgcgaaacaaaaaacacacaataccgaaaacaaaaaaccgaaaaaaaaatcgaaaccgcctcctcaacctctacgaaaacgtaataaaaaaaaaatcacaaactaaccctacgtctcccgccgaaaaccaactacaataatacaccccacgaaaaactacgtctccttaccgactacgcacgcccccaacaaactacaactcccaaaaacccccgcccgcgttccgacgactacgtaacaacacgaaccgcttccttatccgataaaatacgaaaattaaataaaaaaaaaaccccaaacgcctacgctaacccgaacaaacctttaaaaactacaactcccgacgtactctaaaact

SEQ ID NO: 19993 - DNA, 645 bp, Artificial Sequence
  chemically treated genomic DNA (Homo sapiens) CpG-island No: 19993
ttttcgttggtttttattttcgtagtttttttagtagtcgtttttagtaggcgcgttttcgttttggcgttttcgcgagttttcggtaggtagatttcggtagagggtggagggatcggttgggggcgtttcggtttcggttatttcgtataggtggttggaggagttgttgtcgcgggcgcggttgttcggtcgcgtgggtgtcgcgggcggatacgtttggaagtcggtttcgcggagcgcgcgtaggtttcggttttggcgtttcgggggggtggcgtaggttacgtcggagttggatacgcgcgcgcgttggaattaggtttagagcggtcgcgcgcggtagtcgtacgtttaggggttagcgttgagtcgtaggaattcgagcgagggtaggtcggcgagcgtttcgtcgggtagcgaggttaggttgttgttgaataggtagaggatggtgaggcggttgaggtcgcggaaggtcgcgcggtgtacgttttgtagtcggttttcgtgtagtagtagtcggtttaggttgtttaggtcgcgaaatacgtgttttgtgagtagtcgtaggcggttttcgtggaggaagaggtggtttaggttggttaggttcgcgaataagttattttgggtggggtggag

SEQ ID NO: 19994 - DNA, 645 bp, Artificial Sequence
  chemically treated genomic DNA (Homo sapiens) CpG-island No: 19994
ctccaccccacccaaaataacttattcgcgaacctaaccaacctaaaccacctcttcctccacgaaaaccgcctacgactactcacaaaacacgtatttcgcgacctaaacaacctaaaccgactactactacacgaaaaccgactacaaaacgtacaccgcgcgaccttccgcgacctcaaccgcctcaccatcctctacctattcaacaacaacctaacctcgctacccgacgaaacgctcgccgacctaccctcgctcgaattcctacgactcaacgctaacccctaaacgtacgactaccgcgcgcgaccgctctaaacctaattccaacgcgcgcgcgtatccaactccgacgtaacctacgccacccccccgaaacgccaaaaccgaaacctacgcgcgctccgcgaaaccgacttccaaacgtatccgcccgcgacacccacgcgaccgaacaaccgcgcccgcgacaacaactcctccaaccacctatacgaaataaccgaaaccgaaacgcccccaaccgatccctccaccctctaccgaaatctacctaccgaaaactcgcgaaaacgccaaaacgaaaacgcgcctactaaaaacgactactaaaaaaactacgaaaataaaaaccaacgaaaa

SEQ ID NO: 19995 - DNA, 645 bp, Artificial Sequence
  chemically treated genomic DNA (Homo sapiens) CpG-island No: 19995
ttttattttatttaggatgatttgttcgcggatttggttaatttgagttatttttttttttacgggaatcgtttgcggttgtttatagagtacgtgtttcgcggtttgggtagtttggatcggttgttgttgtacgggaatcggttgtagggcgtgtatcgcgcggtttttcgcggttttagtcgttttattattttttatttgtttaataatagtttggtttcgttgttcggcgaggcgttcgtcgatttgttttcgttcgagtttttgcggtttaacgttaatttttgggcgtgcgattgtcgcgcgcggtcgttttgggtttggttttagcgcgcgcgcgtgtttagtttcgacgtgatttgcgttattttttcggagcgttagggtcgagatttgcgcgcgtttcgcgaggtcgatttttaggcgtgttcgttcgcggtatttacgcggtcgggtagtcgcgttcgcggtaatagtttttttaattatttgtacggggtggtcgaggtcggggcgtttttagtcgatttttttattttttatcgagatttgtttgtcgaagattcgcgggggcgttagggcggggacgcgtttattgaggacgattattgggggggttacgggggtgaggattagcgaggg

SEQ ID NO: 19996 - DNA, 645 bp, Artificial Sequence
  chemically treated genomic DNA (Homo sapiens) CpG-island No: 19996
ccctcgctaatcctcacccccgtaacccccccaataatcgtcctcaataaacgcgtccccgccctaacgcccccgcgaatcttcgacaaacaaatctcgataaaaaataaaaaaatcgactaaaaacgccccgacctcgaccaccccgtacaaataattaaaaaaactattaccgcgaacgcgactacccgaccgcgtaaataccgcgaacgaacacgcctaaaaatcgacctcgcgaaacgcgcgcaaatctcgaccctaacgctccgaaaaaataacgcaaatcacgtcgaaactaaacacgcgcgcgcgctaaaaccaaacccaaaacgaccgcgcgcgacaatcgcacgcccaaaaattaacgttaaaccgcaaaaactcgaacgaaaacaaatcgacgaacgcctcgccgaacaacgaaaccaaactattattaaacaaataaaaaataataaaacgactaaaaccgcgaaaaaccgcgcgatacacgccctacaaccgattcccgtacaacaacaaccgatccaaactacccaaaccgcgaaacacgtactctataaacaaccgcaaacgattcccgtaaaaaaaaaaataactcaaattaaccaaatccgcgaacaaatcatcctaaataaaataaaa

SEQ ID NO: 19997 - DNA, 776 bp, Artificial Sequence
  chemically treated genomic DNA (Homo sapiens) CpG-island No: 19997
gattttatcgaatttggggaggtgatttttaaagaggttacggaaaagcgtgaatcgtcgatttttcgcgcgttttttagcgtagggtcgttttttcggtttgtcggtgtttttagttcggtcgtttttttcgaggtcgttattagtattttcgttcgtttttttaggttcggatttggttcgttttttttcgttttttaattcggagtttgtattttttttgtttcgtgttcggttcgttaaggattgcgttttgggttgtcggtttcgaggtcgtcgtcgtcgtcgtcgtttttttttttttttgttgttgtttagtcgacgcgcgagtagatcggattgggcgcggggacgcgggacgcggggacgcgggttcggttcgcgcgggatttgggtcggagcgggaggaggcgtcgtcgttggggtatcggggacgttttgttacgttttttgcgtagtaaattcggtgtttttttcgcggatcggtcgttattcgcgtttttttcgcggttattttttttgcgtcggggtggattcggggttatttggtattgtttttatttttacgttatttatatagtgtttcgcgagttttagtttcgcgtcgttttttcggggttacgtttttagttgattttttcgggtcgttttcggagataatggtttatcgcgtttttcggtttttcgagttttagttcggttatcgtttttattttttgggtagtgagtgtcgtgattgtttcgttttatagaagtgtagattaaggtcggggaga

SEQ ID NO: 19998 - DNA, 776 bp, Artificial Sequence
  chemically treated genomic DNA (Homo sapiens) CpG-island No: 19998
tctccccgaccttaatctacacttctataaaacgaaacaatcacgacactcactacccaaaaaataaaaacgataaccgaactaaaactcgaaaaaccgaaaaacgcgataaaccattatctccgaaaacgacccgaaaaaatcaactaaaaacgtaaccccgaaaaaacgacgcgaaactaaaactcgcgaaacactatataaataacgtaaaaataaaaacaataccaaataaccccgaatccaccccgacgcaaaaaaaataaccgcgaaaaaaacgcgaataacgaccgatccgcgaaaaaaacaccgaatttactacgcaaaaaacgtaacaaaacgtccccgataccccaacgacgacgcctcctcccgctccgacccaaatcccgcgcgaaccgaacccgcgtccccgcgtcccgcgtccccgcgcccaatccgatctactcgcgcgtcgactaaacaacaacaaaaaaaaaaaaaaacgacgacgacgacgacgacctcgaaaccgacaacccaaaacgcaatccttaacgaaccgaacacgaaacaaaaaaaatacaaactccgaattaaaaaacgaaaaaaaacgaaccaaatccgaacctaaaaaaacgaacgaaaatactaataacgacctcgaaaaaaacgaccgaactaaaaacaccgacaaaccgaaaaaacgaccctacgctaaaaaacgcgcgaaaaatcgacgattcacgcttttccgtaacctctttaaaaatcacctccccaaattcgataaaatc

SEQ ID NO: 19999 - DNA, 776 bp, Artificial Sequence
  chemically treated genomic DNA (Homo sapiens) CpG-island No: 19999
ttttttcggttttggtttatatttttgtgaaacggggtagttacggtatttattgtttagggagtggggacggtggtcgagttgaagttcggaggatcgggaggcgcggtgagttattgttttcggggacgattcgggagggttagttgggaacgtggtttcgggggggcggcgcggggttggggttcgcggggtattgtgtgggtggcgtggaggtggaggtagtgttaggtggtttcgagtttatttcggcgtagagggggtggtcgcgggagaggcgcgggtggcgatcggttcgcgggaggggtatcgggtttgttgcgtagggggcgtgatagggcgttttcggtattttagcggcggcgttttttttcgtttcggtttagatttcgcgcgagtcgggttcgcgttttcgcgtttcgcgttttcgcgtttagttcggtttgttcgcgcgtcggttgagtagtagtaggaggaggaggaggcggcggcggcggcggcggtttcggggtcggtagtttagagcgtagtttttagcgggtcgggtacggggtagggaggatgtagatttcgggttggagagcggaggagggcgggttaggttcgggtttggagaggcgggcgggggtgttggtggcggtttcggggaggacggtcgggttggggatatcgataggtcgggggagcggttttgcgttgggggacgcgcgggaggtcggcggtttacgttttttcgtggtttttttgaaaattatttttttagattcggtgagatt

SEQ ID NO: 20000 - DNA, 776 bp, Artificial Sequence
  chemically treated genomic DNA (Homo sapiens) CpG-island No: 20000
aatctcaccgaatctaaaaaaataattttcaaaaaaaccacgaaaaaacgtaaaccgccgacctcccgcgcgtcccccaacgcaaaaccgctcccccgacctatcgatatccccaacccgaccgtcctccccgaaaccgccaccaacacccccgcccgcctctccaaacccgaacctaacccgccctcctccgctctccaacccgaaatctacatcctccctaccccgtacccgacccgctaaaaactacgctctaaactaccgaccccgaaaccgccgccgccgccgccgcctcctcctcctcctactactactcaaccgacgcgcgaacaaaccgaactaaacgcgaaaacgcgaaacgcgaaaacgcgaacccgactcgcgcgaaatctaaaccgaaacgaaaaaaaacgccgccgctaaaataccgaaaacgccctatcacgccccctacgcaacaaacccgatacccctcccgcgaaccgatcgccacccgcgcctctcccgcgaccaccccctctacgccgaaataaactcgaaaccacctaacactacctccacctccacgccacccacacaataccccgcgaaccccaaccccgcgccgcccccccgaaaccacgttcccaactaaccctcccgaatcgtccccgaaaacaataactcaccgcgcctcccgatcctccgaacttcaactcgaccaccgtccccactccctaaacaataaataccgtaactaccccgtttcacaaaaatataaaccaaaaccgaaaaaa

SEQ ID NO: 20001 - DNA, 1282 bp, Artificial Sequence
  chemically treated genomic DNA (Homo sapiens) CpG-island No: 20001
ttcggttttcggggtaagagttttcgtttacgttattttcgtcgtcgttttttcggttttttagcgaaagagataaagagtcggcgttttaattcgcgaagtcgcggttgtcgggagcggtagatcgggggattttgttttaaaacgaggggcgggcgtagggagggcgaggtggtggtattcgggttaagttgtcgcgcgttcggttgcgcgggtagcgggatacgcggatgtggggcgggtagtttcggcgtatggaagtagtggttttaggcgagagtttgcgggtttcgacggacggacgggcgggtattagcgcgcggtggtcggagttcggtagtttcgcggcgggtcggtcgagcgtttggggtagcgtcgttgggcgggtcggtcgtagttgtatttatcggatcggaagaaggtcgcgatgtcggttaggtttttggtcgttttttttgttttttcgtcggtatcgttttcgtagttcgagttagtcgcgttggtcgtcgcggcggggtcggaggacgcggcgggggcggcggtttcgtcgttgttgtcgtttatggttgcggcggcgttcgcggtcgcgttcgtttcgggtttcgcgtttttagcgtcgcgtgtcgttcgtttcgcgtcgggtttggcggcgtcgagtatttagttgttcgcgttcggcgcgcggacgtagagtttcggggcggcggggggcggcggcggcggttcggtttaaggagcgcgtttatatagacgaggatttcgttcggtagtcgcgagttggtcgaggggcggaggcgcggagttacggtttttcgggcgtcggtcggagcgcgggtagtagtacgcgtttttcggacgcgtagtcgcgagggcgggggttcgtggtcggcgagattttcgggattacgggcgtcggcggttgtcgcgagtttttattttgattttaatggggaaggaaggaggggggagggggaaattacggtcgagggaattcgggtgaaaggaaaagggagaatagggaacggagaggaaggaaaaaaaagaggggtttcggtaattttcggcgaatttcgttaagggtcgagtttgggttcggcggtgggcggagtttgggggaggggcggggtcgcgttgggcggatgggttttcgtagggttggcggggaggttgtaggaacgttcggtttggttcggtttgttttttcggggtagttttaagttttggaaggcgtaggaaagttttgattagtcggggcggatttttttaggttcggtattgcgtt

SEQ ID NO: 20002 - DNA, 1282 bp, Artificial Sequence
  chemically treated genomic DNA (Homo sapiens) CpG-island No: 20002
aacgcaataccgaacctaaaaaaatccgccccgactaatcaaaactttcctacgccttccaaaacttaaaactaccccgaaaaaacaaaccgaaccaaaccgaacgttcctacaacctccccgccaaccctacgaaaacccatccgcccaacgcgaccccgcccctcccccaaactccgcccaccgccgaacccaaactcgacccttaacgaaattcgccgaaaattaccgaaacccctcttttttttccttcctctccgttccctattctcccttttcctttcacccgaattccctcgaccgtaatttccccctcccccctccttccttccccattaaaatcaaaataaaaactcgcgacaaccgccgacgcccgtaatcccgaaaatctcgccgaccacgaacccccgccctcgcgactacgcgtccgaaaaacgcgtactactacccgcgctccgaccgacgcccgaaaaaccgtaactccgcgcctccgcccctcgaccaactcgcgactaccgaacgaaatcctcgtctatataaacgcgctccttaaaccgaaccgccgccgccgccccccgccgccccgaaactctacgtccgcgcgccgaacgcgaacaactaaatactcgacgccgccaaacccgacgcgaaacgaacgacacgcgacgctaaaaacgcgaaacccgaaacgaacgcgaccgcgaacgccgccgcaaccataaacgacaacaacgacgaaaccgccgcccccgccgcgtcctccgaccccgccgcgacgaccaacgcgactaactcgaactacgaaaacgataccgacgaaaaaacaaaaaaaacgaccaaaaacctaaccgacatcgcgaccttcttccgatccgataaatacaactacgaccgacccgcccaacgacgctaccccaaacgctcgaccgacccgccgcgaaactaccgaactccgaccaccgcgcgctaatacccgcccgtccgtccgtcgaaacccgcaaactctcgcctaaaaccactacttccatacgccgaaactacccgccccacatccgcgtatcccgctacccgcgcaaccgaacgcgcgacaacttaacccgaataccaccacctcgccctccctacgcccgcccctcgttttaaaacaaaatcccccgatctaccgctcccgacaaccgcgacttcgcgaattaaaacgccgactctttatctctttcgctaaaaaaccgaaaaaacgacgacgaaaataacgtaaacgaaaactcttaccccgaaaaccgaa

SEQ ID NO: 20003 - DNA, 1282 bp, Artificial Sequence
  chemically treated genomic DNA (Homo sapiens) CpG-island No: 20003
ggcgtaatgtcgggtttgggaaggttcgtttcggttggttagagtttttttgcgttttttaaggtttggagttgtttcggggaagtagatcgaattaaatcgaacgtttttgtagttttttcgttagttttgcgggagtttattcgtttaacgcggtttcgttttttttttaggtttcgtttatcgtcgagtttaggttcggtttttgacgaagttcgtcggaaattatcgaagttttttttttttttttttttttttcgttttttgtttttttttttttttttattcgggttttttcggtcgtgattttttttttttttttttttttttttttattgaaattaagatggaggttcgcggtagtcgtcggcgttcgtgatttcggaggtttcgtcggttacgggttttcgttttcgcgattgcgcgttcgggaggcgcgtgttgttgttcgcgtttcggtcggcgttcgggaggtcgtggtttcgcgttttcgtttttcggttagttcgcggttatcgggcggagttttcgtttatgtgggcgcgttttttgggtcgagtcgtcgtcgtcgtttttcgtcgtttcggggttttgcgttcgcgcgtcgggcgcgggtagttgggtgttcggcgtcgttaggttcggcgcggagcgggcggtacgcggcgttaggggcgcggggttcgaggcgggcgcggtcgcgggcgtcgtcgtagttatgagcggtagtagcggcggagtcgtcgttttcgtcgcgtttttcggtttcgtcgcggcggttagcgcggttggttcgggttgcgggggcggtgtcggcgagggggtagaggaggcggttaaggatttggtcgatatcgcggttttttttcgattcggtgagtgtaattgcggtcggttcgtttagcggcgttgttttaagcgttcggtcgattcgtcgcggagttgtcgagtttcggttatcgcgcgttggtgttcgttcgttcgttcgtcggggttcgtaggttttcgtttgggattattgtttttatgcgtcggggttgttcgttttatattcgcgtgtttcgttgttcgcgtagtcgggcgcgcggtagtttggttcgaatgttattatttcgttttttttgcgttcgtttttcgttttagggtagaatttttcggtttgtcgttttcggtagtcgcggtttcgcgggttggggcgtcggttttttgtttttttcgttggaggatcgaggaggcggcggcggagatggcgtgggcggaggtttttatttcggaggtcgag

SEQ ID NO: 20004 - DNA, 1282 bp, Artificial Sequence
  chemically treated genomic DNA (Homo sapiens) CpG-island No: 20004
ctcgacctccgaaataaaaacctccgcccacgccatctccgccgccgcctcctcgatcctccaacgaaaaaaacaaaaaaccgacgccccaacccgcgaaaccgcgactaccgaaaacgacaaaccgaaaaattctaccctaaaacgaaaaacgaacgcaaaaaaaacgaaataataacattcgaaccaaactaccgcgcgcccgactacgcgaacaacgaaacacgcgaatataaaacgaacaaccccgacgcataaaaacaataatcccaaacgaaaacctacgaaccccgacgaacgaacgaacgaacaccaacgcgcgataaccgaaactcgacaactccgcgacgaatcgaccgaacgcttaaaacaacgccgctaaacgaaccgaccgcaattacactcaccgaatcgaaaaaaaaccgcgatatcgaccaaatccttaaccgcctcctctaccccctcgccgacaccgcccccgcaacccgaaccaaccgcgctaaccgccgcgacgaaaccgaaaaacgcgacgaaaacgacgactccgccgctactaccgctcataactacgacgacgcccgcgaccgcgcccgcctcgaaccccgcgcccctaacgccgcgtaccgcccgctccgcgccgaacctaacgacgccgaacacccaactacccgcgcccgacgcgcgaacgcaaaaccccgaaacgacgaaaaacgacgacgacgactcgacccaaaaaacgcgcccacataaacgaaaactccgcccgataaccgcgaactaaccgaaaaacgaaaacgcgaaaccacgacctcccgaacgccgaccgaaacgcgaacaacaacacgcgcctcccgaacgcgcaatcgcgaaaacgaaaacccgtaaccgacgaaacctccgaaatcacgaacgccgacgactaccgcgaacctccatcttaatttcaataaaaaaaaaaaaaaaaaaaaaaaaaaaatcacgaccgaaaaaacccgaataaaaaaaaaaaaaaaaacaaaaaacgaaaaaaaaaaaaaaaaaaaaaaaacttcgataatttccgacgaacttcgtcaaaaaccgaacctaaactcgacgataaacgaaacctaaaaaaaaaacgaaaccgcgttaaacgaataaactcccgcaaaactaacgaaaaaactacaaaaacgttcgatttaattcgatctacttccccgaaacaactccaaaccttaaaaaacgcaaaaaaactctaaccaaccgaaacgaaccttcccaaacccgacattacgcc

SEQ ID NO: 20005 - DNA, 667 bp, Artificial Sequence
  chemically treated genomic DNA (Homo sapiens) CpG-island No: 20005
tagacgcggagtttatttcgttagaaattttgggtttttttttttacgttggtaggttgggttcggttttatcgtcgcggtttcgtttatttttttagggagcgcgggtagagcgtcgagcgcggcgtagggattggagttttcgttagtttcgggtttttttttttcggagttgttcggggggtttcggtttcgggcgttttcgtcgtcgttttgttttttttagggtttatgttttgttttcggggttttagaggtttcgtttgagagcggttttcgcgagtttgggtgtcgcggaattatcgttgtcggaagtcgaggttatataaacgttacgggtaggagcgggagggtatcggcggcggttgcgaggtcgggttttgatatgtcgttgtgttcgtagtgaaggaggagggcgatcgcgagatttttagttttagggatagtttttcggtgcgtttgaaaaagttacgtaaggcgcgtacggtttttatcgattattagttggcgtagttggagcgtagtttcgagcggtagaagtatttgagcgtgtaggatcgtatggagttcgtcgtttcgtttaattttatcgatacgtaggttaagatttggtattagaatcgtaggtgaggtttggttgcgggggtagaggtagaaagggaatttt

SEQ ID NO: 20006 - DNA, 667 bp, Artificial Sequence
  chemically treated genomic DNA (Homo sapiens) CpG-island No: 20006
aaaattccctttctacctctacccccgcaaccaaacctcacctacgattctaataccaaatcttaacctacgtatcgataaaattaaacgaaacgacgaactccatacgatcctacacgctcaaatacttctaccgctcgaaactacgctccaactacgccaactaataatcgataaaaaccgtacgcgccttacgtaactttttcaaacgcaccgaaaaactatccctaaaactaaaaatctcgcgatcgccctcctccttcactacgaacacaacgacatatcaaaacccgacctcgcaaccgccgccgataccctcccgctcctacccgtaacgtttatataacctcgacttccgacaacgataattccgcgacacccaaactcgcgaaaaccgctctcaaacgaaacctctaaaaccccgaaaacaaaacataaaccctaaaaaaaacaaaacgacgacgaaaacgcccgaaaccgaaaccccccgaacaactccgaaaaaaaaaaacccgaaactaacgaaaactccaatccctacgccgcgctcgacgctctacccgcgctccctaaaaaaataaacgaaaccgcgacgataaaaccgaacccaacctaccaacgtaaaaaaaaaaacccaaaatttctaacgaaataaactccgcgtcta

SEQ ID NO: 20007 - DNA, 667 bp, Artificial Sequence
  chemically treated genomic DNA (Homo sapiens) CpG-island No: 20007
gaagttttttttttgtttttattttcgtagttaggttttatttgcggttttggtattaggttttgatttgcgtgtcggtgaggttgagcgaggcggcgagttttatgcggttttgtacgtttaggtatttttgtcgttcgaagttgcgttttagttgcgttagttgatggtcggtgaaggtcgtgcgcgttttgcgtggtttttttaggcgtatcgggggattgtttttggagttggagatttcgcggtcgttttttttttttattgcggatatagcggtatgttagggttcggtttcgtagtcgtcgtcggtgttttttcgtttttgttcgtggcgtttgtgtaatttcggttttcgatagcggtggtttcgcgatatttaagttcgcgggggtcgtttttagacgggatttttggggtttcgggaataggatatgaattttgaggggaataggacggcggcgggagcgttcgaggtcgagatttttcgggtagtttcggggagaaagaattcgaagttggcgagaattttagtttttgcgtcgcgttcggcgttttgttcgcgttttttggagggataaacggagtcgcgacgatggaatcggatttagtttgttagcgtaggggaagggatttagggtttttggcggagtgagtttcgcgtttg

SEQ ID NO: 20008 - DNA, 667 bp, Artificial Sequence
  chemically treated genomic DNA (Homo sapiens) CpG-island No: 20008
caaacgcgaaactcactccgccaaaaaccctaaatcccttcccctacgctaacaaactaaatccgattccatcgtcgcgactccgtttatccctccaaaaaacgcgaacaaaacgccgaacgcgacgcaaaaactaaaattctcgccaacttcgaattctttctccccgaaactacccgaaaaatctcgacctcgaacgctcccgccgccgtcctattcccctcaaaattcatatcctattcccgaaaccccaaaaatcccgtctaaaaacgacccccgcgaacttaaatatcgcgaaaccaccgctatcgaaaaccgaaattacacaaacgccacgaacaaaaacgaaaaaacaccgacgacgactacgaaaccgaaccctaacataccgctatatccgcaataaaaaaaaaaaacgaccgcgaaatctccaactccaaaaacaatcccccgatacgcctaaaaaaaccacgcaaaacgcgcacgaccttcaccgaccatcaactaacgcaactaaaacgcaacttcgaacgacaaaaatacctaaacgtacaaaaccgcataaaactcgccgcctcgctcaacctcaccgacacgcaaatcaaaacctaataccaaaaccgcaaataaaacctaactacgaaaataaaaacaaaaaaaaaacttc

SEQ ID NO: 20009 - DNA, 720 bp, Artificial Sequence
  chemically treated genomic DNA (Homo sapiens) CpG-island No: 20009
ttcgtttttttatatcgttttatttttcgtttttaggcgtatttttgcgggtggtgtttcggttagagatacgtgtttcggcgtaatttgtttcgaagttgttcggtgtttttttttcgtttaatttcgtgaatgattcgaaattcgattttaaggtacggttgtagttcgcggcgcgtttatagtcgggtcgcgggtggggacggagttgaagtcgggttagaatttattcgattcgtttgggttgggggacgtttggagaacgttttggggttgtcgaagagcgaatcgtcggcggttgttatggtttgcgtgggtgacgcgtggtgtagtagcgagttcggtgcgtagattgttgggttcgggattttacgtgggacgcgcgaggattttgcgttatcgtttttttcgggttcggaacggttttagttgtacggattcgtttcgaggggagtcggggacggcggtatcgggcgggtagggataagattatcgcgcgtgttttcgtttggtggtagtttttttttgcgtttttcgcggtttggtaaaattatattcggtcgagagtttacgttggggaagttttttgaatgtttttgagaagcgagattcggcgttattttatcgacgagttttttttttatcgtttcgtgcgtttttttagtattttaggaattaaagtttgtttgggtagttttttaataggttttggagtttaat

SEQ ID NO: 20010 - DNA, 720 bp, Artificial Sequence
  chemically treated genomic DNA (Homo sapiens) CpG-island No: 20010
attaaactccaaaacctattaaaaaactacccaaacaaactttaattcctaaaatactaaaaaaacgcacgaaacgataaaaaaaaaactcgtcgataaaataacgccgaatctcgcttctcaaaaacattcaaaaaacttccccaacgtaaactctcgaccgaatataattttaccaaaccgcgaaaaacgcaaaaaaaaactaccaccaaacgaaaacacgcgcgataatcttatccctacccgcccgataccgccgtccccgactcccctcgaaacgaatccgtacaactaaaaccgttccgaacccgaaaaaaacgataacgcaaaatcctcgcgcgtcccacgtaaaatcccgaacccaacaatctacgcaccgaactcgctactacaccacgcgtcacccacgcaaaccataacaaccgccgacgattcgctcttcgacaaccccaaaacgttctccaaacgtcccccaacccaaacgaatcgaataaattctaacccgacttcaactccgtccccacccgcgacccgactataaacgcgccgcgaactacaaccgtaccttaaaatcgaatttcgaatcattcacgaaattaaacgaaaaaaaaacaccgaacaacttcgaaacaaattacgccgaaacacgtatctctaaccgaaacaccacccgcaaaaatacgcctaaaaacgaaaaataaaacgatataaaaaaacgaa

SEQ ID NO: 20011 - DNA, 720 bp, Artificial Sequence
  chemically treated genomic DNA (Homo sapiens) CpG-island No: 20011
attgagttttagagtttgttagggagttatttagataggttttagtttttaaagtgttgaggaaacgtacggggcggtaaaggggaggttcgtcggtgagatggcgtcggatttcgttttttagaggtatttagagagtttttttagcgtgaattttcggtcgaatgtaattttgttaggtcgcgagggacgtagagaggggttgttattaggcgggggtacgcgcggtagttttgtttttattcgttcggtgtcgtcgttttcggtttttttcgggacgagttcgtatagttggagtcgtttcggattcggaaggggcggtggcgtagggttttcgcgcgttttacgtggggtttcgggtttagtagtttgcgtatcgggttcgttgttgtattacgcgttatttacgtagattatggtagtcgtcgacggttcgtttttcgataattttaggacgttttttagacgttttttagtttaggcgagtcgggtgagttttgattcggttttagtttcgtttttattcgcggttcggttgtgggcgcgtcgcgagttgtagtcgtgttttggagtcgggtttcgagttatttacggagttaagcgggagaaagatatcgggtagtttcgggataagttgcgtcgaaatacgtgtttttaatcggaatattattcgtagggatgcgtttggaagcggggagtggagcggtgtggaggggcggg

SEQ ID NO: 20012 - DNA, 720 bp, Artificial Sequence
  chemically treated genomic DNA (Homo sapiens) CpG-island No: 20012
cccgcccctccacaccgctccactccccgcttccaaacgcatccctacgaataatattccgattaaaaacacgtatttcgacgcaacttatcccgaaactacccgatatctttctcccgcttaactccgtaaataactcgaaacccgactccaaaacacgactacaactcgcgacgcgcccacaaccgaaccgcgaataaaaacgaaactaaaaccgaatcaaaactcacccgactcgcctaaactaaaaaacgtctaaaaaacgtcctaaaattatcgaaaaacgaaccgtcgacgactaccataatctacgtaaataacgcgtaatacaacaacgaacccgatacgcaaactactaaacccgaaaccccacgtaaaacgcgcgaaaaccctacgccaccgccccttccgaatccgaaacgactccaactatacgaactcgtcccgaaaaaaaccgaaaacgacgacaccgaacgaataaaaacaaaactaccgcgcgtacccccgcctaataacaacccctctctacgtccctcgcgacctaacaaaattacattcgaccgaaaattcacgctaaaaaaactctctaaatacctctaaaaaacgaaatccgacgccatctcaccgacgaacctcccctttaccgccccgtacgtttcctcaacactttaaaaactaaaacctatctaaataactccctaacaaactctaaaactcaat

SEQ ID NO: 20013 - DNA, 536 bp, Artificial Sequence
  chemically treated genomic DNA (Homo sapiens) CpG-island No: 20013
ggcggggttttttttggttcggcggcgttcggggtttgaggggagaaaatcgtcgcggagggcgttgggggtggcggcggcggttcgggaggtggtcgcgcgattgcgtggagcgttagggcgttcgatttttgtatttgagagaagatgaatacggtcgattaggttcgggtggggttcgcggacgacgggtttgcgtcgtttggggaggaggagggagaggggggcggcgaggcgggcgggaaggagttagtagcggacgcggtttcggggtttagcgttgtatttcgttttatggtgattcggcgggagtcggtcgtgaagttgtagtatgcggtgagcggtttggaatcgttggtttggttcgaggattatcgcgtgtttgtgtttacggttcgtagtatcgttgtgttggagtttatttgcgacgtgtataattcgggttaggatttggttatttatcgtatttcggtgttcgtatcgtttaatagttgtttttttaaagtaagttatttttcgttatttttggggttttt

SEQ ID NO: 20014 - DNA, 536 bp, Artificial Sequence
  chemically treated genomic DNA (Homo sapiens) CpG-island No: 20014
aaaaaccccaaaaataacgaaaaataacttactttaaaaaaacaactattaaacgatacgaacaccgaaatacgataaataaccaaatcctaacccgaattatacacgtcgcaaataaactccaacacaacgatactacgaaccgtaaacacaaacacgcgataatcctcgaaccaaaccaacgattccaaaccgctcaccgcatactacaacttcacgaccgactcccgccgaatcaccataaaacgaaatacaacgctaaaccccgaaaccgcgtccgctactaactccttcccgcccgcctcgccgcccccctctccctcctcctccccaaacgacgcaaacccgtcgtccgcgaaccccacccgaacctaatcgaccgtattcatcttctctcaaatacaaaaatcgaacgccctaacgctccacgcaatcgcgcgaccacctcccgaaccgccgccgccacccccaacgccctccgcgacgattttctcccctcaaaccccgaacgccgccgaaccaaaaaaaaccccgcc

SEQ ID NO: 20015 - DNA, 536 bp, Artificial Sequence
  chemically treated genomic DNA (Homo sapiens) CpG-island No: 20015
gaagattttagggatggcgggggatgatttattttgaggagatagttgttgagcggtgcgggtatcgaggtgcggtggataattaggttttggttcgggttgtgtacgtcgtagatgagttttagtatagcgatgttgcgggtcgtggatatagatacgcggtggttttcggattaagttagcggttttaggtcgtttatcgtatattgtagttttacggtcggttttcgtcgagttattatgaggcggaatgtagcgttgggtttcggggtcgcgttcgttgttggttttttttcgttcgtttcgtcgtttttttttttttttttttttttagacggcgtaggttcgtcgttcgcgggttttattcgggtttggtcggtcgtgtttatttttttttaggtgtagaggtcggacgttttggcgttttacgtagtcgcgcgattatttttcggatcgtcgtcgttatttttagcgtttttcgcggcggttttttttttttaggtttcgagcgtcgtcgagttaagaaggatttcgtt

SEQ ID NO: 20016 - DNA, 536 bp, Artificial Sequence
  chemically treated genomic DNA (Homo sapiens) CpG-island No: 20016
aacgaaatccttcttaactcgacgacgctcgaaacctaaaaaaaaaaaaccgccgcgaaaaacgctaaaaataacgacgacgatccgaaaaataatcgcgcgactacgtaaaacgccaaaacgtccgacctctacacctaaaaaaaaataaacacgaccgaccaaacccgaataaaacccgcgaacgacgaacctacgccgtctaaaaaaaaaaaaaaaaaaaaaaacgacgaaacgaacgaaaaaaaaccaacaacgaacgcgaccccgaaacccaacgctacattccgcctcataataactcgacgaaaaccgaccgtaaaactacaatatacgataaacgacctaaaaccgctaacttaatccgaaaaccaccgcgtatctatatccacgacccgcaacatcgctatactaaaactcatctacgacgtacacaacccgaaccaaaacctaattatccaccgcacctcgatacccgcaccgctcaacaactatctcctcaaaataaatcatcccccgccatccctaaaatcttc

SEQ ID NO: 20017 - DNA, 704 bp, Artificial Sequence
  chemically treated genomic DNA (Homo sapiens) CpG-island No: 20017
atggtcgtttttaagggagtgggcgggtttgcggggcggaagtgacgtacgagaggaagttcgttttgtcgtttggtcgcggggcgtttggtttagtggtttttgcgggtttcgaggagcgggatgttgcgggttgggtggtttcggggcgcggcggcgttggcgttgttgttggcggttcgagtggtggcggcgttcgagtttattatcgtgggtttagttatcggggtcgcgtcggttattatcggttatttgttttataatgatatttattgtcgtttcgtcgagtgttgtcgcgaggagcggtcgtttaacgtttcgggtacggcgcgcgcgcgagttgtgggtcggcgttgcggggggcgcgggggcgcgggggcgcggagggacggtttcgtgggcgtttggtacggatcgggttcgtggtatttagacggcggtggttttagttggggtgggcggggagcggatggggcggtttcggaatcgttcgcgggaacgtagaagcggtgttttcgtaaatagtttttagatcgtggggttgttttagcgtttttttaaagttttcgttttttgggattataggtggaagaaacggaaagtaggcgggcggtttttttgcgttttgttaattttattaagtagtttttagacgtgttgcgtcgtttagaaagtttatatttggtttttggtttttttgtagg

SEQ ID NO: 20018 - DNA, 704 bp, Artificial Sequence
  chemically treated genomic DNA (Homo sapiens) CpG-island No: 20018
cctacaaaaaaaccaaaaaccaaatataaactttctaaacgacgcaacacgtctaaaaactacttaataaaattaacaaaacgcaaaaaaaccgcccgcctactttccgtttcttccacctataatcccaaaaaacgaaaactttaaaaaaacgctaaaacaaccccacgatctaaaaactatttacgaaaacaccgcttctacgttcccgcgaacgattccgaaaccgccccatccgctccccgcccaccccaactaaaaccaccgccgtctaaataccacgaacccgatccgtaccaaacgcccacgaaaccgtccctccgcgcccccgcgcccccgcgccccccgcaacgccgacccacaactcgcgcgcgcgccgtacccgaaacgttaaacgaccgctcctcgcgacaacactcgacgaaacgacaataaatatcattataaaacaaataaccgataataaccgacgcgaccccgataactaaacccacgataataaactcgaacgccgccaccactcgaaccgccaacaacaacgccaacgccgccgcgccccgaaaccacccaacccgcaacatcccgctcctcgaaacccgcaaaaaccactaaaccaaacgccccgcgaccaaacgacaaaacgaacttcctctcgtacgtcacttccgccccgcaaacccgcccactcccttaaaaacgaccat

SEQ ID NO: 20019 - DNA, 704 bp, Artificial Sequence
  chemically treated genomic DNA (Homo sapiens) CpG-island No: 20019
tttgtaggaaaattaggggttaaatgtgggttttttgggcgacgtagtacgtttgaaaattatttaatagggttggtagggcgtagaagggtcgttcgtttatttttcgttttttttatttgtgattttaaggaacgggagttttagaaaggcgttggggtagttttacgatttggagattgtttgcgaaggtatcgtttttgcgttttcgcgaacggtttcggggtcgttttattcgtttttcgtttattttagttgggattatcgtcgtttagatgttacgggttcggttcgtgttaggcgtttacgaggtcgttttttcgcgttttcgcgttttcgcgtttttcgtagcgtcgatttatagttcgcgcgcgcgtcgtattcgaagcgttgagcggtcgtttttcgcggtagtattcggcgaagcggtagtagatgttattgtaggataggtagtcggtgatggtcgacgcggtttcgatggttaggtttacggtgatgggttcgaacgtcgttattattcgggtcgttagtagtagcgttagcgtcgtcgcgtttcggagttatttagttcgtaatatttcgtttttcgaagttcgtagaagttattgagttaggcgtttcgcggttaagcggtaggacggattttttttcgtgcgttattttcgtttcgtagattcgtttatttttttgggggcggttat

SEQ ID NO: 20020 - DNA, 704 bp, Artificial Sequence
  chemically treated genomic DNA (Homo sapiens) CpG-island No: 20020
ataaccgcccccaaaaaaataaacgaatctacgaaacgaaaataacgcacgaaaaaaaatccgtcctaccgcttaaccgcgaaacgcctaactcaataacttctacgaacttcgaaaaacgaaatattacgaactaaataactccgaaacgcgacgacgctaacgctactactaacgacccgaataataacgacgttcgaacccatcaccgtaaacctaaccatcgaaaccgcgtcgaccatcaccgactacctatcctacaataacatctactaccgcttcgccgaatactaccgcgaaaaacgaccgctcaacgcttcgaatacgacgcgcgcgcgaactataaatcgacgctacgaaaaacgcgaaaacgcgaaaacgcgaaaaaacgacctcgtaaacgcctaacacgaaccgaacccgtaacatctaaacgacgataatcccaactaaaataaacgaaaaacgaataaaacgaccccgaaaccgttcgcgaaaacgcaaaaacgataccttcgcaaacaatctccaaatcgtaaaactaccccaacgcctttctaaaactcccgttccttaaaatcacaaataaaaaaaacgaaaaataaacgaacgacccttctacgccctaccaaccctattaaataattttcaaacgtactacgtcgcccaaaaaacccacatttaacccctaattttcctacaaa

SEQ ID NO: 20021 - DNA, 793 bp, Artificial Sequence
  chemically treated genomic DNA (Homo sapiens) CpG-island No: 20021
aggagagggcggaggagaggacggggggcgaggtttgttttaagaaggggcgtgtggtcggcgtagcgcgtgtattagcggtttcggagcgagcggtcgtggttgagaaggggagggcggaaagtttgttttttcgacgttagcgtcgggcgggtcgcgaggttaggaggcggcgggagttgggtagagcgcggggcggtcggggttttcgtttcgattcgcgttcgcgattttttttgggattcgagttcgagattttcgtcggttttttcggggtcgttcgcgggtatggatagcgcggtcgtcgttttcgttttggataagtcggcgttgggttcggggtcgtcgtcgtttttattcgcgttggggttcggcgattgcgtttaggcgcgtaagaatttttcggtgagttattttttggatttggaagaggtggcggcggtcgggcggttggcggcgcgtttcggggttagggtcgaggcgcgggagggcgtagtacgggagtcgttcgggggtagtagcggtagcgaggcggcgtcgtaggatggtgagtacggtcggttagggacgggggtggcggggtcggggtcggggtcggggtcggggcgcggggttcggggagtcggcgcggggcgggcgaagatgtagggcgcgtggtcggcggtaggatttttgggggcgcgtgtaagtgacggtggacggcggttgattagtattttgggttgggggagggggatttttttcgggttttggggtgcgtttttacggggaagtgcgttgttttcgtttttta

SEQ ID NO: 20022 - DNA, 793 bp, Artificial Sequence
  chemically treated genomic DNA (Homo sapiens) CpG-island No: 20022
taaaaaacgaaaacaacgcacttccccgtaaaaacgcaccccaaaacccgaaaaaaatccccctcccccaacccaaaatactaatcaaccgccgtccaccgtcacttacacgcgcccccaaaaatcctaccgccgaccacgcgccctacatcttcgcccgccccgcgccgactccccgaaccccgcgccccgaccccgaccccgaccccgaccccgccacccccgtccctaaccgaccgtactcaccatcctacgacgccgcctcgctaccgctactacccccgaacgactcccgtactacgccctcccgcgcctcgaccctaaccccgaaacgcgccgccaaccgcccgaccgccgccacctcttccaaatccaaaaaataactcaccgaaaaattcttacgcgcctaaacgcaatcgccgaaccccaacgcgaataaaaacgacgacgaccccgaacccaacgccgacttatccaaaacgaaaacgacgaccgcgctatccatacccgcgaacgaccccgaaaaaaccgacgaaaatctcgaactcgaatcccaaaaaaaatcgcgaacgcgaatcgaaacgaaaaccccgaccgccccgcgctctacccaactcccgccgcctcctaacctcgcgacccgcccgacgctaacgtcgaaaaaacaaactttccgccctccccttctcaaccacgaccgctcgctccgaaaccgctaatacacgcgctacgccgaccacacgccccttcttaaaacaaacctcgccccccgtcctctcctccgccctctcct

SEQ ID NO: 20023 - DNA, 793 bp, Artificial Sequence
  chemically treated genomic DNA (Homo sapiens) CpG-island No: 20023
tggggagcgaaggtagcgtattttttcgtggggacgtattttaagattcgaagagggttttttttttttagtttagagtgttggttaatcgtcgtttatcgttatttatacgcgtttttagaagttttgtcgtcgattacgcgttttgtattttcgttcgtttcgcgtcggtttttcggatttcgcgtttcggtttcggtttcggtttcggtttcgttattttcgtttttggtcggtcgtatttattattttgcggcgtcgtttcgttgtcgttgttgttttcggacggttttcgtgttgcgttttttcgcgtttcggttttggtttcggggcgcgtcgttagtcgttcggtcgtcgttattttttttaggtttaggaggtggtttatcgagaagtttttgcgcgtttgggcgtagtcgtcgggttttagcgcgggtggaggcggcggcggtttcgggtttagcgtcggtttgtttagggcgaaggcggcggtcgcgttgtttatgttcgcgagcggtttcgggggggtcggcgggggtttcgggttcgggttttaggaagggtcgcgggcgcgggtcggagcgagagtttcggtcgtttcgcgttttgtttagttttcgtcgttttttagtttcgcggttcgttcggcgttgacgtcggggaaataaatttttcgtttttttttttttagttacggtcgttcgtttcggagtcgttggtgtacgcgttgcgtcggttatacgtttttttttgaagtaaatttcgtttttcgttttttttttcgttttttttt

SEQ ID NO: 20024 - DNA, 793 bp, Artificial Sequence
  chemically treated genomic DNA (Homo sapiens) CpG-island No: 20024
aaaaaaaaacgaaaaaaaaaacgaaaaacgaaatttacttcaaaaaaaaacgtataaccgacgcaacgcgtacaccaacgactccgaaacgaacgaccgtaactaaaaaaaaaaaaacgaaaaatttatttccccgacgtcaacgccgaacgaaccgcgaaactaaaaaacgacgaaaactaaacaaaacgcgaaacgaccgaaactctcgctccgacccgcgcccgcgacccttcctaaaacccgaacccgaaacccccgccgacccccccgaaaccgctcgcgaacataaacaacgcgaccgccgccttcgccctaaacaaaccgacgctaaacccgaaaccgccgccgcctccacccgcgctaaaacccgacgactacgcccaaacgcgcaaaaacttctcgataaaccacctcctaaacctaaaaaaaataacgacgaccgaacgactaacgacgcgccccgaaaccaaaaccgaaacgcgaaaaaacgcaacacgaaaaccgtccgaaaacaacaacgacaacgaaacgacgccgcaaaataataaatacgaccgaccaaaaacgaaaataacgaaaccgaaaccgaaaccgaaaccgaaacgcgaaatccgaaaaaccgacgcgaaacgaacgaaaatacaaaacgcgtaatcgacgacaaaacttctaaaaacgcgtataaataacgataaacgacgattaaccaacactctaaactaaaaaaaaaaaaccctcttcgaatcttaaaatacgtccccacgaaaaaatacgctaccttcgctcccca

SEQ ID NO: 20025 - DNA, 901 bp, Artificial Sequence
  chemically treated genomic DNA (Homo sapiens) CpG-island No: 20025
gaacgagcgtcggggaaggagtaagtcgagcgagttatttattttaagttttttgttgcggatttttacgtagttttgtttgattatgtcgttaaagttggaggttatggttagcgcgatcgggtttttgcgtttcgcgattcgtttttcggagtcgagagtcgtcgttcgtcgtcgggtttgcgcgggtttcgtatttagtcggtcgtcgttagtagtagcgtcgtcgttcgttttttttcgagttttcgtcggtggggacgcggggtcgtttgtagggtcgtcgcggacggggaacggggttcggcgtcgcgagtcgcgttagtttttcgcgttttggcgtttattttcgtttttcgtcgcgagtttagcgtcgcggttcgcgttttcgttagttgcgggagtttttatcgcgtcgtcgttttcggtagtatttacgggttggcgtttcgttcggcggcgtatagttggtcggagcgtattatcgcggtttttcggcgcggggggagggggcgggtcggggggggcgggttgatgcgtcggtttcgttttttttttttggttcgtggggtggttgggttcggagacgttcgtaagacgcgttttattttttttcgcgcgggtgggagcgttttcgtcgtcgggcgtttcgaggttcgttttttattcggtttttcggttttttagcgtttttcgggcgcgagatttttaaggatacggcgttttattttcgggttttaaatttttattcgtaagttgtgtagcggggaaagggtagtggggatatttttaacgcggaaggttagcgggagcgagatatttattttattggttttgtttatagtatatttttatttttaagtattcgcggtcgttttaggtttttgtttcgttaggaagt

SEQ ID NO: 20026 - DNA, 901 bp, Artificial Sequence
  chemically treated genomic DNA (Homo sapiens) CpG-island No: 20026
acttcctaacgaaacaaaaacctaaaacgaccgcgaatacttaaaaataaaaatatactataaacaaaaccaataaaataaatatctcgctcccgctaaccttccgcgttaaaaatatccccactaccctttccccgctacacaacttacgaataaaaatttaaaacccgaaaataaaacgccgtatccttaaaaatctcgcgcccgaaaaacgctaaaaaaccgaaaaaccgaataaaaaacgaacctcgaaacgcccgacgacgaaaacgctcccacccgcgcgaaaaaaaataaaacgcgtcttacgaacgtctccgaacccaaccaccccacgaaccaaaaaaaaaaaacgaaaccgacgcatcaacccgccccccccgacccgccccctccccccgcgccgaaaaaccgcgataatacgctccgaccaactatacgccgccgaacgaaacgccaacccgtaaatactaccgaaaacgacgacgcgataaaaactcccgcaactaacgaaaacgcgaaccgcgacgctaaactcgcgacgaaaaacgaaaataaacgccaaaacgcgaaaaactaacgcgactcgcgacgccgaaccccgttccccgtccgcgacgaccctacaaacgaccccgcgtccccaccgacgaaaactcgaaaaaaaacgaacgacgacgctactactaacgacgaccgactaaatacgaaacccgcgcaaacccgacgacgaacgacgactctcgactccgaaaaacgaatcgcgaaacgcaaaaacccgatcgcgctaaccataacctccaactttaacgacataatcaaacaaaactacgtaaaaatccgcaacaaaaaacttaaaataaataactcgctcgacttactccttccccgacgctcgttc

SEQ ID NO: 20027 - DNA, 901 bp, Artificial Sequence
  chemically treated genomic DNA (Homo sapiens) CpG-island No: 20027
attttttaacggggtagagatttggaacggtcgcgagtgtttgggaataaaaatgtattgtaaataaggttaatgaaataagtgtttcgttttcgttggtttttcgcgttggaagtgtttttattgtttttttttcgttgtatagtttgcgagtggagatttagagttcgggaatgaggcgtcgtgtttttaggaatttcgcgttcggggagcgttgagggatcggggagtcgggtggggagcgggtttcggggcgttcggcggcggaggcgtttttattcgcgcggagagggatggagcgcgttttgcgagcgttttcgagtttagttattttacgggttagggggagggagcggggtcggcgtattagttcgtttttttcggttcgtttttttttttcgcgtcggggagtcgcggtggtgcgtttcggttagttgtgcgtcgtcgagcgaggcgttagttcgtgggtgttgtcgggggcggcggcgcggtgggggttttcgtagttggcggaggcgcgggtcgcggcgttgggttcgcggcggggagcgaaggtgagcgttagaacgcggagggttggcgcggttcgcggcgtcgggtttcgtttttcgttcgcggcggttttgtaggcgatttcgcgtttttatcggcgggagttcggggaagagcgggcggcggcgttgttgttggcggcggtcggttggatgcgagattcgcgtagattcggcggcggacggcggttttcgatttcggagagcggatcgcggggcgtaggagttcgatcgcgttggttatggtttttaattttaacgatatagttaagtagggttacgtgaaaattcgtagtaggaagtttggggtgagtggttcgttcggtttgtttttttttcggcgttcgttt

SEQ ID NO: 20028 - DNA, 901 bp, Artificial Sequence
  chemically treated genomic DNA (Homo sapiens) CpG-island No: 20028
aaacgaacgccgaaaaaaaaacaaaccgaacgaaccactcaccccaaacttcctactacgaattttcacgtaaccctacttaactatatcgttaaaattaaaaaccataaccaacgcgatcgaactcctacgccccgcgatccgctctccgaaatcgaaaaccgccgtccgccgccgaatctacgcgaatctcgcatccaaccgaccgccgccaacaacaacgccgccgcccgctcttccccgaactcccgccgataaaaacgcgaaatcgcctacaaaaccgccgcgaacgaaaaacgaaacccgacgccgcgaaccgcgccaaccctccgcgttctaacgctcaccttcgctccccgccgcgaacccaacgccgcgacccgcgcctccgccaactacgaaaacccccaccgcgccgccgcccccgacaacacccacgaactaacgcctcgctcgacgacgcacaactaaccgaaacgcaccaccgcgactccccgacgcgaaaaaaaaaaacgaaccgaaaaaaacgaactaatacgccgaccccgctccctccccctaacccgtaaaataactaaactcgaaaacgctcgcaaaacgcgctccatccctctccgcgcgaataaaaacgcctccgccgccgaacgccccgaaacccgctccccacccgactccccgatccctcaacgctccccgaacgcgaaattcctaaaaacacgacgcctcattcccgaactctaaatctccactcgcaaactatacaacgaaaaaaaaacaataaaaacacttccaacgcgaaaaaccaacgaaaacgaaacacttatttcattaaccttatttacaatacatttttattcccaaacactcgcgaccgttccaaatctctaccccgttaaaaaat

SEQ ID NO: 20029 - DNA, 880 bp, Artificial Sequence
  chemically treated genomic DNA (Homo sapiens) CpG-island No: 20029
gaagtttacggggcgaagggtatttgttcgggcgttaggaggttcggtttagggtcgtcgtggcgtttttatttacggtggatttgtaggtttcgtagaaggtgtcgtcggtgaagcgttttattaggttggttttgtttacgtcgcgggagtcgataatgatgatttgtaatttgaagtcggtcggtttggggggttgtttttttcggcggttttggtcgttcgatagcgtcggggagttcgcgtttagatcgtcgtcgttttcggttcgtttttgtagcgcggcgttcggatttatatacgtatgcggttttcgttcggttcgtcgttcgtcgtcgttcgtttttcggttgcgcgtttcgggtttcggcgttttttcggttttcgtcgcgcgcggggggtcggttttcgggttcggttttcgttcgttggagcggtttcggcggttcgtgggtttcgcgttgtaattgcgtcgtcggtcggttttttgcgttcgggtttttttttttttttttttcgtcgttgtcgtcgtcgtcgtcgggagaggaggaagggaagtagttatttcgtagtagcggtagtagtatttcggacgaggaggggtaggaagcgtaggcgcgggcggggcggttggtcgcgaggggtcggaggcgggcgggtgggcgttttttgtcggcgggaggatcgcgcgttcgggtttcggttgggtattgcgcgcggagttttttcgtaattcgcgtcgttttttttttgtttttgttcgtttgttcgttttcgtttttttttttttttcgtcggtttttttatttttttttttttttatttttttttttttttttttttttatttttttttattcggtttttattttgattcgtat

SEQ ID NO: 20030 - DNA, 880 bp, Artificial Sequence
  chemically treated genomic DNA (Homo sapiens) CpG-island No: 20030
atacgaatcaaaataaaaaccgaataaaaaaaaataaaaaaaaaaaaaaaaaaaaaaataaaaaaaaaaaaaaataaaaaaaccgacgaaaaaaaaaaaaaaacgaaaacgaacaaacgaacaaaaacaaaaaaaaaacgacgcgaattacgaaaaaactccgcgcgcaatacccaaccgaaacccgaacgcgcgatcctcccgccgacaaaaaacgcccacccgcccgcctccgacccctcgcgaccaaccgccccgcccgcgcctacgcttcctacccctcctcgtccgaaatactactaccgctactacgaaataactacttcccttcctcctctcccgacgacgacgacgacaacgacgaaaaaaaaaaaaaaaaaaacccgaacgcaaaaaaccgaccgacgacgcaattacaacgcgaaacccacgaaccgccgaaaccgctccaacgaacgaaaaccgaacccgaaaaccgaccccccgcgcgcgacgaaaaccgaaaaaacgccgaaacccgaaacgcgcaaccgaaaaacgaacgacgacgaacgacgaaccgaacgaaaaccgcatacgtatataaatccgaacgccgcgctacaaaaacgaaccgaaaacgacgacgatctaaacgcgaactccccgacgctatcgaacgaccaaaaccgccgaaaaaaacaaccccccaaaccgaccgacttcaaattacaaatcatcattatcgactcccgcgacgtaaacaaaaccaacctaataaaacgcttcaccgacgacaccttctacgaaacctacaaatccaccgtaaataaaaacgccacgacgaccctaaaccgaacctcctaacgcccgaacaaatacccttcgccccgtaaacttc

SEQ ID NO: 20031 - DNA, 880 bp, Artificial Sequence
  chemically treated genomic DNA (Homo sapiens) CpG-island No: 20031
atgcgggttagagtgaaagtcgagtagggaggagtgaaaagggggaaaagggaagagataagaggaagaaaagatgaaagagtcggcggaagagggagggaagcgggggcgggtaggcgagtagaggtagggaaagagcggcgcgggttgcgggaaagtttcgcgcgtagtatttaatcgaggttcgggcgcgcggttttttcgtcggtagggggcgtttattcgttcgttttcggtttttcgcggttagtcgtttcgttcgcgtttgcgttttttgttttttttcgttcgggatgttgttgtcgttattgcggagtagttgttttttttttttttttttcggcggcggcggcggtagcggcggaggaggaggaggaggggattcgggcgtagagagtcggtcggcggcgtagttgtagcgcggagtttacgggtcgtcggggtcgttttagcgggcggaagtcgagttcgggggtcgatttttcgcgcgcggcggaggtcgagggggcgtcggggttcggggcgcgtagtcggggggcgggcggcggcgggcggcgggtcgagcgggagtcgtatgcgtgtatggattcgggcgtcgcgttgtagaggcgggtcgggggcggcggcggtttgggcgcgggtttttcggcgttgtcgggcggttagggtcgtcggaggaagtagttttttaggtcggtcgattttaagttgtaggttattattatcggttttcgcggcgtgggtaagattagtttgatggagcgttttatcgacgatattttttgcgaggtttgtaagtttatcgtgggtaagggcgttacggcgattttgggtcgggttttttggcgttcgggtaggtgtttttcgtttcgtgggtttt

SEQ ID NO: 20032 - DNA, 880 bp, Artificial Sequence
  chemically treated genomic DNA (Homo sapiens) CpG-island No: 20032
aaaacccacgaaacgaaaaacacctacccgaacgccaaaaaacccgacccaaaatcgccgtaacgcccttacccacgataaacttacaaacctcgcaaaaaatatcgtcgataaaacgctccatcaaactaatcttacccacgccgcgaaaaccgataataataacctacaacttaaaatcgaccgacctaaaaaactacttcctccgacgaccctaaccgcccgacaacgccgaaaaacccgcgcccaaaccgccgccgcccccgacccgcctctacaacgcgacgcccgaatccatacacgcatacgactcccgctcgacccgccgcccgccgccgcccgccccccgactacgcgccccgaaccccgacgccccctcgacctccgccgcgcgcgaaaaatcgacccccgaactcgacttccgcccgctaaaacgaccccgacgacccgtaaactccgcgctacaactacgccgccgaccgactctctacgcccgaatcccctcctcctcctcctccgccgctaccgccgccgccgccgaaaaaaaaaaaaaaaaaacaactactccgcaataacgacaacaacatcccgaacgaaaaaaaacaaaaaacgcaaacgcgaacgaaacgactaaccgcgaaaaaccgaaaacgaacgaataaacgccccctaccgacgaaaaaaccgcgcgcccgaacctcgattaaatactacgcgcgaaactttcccgcaacccgcgccgctctttccctacctctactcgcctacccgcccccgcttccctccctcttccgccgactctttcatcttttcttcctcttatctcttcccttttcccccttttcactcctccctactcgactttcactctaacccgcat

SEQ ID NO: 20033 - DNA, 662 bp, Artificial Sequence
  chemically treated genomic DNA (Homo sapiens) CpG-island No: 20033
tgcggggcggggagttgttggagtatattcgtaagaagcggtattttagcgagtcggaagtaagttagattttgcgtagtttcgtgtcggtcgtgagttttatgtacgaggaggcgggcgtggtgtatcgcgattttaagtcggaggtgggcgagttgtttcggcggcggggcggagcggtggcgtcgggggttgtttttgattattatttcgtcgttttcgtagaatattttgtacgtcgacgatacgttcggggtttcggtgaaaattatcgatttcgggttcgcgcggttgcggtcgtagagtttcggggtgtttatgtagacgttttgttttacgttgtagtacgttgttttcgagttgttggcgtagtagggttacgacgagttttgcgatttttggagtttgggcgttattttggtatgggacgcggtttttgaggcggggttagggtcgttcggatttggcgtttttttgatgtgtagtagtacgagggaggggataggggttattttggtgggggcggttgggtttcgttcgaagttgggatcggggtggtttaaatatagaggtggggtcgttttggtgttagagtcggagtattcgggtattgggggttagaagttagggtttattacgcgtgggttttaggagtgttttta

SEQ ID NO: 20034 - DNA, 662 bp, Artificial Sequence
  chemically treated genomic DNA (Homo sapiens) CpG-island No: 20034
taaaaacactcctaaaacccacgcgtaataaaccctaacttctaacccccaatacccgaatactccgactctaacaccaaaacgaccccacctctatatttaaaccaccccgatcccaacttcgaacgaaacccaaccgcccccaccaaaataacccctatcccctccctcgtactactacacatcaaaaaaacgccaaatccgaacgaccctaaccccgcctcaaaaaccgcgtcccataccaaaataacgcccaaactccaaaaatcgcaaaactcgtcgtaaccctactacgccaacaactcgaaaacaacgtactacaacgtaaaacaaaacgtctacataaacaccccgaaactctacgaccgcaaccgcgcgaacccgaaatcgataattttcaccgaaaccccgaacgtatcgtcgacgtacaaaatattctacgaaaacgacgaaataataatcaaaaacaacccccgacgccaccgctccgccccgccgccgaaacaactcgcccacctccgacttaaaatcgcgatacaccacgcccgcctcctcgtacataaaactcacgaccgacacgaaactacgcaaaatctaacttacttccgactcgctaaaataccgcttcttacgaatatactccaacaactccccgccccgca

SEQ ID NO: 20035 - DNA, 662 bp, Artificial Sequence
  chemically treated genomic DNA (Homo sapiens) CpG-island No: 20035
taggggtatttttgagatttacgcgtggtgaattttgatttttaatttttaatattcggatgtttcgattttagtattagagcgattttatttttgtatttgaattatttcgattttagtttcggacgaaatttagtcgtttttattaagatgatttttgttttttttttcgtgttgttgtatattaggaagacgttaggttcgagcgattttgatttcgttttaaggatcgcgttttatattagaatgacgtttaggttttagaggtcgtaggattcgtcgtagttttgttgcgttagtagttcgggggtagcgtattgtagcgtgaagtagggcgtttgtatgggtatttcgggattttgcggtcgtaatcgcgcgaattcgaagtcgatgatttttatcggggtttcgggcgtgtcgtcggcgtataggatgttttgcgagggcggcggggtagtggttagaggtagttttcggcgttatcgtttcgtttcgtcgtcgaggtagttcgtttattttcggtttgaggtcgcggtgtattacgttcgttttttcgtgtatgaagtttacggtcgatacgaggttgcgtaggatttggtttgttttcgattcgttgaagtgtcgttttttgcggatgtgttttagtagtttttcgtttcgta

SEQ ID NO: 20036 - DNA, 662 bp, Artificial Sequence
  chemically treated genomic DNA (Homo sapiens) CpG-island No: 20036
tacgaaacgaaaaactactaaaacacatccgcaaaaaacgacacttcaacgaatcgaaaacaaaccaaatcctacgcaacctcgtatcgaccgtaaacttcatacacgaaaaaacgaacgtaatacaccgcgacctcaaaccgaaaataaacgaactacctcgacgacgaaacgaaacgataacgccgaaaactacctctaaccactaccccgccgccctcgcaaaacatcctatacgccgacgacacgcccgaaaccccgataaaaatcatcgacttcgaattcgcgcgattacgaccgcaaaatcccgaaatacccatacaaacgccctacttcacgctacaatacgctacccccgaactactaacgcaacaaaactacgacgaatcctacgacctctaaaacctaaacgtcattctaatataaaacgcgatccttaaaacgaaatcaaaatcgctcgaacctaacgtcttcctaatatacaacaacacgaaaaaaaaaacaaaaatcatcttaataaaaacgactaaatttcgtccgaaactaaaatcgaaataattcaaatacaaaaataaaatcgctctaatactaaaatcgaaacatccgaatattaaaaattaaaaatcaaaattcaccacgcgtaaatctcaaaaataccccta

SEQ ID NO: 20037 - DNA, 681 bp, Artificial Sequence
  chemically treated genomic DNA (Homo sapiens) CpG-island No: 20037
gcgcggtaggggcggcgggcgagggcgcgagttcggaggacgcggcgggttttttttcggcggtcgggttcgaggcgggggtcggtttttatagtcgatcgggtcgcgcgtcgtttttgaagtggtcgtagttgcgtttcggttcgcggttaattttcgtcgacgcgggcgtttcgttttttcgtttttttcgtatagtaatagtgttcgcgttgaatggcgttggttaattatttcgttcgtattatcgcgggtgaatgagagaattcggtattgtgcgcggcgaatggagaaaataagatagttattgttttcgtacgttaaacgagggtttgatgtcgttggggcgagcgaggtattatttttcgttatttttttttttagagtttcggattttttagttgggttcggtttcggcgtattcgcggcggcggagggaaattgaggaagcggtgtttgttttttcgaggaaataggttttttatttttcgtggaagttgggcggatacgcgcggttttcggattcgttttcgttttttttttcgggttttttttcgagttttttttatttgtagatttttaggggcgttttaattgagcgcgtagttgtttttaatttaggaaaaacgggtacggttttgtatttaaagatttaattttatttcgtcgatatatattaaa

SEQ ID NO: 20038 - DNA, 681 bp, Artificial Sequence
  chemically treated genomic DNA (Homo sapiens) CpG-island No: 20038
tttaatatatatcgacgaaataaaattaaatctttaaatacaaaaccgtacccgtttttcctaaattaaaaacaactacgcgctcaattaaaacgcccctaaaaatctacaaataaaaaaaactcgaaaaaaaacccgaaaaaaaaaacgaaaacgaatccgaaaaccgcgcgtatccgcccaacttccacgaaaaataaaaaacctatttcctcgaaaaaacaaacaccgcttcctcaatttccctccgccgccgcgaatacgccgaaaccgaacccaactaaaaaatccgaaactctaaaaaaaaaaataacgaaaaataatacctcgctcgccccaacgacatcaaaccctcgtttaacgtacgaaaacaataactatcttattttctccattcgccgcgcacaataccgaattctctcattcacccgcgataatacgaacgaaataattaaccaacgccattcaacgcgaacactattactatacgaaaaaaacgaaaaaacgaaacgcccgcgtcgacgaaaattaaccgcgaaccgaaacgcaactacgaccacttcaaaaacgacgcgcgacccgatcgactataaaaaccgacccccgcctcgaacccgaccgccgaaaaaaaacccgccgcgtcctccgaactcgcgccctcgcccgccgcccctaccgcgc

SEQ ID NO: 20039 - DNA, 681 bp, Artificial Sequence
  chemically treated genomic DNA (Homo sapiens) CpG-island No: 20039
tttggtgtgtatcggcgaaatgggattaggtttttgaatgtagagtcgtgttcgttttttttgaattaaggataattgcgcgtttagttagagcgtttttgagaatttgtaggtggagaaggttcggggaggggttcggagggagggacgagggcgagttcgggggtcgcgcgtgttcgtttagtttttacggaaggtgaagggtttattttttcggggagataggtatcgtttttttagttttttttcgtcgtcgcgagtgcgtcggggtcgggtttagttggggaattcgaggttttgggggagggggtggcgggaaatggtgtttcgttcgttttagcgatattaaattttcgtttggcgtgcgaggataatggttgttttattttttttattcgtcgcgtataatgtcggatttttttatttattcgcggtggtgcgagcgaggtaattagttagcgttatttagcgcggatattattgttatgcgggaggggcgggggggcgggacgttcgcgtcggcggggattagtcgcgggtcggggcgtagttgcggttattttaaaggcggcgcgcggttcggtcggttgtgggaatcggttttcgtttcgggttcggtcgtcgggaaggggttcgtcgcgtttttcgggttcgcgttttcgttcgtcgtttttgtcgcgt

SEQ ID NO: 20040 - DNA, 681 bp, Artificial Sequence
  chemically treated genomic DNA (Homo sapiens) CpG-island No: 20040
acgcgacaaaaacgacgaacgaaaacgcgaacccgaaaaacgcgacgaaccccttcccgacgaccgaacccgaaacgaaaaccgattcccacaaccgaccgaaccgcgcgccgcctttaaaataaccgcaactacgccccgacccgcgactaatccccgccgacgcgaacgtcccgcccccccgcccctcccgcataacaataatatccgcgctaaataacgctaactaattacctcgctcgcaccaccgcgaataaataaaaaaatccgacattatacgcgacgaataaaaaaaataaaacaaccattatcctcgcacgccaaacgaaaatttaatatcgctaaaacgaacgaaacaccatttcccgccaccccctcccccaaaacctcgaattccccaactaaacccgaccccgacgcactcgcgacgacgaaaaaaaactaaaaaaacgatacctatctccccgaaaaaataaacccttcaccttccgtaaaaactaaacgaacacgcgcgacccccgaactcgccctcgtccctccctccgaacccctccccgaaccttctccacctacaaattctcaaaaacgctctaactaaacgcgcaattatccttaattcaaaaaaaacgaacacgactctacattcaaaaacctaatcccatttcgccgatacacaccaaa

SEQ ID NO: 20041 - DNA, 1063 bp, Artificial Sequence
  chemically treated genomic DNA (Homo sapiens) CpG-island No: 20041
ggcgtggtcggttcgaatttgttttttaggtttagaacggagttcgtagttcgtaattcgttgtggtcgtagcgggtcgcgtttttcgttttcgttttaggagcggtcgaggatttgtttagttgcgggcgttaagttttggtcgtattttttttttcggcggagggagtcggttggcgttgcggtttttaaggcgcgcggacgtcgcggagggtagttagtcgcgcgggagcgggtagcgcgcgcgagggcgttgggcgtcgtcgcgaggcggggaagcgcggggtcgcggcggtgcgggttttagggcggcggtcgtcgtcgtcgtagtagcgtttcgagcggggagggtcgaggaggttcgacgagttggggatggagagtatcgggttttttattgttttagagcgcgtgtgcggttttgggcgcgtatagtgacggtgacggtatttttggttcggtagcgtcgaggtcgtttcgttagatagttagcggtcggcggtaggtcgggttatgagcggtaggggtcgggtcgggtttcgttgattttggtttcgcgcggtagtttttttagttttcgtttcggtttttcggtatgagagttcgttcgggttcggggttgcggttgttttagattcgtcgtacgttggcgcgtttcgggttcgcggagtcgcggtgttgatatttgcgtcgtattgcgtcgttcgttcgttcgttgtgtgtttcgggggcgcggttatggaggtggtgggtgatttcgagtatagtaagagggatttcgtgggatacggggttttcgtcgtggtttttcgggggcggtatcgttaggtgagcgtcggtcggggcgaggtcgggtttcgggcggtaggtacggggttaggtggttttgaaatttggcgtagtcgcgagtcgagattttcgattcggttagtcgttcgggtatgttattgtgcgcgtagttcgtttcgtcgtttgttttggttttgtgagggttgttgtgaggtttaagtttttggtagcgtttcgtttatcgatcggttgttgttgatttttttgtgtgttt

SEQ ID NO: 20042 - DNA, 1063 bp, Artificial Sequence
  chemically treated genomic DNA (Homo sapiens) CpG-island No: 20042
aaacacacaaaaaaatcaacaacaaccgatcgataaacgaaacgctaccaaaaacttaaacctcacaacaaccctcacaaaaccaaaacaaacgacgaaacgaactacgcgcacaataacatacccgaacgactaaccgaatcgaaaatctcgactcgcgactacgccaaatttcaaaaccacctaaccccgtacctaccgcccgaaacccgacctcgccccgaccgacgctcacctaacgataccgcccccgaaaaaccacgacgaaaaccccgtatcccacgaaatccctcttactatactcgaaatcacccaccacctccataaccgcgcccccgaaacacacaacgaacgaacgaacgacgcaatacgacgcaaatatcaacaccgcgactccgcgaacccgaaacgcgccaacgtacgacgaatctaaaacaaccgcaaccccgaacccgaacgaactctcataccgaaaaaccgaaacgaaaactaaaaaaactaccgcgcgaaaccaaaatcaacgaaacccgacccgacccctaccgctcataacccgacctaccgccgaccgctaactatctaacgaaacgacctcgacgctaccgaaccaaaaataccgtcaccgtcactatacgcgcccaaaaccgcacacgcgctctaaaacaataaaaaacccgatactctccatccccaactcgtcgaacctcctcgaccctccccgctcgaaacgctactacgacgacgacgaccgccgccctaaaacccgcaccgccgcgaccccgcgcttccccgcctcgcgacgacgcccaacgccctcgcgcgcgctacccgctcccgcgcgactaactaccctccgcgacgtccgcgcgccttaaaaaccgcaacgccaaccgactccctccgccgaaaaaaaaaatacgaccaaaacttaacgcccgcaactaaacaaatcctcgaccgctcctaaaacgaaaacgaaaaacgcgacccgctacgaccacaacgaattacgaactacgaactccgttctaaacctaaaaaacaaattcgaaccgaccacgcc

SEQ ID NO: 20043 - DNA, 1063 bp, Artificial Sequence
  chemically treated genomic DNA (Homo sapiens) CpG-island No: 20043
gggtatataggaggattagtagtagtcggtcggtaggcggagcgttgttagaggtttgggttttataataatttttataggattaaaataaacggcgagacgggttgcgcgtataatagtatattcgggcggttagtcgagtcgggggtttcggttcgcggttgcgttaagttttagaattatttagtttcgtgtttgtcgttcggggttcggtttcgtttcggtcggcgtttatttggcggtgtcgttttcggaagattacggcgaaggtttcgtgttttacgagattttttttgttgtattcgaagttatttattatttttatggtcgcgttttcggggtatatagcggacgggcgggcggcgtagtgcggcgtaggtattagtatcgcggtttcgcgggttcggagcgcgttagcgtgcggcgggtttggggtagtcgtagtttcgggttcgggcggatttttatgtcgagagatcggagcggaaattggggaagttgtcgcgcggagttagggttagcgaggttcggttcggtttttgtcgtttatggttcggtttgtcgtcggtcgttggttgtttggcgaagcggtttcggcgttgtcgggttaggggtgtcgttatcgttattgtgcgcgtttagagtcgtatacgcgttttgaggtagtgaggggttcggtattttttatttttagttcgtcgggttttttcggtttttttcgttcggggcgttgttgcgacggcgacggtcgtcgttttagaattcgtatcgtcgcggtttcgcgttttttcgtttcgcggcggcgtttaacgttttcgcgcgcgttattcgttttcgcgcgattggttgtttttcgcgacgttcgcgcgttttgaaggtcgtagcgttagtcggtttttttcgtcggggaaaggagtgcggttagggtttggcgttcgtagttgggtagattttcggtcgtttttgaggcggggacgaagggcgcgattcgttgcggttatagcgggttacgggttgcgggtttcgttttgggtttggggagtagattcgagtcgattacgtt

SEQ ID NO: 20044 - DNA, 1063 bp, Artificial Sequence
  chemically treated genomic DNA (Homo sapiens) CpG-island No: 20044
aacgtaatcgactcgaatctactccccaaacccaaaacgaaacccgcaacccgtaacccgctataaccgcaacgaatcgcgcccttcgtccccgcctcaaaaacgaccgaaaatctacccaactacgaacgccaaaccctaaccgcactcctttccccgacgaaaaaaaccgactaacgctacgaccttcaaaacgcgcgaacgtcgcgaaaaacaaccaatcgcgcgaaaacgaataacgcgcgcgaaaacgttaaacgccgccgcgaaacgaaaaaacgcgaaaccgcgacgatacgaattctaaaacgacgaccgtcgccgtcgcaacaacgccccgaacgaaaaaaaccgaaaaaacccgacgaactaaaaataaaaaataccgaacccctcactacctcaaaacgcgtatacgactctaaacgcgcacaataacgataacgacacccctaacccgacaacgccgaaaccgcttcgccaaacaaccaacgaccgacgacaaaccgaaccataaacgacaaaaaccgaaccgaacctcgctaaccctaactccgcgcgacaacttccccaatttccgctccgatctctcgacataaaaatccgcccgaacccgaaactacgactaccccaaacccgccgcacgctaacgcgctccgaacccgcgaaaccgcgatactaatacctacgccgcactacgccgcccgcccgtccgctatataccccgaaaacgcgaccataaaaataataaataacttcgaatacaacaaaaaaaatctcgtaaaacacgaaaccttcgccgtaatcttccgaaaacgacaccgccaaataaacgccgaccgaaacgaaaccgaaccccgaacgacaaacacgaaactaaataattctaaaacttaacgcaaccgcgaaccgaaacccccgactcgactaaccgcccgaatatactattatacgcgcaacccgtctcgccgtttattttaatcctataaaaattattataaaacccaaacctctaacaacgctccgcctaccgaccgactactactaatcctcctatataccc

SEQ ID NO: 20045 - DNA, 979 bp, Artificial Sequence
  chemically treated genomic DNA (Homo sapiens) CpG-island No: 20045
acggagtatcggggaggaatcgtggggtgcgtaggcgtcggagcgttcgggttcggttcggatcgaaggtttgcgcggtgaaggtgtggtgtttgtgtttcggggaaagggttgttttttcgggggattgtttcgtagcgaggtttgttttgttcgtagttgggcgttttttggggagcgattgagcgtaagggcgggtcgggaggcgcgaggcgagtacgatgttttagggttttaaggattcgtgtgcgtgtgcgtgtgtaaagtggggcggtgtagggcgtgtgtacggtacgggcgagacgcgcgtcggtgcgggcgtcgggcgtcgtcgggcgtaattatagtataaagttcgggcgtcgcggggcgttggttcggagaatttatcggacgcgtagaatcggatcggtatttttttcgttagtattttaacgcggagttatagcgtttagggatcggagggtaggcggcggcggtaaaggatattacgtaagtttttacgtaattttttcgagtagtgtaagtttttaggattggcgcgcgtttcggttattcggagcgcgtatcgttcgtatttcggcgcgtttttcgcgcggtgtagggaattatagcgcgggcgggtattaaggggaaaggaggaggcgtggtttggtcgaggagttaatgggtcgggaggggcgcgcgggggaggagtttaggtgtagagtgtcgattggttagttcgtttttcggtatgtagatacggtgggagttacgtgttaggggtcgggacgattttttgttggaggttaacgcggggcggggaagggggcgcgagcgtttcgtttggttgaagcggggggaggggggtttttgttagttagagtaataagatggtcgcggtggtagttttttattttagcgcgacggtttcggggagtcgtagtcgttcgtcggtcgggttcgtcggcggggtaattttgagcgtcgtttcggt

SEQ ID NO: 20046 - DNA, 979 bp, Artificial Sequence
  chemically treated genomic DNA (Homo sapiens) CpG-island No: 20046
accgaaacgacgctcaaaattaccccgccgacgaacccgaccgacgaacgactacgactccccgaaaccgtcgcgctaaaataaaaaactaccaccgcgaccatcttattactctaactaacaaaaacccccctccccccgcttcaaccaaacgaaacgctcgcgcccccttccccgccccgcgttaacctccaacaaaaaatcgtcccgacccctaacacgtaactcccaccgtatctacataccgaaaaacgaactaaccaatcgacactctacacctaaactcctcccccgcgcgcccctcccgacccattaactcctcgaccaaaccacgcctcctcctttccccttaatacccgcccgcgctataattccctacaccgcgcgaaaaacgcgccgaaatacgaacgatacgcgctccgaataaccgaaacgcgcgccaatcctaaaaacttacactactcgaaaaaattacgtaaaaacttacgtaatatcctttaccgccgccgcctaccctccgatccctaaacgctataactccgcgttaaaatactaacgaaaaaaataccgatccgattctacgcgtccgataaattctccgaaccaacgccccgcgacgcccgaactttatactataattacgcccgacgacgcccgacgcccgcaccgacgcgcgtctcgcccgtaccgtacacacgccctacaccgccccactttacacacgcacacgcacacgaatccttaaaaccctaaaacatcgtactcgcctcgcgcctcccgacccgcccttacgctcaatcgctccccaaaaaacgcccaactacgaacaaaacaaacctcgctacgaaacaatcccccgaaaaaacaaccctttccccgaaacacaaacaccacaccttcaccgcgcaaaccttcgatccgaaccgaacccgaacgctccgacgcctacgcaccccacgattcctccccgatactccgt

SEQ ID NO: 20047 - DNA, 979 bp, Artificial Sequence
  chemically treated genomic DNA (Homo sapiens) CpG-island No: 20047
gtcggggcggcgtttaagattgtttcgtcggcgggttcggtcggcgggcggttacggtttttcggggtcgtcgcgttgaggtggggagttgttatcgcggttattttgttgttttaattgataagaattttttttttttcgttttagttagacggggcgttcgcgttttttttttcgtttcgcgttggtttttaataggaagtcgtttcggtttttagtacgtgatttttatcgtatttgtatatcggagggcgaattggttaatcggtattttgtatttgagtttttttttcgcgcgtttttttcggtttattggtttttcggttaggttacgtttttttttttttttttaatattcgttcgcgttgtggttttttgtatcgcgcggggagcgcgtcggggtgcgagcggtgcgcgtttcgagtggtcgggacgcgcgttagttttgggagtttgtattgttcgggggggttacgtggagatttgcgtggtgttttttatcgtcgtcgtttgtttttcggtttttgggcgttgtggtttcgcgttagggtgttggcgggaggggtgtcgattcggttttgcgcgttcggtgggtttttcgggttagcgtttcgcggcgttcgggttttatgttgtaattgcgttcggcggcgttcggcgttcgtatcggcgcgcgtttcgttcgtgtcgtgtatacgttttgtatcgttttattttgtatacgtatacgtatacgagtttttggggttttggagtatcgtgttcgtttcgcgtttttcggttcgtttttgcgtttagtcgttttttagggagcgtttagttgcgagtaaaataagtttcgttgcgaaatagtttttcggggagatagtttttttttcggagtatagatattatatttttatcgcgtaagttttcggttcgggtcgaattcgggcgtttcggcgtttacgtattttacgattttttttcggtgtttcgt

SEQ ID NO: 20048 - DNA, 979 bp, Artificial Sequence
  chemically treated genomic DNA (Homo sapiens) CpG-island No: 20048
acgaaacaccgaaaaaaaatcgtaaaatacgtaaacgccgaaacgcccgaattcgacccgaaccgaaaacttacgcgataaaaatataatatctatactccgaaaaaaaaactatctccccgaaaaactatttcgcaacgaaacttattttactcgcaactaaacgctccctaaaaaacgactaaacgcaaaaacgaaccgaaaaacgcgaaacgaacacgatactccaaaaccccaaaaactcgtatacgtatacgtatacaaaataaaacgatacaaaacgtatacacgacacgaacgaaacgcgcgccgatacgaacgccgaacgccgccgaacgcaattacaacataaaacccgaacgccgcgaaacgctaacccgaaaaacccaccgaacgcgcaaaaccgaatcgacacccctcccgccaacaccctaacgcgaaaccacaacgcccaaaaaccgaaaaacaaacgacgacgataaaaaacaccacgcaaatctccacgtaacccccccgaacaatacaaactcccaaaactaacgcgcgtcccgaccactcgaaacgcgcaccgctcgcaccccgacgcgctccccgcgcgatacaaaaaaccacaacgcgaacgaatattaaaaaaaaaaaaaaaaacgtaacctaaccgaaaaaccaataaaccgaaaaaaacgcgcgaaaaaaaaactcaaatacaaaataccgattaaccaattcgccctccgatatacaaatacgataaaaatcacgtactaaaaaccgaaacgacttcctattaaaaaccaacgcgaaacgaaaaaaaaaacgcgaacgccccgtctaactaaaacgaaaaaaaaaaaattcttatcaattaaaacaacaaaataaccgcgataacaactccccacctcaacgcgacgaccccgaaaaaccgtaaccgcccgccgaccgaacccgccgacgaaacaatcttaaacgccgccccgac

SEQ ID NO: 20049 - DNA, 720 bp, Artificial Sequence
  chemically treated genomic DNA (Homo sapiens) CpG-island No: 20049
tgatagggtagttttagcgttcgtcgcgttttcgtcgtcgttatcgtcgtagtagtcgcgggttcgttcgagtcggaggcggagggagcggagcggtttcgcgtttagtcgttcgtagttgttatcgtcgtcgtcgtcgtcgtttaggattcggatttcgtcggagtcgtatttcgtcgggcgtgaggaggaggacgcgtcgcggcgttgtcggggtcggatttggatttgtcgggacgcgtcgtcgtttattcgttcgcgtcgtcgtcgtagtcgtcgtcgtcgttcgcgtcgggatttgagttcgtggcgtcggcgttgagcgggttttcgtcgttcgcgtattttcgaggttttcgggcggttgttcgtgtcgtcgtcgtcgttaggttcgcgttatcggagtttcgcggagtcgtcgtcgtcgtcggggacggagtttaggtgagcgcggtagttcgttcgtttttcgtcgtagtcgtaattttgtcgggaggttcgcgggttttttgttcggtcgagtcgagtcggggcgggcgttggtttttagcgattcgcgtgcggcgttaggtttcgggtcggtcgggtttgaggggagcggcgggaagcggtcggggtcggggcgcgtgtgtgttagtgtgagacggggttgtgtagacgttcggtgtgtattataattaaacgggagtggaatggagggttgaagatggatgtgttttt

SEQ ID NO: 20050 - DNA, 720 bp, Artificial Sequence
  chemically treated genomic DNA (Homo sapiens) CpG-island No: 20050
aaaaacacatccatcttcaaccctccattccactcccgtttaattataatacacaccgaacgtctacacaaccccgtctcacactaacacacacgcgccccgaccccgaccgcttcccgccgctcccctcaaacccgaccgacccgaaacctaacgccgcacgcgaatcgctaaaaaccaacgcccgccccgactcgactcgaccgaacaaaaaacccgcgaacctcccgacaaaattacgactacgacgaaaaacgaacgaactaccgcgctcacctaaactccgtccccgacgacgacgacgactccgcgaaactccgataacgcgaacctaacgacgacgacgacacgaacaaccgcccgaaaacctcgaaaatacgcgaacgacgaaaacccgctcaacgccgacgccacgaactcaaatcccgacgcgaacgacgacgacgactacgacgacgacgcgaacgaataaacgacgacgcgtcccgacaaatccaaatccgaccccgacaacgccgcgacgcgtcctcctcctcacgcccgacgaaatacgactccgacgaaatccgaatcctaaacgacgacgacgacgacgataacaactacgaacgactaaacgcgaaaccgctccgctccctccgcctccgactcgaacgaacccgcgactactacgacgataacgacgacgaaaacgcgacgaacgctaaaactaccctatca

SEQ ID NO: 20051 - DNA, 720 bp, Artificial Sequence
  chemically treated genomic DNA (Homo sapiens) CpG-island No: 20051
gggggtatatttatttttagttttttattttattttcgtttgattgtgatgtatatcgggcgtttgtatagtttcgttttatattagtatatacgcgtttcggtttcggtcgtttttcgtcgttttttttaaattcggtcggttcggggtttggcgtcgtacgcgggtcgttaggggttagcgttcgtttcggttcggttcggtcgaataaagggttcgcgaatttttcggtaaagttgcggttgcggcgaggagcgggcggattgtcgcgtttatttgggtttcgttttcggcggcggcggcggtttcgcggggtttcggtggcgcgggtttggcggcggcggcggtacgaataatcgttcgagggtttcgggagtgcgcgggcggcgggggttcgtttagcgtcggcgttacggatttaggtttcggcgcgggcggcggcggcggttgcggcggcggcgcgggcgagtgggcggcggcgcgtttcggtaggtttaggttcggtttcggtaacgtcgcgacgcgtttttttttttacgttcggcgggatgcggtttcggcggggttcgggttttaggcggcggcggcggcggcggtggtagttgcggacggttgggcgcggggtcgtttcgtttttttcgttttcggttcgggcgggttcgcggttattgcgacggtgacggcggcgggagcgcggcgggcgttgggattgttttgtta

SEQ ID NO: 20052 - DNA, 720 bp, Artificial Sequence
  chemically treated genomic DNA (Homo sapiens) CpG-island No: 20052
taacaaaacaatcccaacgcccgccgcgctcccgccgccgtcaccgtcgcaataaccgcgaacccgcccgaaccgaaaacgaaaaaaacgaaacgaccccgcgcccaaccgtccgcaactaccaccgccgccgccgccgccgcctaaaacccgaaccccgccgaaaccgcatcccgccgaacgtaaaaaaaaaaacgcgtcgcgacgttaccgaaaccgaacctaaacctaccgaaacgcgccgccgcccactcgcccgcgccgccgccgcaaccgccgccgccgcccgcgccgaaacctaaatccgtaacgccgacgctaaacgaacccccgccgcccgcgcactcccgaaaccctcgaacgattattcgtaccgccgccgccgccaaacccgcgccaccgaaaccccgcgaaaccgccgccgccgccgaaaacgaaacccaaataaacgcgacaatccgcccgctcctcgccgcaaccgcaactttaccgaaaaattcgcgaaccctttattcgaccgaaccgaaccgaaacgaacgctaacccctaacgacccgcgtacgacgccaaaccccgaaccgaccgaatttaaaaaaaacgacgaaaaacgaccgaaaccgaaacgcgtatatactaatataaaacgaaactatacaaacgcccgatatacatcacaatcaaacgaaaataaaataaaaaactaaaaataaatataccccc

SEQ ID NO: 20053 - DNA, 786 bp, Artificial Sequence
  chemically treated genomic DNA (Homo sapiens) CpG-island No: 20053
tttttcgtttatttttttagtagcgttttttcgtcgttttttttttttttttttttttttttatcgttttttttcggtttattatcgttaatcgtttttttttttatttcgtatttttttttttttatgtttgttttagttttttttttattttttttttttttttttatcgttttttttttatttttttttttttttttaatcgtcgttttttttagttttttttttatttttttgtcgtttttatatttttattttttcgtagtagcgtttttttgtcgcgtttttttttttttttattatttttttttttttttttttatcgttttttttttacgtttttttttttttattgtttttttttcgcgttttttttataatcgttttgtttttcgtttttttttttttatatcgttttttttttatgtttttttatcgtttcgtagtagcgtttgttagtcgtaattttttttttattttttttttttttttttttatcgttttttttttttagttttttatttttcgttattttttttttttttttattttttcgtagtagcgattttttgtcgcgttttttttttttcgtatttttttttttttttttttattttttatcgttttcgttttcgatcgtttttttgtttatttttttttcgcgttttttaattgttttttatttagaagcgttttacgcgtgcgttcgtttgtgtttttgcgtttggtgtgtttgtgcgtttagttagttttatgagttgggtttttgagtttcgttttaatagt

SEQ ID NO: 20054 - DNA, 786 bp, Artificial Sequence
  chemically treated genomic DNA (Homo sapiens) CpG-island No: 20054
actattaaaacgaaactcaaaaacccaactcataaaactaactaaacgcacaaacacaccaaacgcaaaaacacaaacgaacgcacgcgtaaaacgcttctaaataaaaaacaattaaaaaacgcgaaaaaaaaataaacaaaaaaacgatcgaaaacgaaaacgataaaaaataaaaaaaaaaaaaaaaaaatacgaaaaaaaaaaaacgcgacaaaaaatcgctactacgaaaaaataaaaaaaaaaaaaaaataacgaaaaataaaaaactaaaaaaaaaaaacgataaaaaaaaaaaaaaaaaaaataaaaaaaaaattacgactaacaaacgctactacgaaacgataaaaaaacataaaaaaaaaacgatataaaaaaaaaaaaacgaaaaacaaaacgattataaaaaaaacgcgaaaaaaaaacaataaaaaaaaaaaaacgtaaaaaaaaaacgataaaaaaaaaaaaaaaaaaataataaaaaaaaaaaaaaacgcgacaaaaaaacgctactacgaaaaaataaaaatataaaaacgacaaaaaaataaaaaaaaaactaaaaaaaacgacgattaaaaaaaaaaaaaaaaataaaaaaaaaacgataaaaaaaaaaaaaaaaaataaaaaaaaaactaaaacaaacataaaaaaaaaaaaatacgaaataaaaaaaaaaacgattaacgataataaaccgaaaaaaaacgataaaaaaaaaaaaaaaaaaaaaaaaaacgacgaaaaaacgctactaaaaaaataaacgaaaaa

SEQ ID NO: 20055 - DNA, 786 bp, Artificial Sequence
  chemically treated genomic DNA (Homo sapiens) CpG-island No: 20055
gttgttggggcggagtttaggggtttagtttatggggttggttgggcgtatagatatattaggcgtagggatataggcgggcgtacgcgtggagcgtttttaggtgaaaggtagttggagagcgcgagaagggggtgggtaagaagacgatcgggggcgaagacggtggggagtggaagaggggagaagagggtgcggggagagaaaaacgcggtaggaagtcgttgttgcgagaaggtggggaggggaagaagatggcggagaataagaggttggggaaaaaagacgatgggagggggagagaagaaagtgggaagaagattgcgattgatagacgttgttgcgagacggtgggaggatatgggaagaaaacggtgtgaggggaagaaaacgggggataaaacggttgtggggaaggcgcggggagaagatagtgaggagaagagggcgtggggagaggacggtggggaagaggaagagaagatggtgaggggagagaaaagcgcggtaggaagacgttgttgcgagaaggtggggatatggaggcggtaagaaaatggagaagaggttgggaaagacgacgattgggagaggagaagagggtgggaagaaggcgatggggagaggagaagagggtgggaagaagattaaggtagatatgggaagaaaagggtgcggggtgaggaagaaaacggttggcggtaataggtcgggagaagacggtgaggagggggaggggagaagagggagcggcgggaagacgttgttgggggaataggcgggaag

SEQ ID NO: 20056 - DNA, 786 bp, Artificial Sequence
  chemically treated genomic DNA (Homo sapiens) CpG-island No: 20056
cttcccgcctattcccccaacaacgtcttcccgccgctccctcttctcccctccccctcctcaccgtcttctcccgacctattaccgccaaccgttttcttcctcaccccgcacccttttcttcccatatctaccttaatcttcttcccaccctcttctcctctccccatcgccttcttcccaccctcttctcctctcccaatcgtcgtctttcccaacctcttctccattttcttaccgcctccatatccccaccttctcgcaacaacgtcttcctaccgcgcttttctctcccctcaccatcttctcttcctcttccccaccgtcctctccccacgccctcttctcctcactatcttctccccgcgccttccccacaaccgttttatcccccgttttcttcccctcacaccgttttcttcccatatcctcccaccgtctcgcaacaacgtctatcaatcgcaatcttcttcccactttcttctctccccctcccatcgtcttttttccccaacctcttattctccgccatcttcttcccctccccaccttctcgcaacaacgacttcctaccgcgtttttctctccccgcaccctcttctcccctcttccactccccaccgtcttcgcccccgatcgtcttcttacccacccccttctcgcgctctccaactacctttcacctaaaaacgctccacgcgtacgcccgcctatatccctacgcctaatatatctatacgcccaaccaaccccataaactaaacccctaaactccgccccaacaac

SEQ ID NO: 20057 - DNA, 703 bp, Artificial Sequence
  chemically treated genomic DNA (Homo sapiens) CpG-island No: 20057
agtcgtttttttttttcgggcgcgttgtttgtttgcgtgcgtcgggacgcgcggggtcgagcgtttgaagcgcgttcgtacgcggagcggcgttttttaggagtttcgtttttaggtgcgttttgtaggaggcggggcgcgatttcggcgtcgttagttttgtttgcgttaggagcgcgcgggtgcgcgcggtcgcgttttcgtatagattttagttgggttattcgtattgagttaatagattgagcgcgtttaggtttgatagttttgcggttcgggttttgaggtgaggcgggcgtcgcgggcggcggcggcgtttgaggttagtttgggatagtcgtttttgggggagttgaggggacgaggaggggttggttagcgagggacggcggggagagaaggggagttcggcgtttgaggtgtggggtgaagcgggttcggaagcgggtagaggcggcgagttgagggaaatagattttttttagttttcgggaagcgcgggttgttagtttcggggatgcggtgggagcgtttaggatgcggacgtgagggggtcggggttttgcggcgggggtttcgcgaggtttttttgggatcgggttcggtcgtgggatttcgggatattgtttttgtttggacgttgtcgttttatttttagtaattttagggaaagaaggaaaataaatattgatgtaaattttcg

SEQ ID NO: 20058 - DNA, 703 bp, Artificial Sequence
  chemically treated genomic DNA (Homo sapiens) CpG-island No: 20058
cgaaaatttacatcaatatttattttccttctttccctaaaattactaaaaataaaacgacaacgtccaaacaaaaacaatatcccgaaatcccacgaccgaacccgatcccaaaaaaacctcgcgaaacccccgccgcaaaaccccgaccccctcacgtccgcatcctaaacgctcccaccgcatccccgaaactaacaacccgcgcttcccgaaaactaaaaaaaatctatttccctcaactcgccgcctctacccgcttccgaacccgcttcaccccacacctcaaacgccgaactccccttctctccccgccgtccctcgctaaccaacccctcctcgtcccctcaactcccccaaaaacgactatcccaaactaacctcaaacgccgccgccgcccgcgacgcccgcctcacctcaaaacccgaaccgcaaaactatcaaacctaaacgcgctcaatctattaactcaatacgaataacccaactaaaatctatacgaaaacgcgaccgcgcgcacccgcgcgctcctaacgcaaacaaaactaacgacgccgaaatcgcgccccgcctcctacaaaacgcacctaaaaacgaaactcctaaaaaacgccgctccgcgtacgaacgcgcttcaaacgctcgaccccgcgcgtcccgacgcacgcaaacaaacaacgcgcccgaaaaaaaaaaacgact

SEQ ID NO: 20059 - DNA, 703 bp, Artificial Sequence
  chemically treated genomic DNA (Homo sapiens) CpG-island No: 20059
cggaaatttatattaatatttgttttttttttttttttgaggttgttgagggtggaacgatagcgtttaggtaaaggtagtgtttcgaagttttacggtcggattcggttttaggggagtttcgcggagttttcgtcgtagggtttcgatttttttacgttcgtattttgggcgtttttatcgtattttcgaggttggtaattcgcgtttttcgggagttgagggaggtttgttttttttagttcgtcgtttttgttcgttttcgagttcgttttattttatattttagacgtcgaatttttttttttttttcgtcgtttttcgttggttagttttttttcgtttttttaatttttttagggacggttgttttaggttagttttaagcgtcgtcgtcgttcgcgacgttcgttttattttagggttcgagtcgtagagttgttaggtttggacgcgtttagtttgttgatttagtgcgggtgatttagttgggatttgtgcgagggcgcggtcgcgcgtattcgcgcgtttttggcgtaggtagagttggcggcgtcgaagtcgcgtttcgttttttgtagagcgtatttgagggcggggtttttagaaagcgtcgtttcgcgtacgggcgcgttttagacgttcggtttcgcgcgtttcggcgtacgtaggtaagtagcgcgttcggaagaggagagcggtt

SEQ ID NO: 20060 - DNA, 703 bp, Artificial Sequence
  chemically treated genomic DNA (Homo sapiens) CpG-island No: 20060
aaccgctctcctcttccgaacgcgctacttacctacgtacgccgaaacgcgcgaaaccgaacgtctaaaacgcgcccgtacgcgaaacgacgctttctaaaaaccccgccctcaaatacgctctacaaaaaacgaaacgcgacttcgacgccgccaactctacctacgccaaaaacgcgcgaatacgcgcgaccgcgccctcgcacaaatcccaactaaatcacccgcactaaatcaacaaactaaacgcgtccaaacctaacaactctacgactcgaaccctaaaataaaacgaacgtcgcgaacgacgacgacgcttaaaactaacctaaaacaaccgtccctaaaaaaattaaaaaaacgaaaaaaaactaaccaacgaaaaacgacgaaaaaaaaaaaaaaattcgacgtctaaaatataaaataaaacgaactcgaaaacgaacaaaaacgacgaactaaaaaaaacaaacctccctcaactcccgaaaaacgcgaattaccaacctcgaaaatacgataaaaacgcccaaaatacgaacgtaaaaaaatcgaaaccctacgacgaaaactccgcgaaactcccctaaaaccgaatccgaccgtaaaacttcgaaacactacctttacctaaacgctatcgttccaccctcaacaacctcaaaaaaaaaaaaaaaacaaatattaatataaatttccg

SEQ ID NO: 20061 - DNA, 1093 bp, Artificial Sequence
  chemically treated genomic DNA (Homo sapiens) CpG-island No: 20061
ggggcgcgaaaaagcgaggggcgacgttgttcgtggtttcgggtgttcggcgtttcgcggttttcgttatcgttatttacgtcgggttaggatcgattaggttaggtcgagggcggtttttgattacgcgttttttgttttttagttttcgggcggcggttttcgtaggttcggtatagttgtatagttcgcggtttttaggtatcggcgggtttttggaggggaagcgattgatatagttgtttgtattgcgttattcgttcggttgtttattttcgtggtatttgcgtttttcggttgggtcgggagttagaagtggttgtcgagatcgggagggttcggttagtcgttcgttttcgttttcgcgtttggttttcggttcgcgatttcgcggatttggattataattttcgtcgggtttcgcggtcgggttaatggcgggcgtcggagtatgcggggcgtagcgtttgcgcggcggtttgagtaagcggttgcgcgattggttgcggggtcgggcggtcgcgcggggattgtgggaagcggagtgacggagcgagcggttgttggaggaaggaggtgggggtcgggagcgtaaatggcgttgagatggtttagggttttgtttaaattttagtattgattatttatcggcggaagcggcggcgtaggaggcggcggcggtttagcgggggtatatagtaggttttgttattagttttagtagtggcggttagcgagagttaggtttgggttcggtcggcggcgttcgaggcggggagggaagttgcggggtcgtcgtttttgtttttttaatcgggttttttatttatcgaaagtagagtttttcgtttttttcggtttttatttgtcggttttgttttttcgcgcgagggtttcgcgttcgttcgcgggtcgtagggagcgggagaggcggaggcggttcgtggttaaagtattcgttaggtttcgagggtaagtgaggtgtcgggcggtcgtttaggtcgggagggagtcgggagggtgggggaggtagaggttgggagcgggcggtggaagttttattgtttcgtttatcgggtcgttgaggaagttg

SEQ ID NO: 20062 - DNA, 1093 bp, Artificial Sequence
  chemically treated genomic DNA (Homo sapiens) CpG-island No: 20062
caacttcctcaacgacccgataaacgaaacaataaaacttccaccgcccgctcccaacctctacctcccccaccctcccgactccctcccgacctaaacgaccgcccgacacctcacttaccctcgaaacctaacgaatactttaaccacgaaccgcctccgcctctcccgctccctacgacccgcgaacgaacgcgaaaccctcgcgcgaaaaaacaaaaccgacaaataaaaaccgaaaaaaacgaaaaactctactttcgataaataaaaaacccgattaaaaaaacaaaaacgacgaccccgcaacttccctccccgcctcgaacgccgccgaccgaacccaaacctaactctcgctaaccgccactactaaaactaataacaaaacctactatatacccccgctaaaccgccgccgcctcctacgccgccgcttccgccgataaataatcaatactaaaatttaaacaaaaccctaaaccatctcaacgccatttacgctcccgacccccacctccttcctccaacaaccgctcgctccgtcactccgcttcccacaatccccgcgcgaccgcccgaccccgcaaccaatcgcgcaaccgcttactcaaaccgccgcgcaaacgctacgccccgcatactccgacgcccgccattaacccgaccgcgaaacccgacgaaaattataatccaaatccgcgaaatcgcgaaccgaaaaccaaacgcgaaaacgaaaacgaacgactaaccgaaccctcccgatctcgacaaccacttctaactcccgacccaaccgaaaaacgcaaataccacgaaaataaacaaccgaacgaataacgcaatacaaacaactatatcaatcgcttcccctccaaaaacccgccgatacctaaaaaccgcgaactatacaactataccgaacctacgaaaaccgccgcccgaaaactaaaaaacaaaaaacgcgtaatcaaaaaccgccctcgacctaacctaatcgatcctaacccgacgtaaataacgataacgaaaaccgcgaaacgccgaacacccgaaaccacgaacaacgtcgcccctcgctttttcgcgcccc

SEQ ID NO: 20063 - DNA, 1093 bp, Artificial Sequence
  chemically treated genomic DNA (Homo sapiens) CpG-island No: 20063
taatttttttagcggttcggtgggcgaggtagtgagatttttatcgttcgtttttagtttttgttttttttattttttcggttttttttcggtttaggcggtcgttcgatattttatttattttcggagtttggcgggtgttttggttacgggtcgttttcgtttttttcgttttttacggttcgcgggcgggcgcggaattttcgcgcgggagagtagggtcggtaggtgagagtcgagagaggcgagggattttgttttcggtaaataggaagttcggttgggggggtaggagcggcggtttcgtaattttttttttcgtttcgagcgtcgtcggtcgggtttaggtttagttttcgttggtcgttattgttggagttggtaatagagtttgttgtgtgttttcgttgggtcgtcgtcgttttttgcgtcgtcgttttcgtcggtgaatggttagtgttggagtttgaatagggttttgaattattttaacgttatttgcgttttcggtttttattttttttttttaatagtcgttcgtttcgttatttcgttttttatagttttcgcgcggtcgttcgatttcgtagttaatcgcgtagtcgtttatttaaatcgtcgcgtaggcgttgcgtttcgtatgtttcggcgttcgttattggttcggtcgcggagttcgacgggagttgtagtttaggttcgcgaggtcgcgggtcgaggattaggcgcgggagcgggagcgggcgattggtcgggttttttcggtttcggtagttatttttagttttcggtttagtcgggagacgtaggtgttacggagatgggtagtcgggcgggtggcgtagtgtaggtagttgtattaatcgttttttttttagggattcgtcggtgtttggggatcgcgggttgtgtagttgtgtcgggtttgcggaggtcgtcgttcgggagttgggaggtagggggcgcgtggttaagagtcgttttcgatttggtttggtcggttttggttcggcgtaggtgacgatggcggggatcgcgaggcgtcggatattcgaggttacgagtagcgtcgtttttcgttttttcgcgtttt

SEQ ID NO: 20064 - DNA, 1093 bp, Artificial Sequence
  chemically treated genomic DNA (Homo sapiens) CpG-island No: 20064
aaaacgcgaaaaaacgaaaaacgacgctactcgtaacctcgaatatccgacgcctcgcgatccccgccatcgtcacctacgccgaaccaaaaccgaccaaaccaaatcgaaaacgactcttaaccacgcgccccctacctcccaactcccgaacgacgacctccgcaaacccgacacaactacacaacccgcgatccccaaacaccgacgaatccctaaaaaaaaaacgattaatacaactacctacactacgccacccgcccgactacccatctccgtaacacctacgtctcccgactaaaccgaaaactaaaaataactaccgaaaccgaaaaaacccgaccaatcgcccgctcccgctcccgcgcctaatcctcgacccgcgacctcgcgaacctaaactacaactcccgtcgaactccgcgaccgaaccaataacgaacgccgaaacatacgaaacgcaacgcctacgcgacgatttaaataaacgactacgcgattaactacgaaatcgaacgaccgcgcgaaaactataaaaaacgaaataacgaaacgaacgactattaaaaaaaaaaaataaaaaccgaaaacgcaaataacgttaaaataattcaaaaccctattcaaactccaacactaaccattcaccgacgaaaacgacgacgcaaaaaacgacgacgacccaacgaaaacacacaacaaactctattaccaactccaacaataacgaccaacgaaaactaaacctaaacccgaccgacgacgctcgaaacgaaaaaaaaaattacgaaaccgccgctcctacccccccaaccgaacttcctatttaccgaaaacaaaatccctcgcctctctcgactctcacctaccgaccctactctcccgcgcgaaaattccgcgcccgcccgcgaaccgtaaaaaacgaaaaaaacgaaaacgacccgtaaccaaaacacccgccaaactccgaaaataaataaaatatcgaacgaccgcctaaaccgaaaaaaaaccgaaaaaataaaaaaaacaaaaactaaaaacgaacgataaaaatctcactacctcgcccaccgaaccgctaaaaaaatta

SEQ ID NO: 20065 - DNA, 901 bp, Artificial Sequence
  chemically treated genomic DNA (Homo sapiens) CpG-island No: 20065
atattcggtttttattacgggtgggtgtttaattttcgagaattcgtacgttgggtattatatagggtgaaagtgggagtcgggagcggtgtacgtgtttttcgaaattaagacggataataagaataaattcgggttttaagggtcgttttattttttttttcgcgtttttaattagacggggcgttatcgtttcgaagttcgtagataaagcgttttcggggcggagaggagggattagtttaaagtatttggggttgtatataaaagagggaggggcgcgaggggcggcgcgaagcgagaggtcgcggtatttatttattgagttcgaggagtttttgcgtttgggcgcggtcggggtggaggggggcgcggcgggagtcggggttggcggggtttatacgggttttgtttgggggtttacgttggtcgggggaggagggggaggtcgggtcggaggttcgtcgtttttagggagtttggagggcgagattgcggtagtagatagcggggatggcgcgggtacggtcgacgatatcgggttcgggttttaagacggttgtcgtttcggggcgacggggggagcggtcggtaggggttttcggggcgtcggcggtacgaagttattttcgaagtttattaggggcgcgtcggcggtaggggcggtgggtattggggtcgcggatagttcggcggcgggttttttttttagtatttttagtttttttaggttttcgttttcgtttttttttttttttttttttttttttttttcgttttcgggtttttttacgaattggtatttgaacgcgggttgcggtcggggtgggttgttcgaggacgagattagaggagattggtttaggttttttatggttggagggtggagatgatgttgtag

SEQ ID NO: 20066 - DNA, 901 bp, Artificial Sequence
  chemically treated genomic DNA (Homo sapiens) CpG-island No: 20066
ctacaacatcatctccaccctccaaccataaaaaacctaaaccaatctcctctaatctcgtcctcgaacaacccaccccgaccgcaacccgcgttcaaataccaattcgtaaaaaaacccgaaaacgaaaaaaaaaaaaaaaaaaaaaaaaaaaaaaacgaaaacgaaaacctaaaaaaactaaaaatactaaaaaaaaaacccgccgccgaactatccgcgaccccaatacccaccgcccctaccgccgacgcgcccctaataaacttcgaaaataacttcgtaccgccgacgccccgaaaacccctaccgaccgctccccccgtcgccccgaaacgacaaccgtcttaaaacccgaacccgatatcgtcgaccgtacccgcgccatccccgctatctactaccgcaatctcgccctccaaactccctaaaaacgacgaacctccgacccgacctccccctcctcccccgaccaacgtaaacccccaaacaaaacccgtataaaccccgccaaccccgactcccgccgcgcccccctccaccccgaccgcgcccaaacgcaaaaactcctcgaactcaataaataaataccgcgacctctcgcttcgcgccgcccctcgcgcccctccctcttttatatacaaccccaaatactttaaactaatccctcctctccgccccgaaaacgctttatctacgaacttcgaaacgataacgccccgtctaattaaaaacgcgaaaaaaaaaataaaacgacccttaaaacccgaatttattcttattatccgtcttaatttcgaaaaacacgtacaccgctcccgactcccactttcaccctatataatacccaacgtacgaattctcgaaaattaaacacccacccgtaataaaaaccgaatat

SEQ ID NO: 20067 - DNA, 901 bp, Artificial Sequence
  chemically treated genomic DNA (Homo sapiens) CpG-island No: 20067
ttgtagtattatttttattttttagttatggaagatttggattagttttttttggtttcgttttcggatagtttatttcggtcgtagttcgcgtttaagtattagttcgtgagggagttcgaggacgaggaggaagaagaggaggaggaagaggaggacgaggacgaagatttggaggagttggaggtgttggagaggaagttcgtcgtcgggttgttcgcggttttagtgtttatcgtttttgtcgtcggcgcgtttttgatggatttcggaaatgatttcgtgtcgtcggcgtttcggggatttttgtcggtcgtttttttcgtcgtttcggagcggtagtcgttttgggattcgagttcggtgtcgtcgatcgtgttcgcgttattttcgttgtttgttgtcgtagtttcgttttttaagttttttgaggacgacgagttttcggttcggttttttttttttttttcggttagcgtgagtttttaggtagagttcgtgtggatttcgttagtttcggttttcgtcgcgtttttttttatttcggtcgcgtttaagcgtaggggtttttcgggtttagtgggtgagtgtcgcgatttttcgtttcgcgtcgtttttcgcgttttttttttttttgtgtgtagttttagatgttttgggttggtttttttttttcgtttcgagggcgttttgtttgcggatttcggggcgatggcgtttcgtttggttggaagcgcggggagaagggtggggcggtttttggagttcgggtttgtttttattgttcgttttggtttcggggaatacgtgtatcgttttcggtttttatttttattttgtgtgatgtttagcgtacggattttcggaagttaggtatttattcgtagtaggagtcgggtat

SEQ ID NO: 20068 - DNA, 901 bp, Artificial Sequence
  chemically treated genomic DNA (Homo sapiens) CpG-island No: 20068
atacccgactcctactacgaataaatacctaacttccgaaaatccgtacgctaaacatcacacaaaataaaaataaaaaccgaaaacgatacacgtattccccgaaaccaaaacgaacaataaaaacaaacccgaactccaaaaaccgccccacccttctccccgcgcttccaaccaaacgaaacgccatcgccccgaaatccgcaaacaaaacgccctcgaaacgaaaaaaaaaaaccaacccaaaacatctaaaactacacacaaaaaaaaaaaaaacgcgaaaaacgacgcgaaacgaaaaatcgcgacactcacccactaaacccgaaaaacccctacgcttaaacgcgaccgaaataaaaaaaaacgcgacgaaaaccgaaactaacgaaatccacacgaactctacctaaaaactcacgctaaccgaaaaaaaaaaaaaaaaccgaaccgaaaactcgtcgtcctcaaaaaacttaaaaaacgaaactacgacaacaaacaacgaaaataacgcgaacacgatcgacgacaccgaactcgaatcccaaaacgactaccgctccgaaacgacgaaaaaaacgaccgacaaaaatccccgaaacgccgacgacacgaaatcatttccgaaatccatcaaaaacgcgccgacgacaaaaacgataaacactaaaaccgcgaacaacccgacgacgaacttcctctccaacacctccaactcctccaaatcttcgtcctcgtcctcctcttcctcctcctcttcttcctcctcgtcctcgaactccctcacgaactaatacttaaacgcgaactacgaccgaaataaactatccgaaaacgaaaccaaaaaaaactaatccaaatcttccataactaaaaaataaaaataatactacaa

SEQ ID NO: 20069 - DNA, 605 bp, Artificial Sequence
  chemically treated genomic DNA (Homo sapiens) CpG-island No: 20069
tttcgttacggtttttaaatatatatcgtagtttttttatttatttaataggttttttcgttacggtttttaaatatatatcgtagtttttttatttatttaataggtttttttgttacggtttttaaatatatatcgtagtttttttatttaataggttttttcgttacggtttttaaatatatatcgtagtttttttatttatttaataggttttttcgttacggtttttaaatatatatcgtagtttttttatttatttaataggttttttcgttacggtttttaaatatatatcgtagtttttttatttatttaataggttttttcgttacggtttttaaatatatatcgtagtttttttatttatttaataggttttttcgttacggtttttaaatatatatcgtagtttttttatttatttaataggttttttcgttacggtttttaaatatatatcgtagtttttttatttatttaataggttttttcgttatagtttttaaatatatatcgtagtttttttatttatttaataggttttttcgttacggtttttaaaaaatttttttgtaaagtgttattttttcgagttgtagagt

SEQ ID NO: 20070 - DNA, 605 bp, Artificial Sequence
  chemically treated genomic DNA (Homo sapiens) CpG-island No: 20070
actctacaactcgaaaaaataacactttacaaaaaaattttttaaaaaccgtaacgaaaaaacctattaaataaataaaaaaactacgatatatatttaaaaactataacgaaaaaacctattaaataaataaaaaaactacgatatatatttaaaaaccgtaacgaaaaaacctattaaataaataaaaaaactacgatatatatttaaaaaccgtaacgaaaaaacctattaaataaataaaaaaactacgatatatatttaaaaaccgtaacgaaaaaacctattaaataaataaaaaaactacgatatatatttaaaaaccgtaacgaaaaaacctattaaataaataaaaaaactacgatatatatttaaaaaccgtaacgaaaaaacctattaaataaataaaaaaactacgatatatatttaaaaaccgtaacgaaaaaacctattaaataaaaaaactacgatatatatttaaaaaccgtaacaaaaaaacctattaaataaataaaaaaactacgatatatatttaaaaaccgtaacgaaaaaacctattaaataaataaaaaaactacgatatatatttaaaaaccgtaacgaaa

SEQ ID NO: 20071 - DNA, 605 bp, Artificial Sequence
  chemically treated genomic DNA (Homo sapiens) CpG-island No: 20071
gttttgtaattcgggagggtagtattttgtaagagagttttttagaggtcgtggcgagaggatttgttgggtggatggagggattgcggtgtgtgtttagaggttgtggcgggaggatttgttgggtggatggaggggttgcggtgtgtgtttggaggtcgtggcgggaggatttgttgggtggatggaggggttgcggtgtgtgtttagaggtcgtggcgggaggatttgttgggtggatggaggggttgcggtgtgtgtttggaggtcgtggcgggaggatttgttgggtggatggaggggttgcggtgtgtgtttggaggtcgtggcgggagggtttgttgggtggatggaggggttgcggtgtgtgtttggaggtcgtggcgggagggtttgttgggtggatggaggggttgcggtgtgtgtttggaggtcgtggcgggaggatttgttggatggagggattgcggtgtgtgtttagaggtcgtggtaagaggatttgttgggtggatggaggggttgcggtgtgtgtttggaggtcgtggcgggagggtttgttgggtggatggaggggttgcggtgtgtgtttggaggtcgtggcggga

SEQ ID NO: 20072 - DNA, 605 bp, Artificial Sequence
  chemically treated genomic DNA (Homo sapiens) CpG-island No: 20072
tcccgccacgacctccaaacacacaccgcaacccctccatccacccaacaaaccctcccgccacgacctccaaacacacaccgcaacccctccatccacccaacaaatcctcttaccacgacctctaaacacacaccgcaatccctccatccaacaaatcctcccgccacgacctccaaacacacaccgcaacccctccatccacccaacaaaccctcccgccacgacctccaaacacacaccgcaacccctccatccacccaacaaaccctcccgccacgacctccaaacacacaccgcaacccctccatccacccaacaaatcctcccgccacgacctccaaacacacaccgcaacccctccatccacccaacaaatcctcccgccacgacctctaaacacacaccgcaacccctccatccacccaacaaatcctcccgccacgacctccaaacacacaccgcaacccctccatccacccaacaaatcctcccgccacaacctctaaacacacaccgcaatccctccatccacccaacaaatcctctcgccacgacctctaaaaaactctcttacaaaatactaccctcccgaattacaaaac

SEQ ID NO: 20073 - DNA, 1354 bp, Artificial Sequence
  chemically treated genomic DNA (Homo sapiens) CpG-island No: 20073
ttgcggtggggtgagagtgagttgcggtgcggtgagagtgagttgtcgtgcggtgagtgtgagttgtcgtgcggtgagtgtgagttgtcgtgcggtgagagtgagttgtcgtgcggtaagagtgagttgcggtgcggtgagttagttgtcgtgcggtgagtgtgagttgtcgtgcggtgagagtgagttgtcgtgcggtgagtgtgagttgtcgtgcggtgagagtgagttgtcgtgcggggagagtgagttgtcgtgcggggagagtgagttgcggtgtggtgagagtgagttgtcgtgcggtgagagtgagatgtcgtgcggtgagtgtgagttgcggcgcggtgagagtgagttgtcgtgtggtgagtgttagttgttttgcggtgagagtgagttgtagtgcggtgagagtgagttgtcgtgcggtgagagtgatttgtcgtgcggtgagagtgagttgtcgtgtggtgagagtgagttgtcgtgtggtgtgagttgtcgtgtggtgagagtgagttgtcgtgtggtgtgagttgtcgtgtggtgagagtgagttgtcgtgtggtgagtgtgagttgtcgtgtggtgagtgtgagttgtcgtgcggtgtgagttgtcgtgcggtgagtgtgagttgcggtgtagagagagcgagttgtcgtgcggtgaatgagttgtcgtgcggtgagtgtgagttgtcgtgttgtgagagtgagttgtcgtgcggtgagagtgagttgcggtgcggtgagagtgagttgtcgtgcggtgagagtgagttgtcgtgcggtgagagtgagttgtcgtgcggtgagtgtgagttgtcgtgcggtgagagtgagttgtcgtgcggtgagagtgagttgtcgtgcggtgagtgtgagttgcggtgtagagagagtgagttgtcgtgtggtgagagtgagttgtcgtgtggtgaatgtgagttgtcgtgcggtgagtgtgagttgcggtgtagagagagtgagttgtcgtgtggtgagagtgagttgtcgtgtggtgaatgtgagttgtcgtgcggtgagtgtgagttgcggtgtagagagagtgagttgtcgtgtggtgagagtgagttgtcgtgtggtgagtgtgagttgtcgtgtggtgagagtgagttgtcgtgtggtgagtgtgagttgtcgtgcggtgagtgtgagttgcggcgtggtgagagtgagttgtcgtgcggtgagtgtgagttgcggtgtggtgagagttgtcgtgtggtgagagtgagttgtcgtgcggtgagagtgagttgtcgtgtggtgtgagttgtcgtgtggtgagagtgagttgtcgtgtggtgagagtgagttgtggtgtggtg

SEQ ID NO: 20074 - DNA, 1354 bp, Artificial Sequence
  chemically treated genomic DNA (Homo sapiens) CpG-island No: 20074
caccacaccacaactcactctcaccacacgacaactcactctcaccacacgacaactcacaccacacgacaactcactctcaccgcacgacaactcactctcaccacacgacaactctcaccacaccgcaactcacactcaccgcacgacaactcactctcaccacgccgcaactcacactcaccgcacgacaactcacactcaccacacgacaactcactctcaccacacgacaactcacactcaccacacgacaactcactctcaccacacgacaactcactctctctacaccgcaactcacactcaccgcacgacaactcacattcaccacacgacaactcactctcaccacacgacaactcactctctctacaccgcaactcacactcaccgcacgacaactcacattcaccacacgacaactcactctcaccacacgacaactcactctctctacaccgcaactcacactcaccgcacgacaactcactctcaccgcacgacaactcactctcaccgcacgacaactcacactcaccgcacgacaactcactctcaccgcacgacaactcactctcaccgcacgacaactcactctcaccgcaccgcaactcactctcaccgcacgacaactcactctcacaacacgacaactcacactcaccgcacgacaactcattcaccgcacgacaactcgctctctctacaccgcaactcacactcaccgcacgacaactcacaccgcacgacaactcacactcaccacacgacaactcacactcaccacacgacaactcactctcaccacacgacaactcacaccacacgacaactcactctcaccacacgacaactcacaccacacgacaactcactctcaccacacgacaactcactctcaccgcacgacaaatcactctcaccgcacgacaactcactctcaccgcactacaactcactctcaccgcaaaacaactaacactcaccacacgacaactcactctcaccgcgccgcaactcacactcaccgcacgacatctcactctcaccgcacgacaactcactctcaccacaccgcaactcactctccccgcacgacaactcactctccccgcacgacaactcactctcaccgcacgacaactcacactcaccgcacgacaactcactctcaccgcacgacaactcacactcaccgcacgacaactaactcaccgcaccgcaactcactcttaccgcacgacaactcactctcaccgcacgacaactcacactcaccgcacgacaactcacactcaccgcacgacaactcactctcaccgcaccgcaactcactctcaccccaccgcaa

SEQ ID NO: 20075 - DNA, 1354 bp, Artificial Sequence
  chemically treated genomic DNA (Homo sapiens) CpG-island No: 20075
tattatattatagtttatttttattatacggtagtttatttttattatacggtagtttatattatacggtagtttatttttatcgtacggtagtttatttttattatacggtagtttttattatatcgtagtttatatttatcgtacggtagtttatttttattacgtcgtagtttatatttatcgtacggtagtttatatttattatacggtagtttatttttattatacggtagtttatatttattatacggtagtttatttttattatacggtagtttattttttttgtatcgtagtttatatttatcgtacggtagtttatatttattatacggtaatttatttttattatacggtagtttattttttttgtatcgtagtttatatttatcgtacggtagtttatatttattatacggtaatttatttttattatacggtagtttattttttttgtatcgtagtttatatttatcgtacggtagtttatttttatcgtacggtagtttatttttatcgtacggtagtttatatttatcgtacggtagtttatttttatcgtacggtagtttatttttatcgtacggtagtttatttttatcgtatcgtagtttatttttatcgtacggtagtttatttttatagtacggtagtttatatttatcgtacggtagtttatttatcgtacggtagttcgttttttttgtatcgtagtttatatttatcgtacggtagtttatatcgtacggtagtttatatttattatacggtagtttatatttattatacggtagtttatttttattatacggtagtttatattatacggtagtttatttttattatacggtagtttatattatacggtagtttatttttattatacggtagtttatttttatcgtacggtagattatttttatcgtacggtagtttatttttatcgtattgtagtttatttttatcgtagggtagttgatatttattatacggtagtttatttttatcgcgtcgtagtttatatttatcgtacggtattttatttttatcgtacggtagtttatttttattatatcgtagtttatttttttcgtacggtagtttatttttttcgtacggtagtttatttttatcgtacggtagtttatatttatcgtacggtagtttatttttatcgtacggtagtttatatttatcgtacggtagttgatttatcgtatcgtagtttatttttatcgtacggtagtttatttttatcgtacggtagtttatatttatcgtacggtagtttatatttatcgtacggtagtttatttttatcgtatcgtagtttatttttattttatcgtag

SEQ ID NO: 20076 - DNA, 1354 bp, Artificial Sequence
  chemically treated genomic DNA (Homo sapiens) CpG-island No: 20076
ctacgataaaataaaaataaactacgatacgataaaaataaactaccgtacgataaatataaactaccgtacgataaatataaactaccgtacgataaaaataaactaccgtacgataaaaataaactacgatacgataaatcaactaccgtacgataaatataaactaccgtacgataaaaataaactaccgtacgataaatataaactaccgtacgataaaaataaactaccgtacgaaaaaaataaactaccgtacgaaaaaaataaactacgatataataaaaataaactaccgtacgataaaaataaaataccgtacgataaatataaactacgacgcgataaaaataaactaccgtataataaatatcaactaccctacgataaaaataaactacaatacgataaaaataaactaccgtacgataaaaataatctaccgtacgataaaaataaactaccgtataataaaaataaactaccgtataatataaactaccgtataataaaaataaactaccgtataatataaactaccgtataataaaaataaactaccgtataataaatataaactaccgtataataaatataaactaccgtacgatataaactaccgtacgataaatataaactacgatacaaaaaaaacgaactaccgtacgataaataaactaccgtacgataaatataaactaccgtactataaaaataaactaccgtacgataaaaataaactacgatacgataaaaataaactaccgtacgataaaaataaactaccgtacgataaaaataaactaccgtacgataaatataaactaccgtacgataaaaataaactaccgtacgataaaaataaactaccgtacgataaatataaactacgatacaaaaaaaataaactaccgtataataaaaataaattaccgtataataaatataaactaccgtacgataaatataaactacgatacaaaaaaaataaactaccgtataataaaaataaattaccgtataataaatataaactaccgtacgataaatataaactacgatacaaaaaaaataaactaccgtataataaaaataaactaccgtataataaatataaactaccgtataataaaaataaactaccgtataataaatataaactaccgtacgataaatataaactacgacgtaataaaaataaactaccgtacgataaatataaactacgatataataaaaactaccgtataataaaaataaactaccgtacgataaaaataaactaccgtataatataaactaccgtataataaaaataaactaccgtataataaaaataaactataatataata

SEQ ID NO: 20077 - DNA, 1037 bp, Artificial Sequence
  chemically treated genomic DNA (Homo sapiens) CpG-island No: 20077
  misc_feature (857)..(857): n is either a, c, g or t
agttcggtcgttgcggggcgtagtcgttttttgttttcgggaggcgtcgtcggttcgcgtcgttaggtttcgttttttgtttaggtagcggttgcgggatcgttcgggaatcgggcgcgcgggagtcgaggagcgtttggttcggtaaaagtttcgtatttgtagttgtcggggtcgcgagtttatagttttaggagtcgcgcgaggtttaggacgtttcgcgaggcgttcggattttcgtttcggtagtcgtttttttagcggcgcgcggttttaacgttttagagtagcgcgggtttcgcgttttatagtcgcgtcggttttaggttagtgaacggcgatagggattcgggaacgcggttggtcgcggtttatacgtaggttatcggtaggagtcgatttggttcggtagggttcggtggttcgagtagtcgtagcggttaggtaggggggtttcgtatggcgttgcgtgcgattcgtacgttttagttcgtcggttaggcgcgcgtaaagttcgaggattttttcggttcggtttcgagtaaagggcgtggacgcggtggcgttcgttttttttcgttggttgttattcgttttatcgtgtttgtattttcgggttgcgttcgttttcgttttattttcgttcgcgcggtgtcgcgttttttcgttttatttcggggattgtagttattcggattttgtaagttattttttcgagcgtttttaattcgttcgggtgttttttttgtagcgtttttaattgttcgttggcggaggagcgtcgggcgcgttagttgggacgaggttcgggaagtttaggagtacggttgcgtttgcgtattgggcgtagggaattntttcgcgtttcgtcgttttttttggtttgaattggggaacgatacgagtttttttttacgtcggtagatcgggcggagcgcgtaaacgcgattatacgaaggtcggtataaagatggggtcggaggatatcgtgttggatacggcgtgggtcgggtttttcggttcggagattttgttgg

SEQ ID NO: 20078 - DNA, 1037 bp, Artificial Sequence
  chemically treated genomic DNA (Homo sapiens) CpG-island No: 20078
  misc_feature (181)..(181): n is either a, c, g or t
ccaacaaaatctccgaaccgaaaaacccgacccacgccgtatccaacacgatatcctccgaccccatctttataccgaccttcgtataatcgcgtttacgcgctccgcccgatctaccgacgtaaaaaaaaactcgtatcgttccccaattcaaaccaaaaaaaacgacgaaacgcgaaanaattccctacgcccaatacgcaaacgcaaccgtactcctaaacttcccgaacctcgtcccaactaacgcgcccgacgctcctccgccaacgaacaattaaaaacgctacaaaaaaaacacccgaacgaattaaaaacgctcgaaaaaataacttacaaaatccgaataactacaatccccgaaataaaacgaaaaaacgcgacaccgcgcgaacgaaaataaaacgaaaacgaacgcaacccgaaaatacaaacacgataaaacgaataacaaccaacgaaaaaaaacgaacgccaccgcgtccacgccctttactcgaaaccgaaccgaaaaaatcctcgaactttacgcgcgcctaaccgacgaactaaaacgtacgaatcgcacgcaacgccatacgaaacccccctacctaaccgctacgactactcgaaccaccgaaccctaccgaaccaaatcgactcctaccgataacctacgtataaaccgcgaccaaccgcgttcccgaatccctatcgccgttcactaacctaaaaccgacgcgactataaaacgcgaaacccgcgctactctaaaacgttaaaaccgcgcgccgctaaaaaaacgactaccgaaacgaaaatccgaacgcctcgcgaaacgtcctaaacctcgcgcgactcctaaaactataaactcgcgaccccgacaactacaaatacgaaacttttaccgaaccaaacgctcctcgactcccgcgcgcccgattcccgaacgatcccgcaaccgctacctaaacaaaaaacgaaacctaacgacgcgaaccgacgacgcctcccgaaaacaaaaaacgactacgccccgcaacgaccgaact

SEQ ID NO: 20079 - DNA, 1037 bp, Artificial Sequence
  chemically treated genomic DNA (Homo sapiens) CpG-island No: 20079
  misc_feature (181)..(181): n is either a, c, g or t
ttagtagggttttcgggtcggggaattcggtttacgtcgtatttagtacggtgtttttcggttttatttttgtgtcggttttcgtgtggtcgcgtttgcgcgtttcgttcggtttgtcggcgtgagaaagagttcgtgtcgttttttagtttagattagaggggacggcgaagcgcgaaanagttttttgcgtttagtacgtaggcgtagtcgtgtttttgggtttttcgggtttcgttttagttggcgcgttcggcgttttttcgttagcgggtagttgggggcgttgtagggagggtattcgagcgggttgggggcgttcggaagggtggtttgtaaggttcgggtagttgtagttttcggagtggggcggagaggcgcggtatcgcgcggacgaggatggggcgggggcgggcgtagttcgagggtgtaggtacgataaggcgggtgatagttagcggggaggggcgggcgttatcgcgtttacgttttttgttcggggtcgggtcgggagggttttcgggttttgcgcgcgtttggtcggcgggttgaggcgtacgggtcgtacgtagcgttatgcgaggtttttttgtttggtcgttgcggttgttcgagttatcgagttttgtcgagttaggtcggtttttgtcggtagtttgcgtgtgggtcgcggttagtcgcgttttcgggtttttatcgtcgtttattggtttgaggtcggcgcggttatggggcgcggggttcgcgttgttttggggcgttggagtcgcgcgtcgttggaggagcggttgtcggggcgggggttcgggcgtttcgcggggcgttttgggtttcgcgcggtttttggggttgtgggttcgcggtttcggtagttgtaggtgcggggtttttgtcgggttaggcgtttttcggttttcgcgcgttcggttttcgggcggtttcgtagtcgttgtttgggtaggggacgaggtttggcggcgcgggtcggcggcgtttttcggggataaggggcggttgcgtttcgtagcggtcggatt

SEQ ID NO: 20080 - DNA, 1037 bp, Artificial Sequence
  chemically treated genomic DNA (Homo sapiens) CpG-island No: 20080
  misc_feature (857)..(857): n is either a, c, g or t
aatccgaccgctacgaaacgcaaccgccccttatccccgaaaaacgccgccgacccgcgccgccaaacctcgtcccctacccaaacaacgactacgaaaccgcccgaaaaccgaacgcgcgaaaaccgaaaaacgcctaacccgacaaaaaccccgcacctacaactaccgaaaccgcgaacccacaaccccaaaaaccgcgcgaaacccaaaacgccccgcgaaacgcccgaacccccgccccgacaaccgctcctccaacgacgcgcgactccaacgccccaaaacaacgcgaaccccgcgccccataaccgcgccgacctcaaaccaataaacgacgataaaaacccgaaaacgcgactaaccgcgacccacacgcaaactaccgacaaaaaccgacctaactcgacaaaactcgataactcgaacaaccgcaacgaccaaacaaaaaaacctcgcataacgctacgtacgacccgtacgcctcaacccgccgaccaaacgcgcgcaaaacccgaaaaccctcccgacccgaccccgaacaaaaaacgtaaacgcgataacgcccgcccctccccgctaactatcacccgccttatcgtacctacaccctcgaactacgcccgcccccgccccatcctcgtccgcgcgataccgcgcctctccgccccactccgaaaactacaactacccgaaccttacaaaccacccttccgaacgcccccaacccgctcgaataccctccctacaacgcccccaactacccgctaacgaaaaaacgccgaacgcgccaactaaaacgaaacccgaaaaacccaaaaacacgactacgcctacgtactaaacgcaaaaaactntttcgcgcttcgccgtcccctctaatctaaactaaaaaacgacacgaactctttctcacgccgacaaaccgaacgaaacgcgcaaacgcgaccacacgaaaaccgacacaaaaataaaaccgaaaaacaccgtactaaatacgacgtaaaccgaattccccgacccgaaaaccctactaa

SEQ ID NO: 20081 - DNA, 726 bp, Artificial Sequence
  chemically treated genomic DNA (Homo sapiens) CpG-island No: 20081
gcggggtttcgtcggggagcgcgtacggagcggcgtttcggtcgttttgttttttggagttgtgtttttttgattttagtggtagtttttgttattgtatcgttcgtttttttttcggttcgtcgcgttttcgtttttttttttcgttttttcgttcgttttttttttagatcgaggttgttcgggtttttttttttttcgtttttttttagcgtcgcgttttttggtttttagttttagtttgcggcgggattttcggggtcgaaggttttggttcgttcgcgtttttcgtcgttttcgcgcgtttttagcgtttttttagtcggttcgggtcgttcggttatggatcgtttgttcgtcgggcgttgaaggtattttcgggattcggagcgtagttcgggaaaggtaattcgtttcgggaagggaggcggagggcgggggagggggaggaggcggtcgggagttcggtgtcgagtacgagaggaagggaaaaaaatgtatatataaagcggagttcgggtgagaggtgttttgttagaggcgcgtgcgaggggttcggaggttgcggattcgggttgtttcggtgtttttgatattcgtacgagcgggcgtttttcgggtaattcggcgttcggggagggttgatttttaatttttgagcgaaagtaaatttttttttaggaggtgtttttttttcgattttttattttgcgttttttttttttt

SEQ ID NO: 20082 - DNA, 726 bp, Artificial Sequence
  chemically treated genomic DNA (Homo sapiens) CpG-island No: 20082
aaaaaaaaaaaaacgcaaaataaaaaatcgaaaaaaaaacacctcctaaaaaaaaatttactttcgctcaaaaattaaaaatcaaccctccccgaacgccgaattacccgaaaaacgcccgctcgtacgaatatcaaaaacaccgaaacaacccgaatccgcaacctccgaacccctcgcacgcgcctctaacaaaacacctctcacccgaactccgctttatatatacatttttttcccttcctctcgtactcgacaccgaactcccgaccgcctcctccccctcccccgccctccgcctcccttcccgaaacgaattacctttcccgaactacgctccgaatcccgaaaataccttcaacgcccgacgaacaaacgatccataaccgaacgacccgaaccgactaaaaaaacgctaaaaacgcgcgaaaacgacgaaaaacgcgaacgaaccaaaaccttcgaccccgaaaatcccgccgcaaactaaaactaaaaaccaaaaaacgcgacgctaaaaaaaaacgaaaaaaaaaaaaacccgaacaacctcgatctaaaaaaaaaacgaacgaaaaaacgaaaaaaaaaaacgaaaacgcgacgaaccgaaaaaaaaacgaacgatacaataacaaaaactaccactaaaatcaaaaaaacacaactccaaaaaacaaaacgaccgaaacgccgctccgtacgcgctccccgacgaaaccccgc

SEQ ID NO: 20083 - DNA, 726 bp, Artificial Sequence
  chemically treated genomic DNA (Homo sapiens) CpG-island No: 20083
agaagagaagaggcgtaggatggggagtcggagggaagatattttttaaaaaagaatttgttttcgtttaggggttgaaaattagtttttttcgagcgtcgaattgttcgggaggcgttcgttcgtgcggatgttaggggtatcggggtagttcgggttcgtagttttcgagtttttcgtacgcgtttttgataaggtattttttattcgggtttcgttttgtgtgtgtatttttttttttttttttcgtgttcggtatcgggttttcggtcgttttttttttttttttcgtttttcgttttttttttcggggcggattatttttttcgggttgcgtttcggatttcggggatgtttttagcgttcggcgagtaggcgatttatagtcgagcggttcgagtcggttggaggagcgttgggggcgcgcgggggcggcgaggggcgcgagcgggttagaattttcgatttcggaggtttcgtcgtaggttggggttgggggttagggggcgcggcgttagagggaggcggggggagaaaggattcgagtagtttcgatttggggagagagcgagcgagggggcgaggagagggagcgagggcgcggcgagtcggagggagagcgagcggtgtagtgatagggattgttattggggttaaaggagtatagttttaggaagtagggcggtcgaggcgtcgtttcgtgcgcgtttttcggcgggatttcgt

SEQ ID NO: 20084 - DNA, 726 bp, Artificial Sequence
  chemically treated genomic DNA (Homo sapiens) CpG-island No: 20084
acgaaatcccgccgaaaaacgcgcacgaaacgacgcctcgaccgccctacttcctaaaactatactcctttaaccccaataacaatccctatcactacaccgctcgctctccctccgactcgccgcgccctcgctccctctcctcgccccctcgctcgctctctccccaaatcgaaactactcgaatcctttctccccccgcctccctctaacgccgcgccccctaacccccaaccccaacctacgacgaaacctccgaaatcgaaaattctaacccgctcgcgcccctcgccgcccccgcgcgcccccaacgctcctccaaccgactcgaaccgctcgactataaatcgcctactcgccgaacgctaaaaacatccccgaaatccgaaacgcaacccgaaaaaaataatccgccccgaaaaaaaaaacgaaaaacgaaaaaaaaaaaaaaaacgaccgaaaacccgataccgaacacgaaaaaaaaaaaaaaaaatacacacacaaaacgaaacccgaataaaaaataccttatcaaaaacgcgtacgaaaaactcgaaaactacgaacccgaactaccccgatacccctaacatccgcacgaacgaacgcctcccgaacaattcgacgctcgaaaaaaactaattttcaacccctaaacgaaaacaaattcttttttaaaaaatatcttccctccgactccccatcctacgcctcttctcttct

SEQ ID NO: 20085 - DNA, 531 bp, Artificial Sequence
  chemically treated genomic DNA (Homo sapiens) CpG-island No: 20085
tttttttgcgtcgttcgtatttgcgtttttttttatcgtaataggttaggggagggcggaggtgacgagggcgttcgattcgggattagaggacggaagggtttggaaggtgagcgtagttttgcgttatttagggttgggggtcgattcgttcggttttcgacgtcgtcgtcgcggatttttcggaagtcgaggtttttttcgtttttttgtcggttttttagtacgttgatttaagtcgttggcgtttttattttttcggtgggagttttcggggagaacgggttagggtttagagtttttatcgttttatttgcgatttcgcggtaggtagcgcgtagaaaaataggggacggggatatgggaagagatttatgttttttttttacgcgtagtttttaagttagacgtttgtttgtgtatttcgcgttttgcggagagttgtttcgttgttgggatttgttatttgagttgcgtaatgagttttagaagtttttcggggggagggggcggggaaaagtggggtttttt

SEQ ID NO: 20086 - DNA, 531 bp, Artificial Sequence
  chemically treated genomic DNA (Homo sapiens) CpG-island No: 20086
aaaaaaccccacttttccccgccccctccccccgaaaaacttctaaaactcattacgcaactcaaataacaaatcccaacaacgaaacaactctccgcaaaacgcgaaatacacaaacaaacgtctaacttaaaaactacgcgtaaaaaaaaaacataaatctcttcccatatccccgtcccctatttttctacgcgctacctaccgcgaaatcgcaaataaaacgataaaaactctaaaccctaacccgttctccccgaaaactcccaccgaaaaaataaaaacgccaacgacttaaatcaacgtactaaaaaaccgacaaaaaaacgaaaaaaacctcgacttccgaaaaatccgcgacgacgacgtcgaaaaccgaacgaatcgacccccaaccctaaataacgcaaaactacgctcaccttccaaacccttccgtcctctaatcccgaatcgaacgccctcgtcacctccgccctcccctaacctattacgataaaaaaaaacgcaaatacgaacgacgcaaaaaaa

SEQ ID NO: 20087 - DNA, 531 bp, Artificial Sequence
  chemically treated genomic DNA (Homo sapiens) CpG-island No: 20087
gaagaattttattttttttcgtttttttttttcgagaaatttttgggatttattacgtaatttaagtagtaggttttaataacgggatagtttttcgtaaaacgcggggtgtataggtaaacgtttgatttgggggttgcgcgtgagggaggagtatgggtttttttttatgttttcgttttttgtttttttacgcgttatttgtcgcgggatcgtaagtagggcggtgagagttttgagttttagttcgtttttttcgagggtttttatcggaaaagtgggaacgttagcgatttgagttagcgtgttgggaagtcggtagagaggcggggagagtttcggttttcgagaagttcgcggcggcggcgtcgggggtcgggcggatcgatttttagttttgggtggcgtagggttgcgtttattttttagattttttcgttttttagtttcgggtcgggcgttttcgttattttcgtttttttttgatttgttgcggtgggaaagggcgtaagtgcggacgacgtaagggga

SEQ ID NO: 20088 - DNA, 531 bp, Artificial Sequence
  chemically treated genomic DNA (Homo sapiens) CpG-island No: 20088
tccccttacgtcgtccgcacttacgccctttcccaccgcaacaaatcaaaaaaaaacgaaaataacgaaaacgcccgacccgaaactaaaaaacgaaaaaatctaaaaaataaacgcaaccctacgccacccaaaactaaaaatcgatccgcccgacccccgacgccgccgccgcgaacttctcgaaaaccgaaactctccccgcctctctaccgacttcccaacacgctaactcaaatcgctaacgttcccacttttccgataaaaaccctcgaaaaaaacgaactaaaactcaaaactctcaccgccctacttacgatcccgcgacaaataacgcgtaaaaaaacaaaaaacgaaaacataaaaaaaaacccatactcctccctcacgcgcaacccccaaatcaaacgtttacctatacaccccgcgttttacgaaaaactatcccgttattaaaacctactacttaaattacgtaataaatcccaaaaatttctcgaaaaaaaaaaacgaaaaaaaataaaattcttc

SEQ ID NO: 20089 - DNA, 704 bp, Artificial Sequence
  chemically treated genomic DNA (Homo sapiens) CpG-island No: 20089
tcgttacgaacgcgtttgaaaagttttttcggtgtacggtttattttgattgggttgttataatttagtttatagagttaggggtttttcgtttatgagcgtttttatttcgcgggttttgttgttagcgtcgcgtttattatttggcggagtcgggcggggacgcgtttcggcgcggcgtttcgatgttacgggattatttgttttcgagtttcgggcgttttcggcgtagtttcgggttcggttcgtattggttcgcgttaattttgatggatattcgggtattggggtttttgcggcgatttgtattttagacgagttcggggagcgtcgcgttcgaattcggggtaagcgagcgttttcggcgtagtttttgagaagggaaagttagcgggtttttacgttcgaagatcgtcggcgtttaacgtttgtttagtaatagtataacgcgggttatagttagaaaggaaaagaaattgtttttgggtttatttgaagttgttcgagttcgtcgggatattttttgttaagaaagttgcggtggtacggttcgtttatttaaatgggtagggcgttcggcggttttagttaaaggtaggcggtaagcggtaggtagggtcgggtagggggtagagtttgggcgtcgataagttttgttggttttcggtcgagtttcgtttgcgggtttttcgagagtgtttttt

SEQ ID NO: 20090 - DNA, 704 bp, Artificial Sequence
  chemically treated genomic DNA (Homo sapiens) CpG-island No: 20090
aaaaaacactctcgaaaaacccgcaaacgaaactcgaccgaaaaccaacaaaacttatcgacgcccaaactctaccccctacccgaccctacctaccgcttaccgcctacctttaactaaaaccgccgaacgccctacccatttaaataaacgaaccgtaccaccgcaactttcttaacaaaaaatatcccgacgaactcgaacaacttcaaataaacccaaaaacaatttcttttcctttctaactataacccgcgttatactattactaaacaaacgttaaacgccgacgatcttcgaacgtaaaaacccgctaactttcccttctcaaaaactacgccgaaaacgctcgcttaccccgaattcgaacgcgacgctccccgaactcgtctaaaatacaaatcgccgcaaaaaccccaatacccgaatatccatcaaaattaacgcgaaccaatacgaaccgaacccgaaactacgccgaaaacgcccgaaactcgaaaacaaataatcccgtaacatcgaaacgccgcgccgaaacgcgtccccgcccgactccgccaaataataaacgcgacgctaacaacaaaacccgcgaaataaaaacgctcataaacgaaaaacccctaactctataaactaaattataacaacccaatcaaaataaaccgtacaccgaaaaaacttttcaaacgcgttcgtaacga

SEQ ID NO: 20091 - DNA, 704 bp, Artificial Sequence
  chemically treated genomic DNA (Homo sapiens) CpG-island No: 20091
agagagtattttcgaggagttcgtaggcggggttcggtcggggattagtagggtttgtcggcgtttaggttttgttttttattcgattttgtttgtcgtttgtcgtttgtttttggttagggtcgtcgagcgttttgtttatttaagtaggcgggtcgtattatcgtaatttttttgatagggggtatttcggcggattcggataattttaagtgagtttagaggtaatttttttttttttttaattgtggttcgcgttgtgttgttgttgggtaggcgttgggcgtcggcggttttcgagcgtgggggttcgttggttttttttttttagaaattgcgtcgggggcgttcgtttgtttcggattcggacgcggcgtttttcgggttcgtttgaagtgtagatcgtcgtagaggttttagtgttcggatgtttattaggattagcgcgagttaatacgggtcgagttcggggttgcgtcgaggacgttcggggttcgagagtaggtagtttcgtaatatcggggcgtcgcgtcgggacgcgttttcgttcggtttcgttaaatggtgagcgcggcgttggtagtagggttcgcggggtgaaggcgtttatggacggaagatttttggttttataagttgaattatggtagtttagttaaggtaagtcgtgtatcggagaaattttttaaacgcgttcgtggcga

SEQ ID NO: 20092 - DNA, 704 bp, Artificial Sequence
  chemically treated genomic DNA (Homo sapiens) CpG-island No: 20092
tcgccacgaacgcgtttaaaaaatttctccgatacacgacttaccttaactaaactaccataattcaacttataaaaccaaaaatcttccgtccataaacgccttcaccccgcgaaccctactaccaacgccgcgctcaccatttaacgaaaccgaacgaaaacgcgtcccgacgcgacgccccgatattacgaaactacctactctcgaaccccgaacgtcctcgacgcaaccccgaactcgacccgtattaactcgcgctaatcctaataaacatccgaacactaaaacctctacgacgatctacacttcaaacgaacccgaaaaacgccgcgtccgaatccgaaacaaacgaacgcccccgacgcaatttctaaaaaaaaaaaaccaacgaacccccacgctcgaaaaccgccgacgcccaacgcctacccaacaacaacacaacgcgaaccacaattaaaaaaaaaaaaaaattacctctaaactcacttaaaattatccgaatccgccgaaataccccctatcaaaaaaattacgataatacgacccgcctacttaaataaacaaaacgctcgacgaccctaaccaaaaacaaacgacaaacgacaaacaaaatcgaataaaaaacaaaacctaaacgccgacaaaccctactaatccccgaccgaaccccgcctacgaactcctcgaaaatactctct

SEQ ID NO: 20093 - DNA, 713 bp, Artificial Sequence
  chemically treated genomic DNA (Homo sapiens) CpG-island No: 20093
agaggtttcggtgttttttattcgtttcgacgtgcgtttcggtattatttcgggattcgtttttttcgttggcggggggagaaagggtaggaggttttcgtttcggttataaagggtttcggattcgcgcggtttcgtttcggtttgtttcgatacgtttaggcgtttttcgttcgttttagtcgtcgcgttttagttagagttttagcgttcgtttaggttttaatcggatttttcgggtttcggttatttggattgcggcggaatatggcggtttcgatgattttcgcggttcggttcgaggattacgaggcggcgtttaatgtcgttttggttgacgtgttcgaattggttagatttttggagatcgattcgtatttgaagttttacgtcgtggatttttagcgtaggtatcgtcggaattttattatttttatttagataggtagttcgttttttaggagtcgtttcgggatacgggtcgtttttcggttttcgcgcgttaatttcgttttaggcggggaggaatttgagtgggcggggttcggggtgattcgggtaatcgggttttgtggttttcgtagtggtaggtttgatagcgttggtgttcggagcgggcgttgaagaaatttttttttttatttttttttttttttgttttaattagcggttttgcgttatagggtacgtgttgtggttttaatatttatttt

SEQ ID NO: 20094 - DNA, 713 bp, Artificial Sequence
  chemically treated genomic DNA (Homo sapiens) CpG-island No: 20094
aaaataaatattaaaaccacaacacgtaccctataacgcaaaaccgctaattaaaacaaaaaaaaaaaaaaataaaaaaaaaaatttcttcaacgcccgctccgaacaccaacgctatcaaacctaccactacgaaaaccacaaaacccgattacccgaatcaccccgaaccccgcccactcaaattcctccccgcctaaaacgaaattaacgcgcgaaaaccgaaaaacgacccgtatcccgaaacgactcctaaaaaacgaactacctatctaaataaaaataataaaattccgacgatacctacgctaaaaatccacgacgtaaaacttcaaatacgaatcgatctccaaaaatctaaccaattcgaacacgtcaaccaaaacgacattaaacgccgcctcgtaatcctcgaaccgaaccgcgaaaatcatcgaaaccgccatattccgccgcaatccaaataaccgaaacccgaaaaatccgattaaaacctaaacgaacgctaaaactctaactaaaacgcgacgactaaaacgaacgaaaaacgcctaaacgtatcgaaacaaaccgaaacgaaaccgcgcgaatccgaaaccctttataaccgaaacgaaaacctcctaccctttctccccccgccaacgaaaaaaacgaatcccgaaataataccgaaacgcacgtcgaaacgaataaaaaacaccgaaacctct

SEQ ID NO: 20095 - DNA, 713 bp, Artificial Sequence
  chemically treated genomic DNA (Homo sapiens) CpG-island No: 20095
ggaataagtgttggagttatagtacgtattttatggcgtaagatcgttgattagaatagaggggaaaggggatgaggaaagaagtttttttagcgttcgtttcgggtattagcgttgttaaatttgttattacggaagttatagaattcggttattcgagttatttcgagtttcgtttatttaggttttttttcgtttggggcggggttggcgcgcgagggtcgaggggcggttcgtgtttcgagacggtttttgggaggcgggttgtttgtttaagtgggggtggtgggatttcggcggtatttgcgttggaagtttacggcgtagggttttaagtacgggtcgatttttaggagtttggttagttcgggtacgttagttagggcggtattgagcgtcgtttcgtagttttcgggtcgagtcgcgggagttatcggagtcgttatatttcgtcgtagtttaagtagtcgaggttcgagaggttcgattggggtttgagcgggcgttggagttttagttgggacgcggcggttagggcggacggagggcgtttaggcgtgtcgaggtaagtcgaggcgaagtcgcgcgggttcggggttttttatagtcgggacgaaggttttttgtttttttttttttcgttagcgggaggagcggatttcggggtgatgtcgggacgtacgtcggagcgggtaggaggtatcgaggttttt

SEQ ID NO: 20096 - DNA, 713 bp, Artificial Sequence
  chemically treated genomic DNA (Homo sapiens) CpG-island No: 20096
aaaaacctcgatacctcctacccgctccgacgtacgtcccgacatcaccccgaaatccgctcctcccgctaacgaaaaaaaaaaaaacaaaaaaccttcgtcccgactataaaaaaccccgaacccgcgcgacttcgcctcgacttacctcgacacgcctaaacgccctccgtccgccctaaccgccgcgtcccaactaaaactccaacgcccgctcaaaccccaatcgaacctctcgaacctcgactacttaaactacgacgaaatataacgactccgataactcccgcgactcgacccgaaaactacgaaacgacgctcaataccgccctaactaacgtacccgaactaaccaaactcctaaaaatcgacccgtacttaaaaccctacgccgtaaacttccaacgcaaataccgccgaaatcccaccacccccacttaaacaaacaacccgcctcccaaaaaccgtctcgaaacacgaaccgcccctcgaccctcgcgcgccaaccccgccccaaacgaaaaaaaacctaaataaacgaaactcgaaataactcgaataaccgaattctataacttccgtaataacaaatttaacaacgctaatacccgaaacgaacgctaaaaaaacttctttcctcatcccctttcccctctattctaatcaacgatcttacgccataaaatacgtactataactccaacacttattcc

SEQ ID NO: 20097 - DNA, 1428 bp, Artificial Sequence
  chemically treated genomic DNA (Homo sapiens) CpG-island No: 20097
tagaaacgtttgagtacgtggagtttcgggggacgggtgtttcgggaattacgtatatcggtttttttagttcgtcgtagggttgtagaggcgtcgagggttgggggggttgtcggggttgtcgggttttcgtgtaggttttttttcgtagtttcgcggtcgggtttggagatcgcgtgttcggacgtcgtcgttagtttcgtgggtcgtaaaggggcgggggcggtttttggcggcgggaggattcgttcgttcgagggatttcgggttaggtttcggggtcgtttcggttgggtttttgcggttttatagttttgggcggggatgggggcgtcggcgtttacgcgcgaggttaatcgggggaaatcgaggtagtgaatggtttaggtttcgttcggttatttcggagttaggtcgggagcgtttagtgtttcgcgatcgtagtcgtcgtagtttgaattcgtttttttttagtaggatgcggagcgcggtttttttattttgtttttgttatcgttgtttttttacgtcgggtcgtcgtcgggatgggtagacggcgcggtcggtattcgaggtttgcgagcgcgaggttcgcggggcgttgcggagtcgggagcgcggagtcggggcgggggatagataaaggcggggacggcggcgaggggaagataaagcgcggaggggggtcggcggcggcgtcggggtttcgaaggcggtttcgggcgcggcggagttaatgggcgggcgcggggcgggggtcggcgggggcggtgtagcgataaggcggtggcggcggcggtggttcggggattattggtagcggtagtagttcgcgttcgcgtttttttcgtattcgtgcgttttcggagatcgatttcgtttcgcggtttaggtcgggtttggtgagagtcgcggggggaggggtcgcgttcggtttcggaatcgggagaggcgtcgaggggtgtggggtgagggtcgttcgtggggtttcggcgagtttgcgagtcgttttcgttcggggcgtataggttcgagttttcgttttagggtcggttttcggttgggcggagtcgagattcgttggcggggttcgcggcgtcggggtttggggttcggttttcgcggggttaggtcgggggtcgaggggcggggtcgggcggggatttcgggcgttgtttaggggttgcgtagtttaggtttggacgttcgggcgcggcgtagggtagcgagggtcggggttaggtcggggtagcggttttttatcgcggtttcgtcggtttcgatttttttttattttaagcggttttagttcgcgggacgtatacggcggttgcgcgggagttttcggttttttcgttttcgttaattttgttttttcgagggacggtgttattcgggatttcggtttttggggagtaggggtggggg

SEQ ID NO: 20098 - DNA, 1428 bp, Artificial Sequence
  chemically treated genomic DNA (Homo sapiens) CpG-island No: 20098
cccccacccctactccccaaaaaccgaaatcccgaataacaccgtccctcgaaaaaacaaaattaacgaaaacgaaaaaaccgaaaactcccgcgcaaccgccgtatacgtcccgcgaactaaaaccgcttaaaataaaaaaaaatcgaaaccgacgaaaccgcgataaaaaaccgctaccccgacctaaccccgaccctcgctaccctacgccgcgcccgaacgtccaaacctaaactacgcaacccctaaacaacgcccgaaatccccgcccgaccccgcccctcgacccccgacctaaccccgcgaaaaccgaaccccaaaccccgacgccgcgaaccccgccaacgaatctcgactccgcccaaccgaaaaccgaccctaaaacgaaaactcgaacctatacgccccgaacgaaaacgactcgcaaactcgccgaaaccccacgaacgaccctcaccccacacccctcgacgcctctcccgattccgaaaccgaacgcgacccctccccccgcgactctcaccaaacccgacctaaaccgcgaaacgaaatcgatctccgaaaacgcacgaatacgaaaaaaacgcgaacgcgaactactaccgctaccaataatccccgaaccaccgccgccgccaccgccttatcgctacaccgcccccgccgacccccgccccgcgcccgcccattaactccgccgcgcccgaaaccgccttcgaaaccccgacgccgccgccgacccccctccgcgctttatcttcccctcgccgccgtccccgcctttatctatcccccgccccgactccgcgctcccgactccgcaacgccccgcgaacctcgcgctcgcaaacctcgaataccgaccgcgccgtctacccatcccgacgacgacccgacgtaaaaaaacaacgataacaaaaacaaaataaaaaaaccgcgctccgcatcctactaaaaaaaaacgaattcaaactacgacgactacgatcgcgaaacactaaacgctcccgacctaactccgaaataaccgaacgaaacctaaaccattcactacctcgatttcccccgattaacctcgcgcgtaaacgccgacgcccccatccccgcccaaaactataaaaccgcaaaaacccaaccgaaacgaccccgaaacctaacccgaaatccctcgaacgaacgaatcctcccgccgccaaaaaccgcccccgcccctttacgacccacgaaactaacgacgacgtccgaacacgcgatctccaaacccgaccgcgaaactacgaaaaaaaacctacacgaaaacccgacaaccccgacaacccccccaaccctcgacgcctctacaaccctacgacgaactaaaaaaaccgatatacgtaattcccgaaacacccgtcccccgaaactccacgtactcaaacgtttcta

SEQ ID NO: 20099 - DNA, 1428 bp, Artificial Sequence
  chemically treated genomic DNA (Homo sapiens) CpG-island No: 20099
tttttatttttgttttttaggggtcggggtttcgagtggtatcgtttttcggaagaataaagttagcgggagcggaggggtcgggggttttcgcgtagtcgtcgtgtgcgtttcgcgggttgggatcgtttggggtgaggggaggtcggggtcggcggggtcgcgatgagaagtcgttgtttcgatttgatttcggttttcgttgttttgcgtcgcgttcgggcgtttaggtttaggttgcgtagtttttggatagcgttcgaggttttcgttcggtttcgtttttcggttttcgatttggtttcgcgaggatcggattttagatttcgacgtcgcgagtttcgttagcgggtttcggtttcgtttagtcgggggtcggttttgaaacgaggattcgagtttgtgcgtttcgggcgagagcggttcgtagattcgtcgggattttacgggcggtttttattttatatttttcggcgtttttttcggtttcggagtcggacgcggttttttttttcgcggtttttattaggttcggtttgggtcgcggggcgggatcggttttcgggggcgtacgggtacgaggagggcgcgggcgcgagttgttgtcgttattagtggttttcgagttatcgtcgtcgttatcgttttatcgttgtatcgttttcgtcggttttcgtttcgcgttcgtttattggtttcgtcgcgttcggagtcgttttcggggtttcggcgtcgtcgtcgattttttttcgcgttttgtttttttttcgtcgtcgttttcgtttttgtttgtttttcgtttcggtttcgcgttttcggtttcgtagcgtttcgcgggtttcgcgttcgtaggtttcgggtatcggtcgcgtcgtttgtttatttcgacggcggttcggcgtggggaagtaacggtggtagggataggatggaagggtcgcgtttcgtattttattgggaggggacgagtttaggttgcggcggttgcggtcgcgggatattgggcgttttcggtttggtttcgggataatcgggcggggtttgggttatttattgtttcggtttttttcggttggtttcgcgcgtaggcgtcggcgtttttattttcgtttagagttgtggggtcgtagagatttagtcggggcgatttcggagtttggttcggggtttttcgggcgggcgagttttttcgtcgttaggggtcgttttcgtttttttgcggtttacgaggttggcggcggcgttcgggtacgcggtttttaggttcggtcgcgaggttgcggggaggagtttgtacgagggttcggtagtttcggtagtttttttagttttcggcgtttttgtaattttgcgacgggttggggaggtcggtatgcgtggttttcggagtattcgtttttcgaggttttacgtatttaagcgtttttg

SEQ ID NO: 20100 - DNA, 1428 bp, Artificial Sequence
  chemically treated genomic DNA (Homo sapiens) CpG-island No: 20100
caaaaacgcttaaatacgtaaaacctcgaaaaacgaatactccgaaaaccacgcataccgacctccccaacccgtcgcaaaattacaaaaacgccgaaaactaaaaaaactaccgaaactaccgaaccctcgtacaaactcctccccgcaacctcgcgaccgaacctaaaaaccgcgtacccgaacgccgccgccaacctcgtaaaccgcaaaaaaacgaaaacgacccctaacgacgaaaaaactcgcccgcccgaaaaaccccgaaccaaactccgaaatcgccccgactaaatctctacgaccccacaactctaaacgaaaataaaaacgccgacgcctacgcgcgaaaccaaccgaaaaaaaccgaaacaataaataacccaaaccccgcccgattatcccgaaaccaaaccgaaaacgcccaatatcccgcgaccgcaaccgccgcaacctaaactcgtcccctcccaataaaatacgaaacgcgacccttccatcctatccctaccaccgttacttccccacgccgaaccgccgtcgaaataaacaaacgacgcgaccgatacccgaaacctacgaacgcgaaacccgcgaaacgctacgaaaccgaaaacgcgaaaccgaaacgaaaaacaaacaaaaacgaaaacgacgacgaaaaaaaaacaaaacgcgaaaaaaaatcgacgacgacgccgaaaccccgaaaacgactccgaacgcgacgaaaccaataaacgaacgcgaaacgaaaaccgacgaaaacgatacaacgataaaacgataacgacgacgataactcgaaaaccactaataacgacaacaactcgcgcccgcgccctcctcgtacccgtacgcccccgaaaaccgatcccgccccgcgacccaaaccgaacctaataaaaaccgcgaaaaaaaaaaccgcgtccgactccgaaaccgaaaaaaacgccgaaaaatataaaataaaaaccgcccgtaaaatcccgacgaatctacgaaccgctctcgcccgaaacgcacaaactcgaatcctcgtttcaaaaccgacccccgactaaacgaaaccgaaacccgctaacgaaactcgcgacgtcgaaatctaaaatccgatcctcgcgaaaccaaatcgaaaaccgaaaaacgaaaccgaacgaaaacctcgaacgctatccaaaaactacgcaacctaaacctaaacgcccgaacgcgacgcaaaacaacgaaaaccgaaatcaaatcgaaacaacgacttctcatcgcgaccccgccgaccccgacctcccctcaccccaaacgatcccaacccgcgaaacgcacacgacgactacgcgaaaacccccgacccctccgctcccgctaactttattcttccgaaaaacgataccactcgaaaccccgacccctaaaaaacaaaaataaaaa

SEQ ID NO: 20101 - DNA, 525 bp, Artificial Sequence
  chemically treated genomic DNA (Homo sapiens) CpG-island No: 20101
agtggcgtaatagtcgtagttcggttttcgtattagtttttcgtagtttacgggggggcggtagcgcgttagttttttttcggagtagggcgggtagtggatggtttcgtcgtttaggttcggttcgggttcggcggttagtagtagggcggttacgaggtagaggggtagtatgatcgttcgaggattgggcgcgggcgcggggcgttgggcgtaggcggggagcgcgggcgcgcgggcgagcggcggagggtatacggcggtagcgtttggcgtttttggaggattcgattcggagggcgcggggagacggggcggttcggcgggcgaacggggacgtagcgggggaagttagtaggcgtgtcggaggggagtaagtttggtcgtcgaggcgttgcgtcgtattttcggttcggtttaggtaggcggcgggcggcgaggggtagggggttgagcggttgttcgggatcggttttttcggattttatatcggtttttggttatatttttagcgtttttttagag

SEQ ID NO: 20102 - DNA, 525 bp, Artificial Sequence
  chemically treated genomic DNA (Homo sapiens) CpG-island No: 20102
ctctaaaaaaacgctaaaaatataaccaaaaaccgatataaaatccgaaaaaaccgatcccgaacaaccgctcaaccccctacccctcgccgcccgccgcctacctaaaccgaaccgaaaatacgacgcaacgcctcgacgaccaaacttactcccctccgacacgcctactaacttcccccgctacgtccccgttcgcccgccgaaccgccccgtctccccgcgccctccgaatcgaatcctccaaaaacgccaaacgctaccgccgtataccctccgccgctcgcccgcgcgcccgcgctccccgcctacgcccaacgccccgcgcccgcgcccaatcctcgaacgatcatactacccctctacctcgtaaccgccctactactaaccgccgaacccgaaccgaacctaaacgacgaaaccatccactacccgccctactccgaaaaaaaactaacgcgctaccgcccccccgtaaactacgaaaaactaatacgaaaaccgaactacgactattacgccact

SEQ ID NO: 20103 - DNA, 525 bp, Artificial Sequence
  chemically treated genomic DNA (Homo sapiens) CpG-island No: 20103
ttttgggaaggcgttgggggtgtggttagggatcggtataaagttcgggggagtcggtttcgggtagtcgtttagttttttgtttttcgtcgttcgtcgtttgtttgggtcgggtcgaggatgcggcgtagcgtttcggcggttaggtttgttttttttcggtacgtttgttaatttttttcgttacgttttcgttcgttcgtcgggtcgtttcgttttttcgcgtttttcgggtcgggttttttaggagcgttaggcgttgtcgtcgtgtgtttttcgtcgttcgttcgcgcgttcgcgtttttcgtttgcgtttagcgtttcgcgttcgcgtttagttttcgggcggttatgttgtttttttgtttcgtggtcgttttgttgttggtcgtcgggttcgggtcgagtttgggcgacgaagttatttattgttcgttttgtttcgaggagaagttggcgcgttgtcgttttttcgtgggttgcgaggagttggtgcgagagtcgggttgcggttgttgcgttatt

SEQ ID NO: 20104 - DNA, 525 bp, Artificial Sequence
  chemically treated genomic DNA (Homo sapiens) CpG-island No: 20104
aataacgcaacaaccgcaacccgactctcgcaccaactcctcgcaacccacgaaaaaacgacaacgcgccaacttctcctcgaaacaaaacgaacaataaataacttcgtcgcccaaactcgacccgaacccgacgaccaacaacaaaacgaccacgaaacaaaaaaacaacataaccgcccgaaaactaaacgcgaacgcgaaacgctaaacgcaaacgaaaaacgcgaacgcgcgaacgaacgacgaaaaacacacgacgacaacgcctaacgctcctaaaaaacccgacccgaaaaacgcgaaaaaacgaaacgacccgacgaacgaacgaaaacgtaacgaaaaaaattaacaaacgtaccgaaaaaaaacaaacctaaccgccgaaacgctacgccgcatcctcgacccgacccaaacaaacgacgaacgacgaaaaacaaaaaactaaacgactacccgaaaccgactcccccgaactttataccgatccctaaccacacccccaacgccttcccaaaa

SEQ ID NO: 20105 - DNA, 583 bp, Artificial Sequence
  chemically treated genomic DNA (Homo sapiens) CpG-island No: 20105
acgcgcgatttaataacgtcgtattcgggtcgttgtaatatggatttattacgggattaacggatttttgtttttagaaatagggtaataacgtacgatattttggaagtcgggttatattttattattagtattagaaggggttttcgtttttttacgattatttcggaatcgggaatggagaatatgggtttttaagtcggtcgtcggtttgatcgtagttttagagttttattcgttacgggcggttagagagatgttcgggtcgcgcggaggttttatcgttagtttttttcgcgagtcgtatttgtaatggtgatatttttatggtgacggtcgtgaaggggtttaagaattttgaaagcgattaaataggtaggattttacgagattattttcgattaagtcgtttttttatagacgcgcgtcggttaggagagttttatttgaatttttttttagttcgttcgaagtagattagttaatttttgattcgtttttatcgttttcgtttagaagaattaatcgtagtttgttttttatatttatttatgaacggttgagttggtcggggtttgtttga

SEQ ID NO: 20106 - DNA, 583 bp, Artificial Sequence
  chemically treated genomic DNA (Homo sapiens) CpG-island No: 20106
tcaaacaaaccccgaccaactcaaccgttcataaataaatataaaaaacaaactacgattaattcttctaaacgaaaacgataaaaacgaatcaaaaattaactaatctacttcgaacgaactaaaaaaaaattcaaataaaactctcctaaccgacgcgcgtctataaaaaaacgacttaatcgaaaataatctcgtaaaatcctacctatttaatcgctttcaaaattcttaaaccccttcacgaccgtcaccataaaaatatcaccattacaaatacgactcgcgaaaaaaactaacgataaaacctccgcgcgacccgaacatctctctaaccgcccgtaacgaataaaactctaaaactacgatcaaaccgacgaccgacttaaaaacccatattctccattcccgattccgaaataatcgtaaaaaaacgaaaaccccttctaatactaataataaaatataacccgacttccaaaatatcgtacgttattaccctatttctaaaaacaaaaatccgttaatcccgtaataaatccatattacaacgacccgaatacgacgttattaaatcgcgcgt

SEQ ID NO: 20107 - DNA, 583 bp, Artificial Sequence
  chemically treated genomic DNA (Homo sapiens) CpG-island No: 20107
ttaaataaatttcggttaatttagtcgtttataggtggatataaaaggtaagttacgattggtttttttggacggagacggtgagagcgagttagggattggttggtttgtttcgggcgggttaaaggaaggtttaagtggagtttttttaatcgacgcgcgtttgtggagaagcggtttggtcgggggtggtttcgtggggttttgtttgtttagtcgtttttagggtttttgagtttttttacgatcgttattatggaagtgttattattgtaggtacggttcgcgggggggattggcggtggagttttcgcgcggttcgggtatttttttggtcgttcgtgacgggtgaagttttggggttgcggttaggtcggcgatcggtttgggagtttatattttttattttcggtttcggggtgatcgtggagaggcggaagttttttttggtgttagtagtgaagtatgattcggtttttagggtgtcgtgcgttgttgttttgtttttaggggtaggagttcgttggtttcgtagtggatttatgttatagcggttcgggtgcgacgttattgagtcgcgcgt

SEQ ID NO: 20108 - DNA, 583 bp, Artificial Sequence
  chemically treated genomic DNA (Homo sapiens) CpG-island No: 20108
acgcgcgactcaataacgtcgcacccgaaccgctataacataaatccactacgaaaccaacgaactcctacccctaaaaacaaaacaacaacgcacgacaccctaaaaaccgaatcatacttcactactaacaccaaaaaaaacttccgcctctccacgatcaccccgaaaccgaaaataaaaaatataaactcccaaaccgatcgccgacctaaccgcaaccccaaaacttcacccgtcacgaacgaccaaaaaaatacccgaaccgcgcgaaaactccaccgccaatcccccccgcgaaccgtacctacaataataacacttccataataacgatcgtaaaaaaactcaaaaaccctaaaaacgactaaacaaacaaaaccccacgaaaccacccccgaccaaaccgcttctccacaaacgcgcgtcgattaaaaaaactccacttaaaccttcctttaacccgcccgaaacaaaccaaccaatccctaactcgctctcaccgtctccgtccaaaaaaaccaatcgtaacttaccttttatatccacctataaacgactaaattaaccgaaatttatttaa

SEQ ID NO: 20109 - DNA, 1079 bp, Artificial Sequence
  chemically treated genomic DNA (Homo sapiens) CpG-island No: 20109
gttgtagtcgtcgttcgtgggtcgtttttggttggtggttatgttgatttttcgtattttggtgttggttacggtgggcggcgtcgtgttcgaggacgagtaagaggagttcgtgtgtaatacgttgtagtcgggttgtcgttagatttgttacgatcgcgttttttcggttttttattatcgtttttggtttttttatattttgttgttttcggcgttttcggtgttgttcgtcgtttattttatgtatcgggtaggtaaggaggcgggcggcgttgaggcggcggcgtagtgcgttttcggattgttcgaggtttagtgcgcgtcgtgcgttttgcgcgttcgtcgcgcgcgtcgttgttatttgttgagcgtggcgttgcgtttgttggtcgagttgatttttttgggcggttaggcgttgttttacggttttcgcgtggtttcgtatttcgcgtgcgtcggttcgttttgttcgtatacggtcgattgtttcgtgagtcggtttatcgagaagatcgttttcgtgtttttttatttcgcggtggggttgttgtcggcgttgtttagcgtagtcgagttgggttatttgttttggaagggtcgttcgcgcgtcggggagcgtgataatcgttgtaatcgtgtatacgaagaggcgtagaagttgttttcgtcgtcgtcgtcgttattttcgttatcggttttgttttttcggcgtttcggtttcgagttttgcgtttcgtcggtttatgcgtattcggcgtcggttagttttcgcgagtgcggtagcggtcgcggtaaggcgttatcggttatcggtcgtcgagatttggttatttaggggcgggtatcgtttcgcgcggattggacggcgagggtcggatttcgttattttcgttcgtatcgtagaagtcggaagttgtttttattagagttgtcgcgggatttgtttcggtaggagacgcgttgtggggacggttcgcgggcggtatcgtatttgtttcgtattgttttttagtggttgtcggcggtatttggggtaggtcgggttgggggcggagaatgaatttaggtaggtt

SEQ ID NO: 20110 - DNA, 1079 bp, Artificial Sequence
  chemically treated genomic DNA (Homo sapiens) CpG-island No: 20110
aacctacctaaattcattctccgcccccaacccgacctaccccaaataccgccgacaaccactaaaaaacaatacgaaacaaatacgataccgcccgcgaaccgtccccacaacgcgtctcctaccgaaacaaatcccgcgacaactctaataaaaacaacttccgacttctacgatacgaacgaaaataacgaaatccgaccctcgccgtccaatccgcgcgaaacgatacccgcccctaaataaccaaatctcgacgaccgataaccgataacgccttaccgcgaccgctaccgcactcgcgaaaactaaccgacgccgaatacgcataaaccgacgaaacgcaaaactcgaaaccgaaacgccgaaaaaacaaaaccgataacgaaaataacgacgacgacgacgaaaacaacttctacgcctcttcgtatacacgattacaacgattatcacgctccccgacgcgcgaacgacccttccaaaacaaataacccaactcgactacgctaaacaacgccgacaacaaccccaccgcgaaataaaaaaacacgaaaacgatcttctcgataaaccgactcacgaaacaatcgaccgtatacgaacaaaacgaaccgacgcacgcgaaatacgaaaccacgcgaaaaccgtaaaacaacgcctaaccgcccaaaaaaatcaactcgaccaacaaacgcaacgccacgctcaacaaataacaacgacgcgcgcgacgaacgcgcaaaacgcacgacgcgcactaaacctcgaacaatccgaaaacgcactacgccgccgcctcaacgccgcccgcctccttacctacccgatacataaaataaacgacgaacaacaccgaaaacgccgaaaacaacaaaatataaaaaaaccaaaaacgataataaaaaaccgaaaaaacgcgatcgtaacaaatctaacgacaacccgactacaacgtattacacacgaactcctcttactcgtcctcgaacacgacgccgcccaccgtaaccaacaccaaaatacgaaaaatcaacataaccaccaaccaaaaacgacccacgaacgacgactacaac

SEQ ID NO: 20111 - DNA, 1079 bp, Artificial Sequence
  chemically treated genomic DNA (Homo sapiens) CpG-island No: 20111
gatttgtttgagtttatttttcgtttttagttcggtttgttttaggtgtcgtcggtagttattgggaggtagtacgaggtaagtgcgatgtcgttcgcgggtcgtttttataacgcgttttttgtcggggtaggtttcgcgatagttttggtggaagtagttttcggtttttgcggtgcgggcggaggtggcggggttcggttttcgtcgtttagttcgcgcgaggcggtgttcgtttttagatggttagatttcggcggtcggtggtcggtgacgttttgtcgcggtcgttgtcgtattcgcggaggttggtcggcgtcgggtgcgtataggtcggcggggcgtagggttcggggtcggggcgtcgggagggtagggtcggtggcggaggtggcggcggcggcggcgggagtagtttttgcgttttttcgtgtgtacggttgtagcggttgttacgtttttcggcgcgcgggcggtttttttagagtaggtggtttagttcggttacgttgagtagcgtcgatagtagttttatcgcgaaatagaagagtacgaagacggttttttcggtgggtcggtttacgaagtagtcgatcgtgtgcgggtagggcggatcggcgtacgcgaagtgcggggttacgcggaagtcgtagagtagcgtttggtcgtttaggaaggttagttcggttagtaggcgtagcgttacgtttagtaggtagtagcggcgcgcgcggcgggcgcgtagggcgtacggcgcgtattgggtttcgggtagttcgggggcgtattgcgtcgtcgttttagcgtcgttcgtttttttgtttgttcggtgtatggagtagacgacgaatagtatcgggggcgtcgagagtagtaggatgtggaagagttagaagcggtagtgggagatcgggaaggcgcggtcgtagtaggtttggcgatagttcggttgtagcgtgttgtatacgaattttttttgttcgttttcgaatacggcgtcgtttatcgtggttagtattaggatgcggaagattagtatgattattagttagaggcggtttacgagcggcgattgtagt

SEQ ID NO: 20112 - DNA, 1079 bp, Artificial Sequence
  chemically treated genomic DNA (Homo sapiens) CpG-island No: 20112
actacaatcgccgctcgtaaaccgcctctaactaataatcatactaatcttccgcatcctaatactaaccacgataaacgacgccgtattcgaaaacgaacaaaaaaaattcgtatacaacacgctacaaccgaactatcgccaaacctactacgaccgcgccttcccgatctcccactaccgcttctaactcttccacatcctactactctcgacgcccccgatactattcgtcgtctactccatacaccgaacaaacaaaaaaacgaacgacgctaaaacgacgacgcaatacgcccccgaactacccgaaacccaatacgcgccgtacgccctacgcgcccgccgcgcgcgccgctactacctactaaacgtaacgctacgcctactaaccgaactaaccttcctaaacgaccaaacgctactctacgacttccgcgtaaccccgcacttcgcgtacgccgatccgccctacccgcacacgatcgactacttcgtaaaccgacccaccgaaaaaaccgtcttcgtactcttctatttcgcgataaaactactatcgacgctactcaacgtaaccgaactaaaccacctactctaaaaaaaccgcccgcgcgccgaaaaacgtaacaaccgctacaaccgtacacacgaaaaaacgcaaaaactactcccgccgccgccgccgccacctccgccaccgaccctaccctcccgacgccccgaccccgaaccctacgccccgccgacctatacgcacccgacgccgaccaacctccgcgaatacgacaacgaccgcgacaaaacgtcaccgaccaccgaccgccgaaatctaaccatctaaaaacgaacaccgcctcgcgcgaactaaacgacgaaaaccgaaccccgccacctccgcccgcaccgcaaaaaccgaaaactacttccaccaaaactatcgcgaaacctaccccgacaaaaaacgcgttataaaaacgacccgcgaacgacatcgcacttacctcgtactacctcccaataactaccgacgacacctaaaacaaaccgaactaaaaacgaaaaataaactcaaacaaatc

SEQ ID NO: 20113 - DNA, 612 bp, Artificial Sequence
  chemically treated genomic DNA (Homo sapiens) CpG-island No: 20113
tcgtttcgtttatgtgtaataggtcgttggattcgcgttttaatacgttgttattgtgggtgtttcgcgcggtagcgtatatacggttcgaggttcggtttggggtacggtttagtaggttcgcgtagatcgtgcggaagtttttgcggaagtgtttggagattagcgcgtaaacgatggggttgacgtaggagttggcgtaggagattaggtgcgagaggatgcgaagcgtataagtggcgcgcgtgagcgggaattggtcgaattatacgtagaggatgagcgcgtggtggggtatttagtagaggtagaagagcgcggttacgatgaggattatgcgtgttattttgcgtttggcgcgtcgggtattcgagttcgcggttatcgggtcgacggcgcgttagaggtagcgtaaggtgcgcgcgtaggttaggtcgagaattagtataggaagtaggtagttgaagacgaaggtgtagatgtttatggcgcggcggcgaggggcgttttacgcgggatggtatacggttaggttggttagttgcgattggcggtagtagtttaggtagggttcggagaagagtagcgatagtttttagatgagttcgatgg

SEQ ID NO: 20114 - DNA, 612 bp, Artificial Sequence
  chemically treated genomic DNA (Homo sapiens) CpG-island No: 20114
ccatcgaactcatctaaaaactatcgctactcttctccgaaccctacctaaactactaccgccaatcgcaactaaccaacctaaccgtataccatcccgcgtaaaacgcccctcgccgccgcgccataaacatctacaccttcgtcttcaactacctacttcctatactaattctcgacctaacctacgcgcgcaccttacgctacctctaacgcgccgtcgacccgataaccgcgaactcgaatacccgacgcgccaaacgcaaaataacacgcataatcctcatcgtaaccgcgctcttctacctctactaaataccccaccacgcgctcatcctctacgtataattcgaccaattcccgctcacgcgcgccacttatacgcttcgcatcctctcgcacctaatctcctacgccaactcctacgtcaaccccatcgtttacgcgctaatctccaaacacttccgcaaaaacttccgcacgatctacgcgaacctactaaaccgtaccccaaaccgaacctcgaaccgtatatacgctaccgcgcgaaacacccacaataacaacgtattaaaacgcgaatccaacgacctattacacataaacgaaacga

SEQ ID NO: 20115 - DNA, 612 bp, Artificial Sequence
  chemically treated genomic DNA (Homo sapiens) CpG-island No: 20115
ttatcgggtttatttgggggttgtcgttgttttttttcgggttttatttgagttattatcgttagtcgtagttggttaatttgatcgtgtgttatttcgcgtggagcgtttttcgtcgtcgcgttatggatatttgtattttcgtttttagttatttgttttttgtgttggttttcggtttgatttacgcgcgtattttgcgttatttttggcgcgtcgtcgattcggtggtcgcgggttcgggtgttcggcgcgttaagcgtaaggtgatacgtatgatttttatcgtggtcgcgtttttttgtttttgttggatgttttattacgcgtttattttttgcgtgtggttcggttagttttcgtttacgcgcgttatttatgcgtttcgtattttttcgtatttggttttttacgttaatttttgcgttaattttatcgtttacgcgttggtttttaagtattttcgtaaaggttttcgtacgatttgcgcgggtttgttgggtcgtgttttaggtcgagtttcgggtcgtgtgtgcgttgtcgcgcggggtatttatagtggtagcgtgttggagcgcgagtttagcgatttgttgtatatgagcgaggcgg

SEQ ID NO: 20116 - DNA, 612 bp, Artificial Sequence
  chemically treated genomic DNA (Homo sapiens) CpG-island No: 20116
ccgcctcgctcatatacaacaaatcgctaaactcgcgctccaacacgctaccactataaataccccgcgcgacaacgcacacacgacccgaaactcgacctaaaacacgacccaacaaacccgcgcaaatcgtacgaaaacctttacgaaaatacttaaaaaccaacgcgtaaacgataaaattaacgcaaaaattaacgtaaaaaaccaaatacgaaaaaatacgaaacgcataaataacgcgcgtaaacgaaaactaaccgaaccacacgcaaaaaataaacgcgtaataaaacatccaacaaaaacaaaaaaacgcgaccacgataaaaatcatacgtatcaccttacgcttaacgcgccgaacacccgaacccgcgaccaccgaatcgacgacgcgccaaaaataacgcaaaatacgcgcgtaaatcaaaccgaaaaccaacacaaaaaacaaataactaaaaacgaaaatacaaatatccataacgcgacgacgaaaaacgctccacgcgaaataacacacgatcaaattaaccaactacgactaacgataataactcaaataaaacccgaaaaaaaacaacgacaacccccaaataaacccgataa

SEQ ID NO: 20117 - DNA, 1415 bp, Artificial Sequence
  chemically treated genomic DNA (Homo sapiens) CpG-island No: 20117
ttttcgcgcgacgtcgtaggcgaagtagttttaggtaggattttaaaaagcgatttgtagagttcgagtttttgatcgttcgtttgtcgttttcggtttcgtcgtgtatacgtttttcgtttttttcggttcgtttttcgttatagttgttggattcgcgtttcgttagtggcgtttttcgcgttgtattaggtagcgtcgcgcggagttcggttttggtcggaagtttaagagaggcgtagattttcggcggcgcgttgggttcgggaggtttttgggcgtatttgttcgggcggagcggagcggggcggggcgggcgtagggcgcgggttcggacgttggagggggttgtggttttttcgcgttttcgttgttcgggttgcgcggcgttcgttttttttcgtcgaggggtcggtttagattcggggaggggcggtggttattgtatttttcgttcgtcggttttagaggcggcgggttcggcgcgggcgtagcggtgcgggcgttcggttggggcgcggggcggggacgcggtcgttgttcgttttgcgtcgtttttttttgcgcgagtagcgttggtttcggcgtcgaggcggttatggcgattcggagttcgttttttatttatttcgtttgtttcgttttttttttcgtttcgcgttatttttgatggttcggattttagtcggttatcgttagttttgttcgcgcgttcgcgtcgtcgtcgttcgcgggtattaatagtcggcgtcgtcgcgttttcggtcgtcgggggtttgggagtcgtcgatttcggagttcgagtcgggagagggagtcgtcgtagtcgtcggcgttgtggaggtaggaggcgcgcggtgaataatgatcgcggcgggagggcgggggtcggcggggttcgggtcgcgggcggtaatttgtgcgagtttaggttttcgtagcgtacggtcgcggttgcgggcgaaggtgggcgcgtggttttcgaggttttgttttgcgtagtcgggcggcgggtcgggttcgggtagtttcggttattatcgtaggagttcgggggtttcggggtttcgggttgttttttgcgtttttttttttttattttcgtcgacgtcgggttgcggggtttcgcgtcggttttcgttcgtttttttcgatttcggcgtttttttttcgttttttttcgttttattcgttcgttgatagcgttggacgtcgttttcggatttcgggtcgtaatttcggtttttgaggtcggttgcgggtcggggaggtggtcgttggcgcggatgtcgtcgggtgttcgtcgttcgtttacgcgcggcgcgagggttttcggcgggtgataaagaggaatatattttttgtttaagttagatttgtgtttttttttattgtttgtttttatgtagggtaaa

SEQ ID NO: 20118 - DNA, 1415 bp, Artificial Sequence
  chemically treated genomic DNA (Homo sapiens) CpG-island No: 20118
tttaccctacataaaaacaaacaataaaaaaaaacacaaatctaacttaaacaaaaaatatattcctctttatcacccgccgaaaaccctcgcgccgcgcgtaaacgaacgacgaacacccgacgacatccgcgccaacgaccacctccccgacccgcaaccgacctcaaaaaccgaaattacgacccgaaatccgaaaacgacgtccaacgctatcaacgaacgaataaaacgaaaaaaaacgaaaaaaaaacgccgaaatcgaaaaaaacgaacgaaaaccgacgcgaaaccccgcaacccgacgtcgacgaaaataaaaaaaaaaaaacgcaaaaaacaacccgaaaccccgaaacccccgaactcctacgataataaccgaaactacccgaacccgacccgccgcccgactacgcaaaacaaaacctcgaaaaccacgcgcccaccttcgcccgcaaccgcgaccgtacgctacgaaaacctaaactcgcacaaattaccgcccgcgacccgaaccccgccgacccccgccctcccgccgcgatcattattcaccgcgcgcctcctacctccacaacgccgacgactacgacgactccctctcccgactcgaactccgaaatcgacgactcccaaacccccgacgaccgaaaacgcgacgacgccgactattaatacccgcgaacgacgacgacgcgaacgcgcgaacaaaactaacgataaccgactaaaatccgaaccatcaaaaataacgcgaaacgaaaaaaaaaacgaaacaaacgaaataaataaaaaacgaactccgaatcgccataaccgcctcgacgccgaaaccaacgctactcgcgcaaaaaaaaacgacgcaaaacgaacaacgaccgcgtccccgccccgcgccccaaccgaacgcccgcaccgctacgcccgcgccgaacccgccgcctctaaaaccgacgaacgaaaaatacaataaccaccgcccctccccgaatctaaaccgacccctcgacgaaaaaaaacgaacgccgcgcaacccgaacaacgaaaacgcgaaaaaaccacaaccccctccaacgtccgaacccgcgccctacgcccgccccgccccgctccgctccgcccgaacaaatacgcccaaaaacctcccgaacccaacgcgccgccgaaaatctacgcctctcttaaacttccgaccaaaaccgaactccgcgcgacgctacctaatacaacgcgaaaaacgccactaacgaaacgcgaatccaacaactataacgaaaaacgaaccgaaaaaaacgaaaaacgtatacacgacgaaaccgaaaacgacaaacgaacgatcaaaaactcgaactctacaaatcgctttttaaaatcctacctaaaactacttcgcctacgacgtcgcgcgaaaa

SEQ ID NO: 20119 - DNA, 1415 bp, Artificial Sequence
  chemically treated genomic DNA (Homo sapiens) CpG-island No: 20119
tttgttttgtataaaggtagatagtaaagagagatataaatttaatttgggtagagggtgtgtttttttttgttattcgtcgggaattttcgcgtcgcgcgtgggcgagcggcgggtattcggcggtattcgcgttagcggttattttttcggttcgtaatcggttttaggggtcgagattgcggttcgaggttcggaagcggcgtttagcgttgttagcgggcgggtaggacggaaggaaacgggggaagggcgtcggggtcgggggaggcgagcggggatcggcgcggagtttcgtagttcgacgtcggcggaggtgaggggagaggggcgtagggggtagttcggagtttcgaggttttcgagtttttgcgatggtggtcggggttgttcgggttcgattcgtcgttcgattgcgtagggtaggatttcggggattacgcgtttattttcgttcgtagtcgcggtcgtgcgttgcgggagtttggattcgtataagttgtcgttcgcggttcggatttcgtcggttttcgttttttcgtcgcggttattgtttatcgcgcgttttttatttttatagcgtcggcggttgcggcggttttttttttcggttcgggtttcgggatcggcggtttttaagttttcggcggtcgagggcgcggcggcgtcggttattaatattcgcggacggcggcggcgcgggcgcgcgagtagggttggcggtggtcggttgaggttcgagttattaaaggtggcgcggggcggaggggagggcggagtaggcggggtgggtggggagcgggtttcgggtcgttatggtcgtttcgacgtcggggttagcgttattcgcgtagggaggagcggcgtaaagcgggtagcggtcgcgttttcgtttcgcgttttagtcgagcgttcgtatcgttgcgttcgcgtcggattcgtcgtttttgaggtcggcgagcgggaagtgtagtggttatcgttttttttcgggtttgggtcggtttttcggcggggggaggcgggcgtcgcgtagttcgagtagcggggacgcgggagagttatagttttttttagcgttcgggttcgcgttttgcgttcgtttcgtttcgtttcgtttcgttcgggtaggtgcgtttaggggtttttcgagtttagcgcgtcgtcggggatttgcgttttttttgggttttcggttagggtcgggtttcgcgcggcgttatttaatgtagcgcggggagcgttattggcgagacgcgaatttagtagttgtggcgaaaaacgaatcggggagagcgggagacgtgtgtacggcgaagtcgggagcggtaggcgggcggttaggggttcggattttgtaggtcgttttttgaggttttgtttggggttgtttcgtttgcgacgtcgcgcgggga

SEQ ID NO: 20120 - DNA, 1415 bp, Artificial Sequence
  chemically treated genomic DNA (Homo sapiens) CpG-island No: 20120
tccccgcgcgacgtcgcaaacgaaacaaccccaaacaaaacctcaaaaaacgacctacaaaatccgaacccctaaccgcccgcctaccgctcccgacttcgccgtacacacgtctcccgctctccccgattcgtttttcgccacaactactaaattcgcgtctcgccaataacgctccccgcgctacattaaataacgccgcgcgaaacccgaccctaaccgaaaacccaaaaaaaacgcaaatccccgacgacgcgctaaactcgaaaaacccctaaacgcacctacccgaacgaaacgaaacgaaacgaaacgaacgcaaaacgcgaacccgaacgctaaaaaaaactataactctcccgcgtccccgctactcgaactacgcgacgcccgcctccccccgccgaaaaaccgacccaaacccgaaaaaaaacgataaccactacacttcccgctcgccgacctcaaaaacgacgaatccgacgcgaacgcaacgatacgaacgctcgactaaaacgcgaaacgaaaacgcgaccgctacccgctttacgccgctcctccctacgcgaataacgctaaccccgacgtcgaaacgaccataacgacccgaaacccgctccccacccaccccgcctactccgccctcccctccgccccgcgccacctttaataactcgaacctcaaccgaccaccgccaaccctactcgcgcgcccgcgccgccgccgtccgcgaatattaataaccgacgccgccgcgccctcgaccgccgaaaacttaaaaaccgccgatcccgaaacccgaaccgaaaaaaaaaaccgccgcaaccgccgacgctataaaaataaaaaacgcgcgataaacaataaccgcgacgaaaaaacgaaaaccgacgaaatccgaaccgcgaacgacaacttatacgaatccaaactcccgcaacgcacgaccgcgactacgaacgaaaataaacgcgtaatccccgaaatcctaccctacgcaatcgaacgacgaatcgaacccgaacaaccccgaccaccatcgcaaaaactcgaaaacctcgaaactccgaactaccccctacgcccctctcccctcacctccgccgacgtcgaactacgaaactccgcgccgatccccgctcgcctcccccgaccccgacgcccttcccccgtttccttccgtcctacccgcccgctaacaacgctaaacgccgcttccgaacctcgaaccgcaatctcgacccctaaaaccgattacgaaccgaaaaaataaccgctaacgcgaataccgccgaatacccgccgctcgcccacgcgcgacgcgaaaattcccgacgaataacaaaaaaaaacacaccctctacccaaattaaatttatatctctctttactatctacctttatacaaaacaaa

SEQ ID NO: 20121 - DNA, 543 bp, Artificial Sequence
  chemically treated genomic DNA (Homo sapiens) CpG-island No: 20121
ttttttgtcggtttcgttcggttcggtttatttcgtttttatttcggcgtttatttattgttttttcgcgtagttatcgagcgtagatttcgcgttttcgattggaacgtttttttattatttagttatatttaggggttggacgttttattttcgttttcgagttataaaaggtttaggatcgtttttttcgagttagtaggtaaagtcgcggcggcgggagggaggtcgggaggggtcgcgcgtttcggtcggtttagtcggggaaggggagcggcgggcggggcggggggtagcgtattatatataatttttttttgtcgtgcgatcgcgttttgttttcgtttcggggttttcgtttcgtaagttttgattataatgtcggagtcgtcgagttatttttgttattttgttcggggacggttttggggtagttattatcgcgaagtacggagggtggggcgggtcgggtttcggggaggggtggggggatgtgaaaggtttcggatgttgttgaacgggagttttttttagagggagtga

SEQ ID NO: 20122 - DNA, 543 bp, Artificial Sequence
  chemically treated genomic DNA (Homo sapiens) CpG-island No: 20122
tcactccctctaaaaaaaactcccgttcaacaacatccgaaacctttcacatccccccacccctccccgaaacccgacccgccccaccctccgtacttcgcgataataactaccccaaaaccgtccccgaacaaaataacaaaaataactcgacgactccgacattataatcaaaacttacgaaacgaaaaccccgaaacgaaaacaaaacgcgatcgcacgacaaaaaaaaattatatataatacgctaccccccgccccgcccgccgctccccttccccgactaaaccgaccgaaacgcgcgacccctcccgacctccctcccgccgccgcgactttacctactaactcgaaaaaaacgatcctaaaccttttataactcgaaaacgaaaataaaacgtccaacccctaaatataactaaataataaaaaaacgttccaatcgaaaacgcgaaatctacgctcgataactacgcgaaaaaacaataaataaacgccgaaataaaaacgaaataaaccgaaccgaacgaaaccgacaaaaaa

SEQ ID NO: 20123 - DNA, 543 bp, Artificial Sequence
  chemically treated genomic DNA (Homo sapiens) CpG-island No: 20123
ttattttttttggaaggggttttcgtttagtaatattcgggattttttatatttttttattttttttcgaggttcggttcgttttatttttcgtgtttcgcggtagtaattgttttagggtcgttttcgggtaggatgataagggtggttcggcggtttcggtattgtgattaggatttgcggggcgggggtttcggggcgggggtagggcgcggtcgtacggtaagggagggttgtgtgtggtgcgttgtttttcgtttcgttcgtcgtttttttttttcggttgggtcgatcggggcgcgcggtttttttcggtttttttttcgtcgtcgcggttttatttgttggttcgggggaagcggttttagattttttatggttcggaaacgggagtgaggcgtttagtttttgagtgtggttgagtgatggggaggcgttttaatcgagagcgcgggatttgcgttcggtgattgcgcgaggggataatgggtgggcgtcgaggtgggggcgaggtgggtcgggtcgggcggagtcggtaggagg

SEQ ID NO: 20124 - DNA, 543 bp, Artificial Sequence
  chemically treated genomic DNA (Homo sapiens) CpG-island No: 20124
cctcctaccgactccgcccgacccgacccacctcgcccccacctcgacgcccacccattatcccctcgcgcaatcaccgaacgcaaatcccgcgctctcgattaaaacgcctccccatcactcaaccacactcaaaaactaaacgcctcactcccgtttccgaaccataaaaaatctaaaaccgcttcccccgaaccaacaaataaaaccgcgacgacgaaaaaaaaaccgaaaaaaaccgcgcgccccgatcgacccaaccgaaaaaaaaaaacgacgaacgaaacgaaaaacaacgcaccacacacaaccctcccttaccgtacgaccgcgccctacccccgccccgaaacccccgccccgcaaatcctaatcacaataccgaaaccgccgaaccacccttatcatcctacccgaaaacgaccctaaaacaattactaccgcgaaacacgaaaaataaaacgaaccgaacctcgaaaaaaaataaaaaaatataaaaaatcccgaatattactaaacgaaaaccccttccaaaaaaaataa

SEQ ID NO: 20125 - DNA, 890 bp, Artificial Sequence
  chemically treated genomic DNA (Homo sapiens) CpG-island No: 20125
cgtcgttgttgtcgtcgtcgtcgtttagagattgttgagttcgttcgttcgtcgttattatttatttcggatataggtgaggaattcggtcgtcgtcgcgtttcgttttttgttttaggttagtttttcgaacgcgtgggagtcgttttcgtttcgtttttttatttttattcgtttcgcggtggcggcgtcgggttgaggcggagtttttttagcggatacgggcggcggtttttttttcgttgggttcgggagggcggttagcggtcgttttcggttttttgttttcgtatcgacgtttcggcgtcgatcggtgttcgttttttcgttttgttttcgggggtgggtagggcgtttatacgcgagatttttggggatttttttgtcgtcggttttcgaaggtggacgaggtatggtcggggcgtcgtcggtcgcgatttatttttatttttgtttttgcgggtttttattttttttttcgtcgtttttttcgttttcgttcgagataatgattcggcggcggcggcggcgggtatcgtagtggcgtaggtgaggtcgtttttttttttttttttcggtcgtttttttttttttttttttttcgcgtagttttcgcgttgggcgttgcggcggcgggattcggtttttttttatttcgggaggcggtggcgcggcggggaggggtcgggggtttcggggatttaagcgcgagggaaaggtttggtcgagagcgggtcggagtttaggtttggcgcggcggcgttcgttaggtagatcggggcgaggttgcgcgtcggcgggaggggagtttattgcggggtgaggttttggggtggggttcgtttgggatttagagttgaattttttgggtttcgcggtgggaggaagga

SEQ ID NO: 20126 - DNA, 890 bp, Artificial Sequence
  chemically treated genomic DNA (Homo sapiens) CpG-island No: 20126
tccttcctcccaccgcgaaacccaaaaaattcaactctaaatcccaaacgaaccccaccccaaaacctcaccccgcaataaactcccctcccgccgacgcgcaacctcgccccgatctacctaacgaacgccgccgcgccaaacctaaactccgacccgctctcgaccaaacctttccctcgcgcttaaatccccgaaacccccgacccctccccgccgcgccaccgcctcccgaaataaaaaaaaaccgaatcccgccgccgcaacgcccaacgcgaaaactacgcgaaaaaaaaaaaaaaaaaaaaacgaccgaaaaaaaaaaaaaaaaacgacctcacctacgccactacgatacccgccgccgccgccgccgaatcattatctcgaacgaaaacgaaaaaaacgacgaaaaaaaaaataaaaacccgcaaaaacaaaaataaaaataaatcgcgaccgacgacgccccgaccatacctcgtccaccttcgaaaaccgacgacaaaaaaatccccaaaaatctcgcgtataaacgccctacccacccccgaaaacaaaacgaaaaaacgaacaccgatcgacgccgaaacgtcgatacgaaaacaaaaaaccgaaaacgaccgctaaccgccctcccgaacccaacgaaaaaaaaaccgccgcccgtatccgctaaaaaaactccgcctcaacccgacgccgccaccgcgaaacgaataaaaataaaaaaacgaaacgaaaacgactcccacgcgttcgaaaaactaacctaaaacaaaaaacgaaacgcgacgacgaccgaattcctcacctatatccgaaataaataataacgacgaacgaacgaactcaacaatctctaaacgacgacgacgacaacaacgacg

SEQ ID NO: 20127 - DNA, 890 bp, Artificial Sequence
  chemically treated genomic DNA (Homo sapiens) CpG-island No: 20127
tttttttttttatcgcggagtttaggaaatttagttttaggttttaggcgagttttattttaaaattttatttcgtagtggatttttttttcgtcggcgcgtagtttcgtttcggtttatttggcgggcgtcgtcgcgttaggtttgggtttcggttcgttttcggttaggtttttttttcgcgtttgggttttcgaggttttcggttttttttcgtcgcgttatcgtttttcggggtgggggagggtcgggtttcgtcgtcgtagcgtttagcgcggaggttgcgcgagggggagggaaaggagggggcggtcgagggagaggggagggggcggttttatttgcgttattgcgatgttcgtcgtcgtcgtcgtcgagttattatttcgggcggaagcgagaagggcggcgagggagggggtggaagttcgtagagataagggtggggatggatcgcggtcggcggcgtttcggttatgtttcgtttattttcgggagtcggcgatagggagatttttagggatttcgcgtgtgggcgttttatttattttcgggggtaggacgggggagcgagtatcgatcggcgtcggggcgtcgatgcggaagtaaggagtcggaggcggtcgttagtcgttttttcgagtttagcggaagaggagtcgtcgttcgtgttcgttgaggagatttcgttttagttcggcgtcgttatcgcggggcgagtggggatgaggggacggagcgaggacggtttttacgcgttcggaaggttggtttgggataggaagcgaggcgcggcggcggtcgggttttttatttgtgttcggagtgggtggtggcggcggacggacgggtttagtagtttttgggcggcggcggcggtagtagcggcg

SEQ ID NO: 20128 - DNA, 890 bp, Artificial Sequence
  chemically treated genomic DNA (Homo sapiens) CpG-island No: 20128
cgccgctactaccgccgccgccgcccaaaaactactaaacccgtccgtccgccgccaccacccactccgaacacaaataaaaaacccgaccgccgccgcgcctcgcttcctatcccaaaccaaccttccgaacgcgtaaaaaccgtcctcgctccgtcccctcatccccactcgccccgcgataacgacgccgaactaaaacgaaatctcctcaacgaacacgaacgacgactcctcttccgctaaactcgaaaaaacgactaacgaccgcctccgactccttacttccgcatcgacgccccgacgccgatcgatactcgctcccccgtcctacccccgaaaataaataaaacgcccacacgcgaaatccctaaaaatctccctatcgccgactcccgaaaataaacgaaacataaccgaaacgccgccgaccgcgatccatccccacccttatctctacgaacttccaccccctccctcgccgcccttctcgcttccgcccgaaataataactcgacgacgacgacgacgaacatcgcaataacgcaaataaaaccgccccctcccctctccctcgaccgccccctcctttccctccccctcgcgcaacctccgcgctaaacgctacgacgacgaaacccgaccctcccccaccccgaaaaacgataacgcgacgaaaaaaaaccgaaaacctcgaaaacccaaacgcgaaaaaaaaacctaaccgaaaacgaaccgaaacccaaacctaacgcgacgacgcccgccaaataaaccgaaacgaaactacgcgccgacgaaaaaaaaatccactacgaaataaaattttaaaataaaactcgcctaaaacctaaaactaaatttcctaaactccgcgataaaaaaaaaaa

SEQ ID NO: 20129 - DNA, 819 bp, Artificial Sequence
  chemically treated genomic DNA (Homo sapiens) CpG-island No: 20129
cgcgtatagcggtaattcgggcgtgcgggggcgcgcgcggttagggaggggtttgcggaggcgcgaggttttcggaagcgtttttttcggaaggtagggaggtagcgtcggttttcggaggcggtttgggcgatggcggcggagttttgtttataacgtgggtaatcgcgtagttggaggatggttttattcgggtttgtcgtagttggggagtaggcgtcgggggttgaggcggagtcgggtttcgcggggtcgtcgtcgtcgtttttatcgttttttttggggtttttgttttttttgtagcgggaatttttttataattggtaggcgattaaggcgtcgttgaaggagcgtttcgtttttttttttaattcggagttgttgagcgatgtgcgtttcgtattgggtaagggtcgcggcgtcgtcgtcgttgggggttcgtagcgtattttcgtttatcgtttcgtgttggcggtcggtagcgtcgtttttgacgttatgtttaacggcggtatggttattacgtcggtcgagatcgagttgtcggacgtggagttcgtagtttttttggcgttgttgaggtgagcggtagcgcgggtcgggtcgggtcgggtcgggtcgggtcgggttgggagattttcggggttcggtttattcggattttcggatgattttgggttgggtttttttgattcgttcggggttttagttttttttcgagtcgttgatgtttcggagggtcgaaatcgaaatttgtgaattaggacggtttagtcgttaattaaacgttagtgtttttattaggtaagcgtgcgtttt

SEQ ID NO: 20130 - DNA, 819 bp, Artificial Sequence
  chemically treated genomic DNA (Homo sapiens) CpG-island No: 20130
aaaacgcacgcttacctaataaaaacactaacgtttaattaacgactaaaccgtcctaattcacaaatttcgatttcgaccctccgaaacatcaacgactcgaaaaaaaactaaaaccccgaacgaatcaaaaaaacccaacccaaaatcatccgaaaatccgaataaaccgaaccccgaaaatctcccaacccgacccgacccgacccgacccgacccgacccgcgctaccgctcacctcaacaacgccaaaaaaactacgaactccacgtccgacaactcgatctcgaccgacgtaataaccataccgccgttaaacataacgtcaaaaacgacgctaccgaccgccaacacgaaacgataaacgaaaatacgctacgaacccccaacgacgacgacgccgcgacccttacccaatacgaaacgcacatcgctcaacaactccgaattaaaaaaaaaaacgaaacgctccttcaacgacgccttaatcgcctaccaattataaaaaaattcccgctacaaaaaaaacaaaaaccccaaaaaaaacgataaaaacgacgacgacgaccccgcgaaacccgactccgcctcaacccccgacgcctactccccaactacgacaaacccgaataaaaccatcctccaactacgcgattacccacgttataaacaaaactccgccgccatcgcccaaaccgcctccgaaaaccgacgctacctccctaccttccgaaaaaaacgcttccgaaaacctcgcgcctccgcaaacccctccctaaccgcgcgcgcccccgcacgcccgaattaccgctatacgcg

SEQ ID NO: 20131 - DNA, 819 bp, Artificial Sequence
  chemically treated genomic DNA (Homo sapiens) CpG-island No: 20131
aaaacgtacgtttgtttaatgaagatattaacgtttagttggcgattgagtcgttttggtttatagatttcgatttcgatttttcggagtattaacggttcgggaggaaattgaggtttcgggcgggttagaagagtttagtttaaggttattcgggagttcgggtaggtcgggtttcggggattttttagttcggttcggttcggttcggttcggttcggttcgcgttgtcgtttattttagtagcgttaggaaggttgcgggttttacgttcggtagttcgatttcggtcgacgtggtggttatgtcgtcgttgaatatggcgttaaagacggcgttgtcggtcgttagtacgaagcggtgggcggggatgcgttgcgggtttttagcggcggcggcgtcgcgatttttgtttagtacgaagcgtatatcgtttagtagtttcgagttgaagaggaaggcgaagcgtttttttagcgacgttttggtcgtttgttagttgtagagaggttttcgttgtagggggagtaggggttttagagaggacggtgagggcggcggcggcggtttcgcggggttcggtttcgttttagttttcgacgtttgttttttagttgcggtaggttcgagtgaggttattttttagttgcgcggttgtttacgttatggataaaatttcgtcgttatcgtttaggtcgttttcggaggtcggcgttgtttttttgtttttcgggaaaggcgttttcgggggtttcgcgttttcgtaggtttttttttgatcgcgcgcgttttcgtacgttcgggttgtcgttgtgcgcg

SEQ ID NO: 20132 - DNA, 819 bp, Artificial Sequence
  chemically treated genomic DNA (Homo sapiens) CpG-island No: 20132
cgcgcacaacgacaacccgaacgtacgaaaacgcgcgcgatcaaaaaaaaacctacgaaaacgcgaaacccccgaaaacgcctttcccgaaaaacaaaaaaacaacgccgacctccgaaaacgacctaaacgataacgacgaaattttatccataacgtaaacaaccgcgcaactaaaaaataacctcactcgaacctaccgcaactaaaaaacaaacgtcgaaaactaaaacgaaaccgaaccccgcgaaaccgccgccgccgccctcaccgtcctctctaaaacccctactccccctacaacgaaaacctctctacaactaacaaacgaccaaaacgtcgctaaaaaaacgcttcgccttcctcttcaactcgaaactactaaacgatatacgcttcgtactaaacaaaaatcgcgacgccgccgccgctaaaaacccgcaacgcatccccgcccaccgcttcgtactaacgaccgacaacgccgtctttaacgccatattcaacgacgacataaccaccacgtcgaccgaaatcgaactaccgaacgtaaaacccgcaaccttcctaacgctactaaaataaacgacaacgcgaaccgaaccgaaccgaaccgaaccgaaccgaactaaaaaatccccgaaacccgacctacccgaactcccgaataaccttaaactaaactcttctaacccgcccgaaacctcaatttcctcccgaaccgttaatactccgaaaaatcgaaatcgaaatctataaaccaaaacgactcaatcgccaactaaacgttaatatcttcattaaacaaacgtacgtttt

SEQ ID NO: 20133 - DNA, 735 bp, Artificial Sequence
  chemically treated genomic DNA (Homo sapiens) CpG-island No: 20133
atttttgtttcgcggcggacggttttagttttttcggaaaagttgcgaggttttcgtcgcggcgagttaattttcgtcgtttttcggcgcgattttcgtcgcgtcggtttatttatttatgttgggtcgttaggtggttgaagatataggtgatcgggatggtcgagagggatagtacgaagatttcggtggtcgtagaggtatttatcgtagtcgtcgcgtcgttcgttttttatcgtatttcgttgggcgtttcgttttagttttcggcggcgttcgcgtttttttggcgtttgtttttcgaggcgttttagtcgcgtttttcgcgtggcgtttttagcggcgtttttttagcggtgtttttttcgcgcgtttttttagttcgtagtcgtttttcgcgtttggtttcgtcgttttaagtgcgtagggtcgcggtgtagtttcgggaggcgtttttgtagtgtttttgttaggggcgttacggtttagcggtaagcgttcggcggcgtcgaggggcggcgatattttcgcgtagggataggtgtttttggcggcgcgcgtttcgagggagggttcggggtacggtcgggaatcggttatcgaagagttggagaggcgcggggttgagttgcggttcgggaaaggtggaattagattcgagggtgttagaggaggaagggttcgcgggatcgtttatgggggagtttacggtttagaagtgggaaaggataaaat

SEQ ID NO: 20134 - DNA, 735 bp, Artificial Sequence
  chemically treated genomic DNA (Homo sapiens) CpG-island No: 20134
attttatcctttcccacttctaaaccgtaaactcccccataaacgatcccgcgaacccttcctcctctaacaccctcgaatctaattccacctttcccgaaccgcaactcaaccccgcgcctctccaactcttcgataaccgattcccgaccgtaccccgaaccctccctcgaaacgcgcgccgccaaaaacacctatccctacgcgaaaatatcgccgcccctcgacgccgccgaacgcttaccgctaaaccgtaacgcccctaacaaaaacactacaaaaacgcctcccgaaactacaccgcgaccctacgcacttaaaacgacgaaaccaaacgcgaaaaacgactacgaactaaaaaaacgcgcgaaaaaaacaccgctaaaaaaacgccgctaaaaacgccacgcgaaaaacgcgactaaaacgcctcgaaaaacaaacgccaaaaaaacgcgaacgccgccgaaaactaaaacgaaacgcccaacgaaatacgataaaaaacgaacgacgcgacgactacgataaatacctctacgaccaccgaaatcttcgtactatccctctcgaccatcccgatcacctatatcttcaaccacctaacgacccaacataaataaataaaccgacgcgacgaaaatcgcgccgaaaaacgacgaaaattaactcgccgcgacgaaaacctcgcaacttttccgaaaaaactaaaaccgtccgccgcgaaacaaaaat

SEQ ID NO: 20135 - DNA, 735 bp, Artificial Sequence
  chemically treated genomic DNA (Homo sapiens) CpG-island No: 20135
attttgtttttttttatttttgggtcgtgggtttttttatagacgatttcgcgggtttttttttttttgatattttcggatttggttttatttttttcggatcgtagtttagtttcgcgtttttttagtttttcgatgatcggttttcggtcgtgtttcgggttttttttcggagcgcgcgtcgttaggggtatttgtttttgcgcgggggtgtcgtcgtttttcggcgtcgtcgggcgtttgtcgttgagtcgtggcgtttttggtaggagtattgtaaggacgtttttcgggattgtatcgcggttttgcgtatttggggcgacggggttaggcgcgggggacggttgcgggttgggagggcgcgcggaggagatatcgttgaggggacgtcgttgagggcgttacgcggggggcgcggttgaggcgtttcgaagggtaagcgttaagggggcgcgggcgtcgtcggaagttggggcggggcgtttagcgggatgcggtgaagggcgagcggcgcggcggttgcgatgagtgtttttgcggttatcggggttttcgtgttgtttttttcggttatttcggttatttatgtttttaattatttggcggtttagtatgagtgagtgagtcggcgcggcgggggtcgcgtcgaggggcggcgggagttggttcgtcgcgacgggagtttcgtaattttttcgagggggttgggatcgttcgtcgcgggatagaggt

SEQ ID NO: 20136 - DNA, 735 bp, Artificial Sequence
  chemically treated genomic DNA (Homo sapiens) CpG-island No: 20136
acctctatcccgcgacgaacgatcccaaccccctcgaaaaaattacgaaactcccgtcgcgacgaaccaactcccgccgcccctcgacgcgacccccgccgcgccgactcactcactcatactaaaccgccaaataattaaaaacataaataaccgaaataaccgaaaaaaacaacacgaaaaccccgataaccgcaaaaacactcatcgcaaccgccgcgccgctcgcccttcaccgcatcccgctaaacgccccgccccaacttccgacgacgcccgcgcccccttaacgcttacccttcgaaacgcctcaaccgcgccccccgcgtaacgccctcaacgacgtcccctcaacgatatctcctccgcgcgccctcccaacccgcaaccgtcccccgcgcctaaccccgtcgccccaaatacgcaaaaccgcgatacaatcccgaaaaacgtccttacaatactcctaccaaaaacgccacgactcaacgacaaacgcccgacgacgccgaaaaacgacgacacccccgcgcaaaaacaaatacccctaacgacgcgcgctccgaaaaaaaacccgaaacacgaccgaaaaccgatcatcgaaaaactaaaaaaacgcgaaactaaactacgatccgaaaaaaataaaaccaaatccgaaaatatcaaaaaaaaaaaaacccgcgaaatcgtctataaaaaaacccacgacccaaaaataaaaaaaaacaaaat

SEQ ID NO: 20137 - DNA, 1191 bp, Artificial Sequence
  chemically treated genomic DNA (Homo sapiens) CpG-island No: 20137
ggggttcggttagttcgtttttagtttcgttagcgagatttttttttttcgttcgggtggcgagatttttttggttcgtacgtttggttttcggggttgggaggcgtgtgtgtcgttttaaaagttttttttcggcgcggcgggtcggttttttttttgatagcgtcgaggtaagcggagttaagcgagtcgggcggtttttaagggagttagcgttcgttcgggcggttagttcggcggggggcggcggggcgggtcgggggcggtcggggcgcgggcggcgcggcgtcgcggcgtttggggagcgggtttaggtttcgggagttcggcggggtagggtagggcgaggcggtgaagggaggtttagtttcgattcggcgttttgtttgttttatcggcggcgattcggcgttcgggggttgttgaggcggggagtcgagagcgaacggacgggaggtagcggagtcgagcggaggttgcgagtttagtgcgtttcggttcggttcggttcgtcgttcgtttttttttttttttttttttcgtcgcgtttttttttttcgttttttttcgtttttttttttttttttcgttcggcgttgttttcgtttgcgttcgggtcgtcgaatttagttcggtcggggttttcggtttcgcgcgttttcggttgggttcggcggggatcgggttttcgcggttgatatcgttttttttcggggattcggtggatttcggatttttcggaacgtgaattgagtcgtgggagcggtttcgtttagggtcgatcgcggggttgggttgagtagattttcgcggtcgtttcggacgtcgcgggtgtcggggtacggacgttttgggttcgggttgagcgcgtttcgggcgttcggcggtgttagtttatttcgggcggggtggggtagggtagattttagcggaatacggattcggtcgatttggattgggtagagcgaatttcggacggtgtagagttcggggaatgtcgggcgtgggttgaggggatttcggcgtttttttagtttttcgattttggtttacgcgttgggatttgttcggcgttttttttgttttttcgcgtttcggttatttgtggtttcggagttttaaatttgtcggattttcgtttattttcgatttcgagtttggagaggtttgagaaagattttttttgttttt

SEQ ID NO: 20138 - DNA, 1191 bp, Artificial Sequence
  chemically treated genomic DNA (Homo sapiens) CpG-island No: 20138
aaaaacaaaaaaaatctttctcaaacctctccaaactcgaaatcgaaaataaacgaaaatccgacaaatttaaaactccgaaaccacaaataaccgaaacgcgaaaaaacaaaaaaaacgccgaacaaatcccaacgcgtaaaccaaaatcgaaaaactaaaaaaacgccgaaatcccctcaacccacgcccgacattccccgaactctacaccgtccgaaattcgctctacccaatccaaatcgaccgaatccgtattccgctaaaatctaccctaccccaccccgcccgaaataaactaacaccgccgaacgcccgaaacgcgctcaacccgaacccaaaacgtccgtaccccgacacccgcgacgtccgaaacgaccgcgaaaatctactcaacccaaccccgcgatcgaccctaaacgaaaccgctcccacgactcaattcacgttccgaaaaatccgaaatccaccgaatccccgaaaaaaaacgatatcaaccgcgaaaacccgatccccgccgaacccaaccgaaaacgcgcgaaaccgaaaaccccgaccgaactaaattcgacgacccgaacgcaaacgaaaacaacgccgaacgaaaaaaaaaaaaaaaaacgaaaaaaaacgaaaaaaaaaaacgcgacgaaaaaaaaaaaaaaaaaaaaacgaacgacgaaccgaaccgaaccgaaacgcactaaactcgcaacctccgctcgactccgctacctcccgtccgttcgctctcgactccccgcctcaacaacccccgaacgccgaatcgccgccgataaaacaaacaaaacgccgaatcgaaactaaacctcccttcaccgcctcgccctaccctaccccgccgaactcccgaaacctaaacccgctccccaaacgccgcgacgccgcgccgcccgcgccccgaccgcccccgacccgccccgccgccccccgccgaactaaccgcccgaacgaacgctaactcccttaaaaaccgcccgactcgcttaactccgcttacctcgacgctatcaaaaaaaaaaccgacccgccgcgccgaaaaaaaacttttaaaacgacacacacgcctcccaaccccgaaaaccaaacgtacgaaccaaaaaaatctcgccacccgaacgaaaaaaaaaaatctcgctaacgaaactaaaaacgaactaaccgaacccc

SEQ ID NO: 20139 - DNA, 1191 bp, Artificial Sequence
  chemically treated genomic DNA (Homo sapiens) CpG-island No: 20139
gggggtaggaaaaattttttttaagtttttttaggttcggggtcgggaatgagcgagggttcggtagatttggggtttcgaggttataggtgatcggggcgcggggaggtagaggagacgtcgggtaggttttagcgcgtgagttaaagtcggagggttgggagggcgtcgggatttttttagtttacgttcggtatttttcgggttttgtatcgttcgggattcgttttgtttagtttagatcggtcgggttcgtgtttcgttggggtttgttttgttttatttcgttcggagtgagttggtatcgtcgggcgttcgggacgcgtttagttcggatttagaacgttcgtgtttcggtattcgcggcgttcggagcggtcgcgagggtttgtttagtttagtttcgcggtcggttttgggcgagatcgtttttacggtttagtttacgtttcgaaaggttcggaatttatcgggttttcgaggaggggcgatgttagtcgcggggattcggttttcgtcgggtttagtcgagagcgcgcgaagtcgggggtttcggtcgggttgggttcggcggttcgggcgtaggcgggagtagcgtcgggcggaggagaggagaggaggcgagaagaggcgaggggaggaggcgcggcgagggaaagagaggggagggggcgagcggcgggtcgggtcgggtcggggcgtattaggttcgtagttttcgttcggtttcgttatttttcgttcgttcgttttcggtttttcgttttagtagttttcgggcgtcgggtcgtcgtcggtggggtaaatagagcgtcgggtcggggttgggtttttttttatcgtttcgttttgttttgtttcgtcgggttttcggggtttgggttcgttttttaagcgtcgcggcgtcgcgtcgttcgcgtttcggtcgttttcggttcgtttcgtcgtttttcgtcggattggtcgttcgggcgggcgttggtttttttaaaggtcgttcggttcgtttggtttcgtttgtttcggcgttgttagggaaggggtcggttcgtcgcgtcgggagggagtttttaaagcgatatatacgttttttaatttcgagggttaagcgtgcgagttaggggggtttcgttattcgggcgagggggaagggtttcgttggcggggttggaggcggattgatcggatttt

SEQ ID NO: 20140 - DNA, 1191 bp, Artificial Sequence
  chemically treated genomic DNA (Homo sapiens) CpG-island No: 20140
aaaatccgatcaatccgcctccaaccccgccaacgaaacccttccccctcgcccgaataacgaaacccccctaactcgcacgcttaaccctcgaaattaaaaaacgtatatatcgctttaaaaactccctcccgacgcgacgaaccgaccccttccctaacaacgccgaaacaaacgaaaccaaacgaaccgaacgacctttaaaaaaaccaacgcccgcccgaacgaccaatccgacgaaaaacgacgaaacgaaccgaaaacgaccgaaacgcgaacgacgcgacgccgcgacgcttaaaaaacgaacccaaaccccgaaaacccgacgaaacaaaacaaaacgaaacgataaaaaaaaacccaaccccgacccgacgctctatttaccccaccgacgacgacccgacgcccgaaaactactaaaacgaaaaaccgaaaacgaacgaacgaaaaataacgaaaccgaacgaaaactacgaacctaatacgccccgacccgacccgacccgccgctcgccccctcccctctctttccctcgccgcgcctcctcccctcgcctcttctcgcctcctctcctctcctccgcccgacgctactcccgcctacgcccgaaccgccgaacccaacccgaccgaaacccccgacttcgcgcgctctcgactaaacccgacgaaaaccgaatccccgcgactaacatcgcccctcctcgaaaacccgataaattccgaacctttcgaaacgtaaactaaaccgtaaaaacgatctcgcccaaaaccgaccgcgaaactaaactaaacaaaccctcgcgaccgctccgaacgccgcgaataccgaaacacgaacgttctaaatccgaactaaacgcgtcccgaacgcccgacgataccaactcactccgaacgaaataaaacaaaacaaaccccaacgaaacacgaacccgaccgatctaaactaaacaaaacgaatcccgaacgatacaaaacccgaaaaataccgaacgtaaactaaaaaaatcccgacgccctcccaaccctccgactttaactcacgcgctaaaacctacccgacgtctcctctacctccccgcgccccgatcacctataacctcgaaaccccaaatctaccgaaccctcgctcattcccgaccccgaacctaaaaaaacttaaaaaaaatttttcctaccccc

SEQ ID NO: 20141 - DNA, 771 bp, Artificial Sequence
  chemically treated genomic DNA (Homo sapiens) CpG-island No: 20141
cgtttacggagattatagcgggatgtagggcggggtcgggttgagggggcggagttaggggcggggtacggtgattttggtttcgttttttttcggtcgtttagggcggtgtcgttggggcggtgtcgttggggcggggtttgcggggtggggttgacggtacggggcggggtttcggggatttcggtaagttcgcgtatttggtaggagttgtagttatcgtcgttcgcgtttttaaggttttacggtttttttagtagagattcgggttcgttcgttatgttcgtcgtagacgaggttgacgggttgggcgtggttcggtcgtattatggttgtgagtgcggggtttcgcggcgcgggggtttcgggttgggttaattgtagacgaggcgcgatttttttgggggttcggtcgggcgggtggggtagggcggttgtcggtagttcggattcggaagagtcgtttcggtggggcggcgggcggcgggcggggaggtttttggttcgcgttttttcggggttcgaggcggcggagaggattttcgaggtttttcgttttagttggggtcgcggtagggggagttttatttagcgtttttcgtcgtttaggttcggtcgagattggggaagacggtttagagtgaggtggtaggatgatcgcgtagggcgtgtttcggggattgggggtttgggtacgcgggttttgttcgtttcgtggaaaggcgttgttttagtgttgtttgcggggtagatttaagggatagattaggg

SEQ ID NO: 20142 - DNA, 771 bp, Artificial Sequence
  chemically treated genomic DNA (Homo sapiens) CpG-island No: 20142
ccctaatctatcccttaaatctaccccgcaaacaacactaaaacaacgcctttccacgaaacgaacaaaacccgcgtacccaaacccccaatccccgaaacacgccctacgcgatcatcctaccacctcactctaaaccgtcttccccaatctcgaccgaacctaaacgacgaaaaacgctaaataaaactccccctaccgcgaccccaactaaaacgaaaaacctcgaaaatcctctccgccgcctcgaaccccgaaaaaacgcgaaccaaaaacctccccgcccgccgcccgccgccccaccgaaacgactcttccgaatccgaactaccgacaaccgccctaccccacccgcccgaccgaacccccaaaaaaatcgcgcctcgtctacaattaacccaacccgaaacccccgcgccgcgaaaccccgcactcacaaccataatacgaccgaaccacgcccaacccgtcaacctcgtctacgacgaacataacgaacgaacccgaatctctactaaaaaaaccgtaaaaccttaaaaacgcgaacgacgataactacaactcctaccaaatacgcgaacttaccgaaatccccgaaaccccgccccgtaccgtcaaccccaccccgcaaaccccgccccaacgacaccgccccaacgacaccgccctaaacgaccgaaaaaaaacgaaaccaaaatcaccgtaccccgcccctaactccgccccctcaacccgaccccgccctacatcccgctataatctccgtaaacg

SEQ ID NO: 20143 - DNA, 771 bp, Artificial Sequence
  chemically treated genomic DNA (Homo sapiens) CpG-island No: 20143
ttttggtttattttttgggtttatttcgtaggtaatattagggtagcgtttttttacgaaacgggtagagttcgcgtatttagatttttaattttcgggatacgttttgcgcggttattttgttattttattttaggtcgttttttttaatttcggtcgagtttgggcggcgagaggcgttgggtggggttttttttatcgcggttttagttaaggcgggaggtttcgggggtttttttcgtcgtttcggatttcgagggggcgcgaattaggggttttttcgttcgtcgttcgtcgttttatcgggacggttttttcgggttcgagttgtcggtagtcgttttgttttattcgttcggtcgagtttttaggaaaatcgcgtttcgtttgtaattagtttagttcgaagttttcgcgtcgcggagtttcgtatttatagttatagtgcggtcgggttacgtttagttcgttaatttcgtttgcggcggatatggcggacgagttcgagtttttgttgaggaagtcgtgaaattttggaggcgcggacggcggtagttatagtttttgttaagtgcgcgggtttgtcggggttttcgaggtttcgtttcgtgtcgttagttttatttcgtaggtttcgttttagcggtatcgttttagcgatatcgttttgagcggtcggaaagaggcggggttagagttatcgtgtttcgtttttaatttcgtttttttagttcggtttcgttttgtatttcgttatggttttcgtaggcg

SEQ ID NO: 20144 - DNA, 771 bp, Artificial Sequence
  chemically treated genomic DNA (Homo sapiens) CpG-island No: 20144
cgcctacgaaaaccataacgaaatacaaaacgaaaccgaactaaaaaaacgaaattaaaaacgaaacacgataactctaaccccgcctctttccgaccgctcaaaacgatatcgctaaaacgataccgctaaaacgaaacctacgaaataaaactaacgacacgaaacgaaacctcgaaaaccccgacaaacccgcgcacttaacaaaaactataactaccgccgtccgcgcctccaaaatttcacgacttcctcaacaaaaactcgaactcgtccgccatatccgccgcaaacgaaattaacgaactaaacgtaacccgaccgcactataactataaatacgaaactccgcgacgcgaaaacttcgaactaaactaattacaaacgaaacgcgattttcctaaaaactcgaccgaacgaataaaacaaaacgactaccgacaactcgaacccgaaaaaaccgtcccgataaaacgacgaacgacgaacgaaaaaacccctaattcgcgccccctcgaaatccgaaacgacgaaaaaaacccccgaaacctcccgccttaactaaaaccgcgataaaaaaaaccccacccaacgcctctcgccgcccaaactcgaccgaaattaaaaaaaacgacctaaaataaaataacaaaataaccgcgcaaaacgtatcccgaaaattaaaaatctaaatacgcgaactctacccgtttcgtaaaaaaacgctaccctaatattacctacgaaataaacccaaaaaataaaccaaaa

SEQ ID NO: 20145 - DNA, 634 bp, Artificial Sequence
  chemically treated genomic DNA (Homo sapiens) CpG-island No: 20145
gtcgtgataggttcgggttcggtcgcgcggagtcgcgggagaattgtttttcgtagtcggaagggggtcgcggggagcgtttttggtcggtggcggcgggggcgggggaggtcgcgagtcgaggcgttttagtttcggcgatgtcgtttcgtttttttcgtcgcggttgatgcggtacgtgtacgtcgtcgttcgtattaggatttgggtcgggtcgtacggtttggttttcggttatcgtttcggtttaggtgagtgtgtgcggcggtcgttttcggttcgttgggttgtaggcgcgcgggcggggttcgttcggcgcggtaggtgcggattcggcggcgttgttgttcgagttaggatttcgggagaggaggggaggggagggacgatttcgttcggcgcggtttttttcgtcgttttttgttttttgggggtcgcggtttttgggggtttaaggttgggtggcggggtgggcgacggtttgcggttgcggaacgtaataggatagggttttttttattttcgattattcggagcggcggcgcggtggtttaggttgttttttcggagagttttttacgtttaagggggattttaggcggttttggggatgttttcggaggttttttttgga

SEQ ID NO: 20146 - DNA, 634 bp, Artificial Sequence
  chemically treated genomic DNA (Homo sapiens) CpG-island No: 20146
tccaaaaaaaacctccgaaaacatccccaaaaccgcctaaaatcccccttaaacgtaaaaaactctccgaaaaaacaacctaaaccaccgcgccgccgctccgaataatcgaaaataaaaaaaaccctatcctattacgttccgcaaccgcaaaccgtcgcccaccccgccacccaaccttaaacccccaaaaaccgcgacccccaaaaaacaaaaaacgacgaaaaaaaccgcgccgaacgaaatcgtccctcccctcccctcctctcccgaaatcctaactcgaacaacaacgccgccgaatccgcacctaccgcgccgaacgaaccccgcccgcgcgcctacaacccaacgaaccgaaaacgaccgccgcacacactcacctaaaccgaaacgataaccgaaaaccaaaccgtacgacccgacccaaatcctaatacgaacgacgacgtacacgtaccgcatcaaccgcgacgaaaaaaacgaaacgacatcgccgaaactaaaacgcctcgactcgcgacctcccccgcccccgccgccaccgaccaaaaacgctccccgcgacccccttccgactacgaaaaacaattctcccgcgactccgcgcgaccgaacccgaacctatcacgac

SEQ ID NO: 20147 - DNA, 634 bp, Artificial Sequence
  chemically treated genomic DNA (Homo sapiens) CpG-island No: 20147
tttaaagagggttttcggggatatttttagagtcgtttgaaattttttttgggcgtgaagggtttttcgagaggataatttgggttatcgcgtcgtcgtttcgggtaatcggggatggaggagattttgttttgttacgtttcgtagtcgtagatcgtcgtttatttcgttatttaattttgagtttttagaagtcgcggtttttagggggtagggagcggcgggaggggtcgcgtcgagcgaggtcgttttttttttttttttttttttcggagttttggttcgggtagtagcgtcgtcgagttcgtatttgtcgcgtcgagcgagtttcgttcgcgcgtttatagtttagcgggtcgagggcggtcgtcgtatatatttatttaggtcgaagcggtggtcgggggttaagtcgtgcgattcggtttaggttttggtgcgggcggcggcgtgtacgtgtcgtattaatcgcggcggggagggcgaggcggtatcgtcggagttggagcgtttcggttcgcggtttttttcgttttcgtcgttatcggttaggagcgtttttcgcggttttttttcggttgcggagggtagttttttcgcggtttcgcgcggtcgggttcggatttgttacggt

SEQ ID NO: 20148 - DNA, 634 bp, Artificial Sequence
  chemically treated genomic DNA (Homo sapiens) CpG-island No: 20148
accgtaacaaatccgaacccgaccgcgcgaaaccgcgaaaaaactaccctccgcaaccgaaaaaaaaccgcgaaaaacgctcctaaccgataacgacgaaaacgaaaaaaaccgcgaaccgaaacgctccaactccgacgataccgcctcgccctccccgccgcgattaatacgacacgtacacgccgccgcccgcaccaaaacctaaaccgaatcgcacgacttaacccccgaccaccgcttcgacctaaataaatatatacgacgaccgccctcgacccgctaaactataaacgcgcgaacgaaactcgctcgacgcgacaaatacgaactcgacgacgctactacccgaaccaaaactccgaaaaaaaaaaaaaaaaaaaaaacgacctcgctcgacgcgacccctcccgccgctccctaccccctaaaaaccgcgacttctaaaaactcaaaattaaataacgaaataaacgacgatctacgactacgaaacgtaacaaaacaaaatctcctccatccccgattacccgaaacgacgacgcgataacccaaattatcctctcgaaaaacccttcacgcccaaaaaaaatttcaaacgactctaaaaatatccccgaaaaccctctttaaa

SEQ ID NO: 20149 - DNA, 566 bp, Artificial Sequence
  chemically treated genomic DNA (Homo sapiens) CpG-island No: 20149
cggcgtcggttatgaaataggtttttatggggagcggaagtagttattaaagtttagcgagtcggggtaggttagggaacgttgagagttcggacgcggagcgttttttatcgtttttacggtttcggtcgtggcgttttttcgtttggttatacgggggcgcgtttttttttcgcgtttcgattgttttacgttcgcgagtttcgttcgcgagtttagttcgcgcgtttttcgggtcgtttattatgtttcgtttcgcgttattttttcgtttttatcgcgtatttttcgcgtttttttttatgttttttttgggttcgtttagcgtttcggttgcgttttttcggcgttttttttgtcgggttttttgttcgtattttgttcgtattcgcggcggagagaaggaagatatagttcgtgtagcgttttagtttgagcgggttttttcgatgcgttttttaggttagtagggtgtgcggatgtcgttcggttgagtcgcggggaacgacggtagtttacgtattaagcgtttttttcgcgttgggtttcgagggtgcggcggcggg

SEQ ID NO: 20150 - DNA, 566 bp, Artificial Sequence
  chemically treated genomic DNA (Homo sapiens) CpG-island No: 20150
cccgccgccgcaccctcgaaacccaacgcgaaaaaaacgcttaatacgtaaactaccgtcgttccccgcgactcaaccgaacgacatccgcacaccctactaacctaaaaaacgcatcgaaaaaacccgctcaaactaaaacgctacacgaactatatcttccttctctccgccgcgaatacgaacaaaatacgaacaaaaaacccgacaaaaaaaacgccgaaaaaacgcaaccgaaacgctaaacgaacccaaaaaaaacataaaaaaaaacgcgaaaaatacgcgataaaaacgaaaaaataacgcgaaacgaaacataataaacgacccgaaaaacgcgcgaactaaactcgcgaacgaaactcgcgaacgtaaaacaatcgaaacgcgaaaaaaaaacgcgcccccgtataaccaaacgaaaaaacgccacgaccgaaaccgtaaaaacgataaaaaacgctccgcgtccgaactctcaacgttccctaacctaccccgactcgctaaactttaataactacttccgctccccataaaaacctatttcataaccgacgccg

SEQ ID NO: 20151 - DNA, 566 bp, Artificial Sequence
  chemically treated genomic DNA (Homo sapiens) CpG-island No: 20151
ttcgtcgtcgtattttcggagtttagcgcggagagggcgtttagtgcgtgagttatcgtcgtttttcgcgatttagtcgagcggtattcgtatattttgttagtttaggaagcgtatcgagggagttcgtttaagttgaagcgttgtacgagttgtgtttttttttttttcgtcgcgaatgcgggtaggatgcgagtaaaagattcggtaaagagggcgtcgagggggcgtagtcggggcgttgggcggatttagaggggatatggagaggaacgcggaaggtacgcggtagagacggggaggtggcgcgaggcgggatatggtgagcgattcgaggggcgcgcggattgggttcgcggacggggttcgcggacgtagagtagtcgaggcgcggagggggagcgcgttttcgtgtggttaggcggggaggcgttacggtcggggtcgtgggggcggtgggaagcgtttcgcgttcgggtttttagcgttttttggtttgtttcggttcgttaggttttgatggttgttttcgttttttataaaggtttgttttatggtcgacgtcg

SEQ ID NO: 20152 - DNA, 566 bp, Artificial Sequence
  chemically treated genomic DNA (Homo sapiens) CpG-island No: 20152
cgacgtcgaccataaaacaaacctttataaaaaacgaaaacaaccatcaaaacctaacgaaccgaaacaaaccaaaaaacgctaaaaacccgaacgcgaaacgcttcccaccgcccccacgaccccgaccgtaacgcctccccgcctaaccacacgaaaacgcgctccccctccgcgcctcgactactctacgtccgcgaaccccgtccgcgaacccaatccgcgcgcccctcgaatcgctcaccatatcccgcctcgcgccacctccccgtctctaccgcgtaccttccgcgttcctctccatatcccctctaaatccgcccaacgccccgactacgccccctcgacgccctctttaccgaatcttttactcgcatcctacccgcattcgcgacgaaaaaaaaaaaaacacaactcgtacaacgcttcaacttaaacgaactccctcgatacgcttcctaaactaacaaaatatacgaataccgctcgactaaatcgcgaaaaacgacgataactcacgcactaaacgccctctccgcgctaaactccgaaaatacgacgacgaa

SEQ ID NO: 20153 - DNA, 527 bp, Artificial Sequence
  chemically treated genomic DNA (Homo sapiens) CpG-island No: 20153
ttttttgaagtcggcggtgaaggagacgagggtgtcgtcgggtttgcgtagttcgaggttgatgttgttcgcgtcgttgttcgtttgtaggtttttttcggttatttggtcgttcggtagtcgtacgcggattcgtagttcggtcggcgtattcgtttttagtagcggcgcgagtagcggtagtagtagtagtagcgtagggcgcgttaggggtatttcgggaaggcgtattttcgggggtcgttgtcgttcgcggtttcggcgcgtcgcgtgggggcggggagaggcgtaggtaaatttcgtttaaagttgggggttagttcggggcgttcgggagtcgtttcgtcgggggttttggtcgcggggtcgttcgcgaggtggcgcggacgtacgtgggtagcgtttagtagggcgttttcggcggtttcgaggcggagacggcgttgtttcggttcggtttcgcggtttcgggttttagcgttgcgagtttgtgttttgtattttttatttaattttatttttcgtta

SEQ ID NO: 20154 - DNA, 527 bp, Artificial Sequence
  chemically treated genomic DNA (Homo sapiens) CpG-island No: 20154
taacgaaaaataaaattaaataaaaaatacaaaacacaaactcgcaacgctaaaacccgaaaccgcgaaaccgaaccgaaacaacgccgtctccgcctcgaaaccgccgaaaacgccctactaaacgctacccacgtacgtccgcgccacctcgcgaacgaccccgcgaccaaaacccccgacgaaacgactcccgaacgccccgaactaacccccaactttaaacgaaatttacctacgcctctccccgcccccacgcgacgcgccgaaaccgcgaacgacaacgacccccgaaaatacgccttcccgaaatacccctaacgcgccctacgctactactactactaccgctactcgcgccgctactaaaaacgaatacgccgaccgaactacgaatccgcgtacgactaccgaacgaccaaataaccgaaaaaaacctacaaacgaacaacgacgcgaacaacatcaacctcgaactacgcaaacccgacgacaccctcgtctccttcaccgccgacttcaaaaaa

SEQ ID NO: 20155 - DNA, 527 bp, Artificial Sequence
  chemically treated genomic DNA (Homo sapiens) CpG-island No: 20155
tgacggggggtgggattgaatgaaaagtgtaaaatataggttcgtagcgttggagttcggggtcgcggagtcgggtcggggtagcgtcgttttcgtttcggggtcgtcgggggcgttttgttgagcgttatttacgtgcgttcgcgttatttcgcgggcgatttcgcggttaaggttttcggcggagcggttttcgggcgtttcgaattagtttttaattttgggcgaagtttgtttgcgttttttttcgtttttacgcggcgcgtcggggtcgcggacggtagcggttttcggggatgcgttttttcggggtatttttggcgcgttttgcgttgttgttgttgttgtcgttgttcgcgtcgttgttgggaacgggtgcgtcggtcgagttgcgggttcgcgtgcggttgtcggacggttaggtgatcgaggagagtttgtaggcggatagcgacgcggatagtattagtttcgagttgcgtaagttcgacggtattttcgttttttttatcgtcgattttaagaag

SEQ ID NO: 20156 - DNA, 527 bp, Artificial Sequence
  chemically treated genomic DNA (Homo sapiens) CpG-island No: 20156
cttcttaaaatcgacgataaaaaaaacgaaaataccgtcgaacttacgcaactcgaaactaatactatccgcgtcgctatccgcctacaaactctcctcgatcacctaaccgtccgacaaccgcacgcgaacccgcaactcgaccgacgcacccgttcccaacaacgacgcgaacaacgacaacaacaacaacaacgcaaaacgcgccaaaaataccccgaaaaaacgcatccccgaaaaccgctaccgtccgcgaccccgacgcgccgcgtaaaaacgaaaaaaaacgcaaacaaacttcgcccaaaattaaaaactaattcgaaacgcccgaaaaccgctccgccgaaaaccttaaccgcgaaatcgcccgcgaaataacgcgaacgcacgtaaataacgctcaacaaaacgcccccgacgaccccgaaacgaaaacgacgctaccccgacccgactccgcgaccccgaactccaacgctacgaacctatattttacacttttcattcaatcccaccccccgtca

SEQ ID NO: 20157 - DNA, 1482 bp, Artificial Sequence
  chemically treated genomic DNA (Homo sapiens) CpG-island No: 20157
gtatgttttcggacgtttttttcggcgttttttcgttgagttcggtttggttagttcgttatttcgttcgttgttattcgattgttcgtatcgattatttgcggtcgttaaggtgcggtagggggcgttgtgcggtcgtagaggtcgcgtcgggtcgcgttttgattggttggaggtcgcggttttcgtttaggtcgttcgtttagtttgttcgtttcgttcgttaagtgtttgggttttttcgttcgcgttttagtttgcgggttttcggggtagcggcgaggtcggagcgtcgcggcggagaggacgagatcgggataagattagggtaggagggagtcggttagtcgcgagaatttcgtacgttcggtaagatgttgttttggcggttgtagacgggtttcgagaaggtcgagttttaggagtttaacgttcggttttatgattacgtgtgtcgggtgcgggagttggagcgcgaaaatttatttttggaggaggagttgcgcggtcggcgcgggcgagagggtttgtgggtcgaggggtaggttcgttgcgtcgaggaggcgcgtagtttgcggtagtagttggacgagttgagttgggttattgcgttggcggagggcgagcgggacgttttgcggcgcgagttgcgggagttgtagcgtttggatgcggaggagcgcgtcgttcgcggtcgtttggacgtcgagttgggtgcgtagtagcgcgagttgtaggaggcgttgggcgcgcgcgtcgttttcgaggcgttgttgggtcgattgtaggtcgagcgtcgaggtttcgacgcggtttacgaacgcgacgtgcgggagttgcgcgcgcgcgtcgttagttttattatgtattttcgcgttcgcgttatcggtttcgtcgcgtcgtcgttacgtttgcgggaggtgtacgatagttacgtattgttggtggtcgagtcgtggcgggagacggtgtagttgtacgaggacgaggtgcgcgagttggaggaggcgttgcggcgcggttaggagagtagattttaggcggaggaagagacgcggttgtgcgcgtaggaggtagaggcgttgcggcgcgaggcgttcgggttggagtagttgcgcgcgcggttggaggacgcgttgttgcggatgcgcgaggagtacgggatataggtcgaggagcggtaggttcgtgcgcggggatggcgcgttgattttatattcgttgtcgtcgttttagtattttgtttttgacggcgtggggtagcggtttttttattaggggcgcggcgtcgcggatcggtagggttcgtttagagggtgttcgaatggtatggggattcggattcggttcgttggtttatcgatttagcgggcgagcgcggggcggtaggttttagcggatagtttcgttttcgttatggggttaggtggtagttgttttaatttttgataagcgtgattgggcgtattttgataggttatt

SEQ ID NO: 20158 - DNA, 1482 bp, Artificial Sequence
  chemically treated genomic DNA (Homo sapiens) CpG-island No: 20158
aataacctatcaaaatacgcccaatcacgcttatcaaaaattaaaacaactaccacctaaccccataacgaaaacgaaactatccgctaaaacctaccgccccgcgctcgcccgctaaatcgataaaccaacgaaccgaatccgaatccccataccattcgaacaccctctaaacgaaccctaccgatccgcgacgccgcgcccctaataaaaaaaccgctaccccacgccgtcaaaaacaaaatactaaaacgacgacaacgaatataaaatcaacgcgccatccccgcgcacgaacctaccgctcctcgacctatatcccgtactcctcgcgcatccgcaacaacgcgtcctccaaccgcgcgcgcaactactccaacccgaacgcctcgcgccgcaacgcctctacctcctacgcgcacaaccgcgtctcttcctccgcctaaaatctactctcctaaccgcgccgcaacgcctcctccaactcgcgcacctcgtcctcgtacaactacaccgtctcccgccacgactcgaccaccaacaatacgtaactatcgtacacctcccgcaaacgtaacgacgacgcgacgaaaccgataacgcgaacgcgaaaatacataataaaactaacgacgcgcgcgcgcaactcccgcacgtcgcgttcgtaaaccgcgtcgaaacctcgacgctcgacctacaatcgacccaacaacgcctcgaaaacgacgcgcgcgcccaacgcctcctacaactcgcgctactacgcacccaactcgacgtccaaacgaccgcgaacgacgcgctcctccgcatccaaacgctacaactcccgcaactcgcgccgcaaaacgtcccgctcgccctccgccaacgcaataacccaactcaactcgtccaactactaccgcaaactacgcgcctcctcgacgcaacgaacctacccctcgacccacaaaccctctcgcccgcgccgaccgcgcaactcctcctccaaaaataaattttcgcgctccaactcccgcacccgacacacgtaatcataaaaccgaacgttaaactcctaaaactcgaccttctcgaaacccgtctacaaccgccaaaacaacatcttaccgaacgtacgaaattctcgcgactaaccgactccctcctaccctaatcttatcccgatctcgtcctctccgccgcgacgctccgacctcgccgctaccccgaaaacccgcaaactaaaacgcgaacgaaaaaacccaaacacttaacgaacgaaacgaacaaactaaacgaacgacctaaacgaaaaccgcgacctccaaccaatcaaaacgcgacccgacgcgacctctacgaccgcacaacgccccctaccgcaccttaacgaccgcaaataatcgatacgaacaatcgaataacaacgaacgaaataacgaactaaccaaaccgaactcaacgaaaaaacgccgaaaaaaacgtccgaaaacatac

SEQ ID NO: 20159 - DNA, 1482 bp, Artificial Sequence
  chemically treated genomic DNA (Homo sapiens) CpG-island No: 20159
ggtggtttattaggatgcgtttagttacgtttgttaagagttaaagtagttgttatttaattttatgacgaggacggggttattcgttaggatttgtcgtttcgcgttcgttcgttgagtcgatggattagcggatcgagttcgggtttttatgttattcgggtattttttgggcgggttttatcggttcgcgacgtcgcgtttttggtgaaggggtcgttgttttacgtcgttaagggtagggtgttggggcgacggtagcgggtatggggttagcgcgttattttcgcgtacggatttgtcgtttttcggtttgtatttcgtatttttcgcgtattcgtagtagcgcgttttttagtcgcgcgcgtagttgttttaattcgagcgtttcgcgtcgtagcgtttttgttttttgcgcgtatagtcgcgttttttttttcgtttggagtttgtttttttggtcgcgtcgtagcgttttttttagttcgcgtatttcgttttcgtatagttgtatcgtttttcgttacgattcggttattagtagtgcgtagttgtcgtgtatttttcgtaggcgtggcggcggcgcggcggggtcggtggcgcgggcgcggaaatgtatggtaaggttggcggcgcgcgcgcgtagttttcgtacgtcgcgttcgtgggtcgcgtcgaggtttcggcgttcggtttgtagtcggtttagtagcgtttcgagggcggcgcgcgcgtttagcgttttttgtagttcgcgttgttgcgtatttagttcggcgtttaggcggtcgcgggcggcgcgttttttcgtatttaggcgttgtagttttcgtagttcgcgtcgtagagcgtttcgttcgtttttcgttagcgtagtggtttagtttagttcgtttagttgttgtcgtaagttgcgcgttttttcggcgtagcgggtttgtttttcggtttataggttttttcgttcgcgtcggtcgcgtagttttttttttaggagtaggttttcgcgttttagttttcgtattcgatatacgtagttatagagtcgggcgttgagtttttggagttcggttttttcggggttcgtttgtagtcgttaggatagtattttgtcgggcgtgcggggttttcgcggttggtcggtttttttttgttttggttttgtttcggtttcgtttttttcgtcgcgacgtttcggtttcgtcgttgtttcggaggttcgtagattgggacgcgagcgggagagtttaggtatttagcggacggggcgggtagattgggcgggcggtttgggcgagggtcgcggtttttagttaattagagcgcggttcggcgcggtttttgcggtcgtatagcgttttttgtcgtattttggcggtcgtaggtggtcggtgcgggtagtcgggtaatagcgggcggggtggcgggttagttaggtcgggtttagcgaagggacgtcggagagggcgttcgggagtatat

SEQ ID NO: 20160 - DNA, 1482 bp, Artificial Sequence
  chemically treated genomic DNA (Homo sapiens) CpG-island No: 20160
atatactcccgaacgccctctccgacgtcccttcgctaaacccgacctaactaacccgccaccccgcccgctattacccgactacccgcaccgaccacctacgaccgccaaaatacgacaaaaaacgctatacgaccgcaaaaaccgcgccgaaccgcgctctaattaactaaaaaccgcgaccctcgcccaaaccgcccgcccaatctacccgccccgtccgctaaatacctaaactctcccgctcgcgtcccaatctacgaacctccgaaacaacgacgaaaccgaaacgtcgcgacgaaaaaaacgaaaccgaaacaaaaccaaaacaaaaaaaaaccgaccaaccgcgaaaaccccgcacgcccgacaaaatactatcctaacgactacaaacgaaccccgaaaaaaccgaactccaaaaactcaacgcccgactctataactacgtatatcgaatacgaaaactaaaacgcgaaaacctactcctaaaaaaaaaactacgcgaccgacgcgaacgaaaaaacctataaaccgaaaaacaaacccgctacgccgaaaaaacgcgcaacttacgacaacaactaaacgaactaaactaaaccactacgctaacgaaaaacgaacgaaacgctctacgacgcgaactacgaaaactacaacgcctaaatacgaaaaaacgcgccgcccgcgaccgcctaaacgccgaactaaatacgcaacaacgcgaactacaaaaaacgctaaacgcgcgcgccgccctcgaaacgctactaaaccgactacaaaccgaacgccgaaacctcgacgcgacccacgaacgcgacgtacgaaaactacgcgcgcgcgccgccaaccttaccatacatttccgcgcccgcgccaccgaccccgccgcgccgccgccacgcctacgaaaaatacacgacaactacgcactactaataaccgaatcgtaacgaaaaacgatacaactatacgaaaacgaaatacgcgaactaaaaaaaacgctacgacgcgaccaaaaaaacaaactccaaacgaaaaaaaaaacgcgactatacgcgcaaaaaacaaaaacgctacgacgcgaaacgctcgaattaaaacaactacgcgcgcgactaaaaaacgcgctactacgaatacgcgaaaaatacgaaatacaaaccgaaaaacgacaaatccgtacgcgaaaataacgcgctaaccccatacccgctaccgtcgccccaacaccctacccttaacgacgtaaaacaacgaccccttcaccaaaaacgcgacgtcgcgaaccgataaaacccgcccaaaaaatacccgaataacataaaaacccgaactcgatccgctaatccatcgactcaacgaacgaacgcgaaacgacaaatcctaacgaataaccccgtcctcgtcataaaattaaataacaactactttaactcttaacaaacgtaactaaacgcatcctaataaaccacc

SEQ ID NO: 20161 - DNA, 726 bp, Artificial Sequence
  chemically treated genomic DNA (Homo sapiens) CpG-island No: 20161
cgttcgcgtttagtttaggggatgttcggttcgtaattgattttttttttttttttaggagcgcgttgaggtcgtttgcgcgttttacggaatcggttttcgggttcgcgttcgttttcgttttggagcgagggattttatcgattttttcggtagttgtcggggtcgggcgtttattttttggggtttggttttcgtcgtttttttagtttggcggcggagtgtggggttgtagcggttattgttattgtcgtcgtcgtcgtcgttttcgttgttatcgcggtcgtcgtcgttatcgaagcgttgttcggcgcgtcgtcggggttggaggttggggggtcgcggaatttttggaggcgcgagttcgggacgcggcggggtcgagtcgcgggaagttgtttgcgtcgggcgcggagcgagcggggcgttagttattcgcgtttaagtagttataattttgtcgtttgggtgggtgcgcgtttcggagagaggcgagcgcgggagagcggggtaaaggcgttggggcgggagggttttcggagtaggtaggattgtaatttgaacggttcgcgaggaaaggggaaaggtggcgcggggggatgtttatatagtttgtgtggtgcgcggcgagcgagtgtgtaagagcgcgggcgtttattttattttgttttttgtagtttttgtatatttatggggatttttgatgtttttgttagtaattaatat

SEQ ID NO: 20162 - DNA, 726 bp, Artificial Sequence
  chemically treated genomic DNA (Homo sapiens) CpG-island No: 20162
atattaattactaacaaaaacatcaaaaatccccataaatatacaaaaactacaaaaaacaaaataaaataaacgcccgcgctcttacacactcgctcgccgcgcaccacacaaactatataaacatccccccgcgccacctttcccctttcctcgcgaaccgttcaaattacaatcctacctactccgaaaaccctcccgccccaacgcctttaccccgctctcccgcgctcgcctctctccgaaacgcgcacccacccaaacgacaaaattataactacttaaacgcgaataactaacgccccgctcgctccgcgcccgacgcaaacaacttcccgcgactcgaccccgccgcgtcccgaactcgcgcctccaaaaattccgcgaccccccaacctccaaccccgacgacgcgccgaacaacgcttcgataacgacgacgaccgcgataacaacgaaaacgacgacgacgacgacaataacaataaccgctacaaccccacactccgccgccaaactaaaaaaacgacgaaaaccaaaccccaaaaaataaacgcccgaccccgacaactaccgaaaaaatcgataaaatccctcgctccaaaacgaaaacgaacgcgaacccgaaaaccgattccgtaaaacgcgcaaacgacctcaacgcgctcctaaaaaaaaaaaaaaaatcaattacgaaccgaacatcccctaaactaaacgcgaacg

SEQ ID NO: 20163 - DNA, 726 bp, Artificial Sequence
  chemically treated genomic DNA (Homo sapiens) CpG-island No: 20163
gtgttagttattagtaggaatattagagatttttataaatatgtaggagttgtaggaggtaaagtagagtagacgttcgcgtttttatatattcgttcgtcgcgtattatataggttgtgtagatattttttcgcgttatttttttttttttttcgcgggtcgtttaggttgtagttttgtttgtttcgaagattttttcgttttagcgtttttgtttcgttttttcgcgttcgttttttttcggagcgcgtatttatttaggcggtaaagttgtgattatttgggcgcgggtgattggcgtttcgttcgtttcgcgttcggcgtagataatttttcgcggttcggtttcgtcgcgtttcgggttcgcgtttttagggatttcgcggttttttagtttttaatttcggcggcgcgtcgggtagcgtttcggtggcggcggcggtcgcggtggtagcgaaggcggcggcggcggcggtagtggtagtggtcgttgtagttttatatttcgtcgttaaattggaggagcgacggaagttagattttaggaggtgagcgttcggtttcggtagttgtcgggagggtcgatggggtttttcgttttaaggcggaggcgggcgcgggttcgggggtcgatttcgtagggcgcgtaggcggttttagcgcgtttttgggagggagagagaggttaattgcgggtcgggtattttttgagttgggcgcgggcg

SEQ ID NO: 20164 - DNA, 726 bp, Artificial Sequence
  chemically treated genomic DNA (Homo sapiens) CpG-island No: 20164
cgcccgcgcccaactcaaaaaatacccgacccgcaattaacctctctctccctcccaaaaacgcgctaaaaccgcctacgcgccctacgaaatcgacccccgaacccgcgcccgcctccgccttaaaacgaaaaaccccatcgaccctcccgacaactaccgaaaccgaacgctcacctcctaaaatctaacttccgtcgctcctccaatttaacgacgaaatataaaactacaacgaccactaccactaccgccgccgccgccgccttcgctaccaccgcgaccgccgccgccaccgaaacgctacccgacgcgccgccgaaattaaaaactaaaaaaccgcgaaatccctaaaaacgcgaacccgaaacgcgacgaaaccgaaccgcgaaaaattatctacgccgaacgcgaaacgaacgaaacgccaatcacccgcgcccaaataatcacaactttaccgcctaaataaatacgcgctccgaaaaaaaacgaacgcgaaaaaacgaaacaaaaacgctaaaacgaaaaaatcttcgaaacaaacaaaactacaacctaaacgacccgcgaaaaaaaaaaaaaaataacgcgaaaaaatatctacacaacctatataatacgcgacgaacgaatatataaaaacgcgaacgtctactctactttacctcctacaactcctacatatttataaaaatctctaatattcctactaataactaacac

SEQ ID NO: 20165 - DNA, 670 bp, Artificial Sequence
  chemically treated genomic DNA (Homo sapiens) CpG-island No: 20165
tggtttttttcgttttttttcgtttttcgaatttttcggttggtttttttgcggttttcgtttcggcgttgatgtggtttggtagtggagattggcgttcgggcggagtacgatgggttttttcgcggtaggtaggtaggttgttgttgtaggtgggtttcggcgttcgcgtcgtttcgcgtttttcgcggtcgtttcgtttttgttcgttcgtttcgtttcgttcgtattggcgttgtttgttgtttgttttcgcgcggtggggagggggcgtattcggcggcgggttttgtagagggcgttttgtttcgggtgcgatcgcggttttttggaggtttgggcggcgggtttcgcgagcgcgtcgttatttcgggagtagtgttggttaaggatttcgacgttttacgtaagtaaaggtagggcggggagtttgcgggggaggagggtcgggggtaatgttcggttcgcggatcgcggagtgggtaagaggtgtttattggatacggggtattcgagttttttgaggtgttgggagtaagaacgcgggaggtcgtttgttcgttggaattcgcggttagggcgatttttattaggtttgtttatttatttttttcgcgttatagtttgttttagaagtatgggttgtcggtggtttttttttttttttatt

SEQ ID NO: 20166 - DNA, 670 bp, Artificial Sequence
  chemically treated genomic DNA (Homo sapiens) CpG-island No: 20166
aataaaaaaaaaaaaaaaccaccgacaacccatacttctaaaacaaactataacgcgaaaaaaataaataaacaaacctaataaaaatcgccctaaccgcgaattccaacgaacaaacgacctcccgcgttcttactcccaacacctcaaaaaactcgaataccccgtatccaataaacacctcttacccactccgcgatccgcgaaccgaacattacccccgaccctcctcccccgcaaactccccgccctacctttacttacgtaaaacgtcgaaatccttaaccaacactactcccgaaataacgacgcgctcgcgaaacccgccgcccaaacctccaaaaaaccgcgatcgcacccgaaacaaaacgccctctacaaaacccgccgccgaatacgccccctccccaccgcgcgaaaacaaacaacaaacaacgccaatacgaacgaaacgaaacgaacgaacaaaaacgaaacgaccgcgaaaaacgcgaaacgacgcgaacgccgaaacccacctacaacaacaacctacctacctaccgcgaaaaaacccatcgtactccgcccgaacgccaatctccactaccaaaccacatcaacgccgaaacgaaaaccgcaaaaaaaccaaccgaaaaattcgaaaaacgaaaaaaaacgaaaaaaacca

SEQ ID NO: 20167 - DNA, 670 bp, Artificial Sequence
  chemically treated genomic DNA (Homo sapiens) CpG-island No: 20167
gataaagaaggaaaaaagttatcggtaatttatgtttttaagataagttgtaacgcgaaggggataggtgggtagatttgatgagggtcgttttggtcgcggattttagcggataagcgatttttcgcgtttttatttttagtattttagagggttcggatatttcgtatttagtgggtattttttgtttatttcgcggttcgcggatcggatattgttttcgatttttttttttcgtaggtttttcgttttgtttttatttacgtagggcgtcggggtttttggttaatattgttttcgaggtggcggcgcgttcgcggggttcgtcgtttaggtttttagggagtcgcggtcgtattcggagtaaggcgttttttgtagagttcgtcgtcgggtgcgttttttttttatcgcgcggggatagatagtaggtagcgttaatgcgagcggagcggagcgggcgggtaggggcggggcgatcgcgggaggcgcggggcggcgcgggcgtcgggatttatttgtagtagtagtttgtttgtttgtcgcggggaagtttatcgtgtttcgttcgggcgttaatttttattgttagattatattagcgtcgaggcggggatcgtaagagagttagtcggaaggttcggggggcgggggaaggcgggggggatta

SEQ ID NO: 20168 - DNA, 670 bp, Artificial Sequence
  chemically treated genomic DNA (Homo sapiens) CpG-island No: 20168
taatcccccccgccttcccccgccccccgaaccttccgactaactctcttacgatccccgcctcgacgctaatataatctaacaataaaaattaacgcccgaacgaaacacgataaacttccccgcgacaaacaaacaaactactactacaaataaatcccgacgcccgcgccgccccgcgcctcccgcgatcgccccgcccctacccgcccgctccgctccgctcgcattaacgctacctactatctatccccgcgcgataaaaaaaaaacgcacccgacgacgaactctacaaaaaacgccttactccgaatacgaccgcgactccctaaaaacctaaacgacgaaccccgcgaacgcgccgccacctcgaaaacaatattaaccaaaaaccccgacgccctacgtaaataaaaacaaaacgaaaaacctacgaaaaaaaaaaatcgaaaacaatatccgatccgcgaaccgcgaaataaacaaaaaatacccactaaatacgaaatatccgaaccctctaaaatactaaaaataaaaacgcgaaaaatcgcttatccgctaaaatccgcgaccaaaacgaccctcatcaaatctacccacctatccccttcgcgttacaacttatcttaaaaacataaattaccgataacttttttccttctttatc

SEQ ID NO: 20169 - DNA, 703 bp, Artificial Sequence
  chemically treated genomic DNA (Homo sapiens) CpG-island No: 20169
tttcgcggtgcgggttgcgttagttttttcggagttcgacgtagaaatttgttgtaataaataggcgatcgcgggtgtttttagtagttagcggtagagtgggtgggcgggcgagagggaggggaaggttggcggacgtcgtagcgaattggtgggtagattcggagtcgtcgcgtaagcggggtcggtttagtgcggtgcggtaggcgcggttgtgcggtagcggaagttttttgttgtagtatagtttttggtagagttagagttttttcgcgtagtttagttcgagcgtcgagcgtcgcgcgtcgtcgttattgtagttcgcggttttttcgttttcgttcgtttttttcgcggttgatttgttttaaattttttaaaattttcgtagttttggtttttgttgcggtcggtaagtatttgttagttgtggggttatttgcgtaattttggtttaggtcggagggcgacgggtcgcgggtttggcggagtgcggggtcggaggggcgtcgattcgtgcggggagtcggagcgcggcggacgcgttgcgaggattcggtgacgggcggttgttaggtcgtttgtttgttgtcggcgcgttaggtttcgggcgtgcggtttttttgagtcggaggcgaagtttttacggagattagtttttaaattagttatttttttttttttttttttttgtttttatttt

SEQ ID NO: 20170 - DNA, 703 bp, Artificial Sequence
  chemically treated genomic DNA (Homo sapiens) CpG-island No: 20170
aaaataaaaacaaaaaaaaaaaaaaaaaaaaataactaatttaaaaactaatctccgtaaaaacttcgcctccgactcaaaaaaaccgcacgcccgaaacctaacgcgccgacaacaaacaaacgacctaacaaccgcccgtcaccgaatcctcgcaacgcgtccgccgcgctccgactccccgcacgaatcgacgcccctccgaccccgcactccgccaaacccgcgacccgtcgccctccgacctaaaccaaaattacgcaaataaccccacaactaacaaatacttaccgaccgcaacaaaaaccaaaactacgaaaattttaaaaaatttaaaacaaatcaaccgcgaaaaaaacgaacgaaaacgaaaaaaccgcgaactacaataacgacgacgcgcgacgctcgacgctcgaactaaactacgcgaaaaaactctaactctaccaaaaactatactacaacaaaaaacttccgctaccgcacaaccgcgcctaccgcaccgcactaaaccgaccccgcttacgcgacgactccgaatctacccaccaattcgctacgacgtccgccaaccttcccctccctctcgcccgcccacccactctaccgctaactactaaaaacacccgcgatcgcctatttattacaacaaatttctacgtcgaactccgaaaaaactaacgcaacccgcaccgcgaaa

SEQ ID NO: 20171 - DNA, 703 bp, Artificial Sequence
  chemically treated genomic DNA (Homo sapiens) CpG-island No: 20171
aaaataaaggtagagaaagaaagaaaagaaggtaattaatttgggaattagttttcgtaggggtttcgttttcgatttagggaggtcgtacgttcgggatttgacgcgtcggtaataagtaggcggtttggtagtcgttcgttatcgggttttcgtagcgcgttcgtcgcgtttcggtttttcgtacggatcggcgttttttcggtttcgtatttcgttaggttcgcggttcgtcgtttttcggtttgggttaaagttgcgtaaatagttttataattggtaaatatttatcggtcgtaataggaattagagttgcggagattttagggagtttaaggtaaattagtcgcgggaaaggcgggcgaaggcgaaggggtcgcgagttgtagtggcggcggcgcgcggcgttcggcgttcgggttgggttgcgcggagaggttttggttttgttagggattgtgttgtaataaaggattttcgttgtcgtatagtcgcgtttgtcgtatcgtattgagtcggtttcgtttacgcggcgatttcgggtttgtttattagttcgttgcggcgttcgttagtttttttttttttttcgttcgtttatttattttgtcgttggttgttaggggtattcgcggtcgtttgtttgttgtaataagtttttgcgtcgagtttcgaggaggttggcgtaattcgtatcgcgggg

SEQ ID NO: 20172 - DNA, 703 bp, Artificial Sequence
  chemically treated genomic DNA (Homo sapiens) CpG-island No: 20172
ccccgcgatacgaattacgccaacctcctcgaaactcgacgcaaaaacttattacaacaaacaaacgaccgcgaatacccctaacaaccaacgacaaaataaataaacgaacgaaaaaaaaaaaaaaactaacgaacgccgcaacgaactaataaacaaacccgaaatcgccgcgtaaacgaaaccgactcaatacgatacgacaaacgcgactatacgacaacgaaaatcctttattacaacacaatccctaacaaaaccaaaacctctccgcgcaacccaacccgaacgccgaacgccgcgcgccgccgccactacaactcgcgaccccttcgccttcgcccgcctttcccgcgactaatttaccttaaactccctaaaatctccgcaactctaattcctattacgaccgataaatatttaccaattataaaactatttacgcaactttaacccaaaccgaaaaacgacgaaccgcgaacctaacgaaatacgaaaccgaaaaaacgccgatccgtacgaaaaaccgaaacgcgacgaacgcgctacgaaaacccgataacgaacgactaccaaaccgcctacttattaccgacgcgtcaaatcccgaacgtacgacctccctaaatcgaaaacgaaacccctacgaaaactaattcccaaattaattaccttcttttctttctttctctacctttatttt

SEQ ID NO: 20173 - DNA, 642 bp, Artificial Sequence
  chemically treated genomic DNA (Homo sapiens) CpG-island No: 20173
ggttataacggtttcggtttattttaacgattcgtagcgttaggttattaaggacgtaggtattattacggggtttaatgtgttgcgtattattaacgagtttacggcggcggttatcgtttacggtttggataagaagggttgcgcgggcggcgagaagaacgtgtttatttttgatttgggcggtggtattttcgacgtgtttattttgattatcgaggatggtattttcgaggtgaagtttacggtcggcgatatttatttgggcggtgaggatttcgataatcgtatggtgagttatttggcggaggagtttaagcgtaagtataagaaggatattgggtttaataagcgcgtcgtgaggcggttgcgtatcgtttgcgagcgcgttaagcgtattttgagttcgtttacgtaggcgagtatcgagatcgattcgttttacgagggcgtggatttttatacgtttattacgcgcgttcgtttcgaggagtttaatgtcgatttttttcgcgggattttggagtcggtggagaaggcgttgcgcgacgttaagttggataagggttagatttaggagatcgtgttggtgggcggttttattcgtatttttaagatttagaagttgttgtaggatttttt

SEQ ID NO: 20174 - DNA, 642 bp, Artificial Sequence
  chemically treated genomic DNA (Homo sapiens) CpG-island No: 20174
aaaaaatcctacaacaacttctaaatcttaaaaatacgaataaaaccgcccaccaacacgatctcctaaatctaacccttatccaacttaacgtcgcgcaacgccttctccaccgactccaaaatcccgcgaaaaaaatcgacattaaactcctcgaaacgaacgcgcgtaataaacgtataaaaatccacgccctcgtaaaacgaatcgatctcgatactcgcctacgtaaacgaactcaaaatacgcttaacgcgctcgcaaacgatacgcaaccgcctcacgacgcgcttattaaacccaatatccttcttatacttacgcttaaactcctccgccaaataactcaccatacgattatcgaaatcctcaccgcccaaataaatatcgccgaccgtaaacttcacctcgaaaataccatcctcgataatcaaaataaacacgtcgaaaataccaccgcccaaatcaaaaataaacacgttcttctcgccgcccgcgcaacccttcttatccaaaccgtaaacgataaccgccgccgtaaactcgttaataatacgcaacacattaaaccccgtaataatacctacgtccttaataacctaacgctacgaatcgttaaaataaaccgaaaccgttataacc

SEQ ID NO: 20175 - DNA, 642 bp, Artificial Sequence
  chemically treated genomic DNA (Homo sapiens) CpG-island No: 20175
aagaaattttgtagtagtttttggattttggggatacgagtggagtcgtttattagtacgattttttggatttggtttttgtttagtttggcgtcgcgtagcgttttttttatcggttttagggtttcgcgaaagaggtcggtattgagtttttcgaagcgggcgcgcgtgatggacgtatagaagtttacgttttcgtagagcgagtcgatttcgatgttcgtttgcgtggacgagtttagggtgcgtttggcgcgttcgtaagcggtgcgtagtcgttttacggcgcgtttgttgggtttaatgttttttttgtgtttgcgtttgaattttttcgttaggtggtttattatgcggttgtcgaagtttttatcgtttaggtgggtgtcgtcggtcgtggattttatttcgaagatgttattttcgatggttaggatggatacgtcgaaagtgttatcgtttaggttaaagatgagtacgtttttttcgtcgttcgcgtagttttttttgtttaggtcgtaggcgatggtcgtcgtcgtgggttcgttgatgatgcgtagtatattgagtttcgtgatggtgtttgcgtttttggtggtttggcgttgcgagtcgttgaaataggtcgggatcgttatgatt

SEQ ID NO: 20176 - DNA, 642 bp, Artificial Sequence
  chemically treated genomic DNA (Homo sapiens) CpG-island No: 20176
aatcataacgatcccgacctatttcaacgactcgcaacgccaaaccaccaaaaacgcaaacaccatcacgaaactcaatatactacgcatcatcaacgaacccacgacgacgaccatcgcctacgacctaaacaaaaaaaactacgcgaacgacgaaaaaaacgtactcatctttaacctaaacgataacactttcgacgtatccatcctaaccatcgaaaataacatcttcgaaataaaatccacgaccgacgacacccacctaaacgataaaaacttcgacaaccgcataataaaccacctaacgaaaaaattcaaacgcaaacacaaaaaaaacattaaacccaacaaacgcgccgtaaaacgactacgcaccgcttacgaacgcgccaaacgcaccctaaactcgtccacgcaaacgaacatcgaaatcgactcgctctacgaaaacgtaaacttctatacgtccatcacgcgcgcccgcttcgaaaaactcaataccgacctctttcgcgaaaccctaaaaccgataaaaaaaacgctacgcgacgccaaactaaacaaaaaccaaatccaaaaaatcgtactaataaacgactccactcgtatccccaaaatccaaaaactactacaaaatttctt

SEQ ID NO: 20177 - DNA, 812 bp, Artificial Sequence
  chemically treated genomic DNA (Homo sapiens) CpG-island No: 20177
tttttcgttttttttaggttatttttgtcgggcgtttcgcgaagatgtagtttaagtcgatggagattaatttcgaggtgagcgttaggtgtatcgttattcggagagcgcgaggtcgagggagggggagtcgagtcgttgatcggttcggttttgtttttttttttgtatttgttttttagatgttgaataaagtgagtggcgtttcgcgtcgtttttggttttttttttcgcgagcgtcgaggcgggggcgtttatcggtttcggttgttggtagggattaagtcgttcgttgcgagtatcggagacggtcgggttggggcgtgggttgggcgttttttttgggtttttgtatttagcgggtgattttacgaaatcggttacggggagacggagggggttgcgtttcgtggcgagcgagcgttaggcggagttttcgagggcgtggcgcgggtagtatagattcggttgtacgggtttcgcgggcgttacgtgtgggtcgcgttttgtgttgtgttattgcgtcggttcgggtgggggtggtagggcgggattggggttttttttaggttcgggtgcgggcgcggagggcgcgcgttttttggtttcgttttttggtaggtgttcgcgattcgcgtgttttcgtgcgtttggtcgttttgtttttttttcgtaggtgttgtttcggttgggggtcgtcggttagtggcgtttcgtggacgtgttggggttggaagaggagtttttgggttcggtgttagcgtttgtttgcgcgttgttgttgttgtttttttttacggtttaggtagggt

SEQ ID NO: 20178 - DNA, 812 bp, Artificial Sequence
  chemically treated genomic DNA (Homo sapiens) CpG-island No: 20178
accctacctaaaccgtaaaaaaaaacaacaacaacaacgcgcaaacaaacgctaacaccgaacccaaaaactcctcttccaaccccaacacgtccacgaaacgccactaaccgacgacccccaaccgaaacaacacctacgaaaaaaaaacaaaacgaccaaacgcacgaaaacacgcgaatcgcgaacacctaccaaaaaacgaaaccaaaaaacgcgcgccctccgcgcccgcacccgaacctaaaaaaaaccccaatcccgccctaccacccccacccgaaccgacgcaataacacaacacaaaacgcgacccacacgtaacgcccgcgaaacccgtacaaccgaatctatactacccgcgccacgccctcgaaaactccgcctaacgctcgctcgccacgaaacgcaaccccctccgtctccccgtaaccgatttcgtaaaatcacccgctaaatacaaaaacccaaaaaaaacgcccaacccacgccccaacccgaccgtctccgatactcgcaacgaacgacttaatccctaccaacaaccgaaaccgataaacgcccccgcctcgacgctcgcgaaaaaaaaaaccaaaaacgacgcgaaacgccactcactttattcaacatctaaaaaacaaatacaaaaaaaaaaacaaaaccgaaccgatcaacgactcgactccccctccctcgacctcgcgctctccgaataacgatacacctaacgctcacctcgaaattaatctccatcgacttaaactacatcttcgcgaaacgcccgacaaaaataacctaaaaaaaacgaaaaa

SEQ ID NO: 20179 - DNA, 812 bp, Artificial Sequence
  chemically treated genomic DNA (Homo sapiens) CpG-island No: 20179
gttttatttgggtcgtgaggggaaatagtagtagtagcgcgtaggtaggcgttggtatcgagtttagagattttttttttagttttagtacgtttacgaagcgttattggtcggcgatttttagtcgggatagtatttgcggagaggagataaggcggttaggcgtacggggatacgcgggtcgcgggtatttgttagggggcggggttaggaggcgcgcgtttttcgcgttcgtattcgagtttgggaggagttttagtttcgttttgttatttttattcgggtcggcgtaatgatatagtataaagcgcggtttatacgtggcgttcgcgaagttcgtgtagtcgagtttgtgttgttcgcgttacgttttcgggagtttcgtttggcgttcgttcgttacggggcgtagtttttttcgttttttcgtgatcggtttcgtagagttattcgttaaatgtaggggtttaggaaaggcgtttagtttacgttttagttcggtcgttttcggtgttcgtagcgggcggtttggtttttgttagtagtcggaatcggtgggcgttttcgtttcggcgttcgcgggggagggggttagagacggcgcgagacgttatttattttgtttagtatttgaaaggtaaatgtaaagaaaaaggtaaaatcgaatcgattagcgattcggttttttttttttcggtttcgcgtttttcgggtagcggtgtatttggcgtttatttcggggttgatttttatcggtttgagttgtattttcgcggagcgttcggtagaaatagtttagggaagacgaaaaa

SEQ ID NO: 20180 - DNA, 812 bp, Artificial Sequence
  chemically treated genomic DNA (Homo sapiens) CpG-island No: 20180
tttttcgtcttccctaaactatttctaccgaacgctccgcgaaaatacaactcaaaccgataaaaatcaaccccgaaataaacgccaaatacaccgctacccgaaaaacgcgaaaccgaaaaaaaaaaaaccgaatcgctaatcgattcgattttacctttttctttacatttacctttcaaatactaaacaaaataaataacgtctcgcgccgtctctaaccccctcccccgcgaacgccgaaacgaaaacgcccaccgattccgactactaacaaaaaccaaaccgcccgctacgaacaccgaaaacgaccgaactaaaacgtaaactaaacgcctttcctaaacccctacatttaacgaataactctacgaaaccgatcacgaaaaaacgaaaaaaactacgccccgtaacgaacgaacgccaaacgaaactcccgaaaacgtaacgcgaacaacacaaactcgactacacgaacttcgcgaacgccacgtataaaccgcgctttatactatatcattacgccgacccgaataaaaataacaaaacgaaactaaaactcctcccaaactcgaatacgaacgcgaaaaacgcgcgcctcctaaccccgccccctaacaaatacccgcgacccgcgtatccccgtacgcctaaccgccttatctcctctccgcaaatactatcccgactaaaaatcgccgaccaataacgcttcgtaaacgtactaaaactaaaaaaaaaatctctaaactcgataccaacgcctacctacgcgctactactactatttcccctcacgacccaaataaaac

SEQ ID NO: 20181 - DNA, 1154 bp, Artificial Sequence
  chemically treated genomic DNA (Homo sapiens) CpG-island No: 20181
gttcgcgcgttttattgtttcggtgtcgtagcgttcgttttttcgggttcgggtgcgttttattgggcgcgcgttttttatatgatgttagatttattcgttcgttttttagtagtcggcggggcgtagggacgtgcggggcggttagcggattttttttatcgggtcgggtgtgaacgggagggagatacgtagcgttcgtttcgggttatttttagttcgtagttgtgtttttttttttcgggggcggagcggttttcgaaggtggggaggagaagaagttttcggcgttttcgcgttcgttttcgcgggttatttacggcgcgttggagttcgggcggcgtcgggaatagttgtcgcggcgttttttagtagcgcgcggttttttcgggatttgcgtcggtcgggggcggggagaggcggggaggggaggtcggcgggcgggaaggggcggggagcgcgtttttgcggcggcgacggcggcggtcgtttttatttcggcgtttgagaggacgcggggttgcgtaaatggtttgtttcgttttcggtttggaagttttttagtttttgtagttcgagtcgtttttcgagttcgtttttttcgaggcgtagaagtggattgaggtaggtgcgggtggttggcgggcggttttgtattggcgttttgagttacggattcgcgtacgtttcgatcgtaggtttagttttgtttttttttaatcgtttttatttttttttgttagttgttttaggttattttttcgggtttcggcgagtcgcgaaattttagcgttttggtattggaatttcgggcgagggtgggcgtgaaaggggatattgtagtttagttgcgcgcgtgagggtaggaagggattttttgcgcgtttattttttttgttcgttggtttcgtaaattttagttagcgtcgtttttaggcgttgttaagggaagcgtagtgttagtaaagcgttgtaaaggcgtaggaagcgcgagtttttagagattttatcggtgttcgtatttcggggtattttgtttttggttttatatttcgttttttgtttttttatttcgtattttttcggagtagagttggtagtgtttttacggaggcgtatatttatcggagttttttgttgtatttttggtatcg

SEQ ID NO: 20182 - DNA, 1154 bp, Artificial Sequence
  chemically treated genomic DNA (Homo sapiens) CpG-island No: 20182
cgataccaaaaatacaacaaaaaactccgataaatatacgcctccgtaaaaacactaccaactctactccgaaaaaatacgaaataaaaaaacaaaaaacgaaatataaaaccaaaaacaaaataccccgaaatacgaacaccgataaaatctctaaaaactcgcgcttcctacgcctttacaacgctttactaacactacgcttcccttaacaacgcctaaaaacgacgctaactaaaatttacgaaaccaacgaacaaaaaaaataaacgcgcaaaaaatcccttcctaccctcacgcgcgcaactaaactacaatatcccctttcacgcccaccctcgcccgaaattccaataccaaaacgctaaaatttcgcgactcgccgaaacccgaaaaaataacctaaaacaactaacaaaaaaaaataaaaacgattaaaaaaaaacaaaactaaacctacgatcgaaacgtacgcgaatccgtaactcaaaacgccaatacaaaaccgcccgccaaccacccgcacctacctcaatccacttctacgcctcgaaaaaaacgaactcgaaaaacgactcgaactacaaaaactaaaaaacttccaaaccgaaaacgaaacaaaccatttacgcaaccccgcgtcctctcaaacgccgaaataaaaacgaccgccgccgtcgccgccgcaaaaacgcgctccccgccccttcccgcccgccgacctcccctccccgcctctccccgcccccgaccgacgcaaatcccgaaaaaaccgcgcgctactaaaaaacgccgcgacaactattcccgacgccgcccgaactccaacgcgccgtaaataacccgcgaaaacgaacgcgaaaacgccgaaaacttcttctcctccccaccttcgaaaaccgctccgcccccgaaaaaaaaaaacacaactacgaactaaaaataacccgaaacgaacgctacgtatctccctcccgttcacacccgacccgataaaaaaaatccgctaaccgccccgcacgtccctacgccccgccgactactaaaaaacgaacgaataaatctaacatcatataaaaaacgcgcgcccaataaaacgcacccgaacccgaaaaaacgaacgctacgacaccgaaacaataaaacgcgcgaac

SEQ ID NO: 20183 - DNA, 1154 bp, Artificial Sequence
  chemically treated genomic DNA (Homo sapiens) CpG-island No: 20183
cggtgttaggaatatagtaagaggtttcggtgggtatgcgttttcgtgaagatattgttaattttgtttcggaagggtgcggggtagggggataaggggcgaaatgtgggattagaagtaagatatttcgaaatgcgagtatcggtgaagtttttgggggttcgcgttttttgcgtttttgtaacgttttgttagtattgcgttttttttggtagcgtttggaagcggcgttagttgagatttgcgaggttagcgggtaggaaggatggacgcgtaggggatttttttttgtttttacgcgcgtagttagattgtagtgtttttttttacgtttattttcgttcgggattttaatgttaaagcgttaaggtttcgcggttcgtcgaggttcgggggggtgatttggagtagttggtaaaagaaagtgggggcggttggggggaggtaaggttggatttgcggtcggagcgtgcgcgggttcgtggtttagggcgttagtgtaaggtcgttcgttagttattcgtatttattttaatttatttttgcgtttcggagaaggcgggttcggggggcggttcgggttgtaggggttgaagagtttttagatcgagagcgggataagttatttgcgtagtttcgcgtttttttaagcgtcgggatgaggacggtcgtcgtcgtcgtcgtcgtaggagcgcgtttttcgttttttttcgttcgtcggtttttttttttcgttttttttcgttttcggtcggcgtaggtttcgggagagtcgcgcgttgttagaggacgtcgcggtagttgttttcggcgtcgttcgggttttaacgcgtcgtgagtgattcgcgggagcgagcgcggaggcgtcgggagtttttttttttttttattttcgagggtcgtttcgttttcggggagggggagtatagttacggattaaaaataattcggagcgagcgttgcgtgtttttttttcgtttatattcggttcgatagagggaattcgttggtcgtttcgtacgtttttgcgtttcgtcggttgttgaggggcgggcggatgggtttggtattatatgggagacgcgcgtttagtggggcgtattcgggttcgggggagcgggcgttgcggtatcggagtagtaggacgcgcgggt

SEQ ID NO: 20184 - DNA, 1154 bp, Artificial Sequence
  chemically treated genomic DNA (Homo sapiens) CpG-island No: 20184
acccgcgcgtcctactactccgataccgcaacgcccgctcccccgaacccgaatacgccccactaaacgcgcgtctcccatataataccaaacccatccgcccgcccctcaacaaccgacgaaacgcaaaaacgtacgaaacgaccaacgaattccctctatcgaaccgaatataaacgaaaaaaaaacacgcaacgctcgctccgaattatttttaatccgtaactatactccccctccccgaaaacgaaacgaccctcgaaaataaaaaaaaaaaaaaactcccgacgcctccgcgctcgctcccgcgaatcactcacgacgcgttaaaacccgaacgacgccgaaaacaactaccgcgacgtcctctaacaacgcgcgactctcccgaaacctacgccgaccgaaaacgaaaaaaaacgaaaaaaaaaaaccgacgaacgaaaaaaaacgaaaaacgcgctcctacgacgacgacgacgacgaccgtcctcatcccgacgcttaaaaaaacgcgaaactacgcaaataacttatcccgctctcgatctaaaaactcttcaacccctacaacccgaaccgccccccgaacccgccttctccgaaacgcaaaaataaattaaaataaatacgaataactaacgaacgaccttacactaacgccctaaaccacgaacccgcgcacgctccgaccgcaaatccaaccttacctccccccaaccgcccccactttcttttaccaactactccaaatcacccccccgaacctcgacgaaccgcgaaaccttaacgctttaacattaaaatcccgaacgaaaataaacgtaaaaaaaaacactacaatctaactacgcgcgtaaaaacaaaaaaaaatcccctacgcgtccatccttcctacccgctaacctcgcaaatctcaactaacgccgcttccaaacgctaccaaaaaaaacgcaatactaacaaaacgttacaaaaacgcaaaaaacgcgaacccccaaaaacttcaccgatactcgcatttcgaaatatcttacttctaatcccacatttcgccccttatccccctaccccgcacccttccgaaacaaaattaacaatatcttcacgaaaacgcatacccaccgaaacctcttactatattcctaacaccg

SEQ ID NO: 20185 - DNA, 1003 bp, Artificial Sequence
  chemically treated genomic DNA (Homo sapiens) CpG-island No: 20185
agaatgacgtcggtgttcgggtaggagagcggtcgtaggcggtcgtagtttttttggttcgtcgtgttttatagcgttagttttatttgtttgtcgtttattttaatgtcggttatatagttttcgaagacggtgggtacgtatatttcggggaattcgtttttattgaatacgattagtaggtacgttttgttatacgcgtcgtcgtttattattattagttttttgcggatggtcgttatgagcgggtcgggttcgggtagtaggagggggttcgcgaacgtttcgttgttttttcgttcgtcgtttattgtttatttcgggttgcgcgtaggtggcgagagggtcgttagttgtattcgggtttcgcggtggcgcgttttttcgttgcgtttcggttgtcgcggcgggggcggtgggggcgcgggggtatagggcgtatcgtgcgtttcgtcgcgttgttttcgggcggtggtcgttttgtttattttaggtcggggatcggcggttttgtgcgtaacgcgggttcgggtagtagattcgggcggtggattcggtttagttttttttcgggttttttcgggtttcgttgagtatataagataatagttttaattagattgcggtggtagatgagggttgcggttttagcgttcgttatttaaagagttcggttatttttttaatatagtcgtttaatgggaaattagtcggttgagtttatcgttgcggagtttagttttgattggtcgttttttgtagttcgagggcggggtagggttagtttgattgacggtttaggtcgtcgggttgggagaggtagcgatcggggagtttgcgttgttgttgtcgttgcggggttttggcggtattcgggttttttttttcgtcgtagcgtttgcgcgcggggttcgggagttggttgtttggagtttttagggtttgggcgagcggtttcgagataggttttatttagtggggcgttggcgatttttatttagaa

SEQ ID NO: 20186 - DNA, 1003 bp, Artificial Sequence
  chemically treated genomic DNA (Homo sapiens) CpG-island No: 20186
ttctaaataaaaatcgccaacgccccactaaataaaacctatctcgaaaccgctcgcccaaaccctaaaaactccaaacaaccaactcccgaaccccgcgcgcaaacgctacgacgaaaaaaaaaacccgaataccgccaaaaccccgcaacgacaacaacaacgcaaactccccgatcgctacctctcccaacccgacgacctaaaccgtcaatcaaactaaccctaccccgccctcgaactacaaaaaacgaccaatcaaaactaaactccgcaacgataaactcaaccgactaatttcccattaaacgactatattaaaaaaataaccgaactctttaaataacgaacgctaaaaccgcaaccctcatctaccaccgcaatctaattaaaactattatcttatatactcaacgaaacccgaaaaaacccgaaaaaaaactaaaccgaatccaccgcccgaatctactacccgaacccgcgttacgcacaaaaccgccgatccccgacctaaaataaacaaaacgaccaccgcccgaaaacaacgcgacgaaacgcacgatacgccctatacccccgcgcccccaccgcccccgccgcgacaaccgaaacgcaacgaaaaaacgcgccaccgcgaaacccgaatacaactaacgaccctctcgccacctacgcgcaacccgaaataaacaataaacgacgaacgaaaaaacaacgaaacgttcgcgaaccccctcctactacccgaacccgacccgctcataacgaccatccgcaaaaaactaataataataaacgacgacgcgtataacaaaacgtacctactaatcgtattcaataaaaacgaattccccgaaatatacgtacccaccgtcttcgaaaactatataaccgacattaaaataaacgacaaacaaataaaactaacgctataaaacacgacgaaccaaaaaaactacgaccgcctacgaccgctctcctacccgaacaccgacgtcattct

SEQ ID NO: 20187 - DNA, 1003 bp, Artificial Sequence
  chemically treated genomic DNA (Homo sapiens) CpG-island No: 20187
ttttggatgggagtcgttaacgttttattgagtgaagtttgtttcggaatcgttcgtttagattttggaggttttagatagttagttttcggatttcgcgcgtaaacgttgcggcgaaggaggggattcgggtatcgttagagtttcgtagcggtagtagtagcgtagatttttcggtcgttgttttttttagttcggcggtttgggtcgttaattaagttggttttgtttcgttttcgggttgtagggggcggttaattagagttaagtttcgtagcgatgagtttagtcggttggttttttattggacggttatattaagaaagtggtcggattttttaaatagcgggcgttagggtcgtagtttttatttgttatcgtagtttggttggagttgttgttttgtatgtttagcgaggttcggagagattcgggagagagttaggtcgagtttatcgttcgagtttgttgttcgagttcgcgttacgtataaagtcgtcgattttcggtttggggtgagtagagcgattatcgttcgggagtagcgcggcgagacgtacggtgcgttttatgttttcgcgtttttatcgttttcgtcgcggtagtcgaagcgtagcgagagaacgcgttatcgcggggttcgggtgtagttagcgattttttcgttatttgcgcgtagttcgaggtgagtagtgagcggcgagcgggagggtagcgaggcgttcgcgggtttttttttgttgttcgggttcggttcgtttatggcggttattcgtaagaagttggtggtggtgggcgacggcgcgtgtggtaagacgtgtttgttgatcgtgtttagtaaggacgagtttttcgaggtgtacgtgtttatcgttttcgagaattatgtggtcgatattgaggtggacggtaagtaggtggagttggcgttgtgggatacggcgggttaggaggattacgatcgtttgcggtcgtttttttattcggatatcgacgttatttt

SEQ ID NO: 20188 - DNA, 1003 bp, Artificial Sequence
  chemically treated genomic DNA (Homo sapiens) CpG-island No: 20188
aaaataacgtcgatatccgaataaaaaaacgaccgcaaacgatcgtaatcctcctaacccgccgtatcccacaacgccaactccacctacttaccgtccacctcaatatcgaccacataattctcgaaaacgataaacacgtacacctcgaaaaactcgtccttactaaacacgatcaacaaacacgtcttaccacacgcgccgtcgcccaccaccaccaacttcttacgaataaccgccataaacgaaccgaacccgaacaacaaaaaaaaacccgcgaacgcctcgctaccctcccgctcgccgctcactactcacctcgaactacgcgcaaataacgaaaaaatcgctaactacacccgaaccccgcgataacgcgttctctcgctacgcttcgactaccgcgacgaaaacgataaaaacgcgaaaacataaaacgcaccgtacgtctcgccgcgctactcccgaacgataatcgctctactcaccccaaaccgaaaatcgacgactttatacgtaacgcgaactcgaacaacaaactcgaacgataaactcgacctaactctctcccgaatctctccgaacctcgctaaacatacaaaacaacaactccaaccaaactacgataacaaataaaaactacgaccctaacgcccgctatttaaaaaatccgaccactttcttaatataaccgtccaataaaaaaccaaccgactaaactcatcgctacgaaacttaactctaattaaccgccccctacaacccgaaaacgaaacaaaaccaacttaattaacgacccaaaccgccgaactaaaaaaaacaacgaccgaaaaatctacgctactactaccgctacgaaactctaacgatacccgaatcccctccttcgccgcaacgtttacgcgcgaaatccgaaaactaactatctaaaacctccaaaatctaaacgaacgattccgaaacaaacttcactcaataaaacgttaacgactcccatccaaaa

SEQ ID NO: 20189 - DNA, 788 bp, Artificial Sequence
  chemically treated genomic DNA (Homo sapiens) CpG-island No: 20189
ttaagtttcgttttatttaggttcgtttcgggtgcggagggtcgggtcgtaaattcgtaaggcgcggaggtcgtcgcgacgtttatcggggggcgttgtgaagtcggtatcgggcggatagaggtgagtcggttcggaggcggtggttttcgtttttgttcgcgcgtcgaggggcgaattttaggtagcgaggtcgtcgttttcgtttttcggtcggttttttcgttagcgggcgagaggggagtggtcgggtttttttcgtcgtcgttgagtatttcgtagttgggtgcgtacgggagttttaatcgcggcgcgtggaggtagtattagagcgcgcggcgcgtagtcggtcggtagtcgcgggatagttttggtagaatagtcgcggcgggagtttcgtagtttcgggttgggttcgcgtttcggagcgttatcggagagcgaggacgacgtggaggcggagtggcgttcggcgaggtagcgttaggcgaggtagcgcgagcgtttttttttttttttttttgtttttttttttgcgttcgtcgtcggttttcgaggcgtttgtttcgcgtttttgtgttcgcggtttttggtttcgtcgtattttgcgggcgggggttagcgggttttgtcgtttttttgggagacgcggcgttgcggcgggaacggcgtacgttgtaggttgcggagggtggtcgtgatttcgtagtggtttcgggggtggcgggagggaagaagggtttgtaaattaagttgtttttattttgttttatgtttttcgtatttgt

SEQ ID NO: 20190 - DNA, 788 bp, Artificial Sequence
  chemically treated genomic DNA (Homo sapiens) CpG-island No: 20190
acaaatacgaaaaacataaaacaaaataaaaacaacttaatttacaaacccttcttccctcccgccacccccgaaaccactacgaaatcacgaccaccctccgcaacctacaacgtacgccgttcccgccgcaacgccgcgtctcccaaaaaaacgacaaaacccgctaacccccgcccgcaaaatacgacgaaaccaaaaaccgcgaacacaaaaacgcgaaacaaacgcctcgaaaaccgacgacgaacgcaaaaaaaaaaacaaaaaaaaaaaaaaaaaaacgctcgcgctacctcgcctaacgctacctcgccgaacgccactccgcctccacgtcgtcctcgctctccgataacgctccgaaacgcgaacccaacccgaaactacgaaactcccgccgcgactattctaccaaaactatcccgcgactaccgaccgactacgcgccgcgcgctctaatactacctccacgcgccgcgattaaaactcccgtacgcacccaactacgaaatactcaacgacgacgaaaaaaacccgaccactcccctctcgcccgctaacgaaaaaaccgaccgaaaaacgaaaacgacgacctcgctacctaaaattcgcccctcgacgcgcgaacaaaaacgaaaaccaccgcctccgaaccgactcacctctatccgcccgataccgacttcacaacgccccccgataaacgtcgcgacgacctccgcgccttacgaatttacgacccgaccctccgcacccgaaacgaacctaaataaaacgaaacttaa

SEQ ID NO: 20191 - DNA, 788 bp, Artificial Sequence
  chemically treated genomic DNA (Homo sapiens) CpG-island No: 20191
ataggtacgagaggtatggggtaaagtaagagtaatttagtttataagttttttttttttttcgttattttcgaagttattgcggagttacgattatttttcgtaatttatagcgtgcgtcgttttcgtcgtagcgtcgcgttttttaagagagcggtagagttcgttgattttcgttcgtagggtgcgacggggttagggatcgcgggtataaaggcgcggagtaggcgtttcgggggtcgacgacggacgtagagggaagggtaggggagagagagagaaagcgttcgcgttatttcgtttggcgttatttcgtcgggcgttatttcgtttttacgtcgttttcgtttttcggtggcgtttcgggacgcgggtttagttcggggttgcggggttttcgtcgcggttgttttgttaaggttgtttcgcggttgtcggtcgattgcgcgtcgcgcgttttggtattgtttttacgcgtcgcggttgaggttttcgtgcgtatttagttgcggagtgtttagcggcggcgggaggagttcggttatttttttttcgttcgttggcggaggggtcggtcgaggggcgggggcggcgatttcgttgtttgggattcgtttttcggcgcgcgggtaggaacgggagttatcgttttcgagtcgatttatttttgttcgttcggtgtcggttttatagcgtttttcggtgagcgtcgcggcggttttcgcgttttgcgggtttgcggttcgatttttcgtattcggggcgagtttggatgggacgaggtttga

SEQ ID NO: 20192 - DNA, 788 bp, Artificial Sequence
  chemically treated genomic DNA (Homo sapiens) CpG-island No: 20192
tcaaacctcgtcccatccaaactcgccccgaatacgaaaaatcgaaccgcaaacccgcaaaacgcgaaaaccgccgcgacgctcaccgaaaaacgctataaaaccgacaccgaacgaacaaaaataaatcgactcgaaaacgataactcccgttcctacccgcgcgccgaaaaacgaatcccaaacaacgaaatcgccgcccccgcccctcgaccgacccctccgccaacgaacgaaaaaaaaataaccgaactcctcccgccgccgctaaacactccgcaactaaatacgcacgaaaacctcaaccgcgacgcgtaaaaacaataccaaaacgcgcgacgcgcaatcgaccgacaaccgcgaaacaaccttaacaaaacaaccgcgacgaaaaccccgcaaccccgaactaaacccgcgtcccgaaacgccaccgaaaaacgaaaacgacgtaaaaacgaaataacgcccgacgaaataacgccaaacgaaataacgcgaacgctttctctctctctcccctacccttccctctacgtccgtcgtcgacccccgaaacgcctactccgcgcctttatacccgcgatccctaaccccgtcgcaccctacgaacgaaaatcaacgaactctaccgctctcttaaaaaacgcgacgctacgacgaaaacgacgcacgctataaattacgaaaaataatcgtaactccgcaataacttcgaaaataacgaaaaaaaaaaaaaacttataaactaaattactcttactttaccccatacctctcgtacctat

SEQ ID NO: 20193 - DNA, 956 bp, Artificial Sequence
  chemically treated genomic DNA (Homo sapiens) CpG-island No: 20193
gttattcgtttttaaattttaaattttgcgtaatgtttttttatagatttttttaggtattacgtagtttcgagtttcgagtttcgtttcgggggttttatttcgttttttcgcgttcgcggttcgtttttttttattgagcgtttagttttcgtagttttttcggtcgtcgagcgtcgtgggcggggttttagggcggcggcgtttcgcggggagggtttttcgtgttgggggcgaggttattcgaggtagtttttcgttcgtttttaatttcgtttcgttttcggagtttataaagggaggcgattcgcggttcgttcggttggtattttttagtcgtcgttagtttcgtcgaggggagttagcgtcgtttttgaggggcgttcggcgtcggagttatgatttttcgtcgatttaggaagttgtagtagaaggaggaggcggcggttatttcggatttcgtcgttcggattttcgattcggaagtcgcgttcgtcgtttcggtttcgatttcgggattttttgtcgtagtcgttatttttgggtttttagcggacgagttgtacgcggcgttggaggattattattttgtcgagttgtatcgcgcgttcgtcgtgttcgggggtattttgtttcgtcgaaaggtgcgtttttcgttcgtttttaggatttgtttagttttttttcgattttttatagggtttgttgatttcgtagtgtttttttttcggcgttcgcggagttttttattttttttttcggttcgttgggtgtttcgatttttcgcgtttttcgttgttgcgaaggtcgtggttttcgtttgtatatcgcgtttaggttcggtggtttttaatttcgcgttttatgtacgttttttttttttttttttgattttttttagtatttttttttttttattcgttttatttggttttttgttttttatgtttcgtttt

SEQ ID NO: 20194 - DNA, 956 bp, Artificial Sequence
  chemically treated genomic DNA (Homo sapiens) CpG-island No: 20194
aaaacgaaacataaaaaacaaaaaaccaaataaaacgaataaaaaaaaaaaaatactaaaaaaaatcaaaaaaaaaaaaaaaaaacgtacataaaacgcgaaattaaaaaccaccgaacctaaacgcgatatacaaacgaaaaccacgaccttcgcaacaacgaaaaacgcgaaaaatcgaaacacccaacgaaccgaaaaaaaaaataaaaaactccgcgaacgccgaaaaaaaaacactacgaaatcaacaaaccctataaaaaatcgaaaaaaaactaaacaaatcctaaaaacgaacgaaaaacgcacctttcgacgaaacaaaatacccccgaacacgacgaacgcgcgatacaactcgacaaaataataatcctccaacgccgcgtacaactcgtccgctaaaaacccaaaaataacgactacgacaaaaaatcccgaaatcgaaaccgaaacgacgaacgcgacttccgaatcgaaaatccgaacgacgaaatccgaaataaccgccgcctcctccttctactacaacttcctaaatcgacgaaaaatcataactccgacgccgaacgcccctcaaaaacgacgctaactcccctcgacgaaactaacgacgactaaaaaataccaaccgaacgaaccgcgaatcgcctccctttataaactccgaaaacgaaacgaaattaaaaacgaacgaaaaactacctcgaataacctcgcccccaacacgaaaaaccctccccgcgaaacgccgccgccctaaaaccccgcccacgacgctcgacgaccgaaaaaactacgaaaactaaacgctcaataaaaaaaaacgaaccgcgaacgcgaaaaaacgaaataaaacccccgaaacgaaactcgaaactcgaaactacgtaatacctaaaaaaatctataaaaaaacattacgcaaaatttaaaatttaaaaacgaataac

SEQ ID NO: 20195 - DNA, 956 bp, Artificial Sequence
  chemically treated genomic DNA (Homo sapiens) CpG-island No: 20195
gaggcggggtatggggggtagaaagttagatggagcgggtaggagaaggggggtgttgggaggagttaaggagggagagagggggcgtgtatggggcgcggagttaagagttatcgagtttgggcgcggtgtgtaggcgagggttacggttttcgtagtagcggggaacgcggggagtcgaggtatttagcgggtcggggaagaaggtgggggatttcgcggacgtcgaggagagggtattgcggagttagtaggttttgtagggagtcggagaggggttgagtagattttgaaggcgggcgggggacgtatttttcggcggggtagggtgttttcggatacggcgagcgcgcggtatagttcggtagggtgatagttttttagcgtcgcgtatagttcgttcgttgggggtttaggggtggcggttgcggtagggggtttcggggtcgggatcggagcggcgggcgcgattttcgagtcgggagttcgggcggcggggttcggggtggtcgtcgttttttttttttgttgtagttttttgagtcggcggagggttatggtttcggcgtcggacgttttttagagacggcgttggtttttttcggcggggttggcggcggttgggggatgttagtcgggcgggtcgcgggtcgtttttttttataggtttcgagagcggggcggggttgggggcgggcggggagttgtttcgggtggtttcgtttttagtacggaggatttttttcgcgaggcgtcgtcgttttggagtttcgtttacggcgttcgacggtcggggaaattgcgggagttgggcgtttagtgggggaaaacgagtcgcggacgcgaaggggcgggatgaggttttcggggcggggttcggggttcggggttgcgtgatatttggaggggtttgtgaagggatattgcgtaaggtttgaaatttagggacgaatagt

SEQ ID NO: 20196 - DNA, 956 bp, Artificial Sequence
  chemically treated genomic DNA (Homo sapiens) CpG-island No: 20196
actattcgtccctaaatttcaaaccttacgcaatatcccttcacaaacccctccaaatatcacgcaaccccgaaccccgaaccccgccccgaaaacctcatcccgccccttcgcgtccgcgactcgttttcccccactaaacgcccaactcccgcaatttccccgaccgtcgaacgccgtaaacgaaactccaaaacgacgacgcctcgcgaaaaaaatcctccgtactaaaaacgaaaccacccgaaacaactccccgcccgcccccaaccccgccccgctctcgaaacctataaaaaaaaacgacccgcgacccgcccgactaacatcccccaaccgccgccaaccccgccgaaaaaaaccaacgccgtctctaaaaaacgtccgacgccgaaaccataaccctccgccgactcaaaaaactacaacaaaaaaaaaaaacgacgaccaccccgaaccccgccgcccgaactcccgactcgaaaatcgcgcccgccgctccgatcccgaccccgaaaccccctaccgcaaccgccacccctaaacccccaacgaacgaactatacgcgacgctaaaaaactatcaccctaccgaactataccgcgcgctcgccgtatccgaaaacaccctaccccgccgaaaaatacgtcccccgcccgccttcaaaatctactcaacccctctccgactccctacaaaacctactaactccgcaataccctctcctcgacgtccgcgaaatcccccaccttcttccccgacccgctaaatacctcgactccccgcgttccccgctactacgaaaaccgtaaccctcgcctacacaccgcgcccaaactcgataactcttaactccgcgccccatacacgccccctctctccctccttaactcctcccaacaccccccttctcctacccgctccatctaactttctaccccccataccccgcctc

SEQ ID NO: 20197 - DNA, 571 bp, Artificial Sequence
  chemically treated genomic DNA (Homo sapiens) CpG-island No: 20197
tacgatacgttggagtcggtgcgtttttgtttttacggcgcgggtttgttttcgggttcgttgtttttcgggtttttgttcgtcgtgttcgggcgttttcgcggaggcgttcgacgggttaggggcgacgtcgacgacgtcgtttattatacgtgttttttcggggatttcgagtcgtcggcgttgtcgttttcgtcgttttcggttcgcgttttcggttcgggtttcgtcgagatttttgtcgtggggtcgggttttgggtcgcgggtcgcgttgagtcgtagcgttagtgtgcggtgcgcgggttttggcgggggcggaggcgggggcgcgtcgggcgcgttttggattgaggttcgcgagtaggttttatgcggtttcggtttgcgtaaaattaagtatcgtagttttcgtcggcggttgtttaagtttattttcggatttaatcgttttttggaggaggaggagagttagttgtaggggcgggggcgggtagggaggtatttatttatttattcgtaatagttagcgttaaaagagggggaggtcgagttaagaggattttaggagt

SEQ ID NO: 20198 - DNA, 571 bp, Artificial Sequence
  chemically treated genomic DNA (Homo sapiens) CpG-island No: 20198
actcctaaaatcctcttaactcgacctccccctcttttaacgctaactattacgaataaataaataaatacctccctacccgcccccgcccctacaactaactctcctcctcctccaaaaaacgattaaatccgaaaataaacttaaacaaccgccgacgaaaactacgatacttaattttacgcaaaccgaaaccgcataaaacctactcgcgaacctcaatccaaaacgcgcccgacgcgcccccgcctccgcccccgccaaaacccgcgcaccgcacactaacgctacgactcaacgcgacccgcgacccaaaacccgaccccacgacaaaaatctcgacgaaacccgaaccgaaaacgcgaaccgaaaacgacgaaaacgacaacgccgacgactcgaaatccccgaaaaaacacgtataataaacgacgtcgtcgacgtcgcccctaacccgtcgaacgcctccgcgaaaacgcccgaacacgacgaacaaaaacccgaaaaacaacgaacccgaaaacaaacccgcgccgtaaaaacaaaaacgcaccgactccaacgtatcgta

SEQ ID NO: 20199 - DNA, 571 bp, Artificial Sequence
  chemically treated genomic DNA (Homo sapiens) CpG-island No: 20199
gtttttggggtttttttggttcggttttttttttttttagcgttggttgttgcgaataaataaataaatatttttttgttcgttttcgtttttatagttggtttttttttttttttagggagcggttgagttcggggatgaatttgagtagtcgtcggcggaagttgcggtatttggttttgcgtaggtcggggtcgtatagggtttgttcgcgagttttagtttagagcgcgttcggcgcgttttcgttttcgttttcgttagggttcgcgtatcgtatattggcgttgcggtttagcgcggttcgcggtttagggttcggttttacggtaggggtttcggcggggttcgggtcgaaggcgcgggtcgggggcggcgggggcggtagcgtcggcggttcggagttttcgaagaagtacgtgtggtagacggcgtcgtcggcgtcgtttttggttcgtcgggcgttttcgcggggacgttcgggtacggcgagtagaggttcgaagggtagcgagttcgggagtaggttcgcgtcgtagaggtaggagcgtatcgattttagcgtgtcgta

SEQ ID NO: 20200 - DNA, 571 bp, Artificial Sequence
  chemically treated genomic DNA (Homo sapiens) CpG-island No: 20200
tacgacacgctaaaatcgatacgctcctacctctacgacgcgaacctactcccgaactcgctacccttcgaacctctactcgccgtacccgaacgtccccgcgaaaacgcccgacgaaccaaaaacgacgccgacgacgccgtctaccacacgtacttcttcgaaaactccgaaccgccgacgctaccgcccccgccgcccccgacccgcgccttcgacccgaaccccgccgaaacccctaccgtaaaaccgaaccctaaaccgcgaaccgcgctaaaccgcaacgccaatatacgatacgcgaaccctaacgaaaacgaaaacgaaaacgcgccgaacgcgctctaaactaaaactcgcgaacaaaccctatacgaccccgacctacgcaaaaccaaataccgcaacttccgccgacgactactcaaattcatccccgaactcaaccgctccctaaaaaaaaaaaaaaaccaactataaaaacgaaaacgaacaaaaaaatatttatttatttattcgcaacaaccaacgctaaaaaaaaaaaaaaccgaaccaaaaaaaccccaaaaac

SEQ ID NO: 20201 - DNA, 569 bp, Artificial Sequence
  chemically treated genomic DNA (Homo sapiens) CpG-island No: 20201
gcgcgtatatttattttttttatgtatcgtttttaaaaatagatgtacgtttttcgaagggaatttattcggtcggttttcgttgtttttgttcggattggcgtttcgagttttagtttggtttttggtttcgcgtgcgttttcgaagtttttttgtgtatttttttaagtttcgtagttttcgttattgggatttttcggtcgagttcgattttttttttaagcgtttcgtgacgtacggggaggggcgggggcgttattgacgtaggtcgttcgtcgagttttggttatataagggcgcggggggcggtgcggtttcggcgggaggcggttagggggaggtgcggttcggggagttcgagggggcggggcgaggagggggggtttggaatgtttgcgcgcgtgacgtacgcggggttttattgacgtagggagcgcggattgtttgatttataaataggtttttcgcgttcgtcgcgttcgttaaaaatagtagtttttaggtttattaggtttttcgtatcggattcgggttttagttgggggtttttaggtttagaataattagt

SEQ ID NO: 20202 - DNA, 569 bp, Artificial Sequence
  chemically treated genomic DNA (Homo sapiens) CpG-island No: 20202
actaattattctaaacctaaaaacccccaactaaaacccgaatccgatacgaaaaacctaataaacctaaaaactactatttttaacgaacgcgacgaacgcgaaaaacctatttataaatcaaacaatccgcgctccctacgtcaataaaaccccgcgtacgtcacgcgcgcaaacattccaaaccccccctcctcgccccgccccctcgaactccccgaaccgcacctccccctaaccgcctcccgccgaaaccgcaccgccccccgcgcccttatataaccaaaactcgacgaacgacctacgtcaataacgcccccgcccctccccgtacgtcacgaaacgcttaaaaaaaaaatcgaactcgaccgaaaaatcccaataacgaaaactacgaaacttaaaaaaatacacaaaaaaacttcgaaaacgcacgcgaaaccaaaaaccaaactaaaactcgaaacgccaatccgaacaaaaacaacgaaaaccgaccgaataaattcccttcgaaaaacgtacatctatttttaaaaacgatacataaaaaaaataaatatacgcgc

SEQ ID NO: 20203 - DNA, 569 bp, Artificial Sequence
  chemically treated genomic DNA (Homo sapiens) CpG-island No: 20203
gttggttattttggatttgggggtttttagttgggattcgagttcggtgcggggagtttagtgggtttgggagttgttatttttagcgggcgcggcgggcgcgaggagtttatttatagattaaataattcgcgttttttgcgttaatggaatttcgcgtgcgttacgcgcgtagatattttaggtttttttttttcgtttcgttttttcgggtttttcgggtcgtatttttttttggtcgtttttcgtcggaatcgtatcgtttttcgcgtttttgtatggttaaagttcgacgggcggtttgcgttagtggcgttttcgttttttttcgtgcgttacggagcgtttaagaggagggtcgggttcggtcggggagttttagtggcggaggttacgaaatttgggggagtgtatagaagaatttcgggagcgtacgcgggattagggattaggttgagattcggggcgttagttcgggtaggggtagcgggagtcggtcgggtaggtttttttcggggaacgtgtatttgtttttaggagcggtgtatgaaggagatgggtgtacgcgt

SEQ ID NO: 20204 - DNA, 569 bp, Artificial Sequence
  chemically treated genomic DNA (Homo sapiens) CpG-island No: 20204
acgcgtacacccatctccttcatacaccgctcctaaaaacaaatacacgttccccgaaaaaaacctacccgaccgactcccgctacccctacccgaactaacgccccgaatctcaacctaatccctaatcccgcgtacgctcccgaaattcttctatacactcccccaaatttcgtaacctccgccactaaaactccccgaccgaacccgaccctcctcttaaacgctccgtaacgcacgaaaaaaaacgaaaacgccactaacgcaaaccgcccgtcgaactttaaccatacaaaaacgcgaaaaacgatacgattccgacgaaaaacgaccaaaaaaaaatacgacccgaaaaacccgaaaaaacgaaacgaaaaaaaaaaacctaaaatatctacgcgcgtaacgcacgcgaaattccattaacgcaaaaaacgcgaattatttaatctataaataaactcctcgcgcccgccgcgcccgctaaaaataacaactcccaaacccactaaactccccgcaccgaactcgaatcccaactaaaaacccccaaatccaaaataaccaac

SEQ ID NO: 20205 - DNA, 674 bp, Artificial Sequence
  chemically treated genomic DNA (Homo sapiens) CpG-island No: 20205
cgggatttcggcgtggtttcgagttcgtttaaaggtatttatcgaagattcgagattgttcggttttttcggggtttatttttcgttatttcggtagttttttatttggtttcgcgggtttcgttcgtttttttattttcgtttttcggggtcgcgtattagtcggttttgagttgttttgtatcgtaggggcgtttatgtttggaggtcgggggtttcgggcgtcgcgaggggattttcgttagtttcgtcgtcgtcgttatttttttttcgcgtttttgtagtcgcgtcgtagtcgtttagcgtttttcgttttcgggaagtttttcgttcgtagtttcggtcgcgcggcgtttttcgttttcgcgttcgcggtcgttcgcgcgttgttttagtttcggcgcgtttttttcggcgggcggggcggggatcgtgacgcgtgtttattgacgttttcggaatttcggcggcggcggtcgacgtagttttattaatggggttaaaaatagcggcgttcggaatagtcgcgagcgtttcgtttcgcggttttttttacgtcgtatattcggttatataattcgcggttagagtcggggagttggtttttaggtgagggtgtcgaggtttcgtttatatttttcgaggttgggtatttggggttaggttataaataa

SEQ ID NO: 20206 - DNA, 674 bp, Artificial Sequence
  chemically treated genomic DNA (Homo sapiens) CpG-island No: 20206
ttatttataacctaaccccaaatacccaacctcgaaaaatataaacgaaacctcgacaccctcacctaaaaaccaactccccgactctaaccgcgaattatataaccgaatatacgacgtaaaaaaaaccgcgaaacgaaacgctcgcgactattccgaacgccgctatttttaaccccattaataaaactacgtcgaccgccgccgccgaaattccgaaaacgtcaataaacacgcgtcacgatccccgccccgcccgccgaaaaaaacgcgccgaaactaaaacaacgcgcgaacgaccgcgaacgcgaaaacgaaaaacgccgcgcgaccgaaactacgaacgaaaaacttcccgaaaacgaaaaacgctaaacgactacgacgcgactacaaaaacgcgaaaaaaaaataacgacgacgacgaaactaacgaaaatcccctcgcgacgcccgaaacccccgacctccaaacataaacgcccctacgatacaaaacaactcaaaaccgactaatacgcgaccccgaaaaacgaaaataaaaaaacgaacgaaacccgcgaaaccaaataaaaaactaccgaaataacgaaaaataaaccccgaaaaaaccgaacaatctcgaatcttcgataaatacctttaaacgaactcgaaaccacgccgaaatcccg

SEQ ID NO: 20207 - DNA, 674 bp, Artificial Sequence
  chemically treated genomic DNA (Homo sapiens) CpG-island No: 20207
ttatttataatttagttttaggtgtttagtttcggaaggtgtgagcgagatttcggtatttttatttgagaattagtttttcggttttggtcgcgggttatgtaatcgggtgtgcggcgtggggggagtcgcggggcggggcgttcgcggttatttcgggcgtcgttatttttagttttattgatgaggttgcgtcggtcgtcgtcgtcgggatttcggagacgttaatgggtacgcgttacggttttcgtttcgttcgtcgggggaggcgcgtcggggttgggatagcgcgcgggcggtcgcgggcgcgggggcggggggcgtcgcgcggtcggaattgcgggcggggggtttttcgggggcggggggcgttgagcggttgcggcgcggttgtaggagcgcgaggaggaggtggcggcggcggcggaattggcgggggttttttcgcggcgttcgggattttcggtttttaggtatgggcgtttttgcggtgtagagtagtttagggtcggttggtgcgcgatttcggaaagcgggggtggagaggcgagcggagttcgcggggttaggtgaggggttgtcggggtggcgggaggtgggtttcggagaggtcgggtaatttcgggttttcggtggatgtttttgggcgggttcggggttacgtcggagtttcg

SEQ ID NO: 20208 - DNA, 674 bp, Artificial Sequence
  chemically treated genomic DNA (Homo sapiens) CpG-island No: 20208
cgaaactccgacgtaaccccgaacccgcccaaaaacatccaccgaaaacccgaaattacccgacctctccgaaacccacctcccgccaccccgacaacccctcacctaaccccgcgaactccgctcgcctctccacccccgctttccgaaatcgcgcaccaaccgaccctaaactactctacaccgcaaaaacgcccatacctaaaaaccgaaaatcccgaacgccgcgaaaaaacccccgccaattccgccgccgccgccacctcctcctcgcgctcctacaaccgcgccgcaaccgctcaacgccccccgcccccgaaaaaccccccgcccgcaattccgaccgcgcgacgccccccgcccccgcgcccgcgaccgcccgcgcgctatcccaaccccgacgcgcctcccccgacgaacgaaacgaaaaccgtaacgcgtacccattaacgtctccgaaatcccgacgacgacgaccgacgcaacctcatcaataaaactaaaaataacgacgcccgaaataaccgcgaacgccccgccccgcgactccccccacgccgcacacccgattacataacccgcgaccaaaaccgaaaaactaattctcaaataaaaataccgaaatctcgctcacaccttccgaaactaaacacctaaaactaaattataaataa

SEQ ID NO: 20209 - DNA, 633 bp, Artificial Sequence
  chemically treated genomic DNA (Homo sapiens) CpG-island No: 20209
tcgagcgttttgcgtaaggggtaggggcgtagggcgtttggggttcgttttttggtttttttttcgacgtagtcgtcggttcgttcgttagtttgggtttttgtatatttggcgatttcgttatatttgggtagtcggcgttggagtatgaacggtttttaggcgggcgtcgcggtttaggtcgtttggttgagtttttgttgtaattagtcggcgtcgtcgtcggagtttttcgaggggtcgcgcgcggtgtaggcggtggtgttcggcgtgttgtttttgttggtgttttgcggggttttgtttttgggcggcggttttttttttcgcgtttagggtttgatagcgttgttgattcgcgagtagcgcgcgtttcgcgagttcgagtcgggtagtgttagcggagaggacggcgacgacgatttttaggcgttcggttgcgttcggtggtcgcggtttttaggtagtttttgatttcgagcggttcggagtatgttcgacggttgttgcggtttcgattttttattcgaagcggcgcgttttatataggtgagagggagggtagtaggagtgtgggcgcgggggttcggggggttatagtagtttttttattgaggaggttttttggggcgt

SEQ ID NO: 20210 - DNA, 633 bp, Artificial Sequence
  chemically treated genomic DNA (Homo sapiens) CpG-island No: 20210
acgccccaaaaaacctcctcaataaaaaaactactataaccccccgaacccccgcgcccacactcctactaccctccctctcacctatataaaacgcgccgcttcgaataaaaaatcgaaaccgcaacaaccgtcgaacatactccgaaccgctcgaaatcaaaaactacctaaaaaccgcgaccaccgaacgcaaccgaacgcctaaaaatcgtcgtcgccgtcctctccgctaacactacccgactcgaactcgcgaaacgcgcgctactcgcgaatcaacaacgctatcaaaccctaaacgcgaaaaaaaaaaccgccgcccaaaaacaaaaccccgcaaaacaccaacaaaaacaacacgccgaacaccaccgcctacaccgcgcgcgacccctcgaaaaactccgacgacgacgccgactaattacaacaaaaactcaaccaaacgacctaaaccgcgacgcccgcctaaaaaccgttcatactccaacgccgactacccaaatataacgaaatcgccaaatatacaaaaacccaaactaacgaacgaaccgacgactacgtcgaaaaaaaaaccaaaaaacgaaccccaaacgccctacgcccctaccccttacgcaaaacgctcga

SEQ ID NO: 20211 - DNA, 633 bp, Artificial Sequence
  chemically treated genomic DNA (Homo sapiens) CpG-island No: 20211
gcgttttaagaagtttttttagtaaggaagttattgtagtttttcgaattttcgcgtttatatttttgttatttttttttttatttgtgtggggcgcgtcgtttcgggtaaggggtcgggatcgtagtagtcgtcgggtatgtttcggatcgttcggagttaggggttgtttggaggtcgcgattatcgagcgtagtcgggcgtttaggagtcgtcgtcgtcgtttttttcgttggtattgttcggttcgggttcgcgggacgcgcgttgttcgcgggttagtagcgttgttaggttttgggcgcggaggaggaggtcgtcgtttaggaataggatttcgtaaagtattagtagggatagtacgtcgagtattatcgtttgtatcgcgcgcggtttttcggggggtttcggcggcgacgtcgattggttatagtaggagtttagttaggcggtttgagtcgcggcgttcgtttgagagtcgtttatgttttagcgtcggttgtttagatgtggcgggatcgttagatgtgtaggagtttagattggcgggcgggtcggcggttgcgtcggggagggaattaaggggcggattttaggcgttttacgtttttattttttgcgtagagcgttcgg

SEQ ID NO: 20212 - DNA, 633 bp, Artificial Sequence
  chemically treated genomic DNA (Homo sapiens) CpG-island No: 20212
ccgaacgctctacgcaaaaaataaaaacgtaaaacgcctaaaatccgccccttaattccctccccgacgcaaccgccgacccgcccgccaatctaaactcctacacatctaacgatcccgccacatctaaacaaccgacgctaaaacataaacgactctcaaacgaacgccgcgactcaaaccgcctaactaaactcctactataaccaatcgacgtcgccgccgaaaccccccgaaaaaccgcgcgcgatacaaacgataatactcgacgtactatccctactaatactttacgaaatcctattcctaaacgacgacctcctcctccgcgcccaaaacctaacaacgctactaacccgcgaacaacgcgcgtcccgcgaacccgaaccgaacaataccaacgaaaaaaacgacgacgacgactcctaaacgcccgactacgctcgataatcgcgacctccaaacaacccctaactccgaacgatccgaaacatacccgacgactactacgatcccgaccccttacccgaaacgacgcgccccacacaaataaaaaaaaaaataacaaaaatataaacgcgaaaattcgaaaaactacaataacttccttactaaaaaaacttcttaaaacgc

SEQ ID NO: 20213 - DNA, 615 bp, Artificial Sequence
  chemically treated genomic DNA (Homo sapiens) CpG-island No: 20213
ttatttattcgtcggttgcgcggtttcggtcgcggtggcggcggcgacggcggcgattttcgtttgggttatgattttaggaggggaaggtaggagtgtttgatcgtttgggcgaattttttcgttcgcggttatcgtttgttttttcggggttgggggagcgcgggtttaggttttttttttttttcgttttcgtcgtttttttttgcggttatcgtagtcgttgcgagttcgagtttttaaggtcggagattcggcggtagcgcggttttaatttttttagttttttttttttcgttttttttcgtttttttcgcggtcgtagtttagtaagcgaatagtttattttgggcgcgtcgcgttttcgttttttttatttaattcgttaattaggttgcgggaacgttgtcgtggtagttaataagaagatagaatgtcgttgtattacgttagagggcgggaggaggcggagaggaaattaaggagtgaacggggatcgggcggtttaatgaggagggtcggggggcggaggtgtgtaagttgggttgaagaaataggaaatatttttaaaggtagagtgacggataggaaggaaagttagtaggtgaatgggaa

SEQ ID NO: 20214 - DNA, 615 bp, Artificial Sequence
  chemically treated genomic DNA (Homo sapiens) CpG-island No: 20214
ttcccattcacctactaactttccttcctatccgtcactctacctttaaaaatatttcctatttcttcaacccaacttacacacctccgccccccgaccctcctcattaaaccgcccgatccccgttcactccttaatttcctctccgcctcctcccgccctctaacgtaatacaacgacattctatcttcttattaactaccacgacaacgttcccgcaacctaattaacgaattaaataaaaaaaacgaaaacgcgacgcgcccaaaataaactattcgcttactaaactacgaccgcgaaaaaaacgaaaaaaaacgaaaaaaaaaaaactaaaaaaattaaaaccgcgctaccgccgaatctccgaccttaaaaactcgaactcgcaacgactacgataaccgcaaaaaaaaacgacgaaaacgaaaaaaaaaaaaaacctaaacccgcgctcccccaaccccgaaaaaacaaacgataaccgcgaacgaaaaaattcgcccaaacgatcaaacactcctaccttcccctcctaaaatcataacccaaacgaaaatcgccgccgtcgccgccgccaccgcgaccgaaaccgcgcaaccgacgaataaataa

SEQ ID NO: 20215 - DNA, 615 bp, Artificial Sequence
  chemically treated genomic DNA (Homo sapiens) CpG-island No: 20215
tttttatttatttattggtttttttttttgttcgttattttatttttaagaatattttttgtttttttaatttaatttgtatattttcgtttttcggttttttttattgggtcgttcgattttcgtttattttttggtttttttttcgttttttttcgttttttagcgtagtgtaacggtattttgtttttttattggttattacggtagcgttttcgtagtttgattggcgggttgagtgaaagaggcgggaacgcggcgcgtttagggtaggttgttcgtttgttgagttgcggtcgcgggaggggcggggaggggcggggggaggggggttgggaaagttgaggtcgcgttgtcgtcgggttttcggttttgagggttcgggttcgtagcggttgcggtggtcgtaaaaagaggcggcgggggcggggggagaggagggtttgggttcgcgtttttttagtttcggaggagtaggcggtggtcgcggacggagagattcgtttagacggttagatatttttgttttttttttttgggattatgatttaggcgggggtcgtcgtcgtcgtcgtcgttatcgcggtcgagatcgcgtagtcggcgggtaagtga

SEQ ID NO: 20216 - DNA, 615 bp, Artificial Sequence
  chemically treated genomic DNA (Homo sapiens) CpG-island No: 20216
tcacttacccgccgactacgcgatctcgaccgcgataacgacgacgacgacgacgacccccgcctaaatcataatcccaaaaaaaaaaaacaaaaatatctaaccgtctaaacgaatctctccgtccgcgaccaccgcctactcctccgaaactaaaaaaacgcgaacccaaaccctcctctccccccgcccccgccgcctctttttacgaccaccgcaaccgctacgaacccgaaccctcaaaaccgaaaacccgacgacaacgcgacctcaactttcccaacccccctccccccgcccctccccgcccctcccgcgaccgcaactcaacaaacgaacaacctaccctaaacgcgccgcgttcccgcctctttcactcaacccgccaatcaaactacgaaaacgctaccgtaataaccaataaaaaaacaaaataccgttacactacgctaaaaaacgaaaaaaaacgaaaaaaaaaccaaaaaataaacgaaaatcgaacgacccaataaaaaaaaccgaaaaacgaaaatatacaaattaaattaaaaaaacaaaaaatattcttaaaaataaaataacgaacaaaaaaaaaaaccaataaataaataaaaa

SEQ ID NO: 20217 - DNA, 510 bp, Artificial Sequence
  chemically treated genomic DNA (Homo sapiens) CpG-island No: 20217
tttgcgtcgttcggagcggtgatagtaaggagcgtagcgcggaggtcgggcggtaaggggagtttttagttttcgataagtggagtttttgttttgcgttgcgttagcgtttttcgtttgggttcgcggtgttagatatttgtcgagttcgaagcgggagttaggttgagttttcggtttttaagtaagtttttttttttttttttatttttttttcgtcgtttttatttttttatttgcgaagcgaggagttgttgacggaggttttgcgcgaaaagcgtatcggggagttttggcggcgtttaggatgttttagtttttcggcgcgtcgcggtcggcgtagagattcgatcgcgaggttcgtcgttcggttttcgtgcgtagtatggttcgaggcggcggtagagttgttggtattgataagattcgttttttgtgttttgttcgatttcggagttgtgttaggtcggggggagggagcggaagttattttatggttcgtggttttat

SEQ ID NO: 20218 - DNA, 510 bp, Artificial Sequence
  chemically treated genomic DNA (Homo sapiens) CpG-island No: 20218
ataaaaccacgaaccataaaataacttccgctccctccccccgacctaacacaactccgaaatcgaacaaaacacaaaaaacgaatcttatcaataccaacaactctaccgccgcctcgaaccatactacgcacgaaaaccgaacgacgaacctcgcgatcgaatctctacgccgaccgcgacgcgccgaaaaactaaaacatcctaaacgccgccaaaactccccgatacgcttttcgcgcaaaacctccgtcaacaactcctcgcttcgcaaataaaaaaataaaaacgacgaaaaaaaaataaaaaaaaaaaaaaaaacttacttaaaaaccgaaaactcaacctaactcccgcttcgaactcgacaaatatctaacaccgcgaacccaaacgaaaaacgctaacgcaacgcaaaacaaaaactccacttatcgaaaactaaaaactccccttaccgcccgacctccgcgctacgctccttactatcaccgctccgaacgacgcaaa

SEQ ID NO: 20219 - DNA, 510 bp, Artificial Sequence
  chemically treated genomic DNA (Homo sapiens) CpG-island No: 20219
gtggggttacgagttataaagtggttttcgtttttttttttcggtttggtatagtttcgggatcgggtaagatataaaagacgggttttattagtgttaataattttgtcgtcgtttcgggttatgttgcgtacgggaatcgggcggcgggtttcgcggtcgggtttttgcgtcggtcgcggcgcgtcgggaggttggagtattttggacgtcgttagagtttttcggtgcgtttttcgcgtagaattttcgttagtagtttttcgtttcgtagataaagaagtaaaggcgacggaggagaaatggagagaaaagggaagatttatttgggggtcgaaggtttagtttgattttcgtttcggattcggtaggtgtttagtatcgcgggtttaggcggaaggcgttggcgtagcgtagagtagggattttatttatcgaggattggaaattttttttgtcgttcggttttcgcgttgcgttttttgttgttatcgtttcgagcgacgtagg

SEQ ID NO: 20220 - DNA, 510 bp, Artificial Sequence
  chemically treated genomic DNA (Homo sapiens) CpG-island No: 20220
cctacgtcgctcgaaacgataacaacaaaaaacgcaacgcgaaaaccgaacgacaaaaaaaatttccaatcctcgataaataaaatccctactctacgctacgccaacgccttccgcctaaacccgcgatactaaacacctaccgaatccgaaacgaaaatcaaactaaaccttcgacccccaaataaatcttcccttttctctccatttctcctccgtcgcctttacttctttatctacgaaacgaaaaactactaacgaaaattctacgcgaaaaacgcaccgaaaaactctaacgacgtccaaaatactccaacctcccgacgcgccgcgaccgacgcaaaaacccgaccgcgaaacccgccgcccgattcccgtacgcaacataacccgaaacgacgacaaaattattaacactaataaaacccgtcttttatatcttacccgatcccgaaactataccaaaccgaaaaaaaaaaacgaaaaccactttataactcgtaaccccac

SEQ ID NO: 20221 - DNA, 718 bp, Artificial Sequence
  chemically treated genomic DNA (Homo sapiens) CpG-island No: 20221
ttcgggtagatgttgcggggttttggcgttttgttcgggtagatgttgttgggatttggcgttttgttcgggtagatgttgcggggttttggcgttttgttcgggtagatgttgcggggttttggcgttttgttcgggtagatgttgcggggttttggcgttttgttcgggtaggtgttgcggggttttggcgttttgttcgggtaggtgttgtcgggttttggcgttttgttcgggtaggtgttgtcgggttttggcgttttgttcgggtaggtgttgcggggttttggcgttttgttcgggtaggtgttgcggggttttggcgttttgttcgggtaggtgttgcggggttttggcgttttgttcgggtaggtgttgcggggttttggcgttttgttcgggtaggtgttgcggggttttggcgttttgttcgggtaggtgttgcggggttttggcgttttgttcgggtaggtgttgcggggttttggcgttttgttcgggtagatgttgcggggttttggcgttttgttcgggtaggtgttgcggggttttggcgttttgttcgggtagatgttgcggggttttggcgttttgttcgggtagatgttgtcgggttttggcgttttgttcgggtagatgttgcggggttttggcgttttgttcgggtagatgttgtcgggttttggcgttttgttcgggtagatgttgtggggttttg

SEQ ID NO: 20222 - DNA, 718 bp, Artificial Sequence
  chemically treated genomic DNA (Homo sapiens) CpG-island No: 20222
caaaaccccacaacatctacccgaacaaaacgccaaaacccgacaacatctacccgaacaaaacgccaaaaccccgcaacatctacccgaacaaaacgccaaaacccgacaacatctacccgaacaaaacgccaaaaccccgcaacatctacccgaacaaaacgccaaaaccccgcaacacctacccgaacaaaacgccaaaaccccgcaacatctacccgaacaaaacgccaaaaccccgcaacacctacccgaacaaaacgccaaaaccccgcaacacctacccgaacaaaacgccaaaaccccgcaacacctacccgaacaaaacgccaaaaccccgcaacacctacccgaacaaaacgccaaaaccccgcaacacctacccgaacaaaacgccaaaaccccgcaacacctacccgaacaaaacgccaaaaccccgcaacacctacccgaacaaaacgccaaaacccgacaacacctacccgaacaaaacgccaaaacccgacaacacctacccgaacaaaacgccaaaaccccgcaacacctacccgaacaaaacgccaaaaccccgcaacatctacccgaacaaaacgccaaaaccccgcaacatctacccgaacaaaacgccaaaaccccgcaacatctacccgaacaaaacgccaaatcccaacaacatctacccgaacaaaacgccaaaaccccgcaacatctacccgaa

SEQ ID NO: 20223 - DNA, 718 bp, Artificial Sequence
  chemically treated genomic DNA (Homo sapiens) CpG-island No: 20223
taaggttttatagtatttattcggatagggcgttaaggttcggtagtatttattcggatagggcgttaaggtttcgtagtatttattcggatagggcgttaaggttcggtagtatttattcggatagggcgttaaggtttcgtagtatttattcggatagggcgttaaggtttcgtagtatttattcggatagggcgttaaggtttcgtagtatttattcggatagggcgttaaggtttcgtagtatttattcggatagggcgttaaggtttcgtagtatttattcggatagggcgttaaggtttcgtagtatttattcggatagggcgttaaggtttcgtagtatttattcggatagggcgttaaggtttcgtagtatttattcggatagggcgttaaggtttcgtagtatttattcggatagggcgttaaggtttcgtagtatttattcggatagggcgttaaggttcggtagtatttattcggatagggcgttaaggttcggtagtatttattcggatagggcgttaaggtttcgtagtatttattcggatagggcgttaaggtttcgtagtatttattcggatagggcgttaaggtttcgtagtatttattcggatagggcgttaaggtttcgtagtatttattcggatagggcgttaagttttagtagtatttattcggatagggcgttaaggtttcgtagtatttattcgga

SEQ ID NO: 20224 - DNA, 718 bp, Artificial Sequence
  chemically treated genomic DNA (Homo sapiens) CpG-island No: 20224
tccgaataaatactacgaaaccttaacgccctatccgaataaatactactaaaacttaacgccctatccgaataaatactacgaaaccttaacgccctatccgaataaatactacgaaaccttaacgccctatccgaataaatactacgaaaccttaacgccctatccgaataaatactacgaaaccttaacgccctatccgaataaatactaccgaaccttaacgccctatccgaataaatactaccgaaccttaacgccctatccgaataaatactacgaaaccttaacgccctatccgaataaatactacgaaaccttaacgccctatccgaataaatactacgaaaccttaacgccctatccgaataaatactacgaaaccttaacgccctatccgaataaatactacgaaaccttaacgccctatccgaataaatactacgaaaccttaacgccctatccgaataaatactacgaaaccttaacgccctatccgaataaatactacgaaaccttaacgccctatccgaataaatactacgaaaccttaacgccctatccgaataaatactacgaaaccttaacgccctatccgaataaatactaccgaaccttaacgccctatccgaataaatactacgaaaccttaacgccctatccgaataaatactaccgaaccttaacgccctatccgaataaatactataaaacctta

SEQ ID NO: 20225 - DNA, 587 bp, Artificial Sequence
  chemically treated genomic DNA (Homo sapiens) CpG-island No: 20225
ttgttttttcggggttcgttttatttcgtcgcggtttttttttagtcgtcgggttcgggacgcgtagttaggcgggtgggtttcggcgtatgcgcgcggtcgtttttcggtatttgtgggagtcgcggttcggttttttcgagtatttgcgagcgggagttgttttttcgattcgtagcggggcgtgggcggtagagggggcggtggataggttttttcgtttttttaggtcgcgcggagttagcgtttcggttttaggttgcgaggggcgcgcgcggggcgcggggaggggggcgggcgcgtgtatacggggcgttttcgggcgcgcgttttttggttgggtttgcggaggggttgtgggtttttcggggtttttttgtttcgcgtttgttcgtcgggcgtttttttttttttaggatcgcggtttacgtcgttattcgagttcgagttcgagttcgcgtttacgcgcgggggtcgttttttgcgaggaggcggggataggtgttcgcgggcgtaaatagcggagtttcgtgcgtttattttttggtaaaagtagaggcgatgcgttgttgatatatttagtggtt

SEQ ID NO: 20226 - DNA, 587 bp, Artificial Sequence
  chemically treated genomic DNA (Homo sapiens) CpG-island No: 20226
aaccactaaatatatcaacaacgcatcgcctctacttttaccaaaaaataaacgcacgaaactccgctatttacgcccgcgaacacctatccccgcctcctcgcaaaaaacgacccccgcgcgtaaacgcgaactcgaactcgaactcgaataacgacgtaaaccgcgatcctaaaaaaaaaaaaacgcccgacgaacaaacgcgaaacaaaaaaaccccgaaaaacccacaacccctccgcaaacccaaccaaaaaacgcgcgcccgaaaacgccccgtatacacgcgcccgcccccctccccgcgccccgcgcgcgcccctcgcaacctaaaaccgaaacgctaactccgcgcgacctaaaaaaacgaaaaaacctatccaccgccccctctaccgcccacgccccgctacgaatcgaaaaaacaactcccgctcgcaaatactcgaaaaaaccgaaccgcgactcccacaaataccgaaaaacgaccgcgcgcatacgccgaaacccacccgcctaactacgcgtcccgaacccgacgactaaaaaaaaaccgcgacgaaataaaacgaaccccgaaaaaacaa

SEQ ID NO: 20227 - DNA, 587 bp, Artificial Sequence
  chemically treated genomic DNA (Homo sapiens) CpG-island No: 20227
aattattaaatatgttaataacgtatcgtttttatttttattaaaaaataggcgtacgaaatttcgttgtttgcgttcgcggatatttgttttcgttttttcgtaggaagcggttttcgcgcgtgggcgcgggttcgggttcgggttcgagtggcgacgtgggtcgcggttttggagggggagaagcgttcggcgggtaggcgcggggtagggaagtttcggggaatttatagttttttcgtagatttagttagggggcgcgcgttcgaaaacgtttcgtgtgtacgcgttcgttttttttttcgcgtttcgcgcgcgtttttcgtagtttggagtcggagcgttggtttcgcgcggtttggagaggcggagaggtttgtttatcgttttttttgtcgtttacgtttcgttgcgggtcggaggagtagttttcgttcgtaggtgttcggagaggtcgggtcgcggtttttataggtgtcgggaagcggtcgcgcgtatgcgtcggagtttattcgtttggttgcgcgtttcgggttcggcggttgaagaggagtcgcggcgaggtagggcggatttcggggaggtag

SEQ ID NO: 20228 - DNA, 587 bp, Artificial Sequence
  chemically treated genomic DNA (Homo sapiens) CpG-island No: 20228
ctacctccccgaaatccgccctacctcgccgcgactcctcttcaaccgccgaacccgaaacgcgcaaccaaacgaataaactccgacgcatacgcgcgaccgcttcccgacacctataaaaaccgcgacccgacctctccgaacacctacgaacgaaaactactcctccgacccgcaacgaaacgtaaacgacaaaaaaaacgataaacaaacctctccgcctctccaaaccgcgcgaaaccaacgctccgactccaaactacgaaaaacgcgcgcgaaacgcgaaaaaaaaaacgaacgcgtacacacgaaacgttttcgaacgcgcgccccctaactaaatctacgaaaaaactataaattccccgaaacttccctaccccgcgcctacccgccgaacgcttctccccctccaaaaccgcgacccacgtcgccactcgaacccgaacccgaacccgcgcccacgcgcgaaaaccgcttcctacgaaaaaacgaaaacaaatatccgcgaacgcaaacaacgaaatttcgtacgcctattttttaataaaaataaaaacgatacgttattaacatatttaataatt

SEQ ID NO: 20229 - DNA, 698 bp, Artificial Sequence
  chemically treated genomic DNA (Homo sapiens) CpG-island No: 20229
cgcgtggttgtcggcgtagtattgagcgcgggtgtggggcgattcgtagtttttcgcggtgtaaataattttgagtcgcgtatacgttcgaacgacgttttatagtttgtaggtagattgtagcgtagaaagagttcgaggtacgttagtagtttttaagggttttagtaagtttcgtaagcgtgaagcggaggcgcgggggcgcggggtcgcggcggggaggggggtcgttaatcggggggtttttgttaggcgtttagattttttaaagcgcggagttgcgcgttggttcggtttcggtttcgtttcggcgttaaaggaagaagatagagatttacgggagggagaagtaaaggaagggtcgtattttgtagggttcgggagaggcgcgcgtcgcgggttttattagcgattaggtagcgcgagaaggtttgggtgcgggggcggtttttcgattttttagatgcggtataatcgtcgtaagttcggtttagcgcgattcggaaggaagacgcggaggtcgcgaggagcggcgggttcggggaggcggggcggagtcggggaggaggggcggggtcgcggggttggggcggggtcggggaggcggggcggggtttggagggaggcggggcggggttagaagtaaagtcgggcgttttttttatgggaggtgttttgggttttacggatagttcgtt

SEQ ID NO: 20230 - DNA, 698 bp, Artificial Sequence
  chemically treated genomic DNA (Homo sapiens) CpG-island No: 20230
aacgaactatccgtaaaacccaaaacacctcccataaaaaaaacgcccgactttacttctaaccccgccccgcctccctccaaaccccgccccgcctccccgaccccgccccaaccccgcgaccccgcccctcctccccgactccgccccgcctccccgaacccgccgctcctcgcgacctccgcgtcttccttccgaatcgcgctaaaccgaacttacgacgattataccgcatctaaaaaatcgaaaaaccgcccccgcacccaaaccttctcgcgctacctaatcgctaataaaacccgcgacgcgcgcctctcccgaaccctacaaaatacgacccttcctttacttctccctcccgtaaatctctatcttcttcctttaacgccgaaacgaaaccgaaaccgaaccaacgcgcaactccgcgctttaaaaaatctaaacgcctaacaaaaaccccccgattaacgacccccctccccgccgcgaccccgcgcccccgcgcctccgcttcacgcttacgaaacttactaaaacccttaaaaactactaacgtacctcgaactctttctacgctacaatctacctacaaactataaaacgtcgttcgaacgtatacgcgactcaaaattatttacaccgcgaaaaactacgaatcgccccacacccgcgctcaatactacgccgacaaccacgcg

SEQ ID NO: 20231 - DNA, 698 bp, Artificial Sequence
  chemically treated genomic DNA (Homo sapiens) CpG-island No: 20231
agcgggttgttcgtaggatttagagtattttttatgggagaaacgttcggttttgtttttggtttcgtttcgtttttttttaggtttcgtttcgttttttcggtttcgttttaatttcgcggtttcgtttttttttttcggtttcgtttcgttttttcgggttcgtcgtttttcgcggttttcgcgtttttttttcgggtcgcgttaggtcgggtttgcggcggttgtgtcgtatttagagagtcggggagtcgttttcgtatttaggttttttcgcgttgtttggtcgttggtgaagttcgcggcgcgcgtttttttcggattttgtagggtacggttttttttttatttttttttttcgtgggtttttgttttttttttttggcgtcggggcggggtcggggtcgagttagcgcgtagtttcgcgttttggggagtttggacgtttggtaaaggtttttcggttggcggttttttttttcgtcgcggtttcgcgttttcgcgttttcgttttacgtttgcggggtttgttggggtttttgagaattgttgacgtgtttcgggttttttttacgttatagtttgtttgtaggttgtgaggcgtcgttcggacgtgtgcgcggtttagggttgtttatatcgcgggggattgcgggtcgttttatattcgcgtttagtgttgcgtcggtagttacgcg

SEQ ID NO: 20232 - DNA, 698 bp, Artificial Sequence
  chemically treated genomic DNA (Homo sapiens) CpG-island No: 20232
cgcgtaactaccgacgcaacactaaacgcgaatataaaacgacccgcaatcccccgcgatataaacaaccctaaaccgcgcacacgtccgaacgacgcctcacaacctacaaacaaactataacgtaaaaaaaacccgaaacacgtcaacaattctcaaaaaccccaacaaaccccgcaaacgtaaaacgaaaacgcgaaaacgcgaaaccgcgacgaaaaaaaaaaccgccaaccgaaaaacctttaccaaacgtccaaactccccaaaacgcgaaactacgcgctaactcgaccccgaccccgccccgacgccaaaaaaaaaaaacaaaaacccacgaaaaaaaaaaataaaaaaaaaaccgtaccctacaaaatccgaaaaaaacgcgcgccgcgaacttcaccaacgaccaaacaacgcgaaaaaacctaaatacgaaaacgactccccgactctctaaatacgacacaaccgccgcaaacccgacctaacgcgacccgaaaaaaaaacgcgaaaaccgcgaaaaacgacgaacccgaaaaaacgaaacgaaaccgaaaaaaaaaaacgaaaccgcgaaattaaaacgaaaccgaaaaaacgaaacgaaacctaaaaaaaaacgaaacgaaaccaaaaacaaaaccgaacgtttctcccataaaaaatactctaaatcctacgaacaacccgct

SEQ ID NO: 20233 - DNA, 820 bp, Artificial Sequence
  chemically treated genomic DNA (Homo sapiens) CpG-island No: 20233
agttcgttcgcgtcgcgttttatcgttttcgtacgttcgggcgtacgtttttttcgttcgggtcgttttttggtttttcgcgttcggtagttagtgttttatcgcgtcgtttcgcgttagggttcgtttcgagagtcgtttttttttcgtcgcggtcggcgcgggtttttcggttatgcgttttcgagttttagtttgcgtcgtcgcggcgttcgggttttgtagttttttgttgttgttcgcgttcgggtacgcgtgtttcgcgggttgcgtttgtatcgattcgtatatcgtggattgtcgcgatcgcgggttgtttagcgtgttagattttttttttttggacgtgcgtaagttgttggtggtcggtaatcgtatttagcggattttcgaggatttttttattttttacggcgatttggtttatttggattttaggaataattcgttgcgttcgttggaggagggtacgtttagcggttcggttaagttcgtgtttttcgattttagttataataatttgatttagttgggcgtcggcgtttttcgttcggtcgggaggttggtgaagtttagtttggttaataataatttggtgggcgtgtacgaggacgttttcgagattttggagtcgttgtaggtgttggagtttaacgataataatttgcgtagttttagcgtggtcgttttggtcgcgttgttcgcgttgcgttttttgcgtttggacgggaatttttggttgtgcgattgtgatttcgtttatttttttttttggatttaggagaacgtatttaaattgtttaaaggtgagtcgagtcgg

SEQ ID NO: 20234 - DNA, 820 bp, Artificial Sequence
  chemically treated genomic DNA (Homo sapiens) CpG-island No: 20234
ccgactcgactcacctttaaacaatttaaatacgttctcctaaatccaaaaaaaaaaataaacgaaatcacaatcgcacaaccaaaaattcccgtccaaacgcaaaaaacgcaacgcgaacaacgcgaccaaaacgaccacgctaaaactacgcaaattattatcgttaaactccaacacctacaacgactccaaaatctcgaaaacgtcctcgtacacgcccaccaaattattattaaccaaactaaacttcaccaacctcccgaccgaacgaaaaacgccgacgcccaactaaatcaaattattataactaaaatcgaaaaacacgaacttaaccgaaccgctaaacgtaccctcctccaacgaacgcaacgaattattcctaaaatccaaataaaccaaatcgccgtaaaaaataaaaaaatcctcgaaaatccgctaaatacgattaccgaccaccaacaacttacgcacgtccaaaaaaaaaaaatctaacacgctaaacaacccgcgatcgcgacaatccacgatatacgaatcgatacaaacgcaacccgcgaaacacgcgtacccgaacgcgaacaacaacaaaaaactacaaaacccgaacgccgcgacgacgcaaactaaaactcgaaaacgcataaccgaaaaacccgcgccgaccgcgacgaaaaaaaaacgactctcgaaacgaaccctaacgcgaaacgacgcgataaaacactaactaccgaacgcgaaaaaccaaaaaacgacccgaacgaaaaaaacgtacgcccgaacgtacgaaaacgataaaacgcgacgcgaacgaact

SEQ ID NO: 20235 - DNA, 820 bp, Artificial Sequence
  chemically treated genomic DNA (Homo sapiens) CpG-island No: 20235
tcggttcggtttatttttgggtagtttggatgcgtttttttggatttaggagaagaggtgggcgaagttatagtcgtatagttaggggttttcgtttagacgtagggagcgtagcgcgggtagcgcggttagggcggttacgttgaggttgcgtaggttgttgtcgttgagttttagtatttgtagcgattttagggtttcgaaggcgttttcgtgtacgtttattaggttgttgttagttaggttaagttttattagtttttcggtcgagcggaaggcgtcggcgtttagttgggttaagttgttgtagttgaggtcgaggaatacgagtttggtcgagtcgttgaacgtgtttttttttagcgagcgtagcgagttgtttttgaagtttaggtagattaggtcgtcgtagaagatgaagaagttttcggggattcgttggatgcggttgtcggttattagtagtttgcgtacgtttagggggaaagggtttggtacgttgggtagttcgcggtcgcggtagtttacggtgtgcgggtcggtgtaggcgtagttcgcggggtacgcgtgttcgggcgcgagtagtagtagaaggttgtagagttcgagcgtcgcggcggcgtaggttggggttcgggggcgtatggtcggggggttcgcgtcggtcgcggcgagaaggaagcggttttcggagcgagttttggcgcgggacggcgcggtgaggtattggttgtcgggcgcggggagttagagggcggttcgggcggggagggcgtgcgttcgggcgtgcgggggcgatggagcgcggcgcggacggatt

SEQ ID NO: 20236 - DNA, 820 bp, Artificial Sequence
  chemically treated genomic DNA (Homo sapiens) CpG-island No: 20236
aatccgtccgcgccgcgctccatcgcccccgcacgcccgaacgcacgccctccccgcccgaaccgccctctaactccccgcgcccgacaaccaatacctcaccgcgccgtcccgcgccaaaactcgctccgaaaaccgcttccttctcgccgcgaccgacgcgaaccccccgaccatacgcccccgaaccccaacctacgccgccgcgacgctcgaactctacaaccttctactactactcgcgcccgaacacgcgtaccccgcgaactacgcctacaccgacccgcacaccgtaaactaccgcgaccgcgaactacccaacgtaccaaaccctttccccctaaacgtacgcaaactactaataaccgacaaccgcatccaacgaatccccgaaaacttcttcatcttctacgacgacctaatctacctaaacttcaaaaacaactcgctacgctcgctaaaaaaaaacacgttcaacgactcgaccaaactcgtattcctcgacctcaactacaacaacttaacccaactaaacgccgacgccttccgctcgaccgaaaaactaataaaacttaacctaactaacaacaacctaataaacgtacacgaaaacgccttcgaaaccctaaaatcgctacaaatactaaaactcaacgacaacaacctacgcaacctcaacgtaaccgccctaaccgcgctacccgcgctacgctccctacgtctaaacgaaaacccctaactatacgactataacttcgcccacctcttctcctaaatccaaaaaaacgcatccaaactacccaaaaataaaccgaaccga

SEQ ID NO: 20237 - DNA, 800 bp, Artificial Sequence
  chemically treated genomic DNA (Homo sapiens) CpG-island No: 20237
tggttcgtattcgtagaaaggtttgggagaagatcgcgggtagatgtaagaaaagaaaagagagcgttaggcgcggtttgtagttttggttttcgttttagtatcggattttcgattaaagttgtttcgttttaaatagttcgtaaataaatttattttttttttttcgtcggtttttttgttttttcggtcgtttcgggttttcggtatagtcgtcgggcgttgttttaacgggatttcgtggtcgttgcgcggtgtcgttttagttttggttttcggcgttttgggttttacggtcgttcggtcggcgagggcggcgatgcgggcggatttttcgtggttgttcggcggcggcggtattttagttttaagcggcggcggcggttatgttggttttaattacgtgatttgtcgtcgtcgcgcgttgggggtgaaagtttataatgcggcgggggcggtcggatagagattaggaagttgtcgtttgtattcgggtagtaatcggtagaagttttttcggggttttttttatcgttcgtgaagtttatttatttaatttttagcggttgcgaagtttttttattttattttacgatttttttcgttgcggggtttttttcgttttatcgttcggtttcggttttcgttttttgtgtttgtttttttcgcggttgtttttagggtagaggtatcgcgttgggtgttttataggggataaggcgttcgaattttttatcgtttgtgggcgattttcgtttaatttttaggttatttagttttgttattagaggatttttaat

SEQ ID NO: 20238 - DNA, 800 bp, Artificial Sequence
  chemically treated genomic DNA (Homo sapiens) CpG-island No: 20238
attaaaaatcctctaataacaaaactaaataacctaaaaattaaacgaaaatcgcccacaaacgataaaaaattcgaacgccttatcccctataaaacacccaacgcgatacctctaccctaaaaacaaccgcgaaaaaaacaaacacaaaaaacgaaaaccgaaaccgaacgataaaacgaaaaaaaccccgcaacgaaaaaaatcgtaaaataaaataaaaaaacttcgcaaccgctaaaaattaaataaataaacttcacgaacgataaaaaaaaccccgaaaaaacttctaccgattactacccgaatacaaacgacaacttcctaatctctatccgaccgcccccgccgcattataaactttcacccccaacgcgcgacgacgacaaatcacgtaattaaaaccaacataaccgccgccgccgcttaaaactaaaataccgccgccgccgaacaaccacgaaaaatccgcccgcatcgccgccctcgccgaccgaacgaccgtaaaacccaaaacgccgaaaaccaaaactaaaacgacaccgcgcaacgaccacgaaatcccgttaaaacaacgcccgacgactataccgaaaacccgaaacgaccgaaaaaacaaaaaaaccgacgaaaaaaaaaaaataaatttatttacgaactatttaaaacgaaacaactttaatcgaaaatccgatactaaaacgaaaaccaaaactacaaaccgcgcctaacgctctcttttcttttcttacatctacccgcgatcttctcccaaacctttctacgaatacgaacca

SEQ ID NO: 20239 - DNA, 800 bp, Artificial Sequence
  chemically treated genomic DNA (Homo sapiens) CpG-island No: 20239
gttgggagttttttgataatagaattggatggtttaggggttgggcggggatcgtttataggcgatagggaattcggacgttttgttttttgtaaagtatttaacgcgatgtttttgttttaagggtagtcgcgagaaaggtaggtataggaggcgggagtcggggtcgggcgatggggcggaaggagtttcgtagcgggaggggtcgtggagtggggtggaaggatttcgtagtcgttaaagattgggtgggtaggttttacgggcggtgggagggatttcggggaggtttttgtcggttgttattcgagtataaacggtagttttttggtttttgttcggtcgttttcgtcgtattgtgaatttttatttttagcgcgcgacggcggtagattacgtgattagggttaatatggtcgtcgtcgtcgtttggagttgaagtgtcgtcgtcgtcgggtagttacggggaattcgttcgtatcgtcgttttcgtcggtcgggcggtcgtggggtttagagcgtcggaggttagggttggggcggtatcgcgtagcggttacggggtttcgttagagtagcgttcggcggttatgtcgagagttcggagcggtcggaggagtagaggggtcggcgggagggaggaagtaggtttgtttacgggttgtttggggcggagtagttttggtcgggggttcggtgttggggcgggggttaggattgtaggtcgcgtttgacgtttttttttttttttttgtatttgttcgcgatttttttttagatttttttgcgagtacgagtta

SEQ ID NO: 20240 - DNA, 800 bp, Artificial Sequence
  chemically treated genomic DNA (Homo sapiens) CpG-island No: 20240
taactcgtactcgcaaaaaaatctaaaaaaaaatcgcgaacaaatacaaaaaaaaaaaaaaaaacgtcaaacgcgacctacaatcctaacccccgccccaacaccgaacccccgaccaaaactactccgccccaaacaacccgtaaacaaacctacttcctccctcccgccgacccctctactcctccgaccgctccgaactctcgacataaccgccgaacgctactctaacgaaaccccgtaaccgctacgcgataccgccccaaccctaacctccgacgctctaaaccccacgaccgcccgaccgacgaaaacgacgatacgaacgaattccccgtaactacccgacgacgacgacacttcaactccaaacgacgacgacgaccatattaaccctaatcacgtaatctaccgccgtcgcgcgctaaaaataaaaattcacaatacgacgaaaacgaccgaacaaaaaccaaaaaactaccgtttatactcgaataacaaccgacaaaaacctccccgaaatccctcccaccgcccgtaaaacctacccacccaatctttaacgactacgaaatccttccaccccactccacgacccctcccgctacgaaactccttccgccccatcgcccgaccccgactcccgcctcctatacctacctttctcgcgactacccttaaaacaaaaacatcgcgttaaatactttacaaaaaacaaaacgtccgaattccctatcgcctataaacgatccccgcccaacccctaaaccatccaattctattatcaaaaaactcccaac

SEQ ID NO: 20241 - DNA, 570 bp, Artificial Sequence
  chemically treated genomic DNA (Homo sapiens) CpG-island No: 20241
cgttattttcggtttaaacgaattaagattttttaggaaagcgatatttagcgagcgtttcgtaatttagattcgttttttatttttaaatagttattcgtcgggttttttgacggttacgaaaagaaaacggggtggtcgttggttaggttttaggcgagacggaaaacgaaaggtaaagggtcgaatttagtcgtttatttggtggaaaagttcgaaaaggagtttttcggttattttcgttttaaggttgtttataaagagagtgcgattcgttttcgtcgtcgtcgtttttattttagcgtcgttttttttttaatttggttaaaaggtcgtggtcgacgtatttattgcgtatttacggaagttttacgtttttacgttttttggcgttataaacgaaaacgttcgttgcgtttgtttttagcgggcgacgacgtgcgcggacggtttgcgtatgttcgttaggatatttttcgttaaaggtaaggcggtttttggttttttcgtaggtttagttatgggtttttgtgtgtttagttatcgggttcgatataggttggattgatt

SEQ ID NO: 20242 - DNA, 570 bp, Artificial Sequence
  chemically treated genomic DNA (Homo sapiens) CpG-island No: 20242
aatcaatccaacctatatcgaacccgataactaaacacacaaaaacccataactaaacctacgaaaaaaccaaaaaccgccttacctttaacgaaaaatatcctaacgaacatacgcaaaccgtccgcgcacgtcgtcgcccgctaaaaacaaacgcaacgaacgttttcgtttataacgccaaaaaacgtaaaaacgtaaaacttccgtaaatacgcaataaatacgtcgaccacgaccttttaaccaaattaaaaaaaaaacgacgctaaaataaaaacgacgacgacgaaaacgaatcgcactctctttataaacaaccttaaaacgaaaataaccgaaaaactccttttcgaacttttccaccaaataaacgactaaattcgaccctttacctttcgttttccgtctcgcctaaaacctaaccaacgaccaccccgttttcttttcgtaaccgtcaaaaaacccgacgaataactatttaaaaataaaaaacgaatctaaattacgaaacgctcgctaaatatcgctttcctaaaaaatcttaattcgtttaaaccgaaaataacg

SEQ ID NO: 20243 - DNA, 570 bp, Artificial Sequence
  chemically treated genomic DNA (Homo sapiens) CpG-island No: 20243
gattagtttagtttgtgtcggattcgatgattaagtatataggaatttataattgagtttgcggaagagttagaagtcgttttgtttttaacgaggggtattttggcgagtatgcgtagatcgttcgcgtacgtcgtcgttcgttgagagtaagcgtaacgggcgttttcgtttgtgacgttagggagcgtgaggacgtggggttttcgtgaatgcgtagtgggtgcgtcggttacgattttttggttaggttagggagggggcgacgttgagatgggggcggcggcggcggaagcggatcgtattttttttgtgggtaattttgaaacgaaagtgatcgaggagttttttttcgagtttttttattaggtaagcggttgggttcggttttttgtttttcgtttttcgtttcgtttagggtttggttagcggttatttcgtttttttttcgtagtcgttaggggattcgacgggtggttgtttgggggtgaaaggcgggtttgggttgcgaaacgttcgttgggtgtcgtttttttggaagattttggttcgtttaggtcgaaagtgacg

SEQ ID NO: 20244 - DNA, 570 bp, Artificial Sequence
  chemically treated genomic DNA (Homo sapiens) CpG-island No: 20244
cgtcactttcgacctaaacgaaccaaaatcttccaaaaaaacgacacccaacgaacgtttcgcaacccaaacccgcctttcacccccaaacaaccacccgtcgaatcccctaacgactacgaaaaaaaaacgaaataaccgctaaccaaaccctaaacgaaacgaaaaacgaaaaacaaaaaaccgaacccaaccgcttacctaataaaaaaactcgaaaaaaaactcctcgatcactttcgtttcaaaattacccacaaaaaaaatacgatccgcttccgccgccgccgcccccatctcaacgtcgccccctccctaacctaaccaaaaaatcgtaaccgacgcacccactacgcattcacgaaaaccccacgtcctcacgctccctaacgtcacaaacgaaaacgcccgttacgcttactctcaacgaacgacgacgtacgcgaacgatctacgcatactcgccaaaatacccctcgttaaaaacaaaacgacttctaactcttccgcaaactcaattataaattcctatatacttaatcatcgaatccgacacaaactaaactaatc

SEQ ID NO: 20245 - DNA, 519 bp, Artificial Sequence
  chemically treated genomic DNA (Homo sapiens) CpG-island No: 20245
ttttgtatcgttcgtggtcggtcgcgtttatttgttatatttgagatttagatttttaacgtttttttaggacgggttcgatttttcggttttacgagcgaaattttattcgtttttttaagtttttcgtcgattttatttatttttaggtttatttagattattcgttgagttatgtttttttttgtcgttatggttgcgttattttcgcggatatttcgggtttcgaatcgttcgtgatttttatttatatttcgtaatagtttggagtttagggagtcgtttagtattattcgggattagtagttacggttttagtttcgtagtcggcgttggcgtaggcgtaatagtcgttaaacgtcgtaaatttacggggaggcgtacgagttgaaattatacgttttagcgtacggtgcgtcggttcgtttttaatagtttggtttggttgtcgaagggaatgatgggatttagagttttatttgcggttgcgattagatgttttattttcgttacgtgttt

SEQ ID NO: 20246 - DNA, 519 bp, Artificial Sequence
  chemically treated genomic DNA (Homo sapiens) CpG-island No: 20246
aaacacgtaacgaaaataaaacatctaatcgcaaccgcaaataaaactctaaatcccatcattcccttcgacaaccaaaccaaactattaaaaacgaaccgacgcaccgtacgctaaaacgtataatttcaactcgtacgcctccccgtaaatttacgacgtttaacgactattacgcctacgccaacgccgactacgaaactaaaaccgtaactactaatcccgaataatactaaacgactccctaaactccaaactattacgaaatataaataaaaatcacgaacgattcgaaacccgaaatatccgcgaaaataacgcaaccataacgacaaaaaaaaacataactcaacgaataatctaaataaacctaaaaataaataaaatcgacgaaaaacttaaaaaaacgaataaaatttcgctcgtaaaaccgaaaaatcgaacccgtcctaaaaaaacgttaaaaatctaaatctcaaatataacaaataaacgcgaccgaccacgaacgatacaaaa

SEQ ID NO: 20247 - DNA, 519 bp, Artificial Sequence
  chemically treated genomic DNA (Homo sapiens) CpG-island No: 20247
aaatacgtggcgggggtggggtatttggtcgtaatcgtaggtgagattttaagttttattatttttttcggtagttaagttaggttgttgagggcgagtcggcgtatcgtacgttgggacgtgtggttttagttcgtgcgttttttcgtgggtttgcgacgtttagcgattattgcgtttgcgttagcgtcggttgcgagattggggtcgtggttgttggtttcgggtgatgttaggcggttttttgggttttaggttgttgcggggtgtaggtgggagttacggacggttcggggttcgaggtgttcgcgaaggtggcgtagttatggcggtaggggagagtatggtttagcggatggtttgggtggatttggaggtgagtgaggtcggcggggggtttggggaggcgagtgaggtttcgttcgtggaatcgaggagtcgagttcgttttgggagagcgttgggggtttgggttttaggtgtggtaggtgagcgcggtcggttacgggcggtgtaggg

SEQ ID NO: 20248 - DNA, 519 bp, Artificial Sequence
  chemically treated genomic DNA (Homo sapiens) CpG-island No: 20248
ccctacaccgcccgtaaccgaccgcgctcacctaccacacctaaaacccaaacccccaacgctctcccaaaacgaactcgactcctcgattccacgaacgaaacctcactcgcctccccaaaccccccgccgacctcactcacctccaaatccacccaaaccatccgctaaaccatactctcccctaccgccataactacgccaccttcgcgaacacctcgaaccccgaaccgtccgtaactcccacctacaccccgcaacaacctaaaacccaaaaaaccgcctaacatcacccgaaaccaacaaccacgaccccaatctcgcaaccgacgctaacgcaaacgcaataatcgctaaacgtcgcaaacccacgaaaaaacgcacgaactaaaaccacacgtcccaacgtacgatacgccgactcgccctcaacaacctaacttaactaccgaaaaaaataataaaacttaaaatctcacctacgattacgaccaaataccccacccccgccacgtattt

SEQ ID NO: 20249 - DNA, 1042 bp, Artificial Sequence
  chemically treated genomic DNA (Homo sapiens) CpG-island No: 20249
agagttcgcgaggggcgagtggaagttttttgcgggtaggtattcgattatcgttttgttttgggcgtggcggtttcgggtttagggatcgtttcggcgttagacggtcgcgttcggaggaaacgggcgttggtgaaagtttaggtgttttggtttacgcgcgtagtcggacgtcgggtttagggagagacgcgggttggggcgggacgggattcggtttttgaagcgcgagggtgggagtgaaagtaaagaggagaaaagtagagagagaggatagtggggtttagcgtcgcgcgaaaggtaggaatcgattcgcggataggaacgggtgtaatgaggttttcggcgagcgtgggaatatagggtttagttttttgcggcgggcgagtacgcggattttaggggcgggcgggtgcgataggacgtgatttggaagcgcggcgcgtgttatcgttttggagtaggtattcggttttcgtggagcgggtaggcgggtttcgggtttggagtttgcgattggggagggcgtcgcgttaatagtagcggttgcggggcggggtcgagtgcgcgtgcgcggttttcgcgggcggggagtaggcgggggagcgggcgggaagtagtgggagcgcgcgtgcgcgcggtcgtgtagtttgggtagtgggttttgtttgtgacgcgcggcggcggtcggttttgtttgtaacggcggcggcggttgttgtttcggatatttgcggcggcggcggcgatttcgcggcgggcgcggagatgtggtttttggtagcggcgttgttgttgggttcggcgtgttgcggtgagtggtttttcgtttttagttttgcggttgttgtcgtttcgttttcgcgggcgtgtgggttgcgttttagttagttcggcggcgttttgaagagggtggtcggggcgtagaatattcgggttttgagcgttcgaagtgtagacgtgggagggttttacggggaatcgggcgttttttttttttttttttttttttttttggtcgtttttttttttttgggtgaga

SEQ ID NO: 20250 - DNA, 1042 bp, Artificial Sequence
  chemically treated genomic DNA (Homo sapiens) CpG-island No: 20250
tctcacccaaaaaaaaaaaaacgaccaaaaaaaaaaaaaaaaaaaaaaaaaaaacgcccgattccccgtaaaaccctcccacgtctacacttcgaacgctcaaaacccgaatattctacgccccgaccaccctcttcaaaacgccgccgaactaactaaaacgcaacccacacgcccgcgaaaacgaaacgacaacaaccgcaaaactaaaaacgaaaaaccactcaccgcaacacgccgaacccaacaacaacgccgctaccaaaaaccacatctccgcgcccgccgcgaaatcgccgccgccgccgcaaatatccgaaacaacaaccgccgccgccgttacaaacaaaaccgaccgccgccgcgcgtcacaaacaaaacccactacccaaactacacgaccgcgcgcacgcgcgctcccactacttcccgcccgctcccccgcctactccccgcccgcgaaaaccgcgcacgcgcactcgaccccgccccgcaaccgctactattaacgcgacgccctccccaatcgcaaactccaaacccgaaacccgcctacccgctccacgaaaaccgaatacctactccaaaacgataacacgcgccgcgcttccaaatcacgtcctatcgcacccgcccgcccctaaaatccgcgtactcgcccgccgcaaaaaactaaaccctatattcccacgctcgccgaaaacctcattacacccgttcctatccgcgaatcgattcctacctttcgcgcgacgctaaaccccactatcctctctctctacttttctcctctttactttcactcccaccctcgcgcttcaaaaaccgaatcccgtcccgccccaacccgcgtctctccctaaacccgacgtccgactacgcgcgtaaaccaaaacacctaaactttcaccaacgcccgtttcctccgaacgcgaccgtctaacgccgaaacgatccctaaacccgaaaccgccacgcccaaaacaaaacgataatcgaatacctacccgcaaaaaacttccactcgcccctcgcgaactct

SEQ ID NO: 20251 - DNA, 1042 bp, Artificial Sequence
  chemically treated genomic DNA (Homo sapiens) CpG-island No: 20251
ttttatttagggggaagaagacgattagggaaaggaagggaggaagaaggggggcgttcgatttttcgtggggtttttttacgtttgtatttcgggcgtttagggttcgagtgttttgcgtttcggttattttttttagggcgtcgtcgggttggttggggcgtagtttatacgttcgcgggggcgaagcgatagtagtcgtagggttgggagcgaggagttatttatcgtagtacgtcgagtttagtaatagcgtcgttattaggggttatattttcgcgttcgtcgcggggtcgtcgtcgtcgtcgtaggtgttcggagtagtagtcgtcgtcgtcgttataggtaggatcgatcgtcgtcgcgcgttataggtaggatttattgtttaggttgtacggtcgcgcgtacgcgcgtttttattgtttttcgttcgttttttcgtttgtttttcgttcgcgagagtcgcgtacgcgtattcggtttcgtttcgtaatcgttgttgttgacgcggcgttttttttagtcgtaggttttagattcggggttcgtttgttcgttttacggaggtcggatgtttgttttagggcggtggtacgcgtcgcgtttttaggttacgttttgtcgtattcgttcgtttttggggttcgcgtgttcgttcgtcgtaggaggttgaattttgtgtttttacgttcgtcggggattttattgtattcgtttttgttcgcgggtcggtttttgtttttcgcgcggcgttgggttttattgttttttttttttattttttttttttttgtttttatttttattttcgcgttttaggggtcgggtttcgtttcgttttagttcgcgtttttttttggattcgacgttcggttgcgcgcgtggattaggatatttaggtttttattagcgttcgtttttttcggacgcggtcgtttagcgtcgaagcggtttttgagttcgaggtcgttacgtttagggtagggcggtggtcgggtatttgttcgtagggagtttttattcgtttttcgcgggtttt

SEQ ID NO: 20252 - DNA, 1042 bp, Artificial Sequence
  chemically treated genomic DNA (Homo sapiens) CpG-island No: 20252
aaaacccgcgaaaaacgaataaaaactccctacgaacaaatacccgaccaccgccctaccctaaacgtaacgacctcgaactcaaaaaccgcttcgacgctaaacgaccgcgtccgaaaaaaacgaacgctaataaaaacctaaatatcctaatccacgcgcgcaaccgaacgtcgaatccaaaaaaaaacgcgaactaaaacgaaacgaaacccgacccctaaaacgcgaaaataaaaataaaaacaaaaaaaaaaaaaataaaaaaaaaaaacaataaaacccaacgccgcgcgaaaaacaaaaaccgacccgcgaacaaaaacgaatacaataaaatccccgacgaacgtaaaaacacaaaattcaacctcctacgacgaacgaacacgcgaaccccaaaaacgaacgaatacgacaaaacgtaacctaaaaacgcgacgcgtaccaccgccctaaaacaaacatccgacctccgtaaaacgaacaaacgaaccccgaatctaaaacctacgactaaaaaaaacgccgcgtcaacaacaacgattacgaaacgaaaccgaatacgcgtacgcgactctcgcgaacgaaaaacaaacgaaaaaacgaacgaaaaacaataaaaacgcgcgtacgcgcgaccgtacaacctaaacaataaatcctacctataacgcgcgacgacgatcgatcctacctataacgacgacgacgactactactccgaacacctacgacgacgacgacgaccccgcgacgaacgcgaaaatataacccctaataacgacgctattactaaactcgacgtactacgataaataactcctcgctcccaaccctacgactactatcgcttcgcccccgcgaacgtataaactacgccccaaccaacccgacgacgccctaaaaaaaataaccgaaacgcaaaacactcgaaccctaaacgcccgaaatacaaacgtaaaaaaaccccacgaaaaatcgaacgccccccttcttcctcccttcctttccctaatcgtcttcttccccctaaataaaa

SEQ ID NO: 20253 - DNA, 650 bp, Artificial Sequence
  chemically treated genomic DNA (Homo sapiens) CpG-island No: 20253
gcgggggcgcgtttttcggtcgcgtttttttagttacgttttttacgttcggtttttcgagagcgagttcggtcggacgtacggaaagggttgggttacgtgggcggttgttgagtggttcgttttcgttttttagcgcgtagttaggcggaggtaagtttagagcgtacggatagagcggtagcgcgcgttcgcgcgcgtttttagtatttttttcggtgacgtgtttgatcgaggtcgcgttagggcgttgttgttgttaatatagttgttatggcgtttaaggcgttggttgcggagaagtggtcgcggtttttatagagttgggggcgggcggttcggtatggagagtagtttcgagagtttgtagtcgttagaatacggggtggcggtcgggttagcgttagggataggtttttcgtaggaagggttataggagattaggttcgtcgttggtgatggttttggggtatgggcggcggagattagcggcgggaatgggttgggggcggcggtcgttaggaggagtttttcggattcggtttttttcgcgggtttttttgaggttttcggattttgtagttttttcgcgggtttggatttgaaggatagtggtttggagagttttgttgtcgtcgaggcgtttttga

SEQ ID NO: 20254 - DNA, 650 bp, Artificial Sequence
  chemically treated genomic DNA (Homo sapiens) CpG-island No: 20254
tcaaaaacgcctcgacgacaacaaaactctccaaaccactatccttcaaatccaaacccgcgaaaaaactacaaaatccgaaaacctcaaaaaaacccgcgaaaaaaaccgaatccgaaaaactcctcctaacgaccgccgcccccaacccattcccgccgctaatctccgccgcccataccccaaaaccatcaccaacgacgaacctaatctcctataacccttcctacgaaaaacctatccctaacgctaacccgaccgccaccccgtattctaacgactacaaactctcgaaactactctccataccgaaccgcccgcccccaactctataaaaaccgcgaccacttctccgcaaccaacgccttaaacgccataacaactatattaacaacaacaacgccctaacgcgacctcgatcaaacacgtcaccgaaaaaaatactaaaaacgcgcgcgaacgcgcgctaccgctctatccgtacgctctaaacttacctccgcctaactacgcgctaaaaaacgaaaacgaaccactcaacaaccgcccacgtaacccaaccctttccgtacgtccgaccgaactcgctctcgaaaaaccgaacgtaaaaaacgtaactaaaaaaacgcgaccgaaaaacgcgcccccgc

SEQ ID NO: 20255 - DNA, 650 bp, Artificial Sequence
  chemically treated genomic DNA (Homo sapiens) CpG-island No: 20255
ttagaggcgtttcggcggtagtaggattttttaaattattgttttttaagtttaaattcgcggaggagttgtagggttcgggaattttaggagagttcgcgggagaagtcgagttcgggaggttttttttggcggtcgtcgtttttagtttattttcgtcgttggttttcgtcgtttatattttaggattattattagcggcgagtttggttttttgtagttttttttgcgaagaatttgtttttgacgttggttcggtcgttatttcgtgttttagcggttgtaggttttcggggttgttttttatatcgggtcgttcgtttttagttttatggagatcgcggttattttttcgtagttagcgttttggacgttatgatagttgtattggtagtaatagcgttttggcgcggtttcggttaggtacgttatcggggagagtattaagaacgcgcgcgggcgcgcgttatcgttttgttcgtgcgttttgagtttgttttcgtttgattgcgcgttgagaggcgaaggcgaattatttagtagtcgtttacgtggtttagtttttttcgtgcgttcgatcgagttcgttttcggaaggtcgggcgtggagggcgtggttaggagggcgcggtcggggggcgcgttttcgt

SEQ ID NO: 20256 - DNA, 650 bp, Artificial Sequence
  chemically treated genomic DNA (Homo sapiens) CpG-island No: 20256
acgaaaacgcgccccccgaccgcgccctcctaaccacgccctccacgcccgaccttccgaaaacgaactcgatcgaacgcacgaaaaaaactaaaccacgtaaacgactactaaataattcgccttcgcctctcaacgcgcaatcaaacgaaaacaaactcaaaacgcacgaacaaaacgataacgcgcgcccgcgcgcgttcttaatactctccccgataacgtacctaaccgaaaccgcgccaaaacgctattactaccaatacaactatcataacgtccaaaacgctaactacgaaaaaataaccgcgatctccataaaactaaaaacgaacgacccgatataaaaaacaaccccgaaaacctacaaccgctaaaacacgaaataacgaccgaaccaacgtcaaaaacaaattcttcgcaaaaaaaactacaaaaaaccaaactcgccgctaataataatcctaaaatataaacgacgaaaaccaacgacgaaaataaactaaaaacgacgaccgccaaaaaaaacctcccgaactcgacttctcccgcgaactctcctaaaattcccgaaccctacaactcctccgcgaatttaaacttaaaaaacaataatttaaaaaatcctactaccgccgaaacgcctctaa

SEQ ID NO: 20257 - DNA, 773 bp, Artificial Sequence
  chemically treated genomic DNA (Homo sapiens) CpG-island No: 20257
gatcggcgcgtcgggtaaagaataatatacgagtttagttgtaaataatataattttttacgagtttgcgcggcgggtttcggcggcggagaggatttcggaattcgttatcgggtaggggttgggggaggaatggtgagtaggatgagcgttgaacgaggacggcgagatcgttagtttcgttgcggttgtttgtatcggcgttcgtcgagtagattggagggatgtagttattagtttgggttttatcgtttttattaggcgacgcggatgtttcgatttcgtttttttgggaggcgattttcgtttttcggggtcgttagggcggtggggggcggggaaggtttcgtcggaggtttgggagttttttcggttcgttatcgaagggaaagcggtcggggcgcgggggataatagggagcggggagcgcggttcgttagagtggcgtcgttggtcggttgggttgattgacgcgtacgtcgcgaggcgcgattgggtttcgttcggttcggtcgtcgtttcgtcgtggtcgcggcgttttcggcgttcgtagtcgtgttttattttttattttcgtcgtttaggagaggagtagaattaatatttttagtaatattatttttcgttgtcgttgtcgtcgtcgtcgtttttttacgggttaatagtagtatatcgattcggagggagaagttgaaggggtttggttcggagtttttacgggaagtcgggattttttttggtaggagaaacggcgaagtatttttttttcgttt

SEQ ID NO: 20258 - DNA, 773 bp, Artificial Sequence
  chemically treated genomic DNA (Homo sapiens) CpG-island No: 20258
aaacgaaaaaaaaatacttcgccgtttctcctaccaaaaaaaatcccgacttcccgtaaaaactccgaaccaaaccccttcaacttctccctccgaatcgatatactactattaacccgtaaaaaaacgacgacgacgacaacgacaacgaaaaataatattactaaaaatattaattctactcctctcctaaacgacgaaaataaaaaataaaacacgactacgaacgccgaaaacgccgcgaccacgacgaaacgacgaccgaaccgaacgaaacccaatcgcgcctcgcgacgtacgcgtcaatcaacccaaccgaccaacgacgccactctaacgaaccgcgctccccgctccctattatcccccgcgccccgaccgctttcccttcgataacgaaccgaaaaaactcccaaacctccgacgaaaccttccccgccccccaccgccctaacgaccccgaaaaacgaaaatcgcctcccaaaaaaacgaaatcgaaacatccgcgtcgcctaataaaaacgataaaacccaaactaataactacatccctccaatctactcgacgaacgccgatacaaacaaccgcaacgaaactaacgatctcgccgtcctcgttcaacgctcatcctactcaccattcctcccccaacccctacccgataacgaattccgaaatcctctccgccgccgaaacccgccgcgcaaactcgtaaaaaattatattatttacaactaaactcgtatattattctttacccgacgcgccgatc

SEQ ID NO: 20259 - DNA, 773 bp, Artificial Sequence
  chemically treated genomic DNA (Homo sapiens) CpG-island No: 20259
gagcgagagggaggtgtttcgtcgttttttttgttaggggaggtttcggtttttcgtggaggtttcggattaagtttttttagttttttttttcggatcgatgtgttgttgttaattcgtgaggaggcggcggcggcggtagcggtagcggaagatggtgttgttgagagtgttaattttgttttttttttgggcggcggggatgggaggtgaggtacgattgcgagcgtcgggggcgtcgcgattacggcggagcggcggtcgggtcgagcggagtttagtcgcgtttcgcggcgtgcgcgttagttagtttagtcggttagcggcgttattttggcgggtcgcgtttttcgttttttattgtttttcgcgtttcgatcgtttttttttcggtggcgggtcgaggaggtttttaagttttcggcgaggtttttttcgttttttatcgttttggcggtttcgggaggcgggggtcgttttttagagaagcgaagtcggggtattcgcgtcgtttggtgagagcggtggaatttaggttggtggttgtatttttttagtttgttcggcgggcgtcggtgtaggtagtcgtagcgaggttggcggtttcgtcgttttcgtttagcgtttattttgtttattattttttttttagtttttgttcggtggcggatttcgaagtttttttcgtcgtcgagattcgtcgcgtagattcgtgggaagttgtgttgtttgtagttgggttcgtgtattgttttttattcggcgcgtcggtt

SEQ ID NO: 20260 - DNA, 773 bp, Artificial Sequence
  chemically treated genomic DNA (Homo sapiens) CpG-island No: 20260
aaccgacgcgccgaataaaaaacaatacacgaacccaactacaaacaacacaacttcccacgaatctacgcgacgaatctcgacgacgaaaaaaacttcgaaatccgccaccgaacaaaaactaaaaaaaaaataataaacaaaataaacgctaaacgaaaacgacgaaaccgccaacctcgctacgactacctacaccgacgcccgccgaacaaactaaaaaaatacaaccaccaacctaaattccaccgctctcaccaaacgacgcgaataccccgacttcgcttctctaaaaaacgacccccgcctcccgaaaccgccaaaacgataaaaaacgaaaaaaacctcgccgaaaacttaaaaacctcctcgacccgccaccgaaaaaaaaacgatcgaaacgcgaaaaacaataaaaaacgaaaaacgcgacccgccaaaataacgccgctaaccgactaaactaactaacgcgcacgccgcgaaacgcgactaaactccgctcgacccgaccgccgctccgccgtaatcgcgacgcccccgacgctcgcaatcgtacctcacctcccatccccgccgcccaaaaaaaaaacaaaattaacactctcaacaacaccatcttccgctaccgctaccgccgccgccgcctcctcacgaattaacaacaacacatcgatccgaaaaaaaaaactaaaaaaacttaatccgaaacctccacgaaaaaccgaaacctcccctaacaaaaaaaacgacgaaacacctccctctcgctc

SEQ ID NO: 20261 - DNA, 1306 bp, Artificial Sequence
  chemically treated genomic DNA (Homo sapiens) CpG-island No: 20261
aattttacgttagttcggcgcgcgcgattttcgcggcgtagcggtagggttggcgggtggcgcgcgtaggtcgttttatatcggtcggcggagtttttcggtttgttcgcggacgcggcgttagtgtagcgcgaagtcggtttggggcggtggcggtggcggcggcgcgttcgcgttgtagggatttgtagttcgcgcgtttttcgggtatttttttcgggtaggtcggttagcgcgttttcgttcgtcgtaagtcgattttttgcggttgttaagattatatttttcgtcgtttttttcgttgtcgggtcgaaagcgaaaataaattttgggttgcgaggtgttgttttttttcgggcgtttttattcgttttttgttttttcggcgttttttagcgaggtggggaaacgaaaggtcgcgtttttttttttggttttttcggttttcggcgtggggagtgcgcgggggcgtaggtttcgttttatttgagtcggtttagcgtgcgcgttaggggcgggggttttttcgttttatatcggtacggaggaggaaatttgtgggggcggcgattttcggtttgggttttgagttaggtagcgaggtcgtcgggaagtgattatttattttcggggttttttttaatttcgtttttttcgtttgtcgtgggcgcgtgttcgtttcgaggaggcggtcgcgtgcggatagttatgtattaggtagggtttttttatgcgttcggagagcgcggatcgttgtttcgggtcgtcgtcgtttgtcgtcgttcgcggagttcgagttttagttcgagtcgtcgtttgttttaggtcggggcgtcgagtagtcggcggtttggttatgtggggttagttttcgtcgcgtttggtttgtagtaggattagtaatatggaggttgtcgtcggcgttttcgacggcggggattagggcggcgcggggtttcgcgaggacgcgacgtttatggacgtttatttgcggaaattgggtttgtatcggaaattggtcgttaaggacgggtcgtgtttgtttcgggtcgtggcggagtaggtaattgcgggggggcggggagggtttcgaggggaggcggggacggttcggcgggtttgggtggggaggtagttgcgggttgttcgggtcgtttacggtcggggttgcgcgtgttttggttgtcgttatagcgttttattgtaacgtcggagtgggacgttgttttgcgtttgaaaggtgtaaattgaaattcgaaagttcgtaaattaacggggtgttttttttttgatgaagaggtaatga

SEQ ID NO: 20262 - DNA, 1306 bp, Artificial Sequence
  chemically treated genomic DNA (Homo sapiens) CpG-island No: 20262
tcattacctcttcatcaaaaaaaaaacaccccgttaatttacgaactttcgaatttcaatttacacctttcaaacgcaaaacaacgtcccactccgacgttacaataaaacgctataacgacaaccaaaacacgcgcaaccccgaccgtaaacgacccgaacaacccgcaactacctccccacccaaacccgccgaaccgtccccgcctcccctcgaaaccctccccgcccccccgcaattacctactccgccacgacccgaaacaaacacgacccgtccttaacgaccaatttccgatacaaacccaatttccgcaaataaacgtccataaacgtcgcgtcctcgcgaaaccccgcgccgccctaatccccgccgtcgaaaacgccgacgacaacctccatattactaatcctactacaaaccaaacgcgacgaaaactaaccccacataaccaaaccgccgactactcgacgccccgacctaaaacaaacgacgactcgaactaaaactcgaactccgcgaacgacgacaaacgacgacgacccgaaacaacgatccgcgctctccgaacgcataaaaaaaccctacctaatacataactatccgcacgcgaccgcctcctcgaaacgaacacgcgcccacgacaaacgaaaaaaacgaaattaaaaaaaaccccgaaaataaataatcacttcccgacgacctcgctacctaactcaaaacccaaaccgaaaatcgccgcccccacaaatttcctcctccgtaccgatataaaacgaaaaaacccccgcccctaacgcgcacgctaaaccgactcaaataaaacgaaacctacgcccccgcgcactccccacgccgaaaaccgaaaaaaccaaaaaaaaaaacgcgacctttcgtttccccacctcgctaaaaaacgccgaaaaaacaaaaaacgaataaaaacgcccgaaaaaaaacaacacctcgcaacccaaaatttattttcgctttcgacccgacaacgaaaaaaacgacgaaaaatataatcttaacaaccgcaaaaaatcgacttacgacgaacgaaaacgcgctaaccgacctacccgaaaaaaatacccgaaaaacgcgcgaactacaaatccctacaacgcgaacgcgccgccgccaccgccaccgccccaaaccgacttcgcgctacactaacgccgcgtccgcgaacaaaccgaaaaactccgccgaccgatataaaacgacctacgcgcgccacccgccaaccctaccgctacgccgcgaaaatcgcgcgcgccgaactaacgtaaaatt

SEQ ID NO: 20263 - DNA, 1306 bp, Artificial Sequence
  chemically treated genomic DNA (Homo sapiens) CpG-island No: 20263
ttattatttttttattaggagagagatatttcgttaatttgcgggttttcgagttttaatttgtattttttagacgtaaagtagcgttttatttcggcgttataatggggcgttgtgacgatagttagggtacgcgtagtttcggtcgtgggcggttcggatagttcgtagttgtttttttatttagattcgtcgggtcgttttcgttttttttcgaagtttttttcgttttttcgtaattatttgtttcgttacggttcggaataggtacgattcgtttttggcgattagttttcgatataagtttagttttcgtagataggcgtttatgggcgtcgcgttttcgcggggtttcgcgtcgttttggttttcgtcgtcggggacgtcgacggtagtttttatgttgttggttttgttgtaggttaggcgcggcgagggttagttttatatggttaggtcgtcggttgttcgacgtttcggtttggggtaggcggcggttcgggttggggttcgggtttcgcgagcggcggtaggcggcggcggttcgaggtagcggttcgcgtttttcgggcgtatagggaagttttgtttaatgtatggttgttcgtacgcggtcgttttttcggagcgaatacgcgtttacgataaacggggggagcgggattaaggaaaatttcgagagtgagtagttatttttcgacggtttcgttgtttgatttaggatttaggtcgggggtcgtcgtttttataagttttttttttcgtatcggtgtgaagcgagaaaattttcgtttttggcgcgtacgttgggtcggtttaggtgaagcggggtttgcgttttcgcgtattttttacgtcgggagtcgaggaaattaaaaagaaagacgcggtttttcgtttttttatttcgttggagggcgtcggaggggtagggagcgggtgggggcgttcgggagagaatagtatttcgtagtttagaatttgttttcgttttcggttcgatagcggagaggacggcgggagatgtagttttggtagtcgtaggaagtcggtttgcggcgggcggggacgcgttggtcggtttattcgggggaggtgttcgggaggcgcgcggattataagtttttatagcgcgggcgcgtcgtcgttatcgttatcgttttaagtcggtttcgcgttgtattggcgtcgcgttcgcgagtaggtcgaggggtttcgtcggtcgatgtggggcgatttgcgcgcgttattcgttaattttgtcgttgcgtcgcgggaatcgcgcgcgtcgggttggcgtggagtt

SEQ ID NO: 20264 - DNA, 1306 bp, Artificial Sequence
  chemically treated genomic DNA (Homo sapiens) CpG-island No: 20264
aactccacgccaacccgacgcgcgcgattcccgcgacgcaacgacaaaattaacgaataacgcgcgcaaatcgccccacatcgaccgacgaaacccctcgacctactcgcgaacgcgacgccaatacaacgcgaaaccgacttaaaacgataacgataacgacgacgcgcccgcgctataaaaacttataatccgcgcgcctcccgaacacctcccccgaataaaccgaccaacgcgtccccgcccgccgcaaaccgacttcctacgactaccaaaactacatctcccgccgtcctctccgctatcgaaccgaaaacgaaaacaaattctaaactacgaaatactattctctcccgaacgcccccacccgctccctacccctccgacgccctccaacgaaataaaaaaacgaaaaaccgcgtctttctttttaatttcctcgactcccgacgtaaaaaatacgcgaaaacgcaaaccccgcttcacctaaaccgacccaacgtacgcgccaaaaacgaaaattttctcgcttcacaccgatacgaaaaaaaaaacttataaaaacgacgacccccgacctaaatcctaaatcaaacaacgaaaccgtcgaaaaataactactcactctcgaaattttccttaatcccgctccccccgtttatcgtaaacgcgtattcgctccgaaaaaacgaccgcgtacgaacaaccatacattaaacaaaacttccctatacgcccgaaaaacgcgaaccgctacctcgaaccgccgccgcctaccgccgctcgcgaaacccgaaccccaacccgaaccgccgcctaccccaaaccgaaacgtcgaacaaccgacgacctaaccatataaaactaaccctcgccgcgcctaacctacaacaaaaccaacaacataaaaactaccgtcgacgtccccgacgacgaaaaccaaaacgacgcgaaaccccgcgaaaacgcgacgcccataaacgcctatctacgaaaactaaacttatatcgaaaactaatcgccaaaaacgaatcgtacctattccgaaccgtaacgaaacaaataattacgaaaaaacgaaaaaaacttcgaaaaaaaacgaaaacgacccgacgaatctaaataaaaaaacaactacgaactatccgaaccgcccacgaccgaaactacgcgtaccctaactatcgtcacaacgccccattataacgccgaaataaaacgctactttacgtctaaaaaatacaaattaaaactcgaaaacccgcaaattaacgaaatatctctctcctaataaaaaaataataa

SEQ ID NO: 20265 - DNA, 639 bp, Artificial Sequence
  chemically treated genomic DNA (Homo sapiens) CpG-island No: 20265
taggaaatcgcgggtttcgtcgttttcgtttcgggtttgtttttttcgggatttattgaggagtcgtcgtcgtttcgttagttttcgagcgcgagttggaggaaaagttgggcggcgggaagagcggcgggacgagcgtagggagggggcgtaggagacgcggacggagggaagggaggggagatttaaggggcgcggatcgttcgggagggagttaggaggtgaaaggggcgggcggcgagcggagggaggcgtcggtttcggttgggttgcggcgggtaaagcgcgtagtcgggaggtttcggcgtcgggggtcgttcgggacgttaagttcgttttagattcgggggcgtcgcggtttttatttcgttcggcgtggaggtttcgtttcgggagagttcgtcgtggtttgtgcgagcgggcgtgtgttcgcgttttcggtttcggttcgtcgttttcgggttttgttcgggttttggcggggtcgtaagagtttcgcggtcggcgttcgattttcggcggcgttcggtgttcggcgtttttagttcgggcgggaataatggagtcggagttggtgtttcggaggcggggcggggggagggttttcgttcgttattcggggtttttagattttgtgtt

SEQ ID NO: 20266 - DNA, 639 bp, Artificial Sequence
  chemically treated genomic DNA (Homo sapiens) CpG-island No: 20266
aacacaaaatctaaaaaccccgaataacgaacgaaaaccctccccccgccccgcctccgaaacaccaactccgactccattattcccgcccgaactaaaaacgccgaacaccgaacgccgccgaaaatcgaacgccgaccgcgaaactcttacgaccccgccaaaacccgaacaaaacccgaaaacgacgaaccgaaaccgaaaacgcgaacacacgcccgctcgcacaaaccacgacgaactctcccgaaacgaaacctccacgccgaacgaaataaaaaccgcgacgcccccgaatctaaaacgaacttaacgtcccgaacgacccccgacgccgaaacctcccgactacgcgctttacccgccgcaacccaaccgaaaccgacgcctccctccgctcgccgcccgcccctttcacctcctaactccctcccgaacgatccgcgccccttaaatctcccctcccttccctccgtccgcgtctcctacgccccctccctacgctcgtcccgccgctcttcccgccgcccaacttttcctccaactcgcgctcgaaaactaacgaaacgacgacgactcctcaataaatcccgaaaaaaacaaacccgaaacgaaaacgacgaaacccgcgatttccta

SEQ ID NO: 20267 - DNA, 639 bp, Artificial Sequence
  chemically treated genomic DNA (Homo sapiens) CpG-island No: 20267
ggtataaggtttggagatttcgggtggcggacgggagtttttttttcgtttcgttttcggggtattagtttcggttttattgttttcgttcgggttggaggcgtcgagtatcgagcgtcgtcgggagtcgagcgtcggtcgcggagtttttgcgatttcgttaggattcgaatagagttcgggggcggcgggtcggagtcggggacgcgggtatacgttcgttcgtataagttacggcggattttttcgaggcggaatttttacgtcgagcgaggtaagagtcgcggcgttttcggatttggggcgggtttggcgtttcgagcggttttcggcgtcggagtttttcggttgcgcgttttgttcgtcgtagtttagtcggggtcggcgttttttttcgttcgtcgttcgttttttttattttttggttttttttcgggcgattcgcgttttttgggttttttttttttttttttcgttcgcgttttttgcgttttttttttgcgttcgtttcgtcgtttttttcgtcgtttaattttttttttaattcgcgttcgggagttggcgaggcggcggcggttttttagtgagtttcgggagggataggttcggggcgaaggcggcgaggttcgcggttttttg

SEQ ID NO: 20268 - DNA, 639 bp, Artificial Sequence
  chemically treated genomic DNA (Homo sapiens) CpG-island No: 20268
caaaaaaccgcgaacctcgccgccttcgccccgaacctatccctcccgaaactcactaaaaaaccgccgccgcctcgccaactcccgaacgcgaattaaaaaaaaaattaaacgacgaaaaaaacgacgaaacgaacgcaaaaaaaaaacgcaaaaaacgcgaacgaaaaaaaaaaaaaaaaaacccaaaaaacgcgaatcgcccgaaaaaaaaccaaaaaataaaaaaaacgaacgacgaacgaaaaaaaacgccgaccccgactaaactacgacgaacaaaacgcgcaaccgaaaaactccgacgccgaaaaccgctcgaaacgccaaacccgccccaaatccgaaaacgccgcgactcttacctcgctcgacgtaaaaattccgcctcgaaaaaatccgccgtaacttatacgaacgaacgtatacccgcgtccccgactccgacccgccgcccccgaactctattcgaatcctaacgaaatcgcaaaaactccgcgaccgacgctcgactcccgacgacgctcgatactcgacgcctccaacccgaacgaaaacaataaaaccgaaactaataccccgaaaacgaaacgaaaaaaaaactcccgtccgccacccgaaatctccaaaccttatacc

SEQ ID NO: 20269 - DNA, 520 bp, Artificial Sequence
  chemically treated genomic DNA (Homo sapiens) CpG-island No: 20269
gcggtggcgttttattttttttgtagatcgggttttatcgttttgcggaggtttcggcgtcgcggcgtgttcgattgtagtacgggtatcgtgcgttttgcggggcgtttcgagttcggatcggagaaaagtttttgggtttcgcggttttttaagtagcggcgcgttcgcggtcggggaaggcgaggtcgtcgtaatgcgttacgaggggtttcggtttcgttcggacgtggtcgtttagttttcggtatattcgggttttttcgcgcgttgcggttgtatcggcgtttcggttttcgttagttgtcgttcgtcgttaaggacgtcgcgtttgtggtcgtaagagcgtttcgagcgttatgcgtcggcgaggcgcgagggttcgtttttttatttttattcgcgttggtttttttttcgttttcgttttttgtagttgtttgttgggttttgtagttttttagtcgcggttttaaaggacggggagcgggtcgagttgttcggcgttttgttttttttt

SEQ ID NO: 20270 - DNA, 520 bp, Artificial Sequence
  chemically treated genomic DNA (Homo sapiens) CpG-island No: 20270
aaaaaaaaacaaaacgccgaacaactcgacccgctccccgtcctttaaaaccgcgactaaaaaactacaaaacccaacaaacaactacaaaaaacgaaaacgaaaaaaaaaccaacgcgaataaaaataaaaaaacgaaccctcgcgcctcgccgacgcataacgctcgaaacgctcttacgaccacaaacgcgacgtccttaacgacgaacgacaactaacgaaaaccgaaacgccgatacaaccgcaacgcgcgaaaaaacccgaatataccgaaaactaaacgaccacgtccgaacgaaaccgaaacccctcgtaacgcattacgacgacctcgccttccccgaccgcgaacgcgccgctacttaaaaaaccgcgaaacccaaaaacttttctccgatccgaactcgaaacgccccgcaaaacgcacgatacccgtactacaatcgaacacgccgcgacgccgaaacctccgcaaaacgataaaacccgatctacaaaaaaaataaaacgccaccgc

SEQ ID NO: 20271 - DNA, 520 bp, Artificial Sequence
  chemically treated genomic DNA (Homo sapiens) CpG-island No: 20271
agagaagggtagagcgtcggatagttcggttcgtttttcgttttttggggtcgcggttggggaattataaggtttagtaggtagttgtagggggcggaggcggaggagggattagcgcgggtgggagtgagagagcgagttttcgcgtttcgtcggcgtatagcgttcggagcgtttttgcggttataggcgcggcgtttttggcggcgggcggtagttagcgggagtcgggacgtcggtgtagtcgtagcgcgcggaggaattcgggtgtgtcgggagttgggcggttacgttcggacgggatcgagatttttcgtagcgtattgcggcgatttcgtttttttcggtcgcgagcgcgtcgttgtttgaaaagtcgcggaatttaaggattttttttcggttcgagttcggggcgtttcgtagggcgtacggtattcgtgttgtagtcgggtacgtcgcggcgtcggggttttcgtagggcgatggagttcggtttgtaaggaaagtgaggcgttatcgt

SEQ ID NO: 20272 - DNA, 520 bp, Artificial Sequence
  chemically treated genomic DNA (Homo sapiens) CpG-island No: 20272
acgataacgcctcactttccttacaaaccgaactccatcgccctacgaaaaccccgacgccgcgacgtacccgactacaacacgaataccgtacgccctacgaaacgccccgaactcgaaccgaaaaaaaatccttaaattccgcgacttttcaaacaacgacgcgctcgcgaccgaaaaaaacgaaatcgccgcaatacgctacgaaaaatctcgatcccgtccgaacgtaaccgcccaactcccgacacacccgaattcctccgcgcgctacgactacaccgacgtcccgactcccgctaactaccgcccgccgccaaaaacgccgcgcctataaccgcaaaaacgctccgaacgctatacgccgacgaaacgcgaaaactcgctctctcactcccacccgcgctaatccctcctccgcctccgccccctacaactacctactaaaccttataattccccaaccgcgaccccaaaaaacgaaaaacgaaccgaactatccgacgctctacccttctct

SEQ ID NO: 20273 - DNA, 730 bp, Artificial Sequence
  chemically treated genomic DNA (Homo sapiens) CpG-island No: 20273
gtagggttttttaaaatttaaacgtagcggtttacggtttgttacgttttttaggagaatggtagatatagagaggaaatgtggagagggtataaatcgtaaggtgaagaaaacgaataaatatcgagttgatacggatagttttcgtttttttgagggtcgatttcgtgattttcgatgagcgtttagttgcgtcgggtatttttgggttttttagcgtttttttcggaggtttatcgtcgtacggcggaaagcgttttcggtttcgtttttcggttttagtttttcgggcgttttcgcgcggcggttaacgttggttttcggtcgggcgcgttgacgttatcgtgcgttagagtgagttcggatggggcggcgggtttcgggagcgttcgggttgattcgagtcgagcgggtcgtatttttttgtcggcgtcgttgattttcggttttgcggaggtttttaggtagtcgcgtagttttcgtgtttgttgcgttcgtattgcggtgagtgttgtttttttcgggttcgggcggcgtggggcgggtggggacgcgagggttcgcgggggtttatttttttgatgtggcggtcgaacgaggaaggacggggtttgaggtttttcggttaagggtcgagggtcgtcgggggttttttgttttttattttcgttaaggttttattggattcggaagttttaatttcgagatttgtagttaaagcgatttttaa

SEQ ID NO: 20274 - DNA, 730 bp, Artificial Sequence
  chemically treated genomic DNA (Homo sapiens) CpG-island No: 20274
ttaaaaatcgctttaactacaaatctcgaaattaaaacttccgaatccaataaaaccttaacgaaaataaaaaacaaaaaacccccgacgaccctcgacccttaaccgaaaaacctcaaaccccgtccttcctcgttcgaccgccacatcaaaaaaataaacccccgcgaaccctcgcgtccccacccgccccacgccgcccgaacccgaaaaaaacaacactcaccgcaatacgaacgcaacaaacacgaaaactacgcgactacctaaaaacctccgcaaaaccgaaaatcaacgacgccgacaaaaaaatacgacccgctcgactcgaatcaacccgaacgctcccgaaacccgccgccccatccgaactcactctaacgcacgataacgtcaacgcgcccgaccgaaaaccaacgttaaccgccgcgcgaaaacgcccgaaaaactaaaaccgaaaaacgaaaccgaaaacgctttccgccgtacgacgataaacctccgaaaaaaacgctaaaaaacccaaaaatacccgacgcaactaaacgctcatcgaaaatcacgaaatcgaccctcaaaaaaacgaaaactatccgtatcaactcgatatttattcgttttcttcaccttacgatttataccctctccacatttcctctctatatctaccattctcctaaaaaacgtaacaaaccgtaaaccgctacgtttaaattttaaaaaaccctac

SEQ ID NO: 20275 - DNA, 730 bp, Artificial Sequence
  chemically treated genomic DNA (Homo sapiens) CpG-island No: 20275
ttaaaaatcgttttgattgtaagtttcgaagttggggttttcgaatttaataaaattttggcgagagtagaaagtagagagttttcggcgattttcgatttttggtcgaagggttttaggtttcgttttttttcgttcggtcgttatattagggaagtgggttttcgcgggttttcgcgtttttattcgttttacgtcgttcgagttcggaaggagtagtatttatcgtagtgcgggcgtagtaaatacggaagttgcgcggttgtttagaggttttcgtagagtcgggaattagcggcgtcgataaggagatacggttcgttcggttcggattagttcgggcgttttcgaagttcgtcgttttattcgggtttattttgacgtacgatgacgttagcgcgttcggtcgaggattagcgttagtcgtcgcgcgagggcgttcgggaggttggggtcggaaagcggaatcgagagcgtttttcgtcgtgcggcgatgaattttcgggaaagacgttgggaggtttagggatgttcggcgtaattggacgtttatcgggagttacggggtcggtttttaggggaacggggattattcgtattaattcggtgtttgttcgttttttttattttgcggtttgtgttttttttatattttttttttgtgtttattatttttttgggggacgtggtaaatcgtgagtcgttgcgtttgagttttgggaaattttgt

SEQ ID NO: 20276 - DNA, 730 bp, Artificial Sequence
  chemically treated genomic DNA (Homo sapiens) CpG-island No: 20276
acaaaatttcccaaaactcaaacgcaacgactcacgatttaccacgtcccccaaaaaaataataaacacaaaaaaaaaatataaaaaaaacacaaaccgcaaaataaaaaaaacgaacaaacaccgaattaatacgaataatccccgttcccctaaaaaccgaccccgtaactcccgataaacgtccaattacgccgaacatccctaaacctcccaacgtctttcccgaaaattcatcgccgcacgacgaaaaacgctctcgattccgctttccgaccccaacctcccgaacgccctcgcgcgacgactaacgctaatcctcgaccgaacgcgctaacgtcatcgtacgtcaaaataaacccgaataaaacgacgaacttcgaaaacgcccgaactaatccgaaccgaacgaaccgtatctccttatcgacgccgctaattcccgactctacgaaaacctctaaacaaccgcgcaacttccgtatttactacgcccgcactacgataaatactactccttccgaactcgaacgacgtaaaacgaataaaaacgcgaaaacccgcgaaaacccacttccctaatataacgaccgaacgaaaaaaaacgaaacctaaaacccttcgaccaaaaatcgaaaatcgccgaaaactctctactttctactctcgccaaaattttattaaattcgaaaaccccaacttcgaaacttacaatcaaaacgatttttaa

SEQ ID NO: 20277 - DNA, 526 bp, Artificial Sequence
  chemically treated genomic DNA (Homo sapiens) CpG-island No: 20277
ttaacgaaaagcgtttgtatggttgtttcgttaattttgtatttttcggggttgaggaagagtcgaggtgattagaagttagcgataagtgtcggttattttcgacgttaggcgtcgggtttggagttcgacgggtcgaattttcgcgagagcggtcgtcgttatttttttattgattgtagcgggttgggggaggggtcgacgacgaaggcggttgtggtagcggcggcggcggcggcggagttttgggtcggtgtttgcgcgttggtgtttgaggtttaggttgaggttttcgttattgttggagcgtaggcggcggagaggatgattgtcgttgttatttttttttgagttagcgagtcgtcgttattttttattttttttcggtagggcggagaggagcggtcggagttagcgatggtgttcggcgaggagaattaattggtttcgaaagaggtgaggggttttagaggaggttaggttttaggtttgcggtcgttcgaggtaatataggttcgggttcggg

SEQ ID NO: 20278 - DNA, 526 bp, Artificial Sequence
  chemically treated genomic DNA (Homo sapiens) CpG-island No: 20278
cccgaacccgaacctatattacctcgaacgaccgcaaacctaaaacctaacctcctctaaaacccctcacctctttcgaaaccaattaattctcctcgccgaacaccatcgctaactccgaccgctcctctccgccctaccgaaaaaaaataaaaaataacgacgactcgctaactcaaaaaaaaataacaacgacaatcatcctctccgccgcctacgctccaacaataacgaaaacctcaacctaaacctcaaacaccaacgcgcaaacaccgacccaaaactccgccgccgccgccgccgctaccacaaccgccttcgtcgtcgacccctcccccaacccgctacaatcaataaaaaaataacgacgaccgctctcgcgaaaattcgacccgtcgaactccaaacccgacgcctaacgtcgaaaataaccgacacttatcgctaacttctaatcacctcgactcttcctcaaccccgaaaaatacaaaattaacgaaacaaccatacaaacgcttttcgttaa

SEQ ID NO: 20279 - DNA, 526 bp, Artificial Sequence
  chemically treated genomic DNA (Homo sapiens) CpG-island No: 20279
ttcgggttcgggtttgtgttgtttcgagcggtcgtaggtttaaggtttaattttttttggggttttttatttttttcgggattagttggtttttttcgtcgggtattatcgttgatttcggtcgttttttttcgttttgtcgggggagggtggagggtggcggcggttcgttagtttaagagagaatggtagcggtagttatttttttcgtcgtttgcgttttagtaatagcggaggttttagtttgggttttagatattagcgcgtagatatcgatttagggtttcgtcgtcgtcgtcgtcgttattatagtcgttttcgtcgtcggttttttttttagttcgttgtaattaatggaaaaatggcggcggtcgttttcgcgagaattcggttcgtcgggttttaagttcggcgtttggcgtcggaggtggtcggtatttgtcgttagtttttagttatttcggtttttttttagtttcgggaggtatagaattggcgagatagttatgtaaacgtttttcgttag

SEQ ID NO: 20280 - DNA, 526 bp, Artificial Sequence
  chemically treated genomic DNA (Homo sapiens) CpG-island No: 20280
ctaacgaaaaacgtttacataactatctcgccaattctatacctcccgaaactaaaaaaaaaccgaaataactaaaaactaacgacaaataccgaccacctccgacgccaaacgccgaacttaaaacccgacgaaccgaattctcgcgaaaacgaccgccgccatttttccattaattacaacgaactaaaaaaaaaaccgacgacgaaaacgactataataacgacgacgacgacgacgaaaccctaaatcgatatctacgcgctaatatctaaaacccaaactaaaacctccgctattactaaaacgcaaacgacgaaaaaaataactaccgctaccattctctcttaaactaacgaaccgccgccaccctccaccctcccccgacaaaacgaaaaaaaacgaccgaaatcaacgataatacccgacgaaaaaaaccaactaatcccgaaaaaaataaaaaaccccaaaaaaaattaaaccttaaacctacgaccgctcgaaacaacacaaacccgaacccgaa

SEQ ID NO: 20281 - DNA, 1459 bp, Artificial Sequence
  chemically treated genomic DNA (Homo sapiens) CpG-island No: 20281
ggtgttttttttcgggttaggtagcgttgaattaaataattttgcgtttagacgcgttttttaaaagcgagttatttttgatcgtttttttcgttttcggttaagagttaggggaaagcggttttgggagcgttatttatttatttcgcgttgaacgttttaagttattatcgtaggttttggtatacgtttcggtttttagatggttcgaggataggtttgggttgcggggggaggggcgatgtgtgttcgagagtttgggaatttgttggcggcggcgaggagagtatttcggaagacgtcgcgagcgtatacgcgtttcggtcggtgtttagagttcggattttgaatttaggttcgcgtttagtttcggttttacgtttgtatttcgttttcggcgagtttttatattatcgtcgcgtgggcggttaagggttaatttttgtttcgcgttttgagattcggggcgtagcgggtcgggtagttcggggcgcgcgtttttcgcgagtttgggggcggcggggtcggcggtcggaaggggcgaggcgcggcggcggcgcggcgggttcgaggcgtttttttaggcgggggcgggggtaggggcgggggcgggcgtcggaggggtttgggcggtttgaaaagcgttcgagtatcgtttttttatcgcgcggtcgtcgcgttatttatacgttttttggttattcggcgcggcgcggcgcggcgcgggggcggggggcgtcgttttaatggggatttcgcggttcggcgtcggggtcgggggcgcggttcggtcgcgggagtcgttcgttgttacgcggtggcggtcggttcggcggttcgggttcggcggtcgtattatgcgggtaatgcggtgtgatatcgcgcgaataaaggcggattgagcggtttagcgggtttcgtcggacggggaaggtatagcggggttgttagcgtcgtttttaggttaattttcgtttcgttttcgtcgttttcgcgttttcggggttgggaatttagcgcggttcggggttcgggcgtcgttgtcgtcgcgagaggtcgtaggtcggtcggaaacgaggggcgttcgttttgtgaattcgttttcggtttttttttttcgaggcgtttttagggttggggcgtttaggattggggcgagtgagcggcgcggttgggatttcgaggtcgggagtataattggacgcgggacgtcgggtttttttgtcgtcgttttcggtcggttttggtagcgtaggcgcggggcgcgggcgggattagttttgtatttttcgttttttcgtcgttggaagtgggacgggtttttttgtaggtggcgtaggagggcgtgggggtcgcggagagcggtcgcgggagttaagaggggtttcgggttttttttttgtagtattcggtttatagtttaggaggggaggcgggcgtttggtttttaaataaattt

SEQ ID NO: 20282 - DNA, 1459 bp, Artificial Sequence
  chemically treated genomic DNA (Homo sapiens) CpG-island No: 20282
aaatttatttaaaaaccaaacgcccgcctcccctcctaaactataaaccgaatactacaaaaaaaaaacccgaaacccctcttaactcccgcgaccgctctccgcgacccccacgccctcctacgccacctacaaaaaaacccgtcccacttccaacgacgaaaaaacgaaaaatacaaaactaatcccgcccgcgccccgcgcctacgctaccaaaaccgaccgaaaacgacgacaaaaaaacccgacgtcccgcgtccaattatactcccgacctcgaaatcccaaccgcgccgctcactcgccccaatcctaaacgccccaaccctaaaaacgcctcgaaaaaaaaaaaccgaaaacgaattcacaaaacgaacgcccctcgtttccgaccgacctacgacctctcgcgacgacaacgacgcccgaaccccgaaccgcgctaaattcccaaccccgaaaacgcgaaaacgacgaaaacgaaacgaaaattaacctaaaaacgacgctaacaaccccgctataccttccccgtccgacgaaacccgctaaaccgctcaatccgcctttattcgcgcgatatcacaccgcattacccgcataatacgaccgccgaacccgaaccgccgaaccgaccgccaccgcgtaacaacgaacgactcccgcgaccgaaccgcgcccccgaccccgacgccgaaccgcgaaatccccattaaaacgacgccccccgcccccgcgccgcgccgcgccgcgccgaataaccaaaaaacgtataaataacgcgacgaccgcgcgataaaaaaacgatactcgaacgcttttcaaaccgcccaaacccctccgacgcccgcccccgcccctacccccgcccccgcctaaaaaaacgcctcgaacccgccgcgccgccgccgcgcctcgccccttccgaccgccgaccccgccgcccccaaactcgcgaaaaacgcgcgccccgaactacccgacccgctacgccccgaatctcaaaacgcgaaacaaaaattaacccttaaccgcccacgcgacgataatataaaaactcgccgaaaacgaaatacaaacgtaaaaccgaaactaaacgcgaacctaaattcaaaatccgaactctaaacaccgaccgaaacgcgtatacgctcgcgacgtcttccgaaatactctcctcgccgccgccaacaaattcccaaactctcgaacacacatcgcccctccccccgcaacccaaacctatcctcgaaccatctaaaaaccgaaacgtataccaaaacctacgataataacttaaaacgttcaacgcgaaataaataaataacgctcccaaaaccgctttcccctaactcttaaccgaaaacgaaaaaaacgatcaaaaataactcgcttttaaaaaacgcgtctaaacgcaaaattatttaattcaacgctacctaacccgaaaaaaaacacc

SEQ ID NO: 20283 - DNA, 1459 bp, Artificial Sequence
  chemically treated genomic DNA (Homo sapiens) CpG-island No: 20283
aaatttatttagaagttaggcgttcgtttttttttttgggttgtgggtcgagtgttgtaagaaggaagttcgggattttttttggttttcgcggtcgtttttcgcggtttttacgtttttttgcgttatttatagaggggttcgttttatttttaacgacgggagggcgaagagtgtagagttggtttcgttcgcgtttcgcgtttgcgttgttagggtcgatcgaggacggcggtaagggggttcgacgtttcgcgtttagttgtgttttcggtttcggggttttagtcgcgtcgtttattcgttttaattttagacgttttagttttgggggcgtttcggggaagaggggtcgagggcgggtttatagggcgggcgtttttcgttttcggtcggtttgcggtttttcgcggcggtagcggcgttcgggtttcgggtcgcgttgggtttttagtttcgggaacgcgggggcggcgggggcggggcggggattagtttgggagcggcgttgatagtttcgttgtgtttttttcgttcggcggggttcgttgggtcgtttaattcgtttttgttcgcgcggtgttatatcgtattattcgtataatgcggtcgtcgggttcgggtcgtcgggtcggtcgttatcgcgtagtaacgggcggttttcgcggtcgggtcgcgttttcggtttcggcgtcgggtcgcgaaatttttattgaagcggcgtttttcgttttcgcgtcgcgtcgcgtcgcgtcgaatggttagagggcgtgtgaatggcgcggcggtcgcgcggtgggggggcggtgttcgggcgttttttaggtcgtttaggttttttcggcgttcgttttcgtttttgttttcgttttcgtttggggaagcgtttcgggttcgtcgcgtcgtcgtcgcgtttcgtttttttcggtcgtcgatttcgtcgtttttagattcgcggaagacgcgcgtttcgggttgttcgattcgttgcgtttcgggttttaaagcgcggggtagagattaatttttggtcgtttacgcggcggtggtgtggggattcgtcgggggcggggtgtaaacgtggggtcggagttgggcgcgaatttgggtttaaggttcgggttttgggtatcgatcggggcgcgtatgcgttcgcggcgtttttcgggatgtttttttcgtcgtcgttagtaaatttttaaattttcgggtatatatcgttttttttttcgtaatttaaatttgttttcgggttatttagggatcggggcgtgtgttagaatttacggtggtgatttaaaacgtttaacgcggagtgaatgggtagcgtttttagagtcgtttttttttggtttttggtcggagacgggaagagcgattagaggtgattcgtttttggggagcgcgtttagacgtagggttgtttgatttagcgttatttggttcgaggaggggtatt

SEQ ID NO: 20284 - DNA, 1459 bp, Artificial Sequence
  chemically treated genomic DNA (Homo sapiens) CpG-island No: 20284
aatacccctcctcgaaccaaataacgctaaatcaaacaaccctacgtctaaacgcgctccccaaaaacgaatcacctctaatcgctcttcccgtctccgaccaaaaaccaaaaaaaaacgactctaaaaacgctacccattcactccgcgttaaacgttttaaatcaccaccgtaaattctaacacacgccccgatccctaaataacccgaaaacaaatttaaattacgaaaaaaaaaacgatatatacccgaaaatttaaaaatttactaacgacgacgaaaaaaacatcccgaaaaacgccgcgaacgcatacgcgccccgatcgatacccaaaacccgaaccttaaacccaaattcgcgcccaactccgaccccacgtttacaccccgcccccgacgaatccccacaccaccgccgcgtaaacgaccaaaaattaatctctaccccgcgctttaaaacccgaaacgcaacgaatcgaacaacccgaaacgcgcgtcttccgcgaatctaaaaacgacgaaatcgacgaccgaaaaaaacgaaacgcgacgacgacgcgacgaacccgaaacgcttccccaaacgaaaacgaaaacaaaaacgaaaacgaacgccgaaaaaacctaaacgacctaaaaaacgcccgaacaccgcccccccaccgcgcgaccgccgcgccattcacacgccctctaaccattcgacgcgacgcgacgcgacgcgaaaacgaaaaacgccgcttcaataaaaatttcgcgacccgacgccgaaaccgaaaacgcgacccgaccgcgaaaaccgcccgttactacgcgataacgaccgacccgacgacccgaacccgacgaccgcattatacgaataatacgatataacaccgcgcgaacaaaaacgaattaaacgacccaacgaaccccgccgaacgaaaaaaacacaacgaaactatcaacgccgctcccaaactaatccccgccccgcccccgccgcccccgcgttcccgaaactaaaaacccaacgcgacccgaaacccgaacgccgctaccgccgcgaaaaaccgcaaaccgaccgaaaacgaaaaacgcccgccctataaacccgccctcgacccctcttccccgaaacgcccccaaaactaaaacgtctaaaattaaaacgaataaacgacgcgactaaaaccccgaaaccgaaaacacaactaaacgcgaaacgtcgaacccccttaccgccgtcctcgatcgaccctaacaacgcaaacgcgaaacgcgaacgaaaccaactctacactcttcgccctcccgtcgttaaaaataaaacgaacccctctataaataacgcaaaaaaacgtaaaaaccgcgaaaaacgaccgcgaaaaccaaaaaaaatcccgaacttccttcttacaacactcgacccacaacccaaaaaaaaaaacgaacgcctaacttctaaataaattt

SEQ ID NO: 20285 - DNA, 920 bp, Artificial Sequence
  chemically treated genomic DNA (Homo sapiens) CpG-island No: 20285
acgcgggaggggtttttggacgtattttttttcgtaaacgttcggttagtttcggcggattcgtagtggagagcggttttaggaggcggcgggcggcggggcggtgggcgttagtgcgtaggcgcggcgcggtagggcggggcggcgggcgcggggcggggcggggcggagtcgggcggggcggggtcggcggtaggcgttgggcgttcggcgcggtggtttagagtgcgcggggcggcgcgcggcgtgtaggtcgtagttgtggttcgggtgttggtaggtgttggcgggattggcggggatcgtcgtggattgttttaggggcgtcgtagttcgttcggttcgagggttcgtttaatcgcgtcgttcgcgttcgttttttttcggttcgcgttcggagcgcgggggtcgtcggcgttgggtattcggcggttatcggggatcggggttgagcggtcggttttcgttttcgtgtcgtcgtcgtcgtttttcggtcgatcgttcggtttggtcgttgttgtcgcgtttggttttcgggttttcgtcgttgggggcgcgggcggggtcgggggttgtcgggcgtcgtttttcgtgcgtttggagtttatatttcgggttcggcggtcggcgagtatggaggagaagtatttgttcgagttgatggcggagaaggattttttggattttttttttacgtacgttttgcgtttggtgaattaaggtgaggcgtcggtcgttaattgtcggtcggcggcggttgggggtcgggtggaaacgcgggggtttagggggttttttcgtgttttttgttgttagcggacgcggcggagacggaggttcgggtggttttcggggtcgtttgtacggggatttgggaggttgtgggatatttaggggaagattttgatgtgaattttggg

SEQ ID NO: 20286 - DNA, 920 bp, Artificial Sequence
  chemically treated genomic DNA (Homo sapiens) CpG-island No: 20286
cccaaaattcacatcaaaatcttcccctaaatatcccacaacctcccaaatccccgtacaaacgaccccgaaaaccacccgaacctccgtctccgccgcgtccgctaacaacaaaaaacacgaaaaaaccccctaaacccccgcgtttccacccgacccccaaccgccgccgaccgacaattaacgaccgacgcctcaccttaattcaccaaacgcaaaacgtacgtaaaaaaaaaatccaaaaaatccttctccgccatcaactcgaacaaatacttctcctccatactcgccgaccgccgaacccgaaatataaactccaaacgcacgaaaaacgacgcccgacaacccccgaccccgcccgcgcccccaacgacgaaaacccgaaaaccaaacgcgacaacaacgaccaaaccgaacgatcgaccgaaaaacgacgacgacgacacgaaaacgaaaaccgaccgctcaaccccgatccccgataaccgccgaatacccaacgccgacgacccccgcgctccgaacgcgaaccgaaaaaaaacgaacgcgaacgacgcgattaaacgaaccctcgaaccgaacgaactacgacgcccctaaaacaatccacgacgatccccgccaatcccgccaacacctaccaacacccgaaccacaactacgacctacacgccgcgcgccgccccgcgcactctaaaccaccgcgccgaacgcccaacgcctaccgccgaccccgccccgcccgactccgccccgccccgccccgcgcccgccgccccgccctaccgcgccgcgcctacgcactaacgcccaccgccccgccgcccgccgcctcctaaaaccgctctccactacgaatccgccgaaactaaccgaacgtttacgaaaaaaaatacgtccaaaaacccctcccgcgt

SEQ ID NO: 20287 - DNA, 920 bp, Artificial Sequence
  chemically treated genomic DNA (Homo sapiens) CpG-island No: 20287
tttaaaatttatattagggtttttttttaggtgttttatagttttttaggttttcgtgtaaacgatttcgggggttattcgggttttcgttttcgtcgcgttcgttgatagtagagggtacggaggggttttttgggttttcgcgtttttattcggtttttaatcgtcgtcggtcggtagttaacggtcggcgttttattttggtttattaggcgtagggcgtgcgtgaaggaggggtttagggagttttttttcgttattagttcgggtaggtattttttttttatgttcgtcggtcgtcgggttcgggatgtggattttaggcgtacggggggcggcgttcggtaattttcgatttcgttcgcgtttttagcggcggggattcgggggttagacgcggtagtagcggttaagtcgggcggtcggtcggaaggcggcggcggcggtacgggggcgggaatcgatcgtttagtttcgattttcggtggtcgtcgagtatttagcgtcggcggttttcgcgtttcgggcgcgggtcgaggaggagcgggcgcgggcggcgcggttaggcgggttttcgggtcgagcgggttgcggcgtttttgaggtagtttacggcgattttcgttagtttcgttagtatttgttagtattcgagttatagttgcgatttgtacgtcgcgcgtcgtttcgcgtattttgagttatcgcgtcgagcgtttagcgtttgtcgtcggtttcgtttcgttcggtttcgtttcgtttcgtttcgcgttcgtcgtttcgttttgtcgcgtcgcgtttgcgtattggcgtttatcgtttcgtcgttcgtcgttttttggggtcgttttttattgcgagttcgtcgggattaatcgggcgtttgcgagagggggtgcgtttaagggtttttttcgcgt

SEQ ID NO: 20288 - DNA, 920 bp, Artificial Sequence
  chemically treated genomic DNA (Homo sapiens) CpG-island No: 20288
acgcgaaaaaaacccttaaacgcaccccctctcgcaaacgcccgattaatcccgacgaactcgcaataaaaaacgaccccaaaaaacgacgaacgacgaaacgataaacgccaatacgcaaacgcgacgcgacaaaacgaaacgacgaacgcgaaacgaaacgaaacgaaaccgaacgaaacgaaaccgacgacaaacgctaaacgctcgacgcgataactcaaaatacgcgaaacgacgcgcgacgtacaaatcgcaactataactcgaatactaacaaatactaacgaaactaacgaaaatcgccgtaaactacctcaaaaacgccgcaacccgctcgacccgaaaacccgcctaaccgcgccgcccgcgcccgctcctcctcgacccgcgcccgaaacgcgaaaaccgccgacgctaaatactcgacgaccaccgaaaatcgaaactaaacgatcgattcccgcccccgtaccgccgccgccgccttccgaccgaccgcccgacttaaccgctactaccgcgtctaacccccgaatccccgccgctaaaaacgcgaacgaaatcgaaaattaccgaacgccgccccccgtacgcctaaaatccacatcccgaacccgacgaccgacgaacataaaaaaaaaatacctacccgaactaataacgaaaaaaaactccctaaacccctccttcacgcacgccctacgcctaataaaccaaaataaaacgccgaccgttaactaccgaccgacgacgattaaaaaccgaataaaaacgcgaaaacccaaaaaacccctccgtaccctctactatcaacgaacgcgacgaaaacgaaaacccgaataacccccgaaatcgtttacacgaaaacctaaaaaactataaaacacctaaaaaaaaaccctaatataaattttaaa

SEQ ID NO: 20289 - DNA, 528 bp, Artificial Sequence
  chemically treated genomic DNA (Homo sapiens) CpG-island No: 20289
gcgtatattgggggtttttcgcgtcgggaatcggatgttagttaaatgtcggggttgggaagtaaaaaagtttttatttttcggttttcgttttttttcgagtttttcggcgtttcgtaaaagtagttggtttaggtagtttcggggatttttaggggtatttggttttttcgcggcggtttaataaaaaggggcgcgacgcgagcgtttttcgtcgacgttttaagttattagcgttcgggcgatataggtttcgagggtgcgcgtcgttagcggttggtgcgcgtcgattttcgtcgtcgtttttttcgtagggtttcgaggttcgggtagttttggtttttcgtttgttatcggtttatttggggttgttgttgttttagtagatagcgtaacggtcggcgacggttttggagttcgggttttggttgaatatatatatttagagtattagaaatattagcgtgaatatttttacgtgtaatattacgtttggtttagcgtcggagttttcgattcgttatttcg

SEQ ID NO: 20290 - DNA, 528 bp, Artificial Sequence
  chemically treated genomic DNA (Homo sapiens) CpG-island No: 20290
cgaaataacgaatcgaaaactccgacgctaaaccaaacgtaatattacacgtaaaaatattcacgctaatatttctaatactctaaatatatatattcaaccaaaacccgaactccaaaaccgtcgccgaccgttacgctatctactaaaacaacaacaaccccaaataaaccgataacaaacgaaaaaccaaaactacccgaacctcgaaaccctacgaaaaaaacgacgacgaaaatcgacgcgcaccaaccgctaacgacgcgcaccctcgaaacctatatcgcccgaacgctaataacttaaaacgtcgacgaaaaacgctcgcgtcgcgcccctttttattaaaccgccgcgaaaaaaccaaatacccctaaaaatccccgaaactacctaaaccaactacttttacgaaacgccgaaaaactcgaaaaaaaacgaaaaccgaaaaataaaaacttttttacttcccaaccccgacatttaactaacatccgattcccgacgcgaaaaacccccaatatacgc

SEQ ID NO: 20291 - DNA, 528 bp, Artificial Sequence
  chemically treated genomic DNA (Homo sapiens) CpG-island No: 20291
cggagtggcgggtcgggggtttcggcgttgggttaggcgtgatgttgtacgtggagatgtttacgttggtgtttttggtgttttggatgtgtgtgtttagttaggattcgggttttaaggtcgtcgtcgatcgttacgttgtttattggaatagtagtaattttaggtaagtcgataataggcggagagttagggttattcgggtttcggggttttgcggaaggagcggcggcggggatcggcgcgtattaatcgttggcggcgcgtattttcggagtttgtgtcgttcgggcgttgatggtttgaggcgtcggcgggaagcgttcgcgtcgcgtttttttttgttaagtcgtcgcggaaaggttaggtatttttgggagttttcggggttgtttagattaattgtttttgcggggcgtcgggagattcggaaaagggcgggagtcggggagtagggatttttttgttttttagtttcggtatttggttggtattcggttttcggcgcggggagtttttagtgtgcgt

SEQ ID NO: 20292 - DNA, 528 bp, Artificial Sequence
  chemically treated genomic DNA (Homo sapiens) CpG-island No: 20292
acgcacactaaaaactccccgcgccgaaaaccgaataccaaccaaataccgaaactaaaaaacaaaaaaatccctactccccgactcccgcccttttccgaatctcccgacgccccgcaaaaacaattaatctaaacaaccccgaaaactcccaaaaatacctaacctttccgcgacgacttaacaaaaaaaaacgcgacgcgaacgcttcccgccgacgcctcaaaccatcaacgcccgaacgacacaaactccgaaaatacgcgccgccaacgattaatacgcgccgatccccgccgccgctccttccgcaaaaccccgaaacccgaataaccctaactctccgcctattatcgacttacctaaaattactactattccaataaacaacgtaacgatcgacgacgaccttaaaacccgaatcctaactaaacacacacatccaaaacaccaaaaacaccaacgtaaacatctccacgtacaacatcacgcctaacccaacgccgaaacccccgacccgccactccg

SEQ ID NO: 20293 - DNA, 566 bp, Artificial Sequence
  chemically treated genomic DNA (Homo sapiens) CpG-island No: 20293
tcggttttcgttttttttcgagtttttcggcgtttcgtagaagtagttggtttaggtagtttcggggatttttaggggtatttggttttttcgcggcggtttaataaagaggggcgcgacgcgagcgtttttcgtcgacgttttaagttattagcgttcgggcgacgtaggtttcgagggtgcgcgtcgttagcggttggtgcgcgtcgattttcgtcgtcgtttttttcgtagggtttcgaggttcgggtagttttggtttttcgtttgttatcggtttatttggggttgttgttgttttagtagatagcgtagcggtcggcgacggttttggagttcgggttttggttgaatatatatatttagagtattagaaatattagcgttaatatttttacgtgtaatattacgtttggttagcggcggagttttcgacgcgttatttcggggagagagcggggattcggagggagggaggtaggtaaagggatagagagagagcgggcgttaaataaatatgaataaataaaaatgaaagtgggcgagaaaggaaagaggcgtttatt

SEQ ID NO: 20294 - DNA, 566 bp, Artificial Sequence
  chemically treated genomic DNA (Homo sapiens) CpG-island No: 20294
aataaacgcctctttcctttctcgcccactttcatttttatttattcatatttatttaacgcccgctctctctctatccctttacctacctccctccctccgaatccccgctctctccccgaaataacgcgtcgaaaactccgccgctaaccaaacgtaatattacacgtaaaaatattaacgctaatatttctaatactctaaatatatatattcaaccaaaacccgaactccaaaaccgtcgccgaccgctacgctatctactaaaacaacaacaaccccaaataaaccgataacaaacgaaaaaccaaaactacccgaacctcgaaaccctacgaaaaaaacgacgacgaaaatcgacgcgcaccaaccgctaacgacgcgcaccctcgaaacctacgtcgcccgaacgctaataacttaaaacgtcgacgaaaaacgctcgcgtcgcgcccctctttattaaaccgccgcgaaaaaaccaaatacccctaaaaatccccgaaactacctaaaccaactacttctacgaaacgccgaaaaactcgaaaaaaaacgaaaaccga

SEQ ID NO: 20295 - DNA, 566 bp, Artificial Sequence
  chemically treated genomic DNA (Homo sapiens) CpG-island No: 20295
ggtgggcgttttttttttttttcgtttatttttatttttatttatttatatttatttggcgttcgttttttttttgtttttttgtttgttttttttttttcggattttcgtttttttttcggagtggcgcgtcgggggtttcgtcgttggttaggcgtgatgttgtacgtggagatgttgacgttggtgtttttggtgttttggatgtgtgtgtttagttaggattcgggttttaaggtcgtcgtcgatcgttacgttgtttattggaatagtagtaattttaggtaagtcgataataggcggagagttagggttattcgggtttcggggttttgcggaaggagcggcggcggggatcggcgcgtattaatcgttggcggcgcgtattttcggagtttgcgtcgttcgggcgttgatggtttgaggcgtcggcgggaagcgttcgcgtcgcgtttttttttgttaagtcgtcgcggaaaggttaggtatttttgggagttttcggggttgtttagattaattgtttttgcggggcgtcgggagattcggaaaagggcgggagtcgg

SEQ ID NO: 20296 - DNA, 566 bp, Artificial Sequence
  chemically treated genomic DNA (Homo sapiens) CpG-island No: 20296
ccgactcccgcccttttccgaatctcccgacgccccgcaaaaacaattaatctaaacaaccccgaaaactcccaaaaatacctaacctttccgcgacgacttaacaaaaaaaaacgcgacgcgaacgcttcccgccgacgcctcaaaccatcaacgcccgaacgacgcaaactccgaaaatacgcgccgccaacgattaatacgcgccgatccccgccgccgctccttccgcaaaaccccgaaacccgaataaccctaactctccgcctattatcgacttacctaaaattactactattccaataaacaacgtaacgatcgacgacgaccttaaaacccgaatcctaactaaacacacacatccaaaacaccaaaaacaccaacgtcaacatctccacgtacaacatcacgcctaaccaacgacgaaacccccgacgcgccactccgaaaaaaaaacgaaaatccgaaaaaaaaaaaacaaacaaaaaaacaaaaaaaaaacgaacgccaaataaatataaataaataaaaataaaaataaacgaaaaaaaaaaaaaacgcccacc

SEQ ID NO: 20297 - DNA, 848 bp, Artificial Sequence
  chemically treated genomic DNA (Homo sapiens) CpG-island No: 20297
cgattcgcgcggggttggttcgagggcggaggtaattcgtcggcgacgtcgtaggtttcgggtggttgacgtcgttcgggggcgtttttgggagttgggggtcggcgaggttggattcgacgcgttcgggaggagtcggtcggcggttacgtgatttatcgcggcggggtcggcggtttagaaatagtagcggcggcggtttcgttcgcgggcggcgcgagcgaggggtagaggcgagagacgtcggcggggcgcgggcgcggcggtttcggaggatgttgttgagtttcggtattgtttggttgcgagtatatgatggcgatacgggagtttaaagtgtgttttttcggggtgagttttggtcgttattcgtcggcggatttcggttcgcgttttcgcgttttttcgtttttttattttttgcgcgtttagttttcgtgattttttcgtttttcgtatttttttcgtagttttcgtttttttcgttcgcgcgttttttggtttttcgggtttttttggtttttttagttcgtgcgtttttcgtttttcgcgtttttcgtttttcgtatttcgtttgtttttcgttttttcgtcgttcgtgcgttttttttggttcgttttcgtttttattttgtcggggttcgggttcgagtttgtttcgggtttatttcgtttttttttttcggttcgcgagttttcggattcgcggcgatttcgcggggatttttagcggggacggggtagtggcggcgagtttggggtttcgagggttttttttttcgtttttgatagttttttttcggtagaaagtttaagttgtttagttaagtcgttgagtgtttttttgt

SEQ ID NO: 20298 - DNA, 848 bp, Artificial Sequence
  chemically treated genomic DNA (Homo sapiens) CpG-island No: 20298
acaaaaaaacactcaacgacttaactaaacaacttaaactttctaccgaaaaaaaactatcaaaaacgaaaaaaaaaaccctcgaaaccccaaactcgccgccactaccccgtccccgctaaaaatccccgcgaaatcgccgcgaatccgaaaactcgcgaaccgaaaaaaaaaaacgaaataaacccgaaacaaactcgaacccgaaccccgacaaaataaaaacgaaaacgaaccaaaaaaaacgcacgaacgacgaaaaaacgaaaaacaaacgaaatacgaaaaacgaaaaacgcgaaaaacgaaaaacgcacgaactaaaaaaaccaaaaaaacccgaaaaaccaaaaaacgcgcgaacgaaaaaaacgaaaactacgaaaaaaatacgaaaaacgaaaaaatcacgaaaactaaacgcgcaaaaaataaaaaaacgaaaaaacgcgaaaacgcgaaccgaaatccgccgacgaataacgaccaaaactcaccccgaaaaaacacactttaaactcccgtatcgccatcatatactcgcaaccaaacaataccgaaactcaacaacatcctccgaaaccgccgcgcccgcgccccgccgacgtctctcgcctctacccctcgctcgcgccgcccgcgaacgaaaccgccgccgctactatttctaaaccgccgaccccgccgcgataaatcacgtaaccgccgaccgactcctcccgaacgcgtcgaatccaacctcgccgacccccaactcccaaaaacgcccccgaacgacgtcaaccacccgaaacctacgacgtcgccgacgaattacctccgccctcgaaccaaccccgcgcgaatcg

SEQ ID NO: 20299 - DNA, 848 bp, Artificial Sequence
  chemically treated genomic DNA (Homo sapiens) CpG-island No: 20299
gtaaaagagtatttagcgatttggttgagtaatttaaattttttgtcggaaggaaattattaaaagcggaggagaaagttttcggggttttagattcgtcgttattgtttcgttttcgttgggggttttcgcgaggtcgtcgcggattcggggattcgcgggtcgggaggaaagagcggagtaagttcggggtaggttcggattcggatttcggtagggtgagagcgggggcggattagagggggcgtacggacggcggggaggcggagaataggcggggtgcggagagcgaggggcgcggagagcgaggggcgtacggattaggggagttagggggattcggggaattagggggcgcgcggacgagggggacgggggttacgagaggggtgcggagagcgaggggattacggggattgagcgcgtagggaataggggagcgaaggggcgcgagagcgcgggtcggggttcgtcggcgggtggcggttaggatttatttcgagaaggtatattttgagttttcgtatcgttattatgtgttcgtagttaggtagtgtcggggtttagtagtatttttcggggtcgtcgcgttcgcgtttcgtcggcgtttttcgtttttgtttttcgttcgcgtcgttcgcgggcggaatcgtcgtcgttgttatttttgggtcgtcggtttcgtcgcggtgggttacgtggtcgtcggtcggtttttttcgggcgcgtcgggtttagtttcgtcggtttttagtttttaggaacgttttcggacggcgttagttattcgggatttgcggcgtcgtcggcggattgttttcgttttcggattagtttcgcgcgggtcg

SEQ ID NO: 20300 - DNA, 848 bp, Artificial Sequence
  chemically treated genomic DNA (Homo sapiens) CpG-island No: 20300
cgacccgcgcgaaactaatccgaaaacgaaaacaatccgccgacgacgccgcaaatcccgaataactaacgccgtccgaaaacgttcctaaaaactaaaaaccgacgaaactaaacccgacgcgcccgaaaaaaaccgaccgacgaccacgtaacccaccgcgacgaaaccgacgacccaaaaataacaacgacgacgattccgcccgcgaacgacgcgaacgaaaaacaaaaacgaaaaacgccgacgaaacgcgaacgcgacgaccccgaaaaatactactaaaccccgacactacctaactacgaacacataataacgatacgaaaactcaaaatataccttctcgaaataaatcctaaccgccacccgccgacgaaccccgacccgcgctctcgcgccccttcgctcccctattccctacgcgctcaatccccgtaatcccctcgctctccgcacccctctcgtaacccccgtccccctcgtccgcgcgccccctaattccccgaatccccctaactcccctaatccgtacgcccctcgctctccgcgcccctcgctctccgcaccccgcctattctccgcctccccgccgtccgtacgccccctctaatccgcccccgctctcaccctaccgaaatccgaatccgaacctaccccgaacttactccgctctttcctcccgacccgcgaatccccgaatccgcgacgacctcgcgaaaacccccaacgaaaacgaaacaataacgacgaatctaaaaccccgaaaactttctcctccgcttttaataatttccttccgacaaaaaatttaaattactcaaccaaatcgctaaatactcttttac

SEQ ID NO: 20301 - DNA, 696 bp, Artificial Sequence
  chemically treated genomic DNA (Homo sapiens) CpG-island No: 20301
cgtaggttcgtttttatcgtttttgggtttagattcgtcggttggtttcgtcgaggcggagcggggcggttgttgttttttgttgttgttcgaagaggcggaggagttgttggagtcgttgtttttgtttatgtcggaggcggtggcggcggcgttgggggagtttagcggtattaacgggggtttcggcggcgacggtagtcggagcggagcgggcgcggcggggatttaggtttatggcgtttagggtcggcgggggtcggcggcggtagcggttttcggtttttatggcgatatttttttttgtttttttttttggttttttaaattaggaagagaagcggcggacggggttgttaagttcggcggtagcggcgatcgaggacgaggaggtcggggttcgggagttcgggtcgggtttggcggggcggaggttgcgggggaaggggaggcgagggaggttgcgcgagtttcgtcggtcggtcggtcggatacgttttttcgtcgcgaggtaggggagagggttggttgtttcggtgtcggggattagtgttttcgatatagtaacggatattcgtttttgggtcgaggtcgatttgtttcgggaatggcgacgagtcgttaaatagtattttaaagaattcggatggattgtatatatagtggagagggggtgaggtattttgggaaatgtag

SEQ ID NO: 20302 - DNA, 696 bp, Artificial Sequence
  chemically treated genomic DNA (Homo sapiens) CpG-island No: 20302
ctacatttcccaaaatacctcaccccctctccactatatatacaatccatccgaattctttaaaatactatttaacgactcgtcgccattcccgaaacaaatcgacctcgacccaaaaacgaatatccgttactatatcgaaaacactaatccccgacaccgaaacaaccaaccctctcccctacctcgcgacgaaaaaacgtatccgaccgaccgaccgacgaaactcgcgcaacctccctcgcctccccttcccccgcaacctccgccccgccaaacccgacccgaactcccgaaccccgacctcctcgtcctcgatcgccgctaccgccgaacttaacaaccccgtccgccgcttctcttcctaatttaaaaaaccaaaaaaaaaaacaaaaaaaaatatcgccataaaaaccgaaaaccgctaccgccgccgacccccgccgaccctaaacgccataaacctaaatccccgccgcgcccgctccgctccgactaccgtcgccgccgaaacccccgttaataccgctaaactcccccaacgccgccgccaccgcctccgacataaacaaaaacaacgactccaacaactcctccgcctcttcgaacaacaacaaaaaacaacaaccgccccgctccgcctcgacgaaaccaaccgacgaatctaaacccaaaaacgataaaaacgaacctacg

SEQ ID NO: 20303 - DNA, 696 bp, Artificial Sequence
  chemically treated genomic DNA (Homo sapiens) CpG-island No: 20303
ttatattttttagaatattttattttttttttattatatatatagtttattcgggttttttgagatgttgtttggcgattcgtcgttattttcggagtaggtcggtttcggtttaggggcgagtattcgttgttgtgtcggagatattagttttcgatatcgagatagttagtttttttttttgtttcgcggcgggagagcgtgttcggtcggtcggtcggcggggttcgcgtaatttttttcgtttttttttttttcgtagttttcgtttcgttaggttcggttcggattttcgagtttcggttttttcgttttcggtcgtcgttgtcgtcgggtttaatagtttcgttcgtcgtttttttttttagtttgagaagttaaggaaggaaatagggaaaaatgtcgttatgaaggtcgagaatcgttgtcgtcgtcgattttcgtcggttttgaacgttatgagtttgggttttcgtcgcgttcgtttcgtttcgattgtcgtcgtcgtcgaggttttcgttgatgtcgttgagtttttttaacgtcgtcgttatcgttttcgatatggataagaatagcggttttaatagttttttcgttttttcgggtagtagtaaagggtaatagtcgtttcgtttcgtttcggcggggttagtcggcgagtttaaatttaagagcggtaaggacgggtttgcg

SEQ ID NO: 20304 - DNA, 696 bp, Artificial Sequence
  chemically treated genomic DNA (Homo sapiens) CpG-island No: 20304
cgcaaacccgtccttaccgctcttaaatttaaactcgccgactaaccccgccgaaacgaaacgaaacgactattaccctttactactacccgaaaaaacgaaaaaactattaaaaccgctattcttatccatatcgaaaacgataacgacgacgttaaaaaaactcaacgacatcaacgaaaacctcgacgacgacgacaatcgaaacgaaacgaacgcgacgaaaacccaaactcataacgttcaaaaccgacgaaaatcgacgacgacaacgattctcgaccttcataacgacatttttccctatttccttccttaacttctcaaactaaaaaaaaaaacgacgaacgaaactattaaacccgacgacaacgacgaccgaaaacgaaaaaaccgaaactcgaaaatccgaaccgaacctaacgaaacgaaaactacgaaaaaaaaaaaaacgaaaaaaattacgcgaaccccgccgaccgaccgaccgaacacgctctcccgccgcgaaacaaaaaaaaaaactaactatctcgatatcgaaaactaatatctccgacacaacaacgaatactcgcccctaaaccgaaaccgacctactccgaaaataacgacgaatcgccaaacaacatctcaaaaaacccgaataaactatatatataataaaaaaaaaataaaatattctaaaaaatataa

SEQ ID NO: 20305 - DNA, 687 bp, Artificial Sequence
  chemically treated genomic DNA (Homo sapiens) CpG-island No: 20305
ttgcgtttcgtaggttttgggcgttatttacgttagtgagtgtttataagtttgtgaggtaggcggcgttatagagagaaattgaggcgcgggagtttaagttatttgtttagcgttttagtcgagcgcgaatcgcgttcggggatggtatttatacggttcggttttaggttttttttgttagcgttcgaaggtttttcgtatttttagggggcgtcggtttgcgcgtacgcgtaatggtcgtagtcgcgttttttttaagaggattttttttgttttcgtcgattttttcgttttcgtttcgcgtttttataatgtagtgcggttgagcgtttcggagttcgcggggacgttgcggggggattcgtgttgaggcggcggcggcgacgtgggttgcggcgggttcgcggcgtcgggcggtgcggatgtcgggttgggcggacgagcgcggcggcgagggcgacgggcgtatttacgtggggaatttttcgatcgacgtgcgcgagaaggatttggaggatttgttttataagtacggtcgtattcgcgagatcgagtttaagaatcggtacggtttcgtgtttttcgttttcgtgcgtttcgaggattttcggtgaggttttcgcgtttttgttttttttttttcggtgtttgaggttttcgttttttttgttgttttttttttta

SEQ ID NO: 20306 - DNA, 687 bp, Artificial Sequence
  chemically treated genomic DNA (Homo sapiens) CpG-island No: 20306
taaaaaaaaaaacaacaaaaaaaacgaaaacctcaaacaccgaaaaaaaaaaaacaaaaacgcgaaaacctcaccgaaaatcctcgaaacgcacgaaaacgaaaaacacgaaaccgtaccgattcttaaactcgatctcgcgaatacgaccgtacttataaaacaaatcctccaaatccttctcgcgcacgtcgatcgaaaaattccccacgtaaatacgcccgtcgccctcgccgccgcgctcgtccgcccaacccgacatccgcaccgcccgacgccgcgaacccgccgcaacccacgtcgccgccgccgcctcaacacgaatccccccgcaacgtccccgcgaactccgaaacgctcaaccgcactacattataaaaacgcgaaacgaaaacgaaaaaatcgacgaaaacaaaaaaaatcctcttaaaaaaaacgcgactacgaccattacgcgtacgcgcaaaccgacgccccctaaaaatacgaaaaaccttcgaacgctaacaaaaaaaacctaaaaccgaaccgtataaataccatccccgaacgcgattcgcgctcgactaaaacgctaaacaaataacttaaactcccgcgcctcaatttctctctataacgccgcctacctcacaaacttataaacactcactaacgtaaataacgcccaaaacctacgaaacgcaa

SEQ ID NO: 20307 - DNA, 687 bp, Artificial Sequence
  chemically treated genomic DNA (Homo sapiens) CpG-island No: 20307
tgggggaggggatagtagggaaggcgggggttttaggtatcgaggaggagagggtaggggcgcgggggttttatcgggggttttcgaagcgtacgaaggcgaagggtacgaggtcgtgtcggtttttgagttcgatttcgcggatgcggtcgtatttgtagaataggttttttaagtttttttcgcgtacgtcggtcggaaggttttttacgtagatgcgttcgtcgttttcgtcgtcgcgttcgttcgtttagttcgatattcgtatcgttcgacgtcgcgggttcgtcgtagtttacgtcgtcgtcgtcgttttagtacgggttttttcgtagcgttttcgcgggtttcgaggcgtttagtcgtattgtattgtgggaacgcggagcggaagcgaaggggtcggcggaggtaaaaggagtttttttaaagagaacgcggttgcgattattgcgcgtgcgcgtaggtcggcgttttttggaggtgcgaagggttttcgggcgttgatagggagagtttggggtcgggtcgtgtggatgttattttcgagcgcggttcgcgttcggttgaggcgttggataagtggtttgggttttcgcgttttagtttttttttgtggcgtcgtttattttatagatttgtgagtatttattgacgtgggtagcgtttagggtttgcggggcgtag

SEQ ID NO: 20308 - DNA, 687 bp, Artificial Sequence
  chemically treated genomic DNA (Homo sapiens) CpG-island No: 20308
ctacgccccgcaaaccctaaacgctacccacgtcaataaatactcacaaatctataaaataaacgacgccacaaaaaaaaactaaaacgcgaaaacccaaaccacttatccaacgcctcaaccgaacgcgaaccgcgctcgaaaataacatccacacgacccgaccccaaactctccctatcaacgcccgaaaacccttcgcacctccaaaaaacgccgacctacgcgcacgcgcaataatcgcaaccgcgttctctttaaaaaaactccttttacctccgccgaccccttcgcttccgctccgcgttcccacaatacaatacgactaaacgcctcgaaacccgcgaaaacgctacgaaaaaacccgtactaaaacgacgacgacgacgtaaactacgacgaacccgcgacgtcgaacgatacgaatatcgaactaaacgaacgaacgcgacgacgaaaacgacgaacgcatctacgtaaaaaaccttccgaccgacgtacgcgaaaaaaacttaaaaaacctattctacaaatacgaccgcatccgcgaaatcgaactcaaaaaccgacacgacctcgtacccttcgccttcgtacgcttcgaaaacccccgataaaacccccgcgcccctaccctctcctcctcgatacctaaaacccccgccttccctactatcccctccccca

SEQ ID NO: 20309 - DNA, 609 bp, Artificial Sequence
  chemically treated genomic DNA (Homo sapiens) CpG-island No: 20309
acgcgggcgcgttgtcggggttggagacgtttgaaattggagagcgtattcggattttatttttcgtttttagggagcgtgtgcgggtggaataattgtgtgtgagtgcgtgattttttgtatttcgagtggtagtttttagttaggttgagcgtttttaattcgcggtacgtatatttttttttttaaattattttttattcgtttttcgttgttatttttagttcgcgcgtggtttagttttgcgtttatggggttttaattttttttattttggatcgatgggggtagtttttagtttttttcgacgaggtcgaggtttcgttagtttttaaggagtcgagggtatcgattcggttgggggcggagggcggggagagaagattgcgattttgggattggttcggttgggtgtatgtggttttcggcgagtagttttcgttttcgtttcgtaatcgtcgtcgtatttttaggggagcgcggaggaggaatcgtttttttatttcgtggtttacgaaggggtgggggttaggagcggtttttttcgtttcgttcgtttttgttttgacggcgtagttcgtttttaggatagttattgttatggagatt

SEQ ID NO: 20310 - DNA, 609 bp, Artificial Sequence
  chemically treated genomic DNA (Homo sapiens) CpG-island No: 20310
aatctccataacaataactatcctaaaaacgaactacgccgtcaaaacaaaaacgaacgaaacgaaaaaaaccgctcctaacccccaccccttcgtaaaccacgaaataaaaaaacgattcctcctccgcgctcccctaaaaatacgacgacgattacgaaacgaaaacgaaaactactcgccgaaaaccacatacacccaaccgaaccaatcccaaaatcgcaatcttctctccccgccctccgcccccaaccgaatcgataccctcgactccttaaaaactaacgaaacctcgacctcgtcgaaaaaaactaaaaactacccccatcgatccaaaataaaaaaaattaaaaccccataaacgcaaaactaaaccacgcgcgaactaaaaataacaacgaaaaacgaataaaaaataatttaaaaaaaaaaatatacgtaccgcgaattaaaaacgctcaacctaactaaaaactaccactcgaaatacaaaaaatcacgcactcacacacaattattccacccgcacacgctccctaaaaacgaaaaataaaatccgaatacgctctccaatttcaaacgtctccaaccccgacaacgcgcccgcgt

SEQ ID NO: 20311 - DNA, 609 bp, Artificial Sequence
  chemically treated genomic DNA (Homo sapiens) CpG-island No: 20311
ggtttttatggtaatggttgttttgggagcggattgcgtcgttagggtagagacggacggggcgggggagatcgtttttgatttttattttttcgtgggttacgaagtaggggagcggtttttttttcgcgtttttttgggaatgcggcggcggttgcggggcgggggcgggggttgttcgtcgggggttatatgtatttaatcgggttaattttaaagtcgtagtttttttttttcgtttttcgtttttaatcgagtcggtgttttcggttttttagaaattggcgggatttcggtttcgtcggggaagattgaaagttgtttttatcggtttagggtgaaaggaattgggattttatgagcgtagaattggattacgcgcgagttaggggtggtagcgaaaggcggatgaggagtaatttgggggagggggtatacgtgtcgcggattgggggcgtttagtttggttgggaattgttattcgaagtgtagagaattacgtatttatatataattgttttattcgtatacgttttttgggaacgaggggtggggttcgagtgcgttttttaattttagacgtttttaatttcgataacgcgttcgcgt

SEQ ID NO: 20312 - DNA, 609 bp, Artificial Sequence
  chemically treated genomic DNA (Homo sapiens) CpG-island No: 20312
acgcgaacgcgttatcgaaattaaaaacgtctaaaattaaaaaacgcactcgaaccccacccctcgttcccaaaaaacgtatacgaataaaacaattatatataaatacgtaattctctacacttcgaataacaattcccaaccaaactaaacgcccccaatccgcgacacgtataccccctcccccaaattactcctcatccgcctttcgctaccacccctaactcgcgcgtaatccaattctacgctcataaaatcccaattcctttcaccctaaaccgataaaaacaactttcaatcttccccgacgaaaccgaaatcccgccaatttctaaaaaaccgaaaacaccgactcgattaaaaacgaaaaacgaaaaaaaaaaactacgactttaaaattaacccgattaaatacatataacccccgacgaacaacccccgcccccgccccgcaaccgccgccgcattcccaaaaaaacgcgaaaaaaaaaccgctcccctacttcgtaacccacgaaaaaataaaaatcaaaaacgatctcccccgccccgtccgtctctaccctaacgacgcaatccgctcccaaaacaaccattaccataaaaacc

SEQ ID NO: 20313 - DNA, 1383 bp, Artificial Sequence
  chemically treated genomic DNA (Homo sapiens) CpG-island No: 20313
  misc_feature (1195)..(1195): n is either a, c, g or t
  misc_feature (1229)..(1229): n is either a, c, g or t
gttttggcgtggttcggttttcgcgagaggggaggaggcggaggaacggcgttagtagtttgaggagcggcgcgtttcgttagggttggaggtaggcgtgtacggcgggcgttatcgtcgttgcgggggagcggggggttgttttgggtgcgggtgagtggtacggcggttttaaattacgaggattgaggggcgtcggatatcgggaaagcggcgagagattcgggagagggtcgagtttttgttttcgacgtttggtggcgggttaggagcggagttcggagtagcgagtaattaatatttttaggcgggaggttcggggaaggagcggcgatacgttaggcgtgcggtttaggagcggcggggtagtcggagttttcgggatagcggagtaggaatttcgggattttcggttgtagtcgtttacgcgcggagggagaggtattagagcgcgggcggaggtcggagtttcgcggggcgcgagaataggggcgttttcgtgcggaattgttaggttgttcgggcgcggcggtcggggttatgtttaaatttaaggatttgtgttttcgagcggggacgcgtatttttttggaggttatgtaggcgggtaaagtgtatttggttcgtttcgtgttggatgcgttggatcgtagtattatcgattgtcgcgcggagtagggtcgtacgtcgtttatggtggtcgtggggttgtcggatttcgcgttgcgcgcgcgtttcgtgcggttgttgttcgagtagggtgttgtagtgaatttgcgagacgagcgcggtcgtatcgtatttagtttggcgtgcgagcgaggttatttggacgtcgtgtagttgttggtgtagtttagcggtgatttcgaggcggtcgattttgcgggtaatagttcggtgatgtgggcggcggtttgcggttacggggcggtgttcgagtttttggtgcggttttttcgtcgtttaggtttgcgtttcgatcgtattaatcgtgcggggtttatcgagttgtaattggtcgttttttcggggttacgggatttgtgtgtaggtttttatcgggttttggggtcgcgtcggcgtcgtcgttgtagttcggggttttaatttcgatagtttttttggtcgatcggttttcgcggttagtttcgagtatcgacgatttagttttcgtcgtttttcgcgggttttnttggcgcgttttgcgcgagcggcgggcggttatngcggcgaggtttgtttaacgggtaagaatttcgggtcgtatcgggcgtagggtagcgaacgggtcgagtttgggtcggagtatgaatttggttttaggtgcggtattcgaggaggaggttgtttcgtttgtcgggttggggtttttaatggttt

SEQ ID NO: 20314 - DNA, 1383 bp, Artificial Sequence
  chemically treated genomic DNA (Homo sapiens) CpG-island No: 20314
  misc_feature (155)..(155): n is either a, c, g or t
  misc_feature (189)..(189): n is either a, c, g or t
aaaccattaaaaaccccaacccgacaaacgaaacaacctcctcctcgaataccgcacctaaaaccaaattcatactccgacccaaactcgacccgttcgctaccctacgcccgatacgacccgaaattcttacccgttaaacaaacctcgccgcnataaccgcccgccgctcgcgcaaaacgcgccaanaaaacccgcgaaaaacgacgaaaactaaatcgtcgatactcgaaactaaccgcgaaaaccgatcgaccaaaaaaactatcgaaattaaaaccccgaactacaacgacgacgccgacgcgaccccaaaacccgataaaaacctacacacaaatcccgtaaccccgaaaaaacgaccaattacaactcgataaaccccgcacgattaatacgatcgaaacgcaaacctaaacgacgaaaaaaccgcaccaaaaactcgaacaccgccccgtaaccgcaaaccgccgcccacatcaccgaactattacccgcaaaatcgaccgcctcgaaatcaccgctaaactacaccaacaactacacgacgtccaaataacctcgctcgcacgccaaactaaatacgatacgaccgcgctcgtctcgcaaattcactacaacaccctactcgaacaacaaccgcacgaaacgcgcgcgcaacgcgaaatccgacaaccccacgaccaccataaacgacgtacgaccctactccgcgcgacaatcgataatactacgatccaacgcatccaacacgaaacgaaccaaatacactttacccgcctacataacctccaaaaaaatacgcgtccccgctcgaaaacacaaatccttaaatttaaacataaccccgaccgccgcgcccgaacaacctaacaattccgcacgaaaacgcccctattctcgcgccccgcgaaactccgacctccgcccgcgctctaatacctctccctccgcgcgtaaacgactacaaccgaaaatcccgaaattcctactccgctatcccgaaaactccgactaccccgccgctcctaaaccgcacgcctaacgtatcgccgctccttccccgaacctcccgcctaaaaatattaattactcgctactccgaactccgctcctaacccgccaccaaacgtcgaaaacaaaaactcgaccctctcccgaatctctcgccgctttcccgatatccgacgcccctcaatcctcgtaatttaaaaccgccgtaccactcacccgcacccaaaacaaccccccgctcccccgcaacgacgataacgcccgccgtacacgcctacctccaaccctaacgaaacgcgccgctcctcaaactactaacgccgttcctccgcctcctcccctctcgcgaaaaccgaaccacgccaaaac

SEQ ID NO: 20315 - DNA, 1383 bp, Artificial Sequence
  chemically treated genomic DNA (Homo sapiens) CpG-island No: 20315
  misc_feature (155)..(155): n is either a, c, g or t
  misc_feature (189)..(189): n is either a, c, g or t
gggttattaagggttttagttcggtaggcggggtagtttttttttcggatatcgtatttagagttaggtttatgtttcgatttaagttcggttcgttcgttgttttgcgttcggtgcggttcgaaatttttgttcgttgagtaagtttcgtcgtngtggtcgttcgtcgttcgcgtaaagcgcgttagnaaagttcgcgggaggcggcgggggttgggtcgtcgatgttcggggttgatcgcgggggtcggtcgattagggggattatcggagttggagtttcgggttgtagcggcggcgtcggcgcggttttagggttcggtgagggtttgtatataggtttcgtgatttcgaaaaaacggttagttgtagttcggtgagtttcgtacggttggtgcggtcgaggcgtaggtttaggcggcggaaggatcgtattaggaattcgagtatcgtttcgtggtcgtaggtcgtcgtttatattatcgggttgttgttcgtagagtcggtcgtttcggggttatcgttgaattgtattagtagttgtacggcgtttaggtggtttcgttcgtacgttaggttgagtgcggtgcggtcgcgttcgtttcgtaggtttattgtagtattttgttcgagtagtagtcgtacgaagcgcgcgcgtagcgcggggttcggtagttttacggttattatgagcggcgtacggttttgtttcgcgcggtagtcgatgatgttgcggtttagcgtatttaatacgaagcgggttaagtgtattttgttcgtttgtatggtttttaggaaggtgcgcgttttcgttcgggggtataggtttttgggtttgagtatggtttcggtcgtcgcgttcgggtagtttggtagtttcgtacgggggcgtttttgttttcgcgtttcgcggggtttcggttttcgttcgcgttttgatattttttttttcgcgcgtgggcggttgtagtcgagggtttcgaggtttttatttcgttgtttcggaggtttcgattgtttcgtcgtttttgggtcgtacgtttggcgtgtcgtcgtttttttttcgggtttttcgtttggaggtgttgattgttcgttatttcgggtttcgtttttggttcgttattagacgtcgggagtagagattcgattttttttcgagtttttcgtcgttttttcggtgttcggcgttttttagttttcgtggtttggagtcgtcgtgttatttattcgtatttagggtagtttttcgttttttcgtagcgacggtggcgttcgtcgtgtacgtttgtttttagttttggcggggcgcgtcgttttttaagttgttggcgtcgttttttcgtttttttttttttcgcgggggtcgggttacgttagggt

SEQ ID NO: 20316 - DNA, 1383 bp, Artificial Sequence
  chemically treated genomic DNA (Homo sapiens) CpG-island No: 20316
  misc_feature (1195)..(1195): n is either a, c, g or t
  misc_feature (1229)..(1229): n is either a, c, g or t
accctaacgtaacccgacccccgcgaaaaaaaaaaaaacgaaaaaacgacgccaacaacttaaaaaacgacgcgccccgccaaaactaaaaacaaacgtacacgacgaacgccaccgtcgctacgaaaaaacgaaaaactaccctaaatacgaataaataacacgacgactccaaaccacgaaaactaaaaaacgccgaacaccgaaaaaacgacgaaaaactcgaaaaaaaatcgaatctctactcccgacgtctaataacgaaccaaaaacgaaacccgaaataacgaacaatcaacacctccaaacgaaaaacccgaaaaaaaaacgacgacacgccaaacgtacgacccaaaaacgacgaaacaatcgaaacctccgaaacaacgaaataaaaacctcgaaaccctcgactacaaccgcccacgcgcgaaaaaaaaaatatcaaaacgcgaacgaaaaccgaaaccccgcgaaacgcgaaaacaaaaacgcccccgtacgaaactaccaaactacccgaacgcgacgaccgaaaccatactcaaacccaaaaacctatacccccgaacgaaaacgcgcaccttcctaaaaaccatacaaacgaacaaaatacacttaacccgcttcgtattaaatacgctaaaccgcaacatcatcgactaccgcgcgaaacaaaaccgtacgccgctcataataaccgtaaaactaccgaaccccgcgctacgcgcgcgcttcgtacgactactactcgaacaaaatactacaataaacctacgaaacgaacgcgaccgcaccgcactcaacctaacgtacgaacgaaaccacctaaacgccgtacaactactaatacaattcaacgataaccccgaaacgaccgactctacgaacaacaacccgataatataaacgacgacctacgaccacgaaacgatactcgaattcctaatacgatccttccgccgcctaaacctacgcctcgaccgcaccaaccgtacgaaactcaccgaactacaactaaccgttttttcgaaatcacgaaacctatatacaaaccctcaccgaaccctaaaaccgcgccgacgccgccgctacaacccgaaactccaactccgataatccccctaatcgaccgacccccgcgatcaaccccgaacatcgacgacccaacccccgccgcctcccgcgaactttnctaacgcgctttacgcgaacgacgaacgaccacnacgacgaaacttactcaacgaacaaaaatttcgaaccgcaccgaacgcaaaacaacgaacgaaccgaacttaaatcgaaacataaacctaactctaaatacgatatccgaaaaaaaaactaccccgcctaccgaactaaaacccttaataaccc

SEQ ID NO: 20317 - DNA, 708 bp, Artificial Sequence
  chemically treated genomic DNA (Homo sapiens) CpG-island No: 20317
gttcgtcgtcgcgttttatttgaggttatattttgaaattaaaatcgcggttaggtgaagtcggcgttgtattaacgtgtaagcgcggttttttttcggcgttttcgcgtcgaggtttttttcgcggagggcgggttcggtttttacgattttttcgagcgtttttgggtttttcgtttcgtaggtgggtttttcggttgtttcggaggttcgcggcgagaggacgggttttttaatacgcgtagttttttttttgggtgtttatgtttcgaagttcgggattagtcggcgttaggcgaggggttttgggcgtaggtatttggagtttcgcgtttttggagcgggattttttttcgcgggcgttcgttcggcgcggggtattcgcgttttcgagagggcgtagtagtggggtttgcgagttggggtcgggtggtcgcgtcgggtcggagtgtggttggagaggggtcgtttcggaagcggtgttgcgtttaacgttttttttttttcgtaagtttcgtaaggagtttgtcgttttttgtatttgagttaggagtttagtcgggaggcgggcgcggagcggtttttagcgtttggacgttagttagtcgtaatattcgcgggaatatttgttatatttgttataatgtatttttgatttgttttcgcgtaggtttgcggaggattggtttagtaaggttttaggttttt

SEQ ID NO: 20318 - DNA, 708 bp, Artificial Sequence
  chemically treated genomic DNA (Homo sapiens) CpG-island No: 20318
aaaaacctaaaaccttactaaaccaatcctccgcaaacctacgcgaaaacaaatcaaaaatacattataacaaatataacaaatattcccgcgaatattacgactaactaacgtccaaacgctaaaaaccgctccgcgcccgcctcccgactaaactcctaactcaaatacaaaaaacgacaaactccttacgaaacttacgaaaaaaaaaaaacgttaaacgcaacaccgcttccgaaacgacccctctccaaccacactccgacccgacgcgaccacccgaccccaactcgcaaaccccactactacgccctctcgaaaacgcgaataccccgcgccgaacgaacgcccgcgaaaaaaaatcccgctccaaaaacgcgaaactccaaatacctacgcccaaaacccctcgcctaacgccgactaatcccgaacttcgaaacataaacacccaaaaaaaaaactacgcgtattaaaaaacccgtcctctcgccgcgaacctccgaaacaaccgaaaaacccacctacgaaacgaaaaacccaaaaacgctcgaaaaaatcgtaaaaaccgaacccgccctccgcgaaaaaaacctcgacgcgaaaacgccgaaaaaaaaccgcgcttacacgttaatacaacgccgacttcacctaaccgcgattttaatttcaaaatataacctcaaataaaacgcgacgacgaac

SEQ ID NO: 20319 - DNA, 708 bp, Artificial Sequence
  chemically treated genomic DNA (Homo sapiens) CpG-island No: 20319
gaagatttgggattttgttgggttagtttttcgtaggtttgcgcggaaatagattagaaatgtattatggtaaatgtagtaagtgttttcgcgggtgttgcgattggttgacgtttaggcgttgggaatcgtttcgcgttcgtttttcgattgaatttttggtttaggtgtaagaggcggtaggttttttgcggggtttacggggagaaggggacgttgggcgtagtatcgttttcggggcggtttttttttagttatatttcgattcggcgcggttattcggttttagttcgtaggttttattgttgcgttttttcggggacgcgaatgtttcgcgtcgggcgggcgttcgcggagggaggtttcgttttagggacgcggagttttagatgtttgcgtttaaggtttttcgtttggcgtcggttggtttcgaatttcggggtatgggtatttaggaagggggttgcgcgtgttgggaggttcgttttttcgtcgcgaattttcggggtagtcggggaatttatttgcggagcgggaagtttaggaacgttcgaagaggtcgtgggagtcgggttcgtttttcgcgggagggatttcggcgcgggaacgtcgaggaggggtcgcgtttatacgttggtgtagcgtcggttttatttgatcgcgattttgattttagggtgtggttttaggtaggacgcggcggcgaat

SEQ ID NO: 20320 - DNA, 708 bp, Artificial Sequence
  chemically treated genomic DNA (Homo sapiens) CpG-island No: 20320
attcgccgccgcgtcctacctaaaaccacaccctaaaatcaaaatcgcgatcaaataaaaccgacgctacaccaacgtataaacgcgacccctcctcgacgttcccgcgccgaaatccctcccgcgaaaaacgaacccgactcccacgacctcttcgaacgttcctaaacttcccgctccgcaaataaattccccgactaccccgaaaattcgcgacgaaaaaacgaacctcccaacacgcgcaacccccttcctaaatacccataccccgaaattcgaaaccaaccgacgccaaacgaaaaaccttaaacgcaaacatctaaaactccgcgtccctaaaacgaaacctccctccgcgaacgcccgcccgacgcgaaacattcgcgtccccgaaaaaacgcaacaataaaacctacgaactaaaaccgaataaccgcgccgaatcgaaatataactaaaaaaaaaccgccccgaaaacgatactacgcccaacgtccccttctccccgtaaaccccgcaaaaaacctaccgcctcttacacctaaaccaaaaattcaatcgaaaaacgaacgcgaaacgattcccaacgcctaaacgtcaaccaatcgcaacacccgcgaaaacacttactacatttaccataatacatttctaatctatttccgcgcaaacctacgaaaaactaacccaacaaaatcccaaatcttc

SEQ ID NO: 20321 - DNA, 555 bp, Artificial Sequence
  chemically treated genomic DNA (Homo sapiens) CpG-island No: 20321
gataaattcgtaatttatagtagtgacgtttttcgacgtttttcggttatatttttataggaacgttacggcgtatagggtattattgtgtttttattataattatataaagaaaatgtgggggttcggttttttagttacgcggcgagtaagtgtagcgcgggacgttcgagcgtcgggtttaggcgggttgtaggtgtcggtaagtgttggggtcgggtcgtcgcggaatttatttgtgttgggttttaggttttgcgtcgttttcgggttgtcgtcgttaattttttttaaatagttcgtcgttacgttttttcgtcggggtatcgttttcggtattcgtttcggaagtagttgcgggagggcgcggagtacgtcgggaagttcgcgggtcggtatcgggatagttttcgggcgtcgtggaatgtatacgtttcgtattcggatttttcggttagtttttcggttcgttgtttgatgttcgcggtagttaatgagttagtggtgtttgttttgtttcgttttcgttttttaggggaattaattttattgtag

SEQ ID NO: 20322 - DNA, 555 bp, Artificial Sequence
  chemically treated genomic DNA (Homo sapiens) CpG-island No: 20322
ctacaataaaattaattcccctaaaaaacgaaaacgaaacaaaacaaacaccactaactcattaactaccgcgaacatcaaacaacgaaccgaaaaactaaccgaaaaatccgaatacgaaacgtatacattccacgacgcccgaaaactatcccgataccgacccgcgaacttcccgacgtactccgcgccctcccgcaactacttccgaaacgaataccgaaaacgataccccgacgaaaaaacgtaacgacgaactatttaaaaaaaattaacgacgacaacccgaaaacgacgcaaaacctaaaacccaacacaaataaattccgcgacgacccgaccccaacacttaccgacacctacaacccgcctaaacccgacgctcgaacgtcccgcgctacacttactcgccgcgtaactaaaaaaccgaacccccacattttctttatataattataataaaaacacaataataccctatacgccgtaacgttcctataaaaatataaccgaaaaacgtcgaaaaacgtcactactataaattacgaatttatc

SEQ ID NO: 20323 - DNA, 555 bp, Artificial Sequence
  chemically treated genomic DNA (Homo sapiens) CpG-island No: 20323
ttgtaatgggattggtttttttggagggcggggacggagtaggataaatattattagtttattggttatcgcgggtattagatagcgagtcgggaagttgatcggaaggttcgggtgcgggacgtgtgtattttacggcgttcgggagttgtttcggtgtcgattcgcgagtttttcggcgtgtttcgcgttttttcgtaattattttcggggcgggtgtcgggggcggtgtttcggcgagggagcgtggcggcgagttgtttggggggggttggcgacggtagttcgagggcggcgtaaggtttgaggtttagtataggtgggtttcgcggcggttcggttttagtatttgtcggtatttgtagttcgtttagattcggcgttcgggcgtttcgcgttgtatttgttcgtcgcgtgattggaggatcgagtttttatattttttttatgtggttgtggtgggggtatagtaatgttttgtgcgtcgtagcgtttttgtggggatgtggtcggggggcgtcgggaagcgttattgttgtgagttacgggtttgtt

SEQ ID NO: 20324 - DNA, 555 bp, Artificial Sequence
  chemically treated genomic DNA (Homo sapiens) CpG-island No: 20324
aacaaacccgtaactcacaacaataacgcttcccgacgccccccgaccacatccccacaaaaacgctacgacgcacaaaacattactatacccccaccacaaccacataaaaaaaatataaaaactcgatcctccaatcacgcgacgaacaaatacaacgcgaaacgcccgaacgccgaatctaaacgaactacaaataccgacaaatactaaaaccgaaccgccgcgaaacccacctatactaaacctcaaaccttacgccgccctcgaactaccgtcgccaaccccccccaaacaactcgccgccacgctccctcgccgaaacaccgcccccgacacccgccccgaaaataattacgaaaaaacgcgaaacacgccgaaaaactcgcgaatcgacaccgaaacaactcccgaacgccgtaaaatacacacgtcccgcacccgaaccttccgatcaacttcccgactcgctatctaatacccgcgataaccaataaactaataatatttatcctactccgtccccgccctccaaaaaaaccaatcccattacaa

SEQ ID NO: 20325 - DNA, 1079 bp, Artificial Sequence
  chemically treated genomic DNA (Homo sapiens) CpG-island No: 20325
atttaggtttttgttagtattttcgtcgggattcgtttttgttcgtatataggtatttatataatgaggtcggttcgagttcgcggaggcggggttttgtttgaaagtcgcggtagtcgtatattgtaggcgtttaggacgtagtcgcgcggttttaggtggagttagggaaatgaggagggagggtcgttacgttcggcggggtagggcgcgggtcgttattttgaggatgttttgtagttgttttaatatagcgtgtatttcgtcgtgtagtagttagcggaatttttttttttgcgggatagattcggcggtcgcgttcggtttcgtcgtttcgtcggttcgttcgttggttcgcgcgttttattagtatcgttcgtttcgtcgtcgtcgttgttattacggtggttatggtcgtaggtcgtcgtcgagcgttttttttatcggtcgttgtttttgtttattaatttttttgttttcggtttttcggttttttcgttcgttttcggcgtttggtttcgtttttattcgattggcggagcgggtattatttcgtttttaggtcggtttcgtgttcgcgattggttggcgtttgtcggttcgtttcggttttcgaaatttgcgggagttttggaattagattggcggttgcgggagtgaggttcgtttcgtttggttagggacgcggtcggcggttgtacgagttaggtttgtttcggttggttagggacgcggtcggtattagtttggggcgttcgtttgggggcggagttttcggggcgtttttaggatatgatagggcgttttgttttattcgcgtttatttattggtcggtaggatagtttgttttcgttttttttttttattggttcgtttggttttattggtcgtggttttaattttgtcgcggatttcgtcgttatttttaagttcgttttatttcggacgcggaggtttcgaaaatttatttcggtttcgtcgttgttttttttttttatttatttcgtcgaggacgagggaagtaggatttttgcggtatagttgtgttattaagaagtgttttattttttttgtagta

SEQ ID NO: 20326 - DNA, 1079 bp, Artificial Sequence
  chemically treated genomic DNA (Homo sapiens) CpG-island No: 20326
tactacaaaaaaaataaaacacttcttaataacacaactataccgcaaaaatcctacttccctcgtcctcgacgaaataaataaaaaaaaaaaacaacgacgaaaccgaaataaattttcgaaacctccgcgtccgaaataaaacgaacttaaaaataacgacgaaatccgcgacaaaattaaaaccacgaccaataaaaccaaacgaaccaataaaaaaaaaaaacgaaaacaaactatcctaccgaccaataaataaacgcgaataaaacaaaacgccctatcatatcctaaaaacgccccgaaaactccgcccccaaacgaacgccccaaactaataccgaccgcgtccctaaccaaccgaaacaaacctaactcgtacaaccgccgaccgcgtccctaaccaaacgaaacgaacctcactcccgcaaccgccaatctaattccaaaactcccgcaaatttcgaaaaccgaaacgaaccgacaaacgccaaccaatcgcgaacacgaaaccgacctaaaaacgaaataatacccgctccgccaatcgaataaaaacgaaaccaaacgccgaaaacgaacgaaaaaaccgaaaaaccgaaaacaaaaaaattaataaacaaaaacaacgaccgataaaaaaaacgctcgacgacgacctacgaccataaccaccgtaataacaacgacgacgacgaaacgaacgatactaataaaacgcgcgaaccaacgaacgaaccgacgaaacgacgaaaccgaacgcgaccgccgaatctatcccgcaaaaaaaaaaattccgctaactactacacgacgaaatacacgctatattaaaacaactacaaaacatcctcaaaataacgacccgcgccctaccccgccgaacgtaacgaccctccctcctcatttccctaactccacctaaaaccgcgcgactacgtcctaaacgcctacaatatacgactaccgcgactttcaaacaaaaccccgcctccgcgaactcgaaccgacctcattatataaatacctatatacgaacaaaaacgaatcccgacgaaaatactaacaaaaacctaaat

SEQ ID NO: 20327 - DNA, 1079 bp, Artificial Sequence
  chemically treated genomic DNA (Homo sapiens) CpG-island No: 20327
tattgtaagaaaaataaaatattttttggtaatatagttgtgtcgtaggagttttgtttttttcgttttcggcgagatgggtgggaggagaaggtagcggcggggtcggggtgggttttcgggattttcgcgttcggggtgagacggatttgggagtggcggcgaggttcgcggtagggttggaattacgattaatggagttaagcgggttaatagggaggaggagcggggatagattgttttgtcggttaatgagtgagcgcgagtggagtagagcgttttattatattttgggggcgtttcgggagtttcgtttttaagcgggcgttttaggttggtgtcggtcgcgtttttggttagtcggagtaagtttgattcgtgtagtcgtcggtcgcgtttttggttaggcggagcgagttttattttcgtagtcgttagtttggttttagggttttcgtaggtttcgggggtcgaggcggatcgataggcgttagttaatcgcgagtacggagtcggtttgggggcggggtggtattcgtttcgttaatcgggtgggggcggagttagacgtcgggggcggacgggaggatcggaggatcgaggatagaaagattggtggataggagtagcggtcggtggggagggcgttcggcggcggtttgcggttatggttatcgtgatggtagcgacggcggcggagcgggcggtgttggtaaggcgcgcgggttagcgggcgggtcggcggggcggcggggtcgggcgcgatcgtcgggtttgtttcgtaggaggaggagtttcgttggttgttgtacgacgaggtgtacgttgtgttgaagtagttgtaggatatttttaaggtaacgattcgcgttttgtttcgtcgggcgtggcggttttttttttttatttttttggttttatttggggtcgcgcggttgcgttttgagcgtttatagtgtgcggttgtcgcggtttttaggtagggtttcgttttcgcgaattcgagtcgattttattatataagtatttgtgtgcgggtaggggcgggtttcgacgagggtgttagtaagggtttgagt

SEQ ID NO: 20328 - DNA, 1079 bp, Artificial Sequence
  chemically treated genomic DNA (Homo sapiens) CpG-island No: 20328
actcaaacccttactaacaccctcgtcgaaacccgcccctacccgcacacaaatacttatataataaaatcgactcgaattcgcgaaaacgaaaccctacctaaaaaccgcgacaaccgcacactataaacgctcaaaacgcaaccgcgcgaccccaaataaaaccaaaaaaataaaaaaaaaaaaccgccacgcccgacgaaacaaaacgcgaatcgttaccttaaaaatatcctacaactacttcaacacaacgtacacctcgtcgtacaacaaccaacgaaactcctcctcctacgaaacaaacccgacgatcgcgcccgaccccgccgccccgccgacccgcccgctaacccgcgcgccttaccaacaccgcccgctccgccgccgtcgctaccatcacgataaccataaccgcaaaccgccgccgaacgccctccccaccgaccgctactcctatccaccaatctttctatcctcgatcctccgatcctcccgtccgcccccgacgtctaactccgcccccacccgattaacgaaacgaataccaccccgcccccaaaccgactccgtactcgcgattaactaacgcctatcgatccgcctcgacccccgaaacctacgaaaaccctaaaaccaaactaacgactacgaaaataaaactcgctccgcctaaccaaaaacgcgaccgacgactacacgaatcaaacttactccgactaaccaaaaacgcgaccgacaccaacctaaaacgcccgcttaaaaacgaaactcccgaaacgcccccaaaatataataaaacgctctactccactcgcgctcactcattaaccgacaaaacaatctatccccgctcctcctccctattaacccgcttaactccattaatcgtaattccaaccctaccgcgaacctcgccgccactcccaaatccgtctcaccccgaacgcgaaaatcccgaaaacccaccccgaccccgccgctaccttctcctcccacccatctcgccgaaaacgaaaaaaacaaaactcctacgacacaactatattaccaaaaaatattttatttttcttacaata

SEQ ID NO: 20329 - DNA, 1681 bp, Artificial Sequence
  chemically treated genomic DNA (Homo sapiens) CpG-island No: 20329
ggttcgggcggttgtttgggatatagaagtagatcgcgggaggtatttaagcgtgtattggttattgttaagttatcggttgtaaaggagaagttttttcgtcgttttttcgcggggtaacgttagtagttcggtttagataatttcggttgagtcggtcgtataggtcggttgtatcgtaatttgggttttgatcgaatggtatcggttagatttcgtaggttcggttttcggcgtttttgttttttgggaagttttaataagatttcggggatcggtcgttcggggaagtttcgcggtatcggcggttttttttacgggggtcgttagtatttgggtttcgagtgtagattttattcggtcggtttcggggattaaagtcggtgttcgacgtggttattttcggtttcggtttttcgggattggattgtttttttcgtttggcgtcgttcgtaagcgtcggtatttttttttttttttttttcgcgatttggagcgtataaaaaggtagttttagggtcggtagcgaatttcgcgtttaggcgggtagtttttcggcgcgtttcggttggttcggtcgttcggatttattatattaagtcgtcgagtcgtagatttatagtcgttattttattatttaattatcgtcgacgtacgggtcgtcgggaatagtaagtcgtttcggcgtcgtttattggagtgggttcgattacgtgacgggggtcggttgttattggttacgtcgttattttgacgttatcgcgttcgtcggggattattggtcgatcgaggggtacgtgacgcgagcgtcgcggttttcgcgcgtcggagcgtagagattttcggtttttttttttttttttcggttcgtgataacgaagcgttcgcggtttgaggcggcggcggcggcgacggtgcgatcggttgagcgcgagagggagtcggtttcgcggttcgtttcgttttcgggttttggatttcgcgttttttttttttcggcgttttcgttacgttcgttggttcggcgcgggtttcggggttattttcgagttcgaggcgttggtcggtttcgtcgtagcgttagtgagttattttgacggagttcggcgcggtttggaatttagttttcgtcgggtttgggttttcgcgttcggtaattttgtttggtcgtaggtcgggaggtttcggtgttcgcgttcgttcgttttcgtcgttcgtgttttttggagcgtttttttcgacggtcgttttcggaggcgtcgtttgagcgcggggtttcgcgtcgtaagtttttttggggcgatcggaggttgttttttcgattttttggtgttttcggagtggttgcgcggacgtcgagttggtattttttcgtttttttttgggtcggcgcgcggcgcggtatattaggtttttttgggttcggggattcggttatgggtcgaggcgcgggtcgttcgttcgttgggagttacggtttagtagtcgatcgttagttgcgtcgtcgttcggggatcggtatgaggatcgtcgcggggggacgtttgcggttcgcgtcggcgttggggataaaggtgcgtgtcgttgtcgggttcgggttttttcgttagttttgttttagttttgtatttttgaaaaagttgtgataataggaagatagatgtcgggcgtagtttggata

SEQ ID NO: 20330 - DNA, 1681 bp, Artificial Sequence
  chemically treated genomic DNA (Homo sapiens) CpG-island No: 20330
tatccaaactacgcccgacatctatcttcctattatcacaactttttcaaaaatacaaaactaaaacaaaactaacgaaaaaacccgaacccgacaacgacacgcacctttatccccaacgccgacgcgaaccgcaaacgtccccccgcgacgatcctcataccgatccccgaacgacgacgcaactaacgatcgactactaaaccgtaactcccaacgaacgaacgacccgcgcctcgacccataaccgaatccccgaacccaaaaaaacctaatataccgcgccgcgcgccgacccaaaaaaaaacgaaaaaataccaactcgacgtccgcgcaaccactccgaaaacaccaaaaaatcgaaaaaacaacctccgatcgccccaaaaaaacttacgacgcgaaaccccgcgctcaaacgacgcctccgaaaacgaccgtcgaaaaaaacgctccaaaaaacacgaacgacgaaaacgaacgaacgcgaacaccgaaacctcccgacctacgaccaaacaaaattaccgaacgcgaaaacccaaacccgacgaaaactaaattccaaaccgcgccgaactccgtcaaaataactcactaacgctacgacgaaaccgaccaacgcctcgaactcgaaaataaccccgaaacccgcgccgaaccaacgaacgtaacgaaaacgccgaaaaaaaaaaaacgcgaaatccaaaacccgaaaacgaaacgaaccgcgaaaccgactccctctcgcgctcaaccgatcgcaccgtcgccgccgccgccgcctcaaaccgcgaacgcttcgttatcacgaaccgaaaaaaaaaaaaaaaaaccgaaaatctctacgctccgacgcgcgaaaaccgcgacgctcgcgtcacgtacccctcgatcgaccaataatccccgacgaacgcgataacgtcaaaataacgacgtaaccaataacaaccgacccccgtcacgtaatcgaacccactccaataaacgacgccgaaacgacttactattcccgacgacccgtacgtcgacgataattaaataataaaataacgactataaatctacgactcgacgacttaatataataaatccgaacgaccgaaccaaccgaaacgcgccgaaaaactacccgcctaaacgcgaaattcgctaccgaccctaaaactacctttttatacgctccaaatcgcgaaaaaaaaaaaaaaaaaaataccgacgcttacgaacgacgccaaacgaaaaaaacaatccaatcccgaaaaaccgaaaccgaaaataaccacgtcgaacaccgactttaatccccgaaaccgaccgaataaaatctacactcgaaacccaaatactaacgacccccgtaaaaaaaaccgccgataccgcgaaacttccccgaacgaccgatccccgaaatcttattaaaacttcccaaaaaacaaaaacgccgaaaaccgaacctacgaaatctaaccgataccattcgatcaaaacccaaattacgatacaaccgacctatacgaccgactcaaccgaaattatctaaaccgaactactaacgttaccccgcgaaaaaacgacgaaaaaacttctcctttacaaccgataacttaacaataaccaatacacgcttaaatacctcccgcgatctacttctatatcccaaacaaccgcccgaacc

SEQ ID NO: 20331 - DNA, 1681 bp, Artificial Sequence
  chemically treated genomic DNA (Homo sapiens) CpG-island No: 20331
tgtttaaattacgttcggtatttgtttttttgttgttataatttttttaaaagtgtaaaattagggtaaggttaacgagagagttcggattcgataacgatacgtatttttgtttttagcgtcgacgcgggtcgtagacgttttttcgcggcggtttttatgtcggttttcgggcggcggcgtagttagcggtcggttgttaagtcgtggtttttagcgggcgggcggttcgcgtttcggtttatggtcgggttttcgagtttaggggagtttggtgtgtcgcgtcgcgcgtcggtttaggaggaagcgaagaaatgttaattcgacgttcgcgtagttatttcggggatattagggggtcgggggagtagttttcggtcgttttaggagaatttgcggcgcgggatttcgcgtttagacggcgttttcgaaagcggtcgtcgggaggagcgttttaaagaatacgggcggcgggagcggacgggcgcggatatcggggtttttcggtttgcggttaagtagagttgtcgggcgcgggagtttagattcggcggaggttgagttttaggtcgcgtcgagtttcgttagggtagtttattggcgttgcgacggggtcgattagcgtttcgggttcgggaatggtttcggggttcgcgtcggattaacgggcgtaacggaagcgtcgagaggggaggggcgcggagtttaagattcgggggcggggcgagtcgcgaggtcggttttttttcgcgtttagtcggtcgtatcgtcgtcgtcgtcgtcgttttagatcgcgggcgtttcgttgttacgagtcgaagggagggggaaggagtcgggagtttttgcgtttcggcgcgcggagatcgcggcgttcgcgttacgtgtttttcggtcgattaatgattttcggcgggcgcggtgacgttagagtagcggcgtggttagtgatagtcggttttcgttacgtggtcgggtttattttaatgggcggcgtcggggcgatttgttgttttcggcggttcgtgcgtcggcggtggttgggtggtaagatggcggttgtgagtttgcggttcggcgatttggtgtggtgagttcgagcggtcgggttaatcgagacgcgtcggggagttattcgtttgggcgcggggttcgttgtcggttttggagttgtttttttatgcgttttaggtcgcggagagaggggaagagaaggtgtcggcgtttgcgagcggcgttaggcggaaggggtagtttagtttcgggggatcgaggtcgagggtggttacgtcgggtatcggttttgattttcgaggtcggtcgggtggggtttgtattcggggtttagatattggcggttttcgtgaagggagtcgtcggtgtcgcgaggttttttcggacgatcggttttcggggttttgttggggttttttagaaagtagaagcgtcggggatcggatttgcgagatttggtcggtgttattcggttaaagtttaggttgcgatgtagtcgatttgtgcggtcggtttagtcggggttgtttaaatcggattgttggcgttgtttcgcgaagaaacggcggggggattttttttttataatcgatggtttggtagtgattagtgtacgtttgggtgtttttcgcggtttgtttttgtgttttagataatcgttcgaatt

SEQ ID NO: 20332 - DNA, 1681 bp, Artificial Sequence
  chemically treated genomic DNA (Homo sapiens) CpG-island No: 20332
aattcgaacgattatctaaaacacaaaaacaaaccgcgaaaaacacccaaacgtacactaatcactaccaaaccatcgattataaaaaaaaaatccccccgccgtttcttcgcgaaacaacgccaacaatccgatttaaacaaccccgactaaaccgaccgcacaaatcgactacatcgcaacctaaactttaaccgaataacaccgaccaaatctcgcaaatccgatccccgacgcttctactttctaaaaaaccccaacaaaaccccgaaaaccgatcgtccgaaaaaacctcgcgacaccgacgactcccttcacgaaaaccgccaatatctaaaccccgaatacaaaccccacccgaccgacctcgaaaatcaaaaccgatacccgacgtaaccaccctcgacctcgatcccccgaaactaaactaccccttccgcctaacgccgctcgcaaacgccgacaccttctcttcccctctctccgcgacctaaaacgcataaaaaaacaactccaaaaccgacaacgaaccccgcgcccaaacgaataactccccgacgcgtctcgattaacccgaccgctcgaactcaccacaccaaatcgccgaaccgcaaactcacaaccgccatcttaccacccaaccaccgccgacgcacgaaccgccgaaaacaacaaatcgccccgacgccgcccattaaaataaacccgaccacgtaacgaaaaccgactatcactaaccacgccgctactctaacgtcaccgcgcccgccgaaaatcattaatcgaccgaaaaacacgtaacgcgaacgccgcgatctccgcgcgccgaaacgcaaaaactcccgactccttccccctcccttcgactcgtaacaacgaaacgcccgcgatctaaaacgacgacgacgacgacgatacgaccgactaaacgcgaaaaaaaaccgacctcgcgactcgccccgcccccgaatcttaaactccgcgcccctcccctctcgacgcttccgttacgcccgttaatccgacgcgaaccccgaaaccattcccgaacccgaaacgctaatcgaccccgtcgcaacgccaataaactaccctaacgaaactcgacgcgacctaaaactcaacctccgccgaatctaaactcccgcgcccgacaactctacttaaccgcaaaccgaaaaaccccgatatccgcgcccgtccgctcccgccgcccgtattctttaaaacgctcctcccgacgaccgctttcgaaaacgccgtctaaacgcgaaatcccgcgccgcaaattctcctaaaacgaccgaaaactactcccccgaccccctaatatccccgaaataactacgcgaacgtcgaattaacatttcttcgcttcctcctaaaccgacgcgcgacgcgacacaccaaactcccctaaactcgaaaacccgaccataaaccgaaacgcgaaccgcccgcccgctaaaaaccacgacttaacaaccgaccgctaactacgccgccgcccgaaaaccgacataaaaaccgccgcgaaaaaacgtctacgacccgcgtcgacgctaaaaacaaaaatacgtatcgttatcgaatccgaactctctcgttaaccttaccctaattttacacttttaaaaaaattataacaacaaaaaaacaaataccgaacgtaatttaaaca

SEQ ID NO: 20333 - DNA, 512 bp, Artificial Sequence
  chemically treated genomic DNA (Homo sapiens) CpG-island No: 20333
gttttgcgtcgtttttgtttttattttcgtttttattttcgttttttgcgcggtttcgacgttgttttgttttttttgtttagtttttagtttttttttttacgtattggtagtttttttcggcgttgtagattttttcgttaagtcgcgttcggttttagttgcgttttcgaggtcggtttcgcgggagtttgggggtcgcgcggcgtcgttttaggtacggaggcggtaggtttaggcgcgtttcggatattaggcgcgggaggcggtcggtattaacgcgagttaagaagcgagcgggagggacgttttagtttcgtttggcgtttttttttcgttatatcggtagtttttttcgttttttttttttatcggggcggggcggtcgcggtgtacggattcgcgttaaagatcgcgtcgttagttttcgtttgtaggtggagaacgttaggttttattattgcgttgtttatttaacgtaggggttgtatttaggaaaatgttgttttgtt

SEQ ID NO: 20334 - DNA, 512 bp, Artificial Sequence
  chemically treated genomic DNA (Homo sapiens) CpG-island No: 20334
aacaaaacaacattttcctaaatacaacccctacgttaaataaacaacgcaataataaaacctaacgttctccacctacaaacgaaaactaacgacgcgatctttaacgcgaatccgtacaccgcgaccgccccgccccgataaaaaaaaaaaacgaaaaaaactaccgatataacgaaaaaaaaacgccaaacgaaactaaaacgtccctcccgctcgcttcttaactcgcgttaataccgaccgcctcccgcgcctaatatccgaaacgcgcctaaacctaccgcctccgtacctaaaacgacgccgcgcgacccccaaactcccgcgaaaccgacctcgaaaacgcaactaaaaccgaacgcgacttaacgaaaaaatctacaacgccgaaaaaaactaccaatacgtaaaaaaaaaaactaaaaactaaacaaaaaaaacaaaacaacgtcgaaaccgcgcaaaaaacgaaaataaaaacgaaaataaaaacaaaaacgacgcaaaac

SEQ ID NO: 20335 - DNA, 512 bp, Artificial Sequence
  chemically treated genomic DNA (Homo sapiens) CpG-island No: 20335
aataggatagtatttttttgggtgtagtttttgcgttgggtgaatagcgtagtgataaagtttggcgttttttatttgtaggcggaggttgacggcgcggtttttggcgcgagttcgtgtatcgcggtcgtttcgtttcggtgggagagagggacggaggaagttgtcggtataacgggaggagagcgttaggcggagttggggcgtttttttcgttcgttttttgattcgcgttggtgtcggtcgtttttcgcgtttagtgttcgggacgcgtttgaatttgtcgttttcgtgtttggggcggcgtcgcgcggtttttaggttttcgcggggtcgatttcggagacgtagttggggtcgggcgcggtttggcgggagggtttgtagcgtcgagggaggttgttagtgcgtgaggaagagagttagagattggataggggagatagagtagcgtcggagtcgcgtaggggacgggagtgagagcgggagtgagagtaggaacgacgtagagt

SEQ ID NO: 20336 - DNA, 512 bp, Artificial Sequence
  chemically treated genomic DNA (Homo sapiens) CpG-island No: 20336
actctacgtcgttcctactctcactcccgctctcactcccgtcccctacgcgactccgacgctactctatctcccctatccaatctctaactctcttcctcacgcactaacaacctccctcgacgctacaaaccctcccgccaaaccgcgcccgaccccaactacgtctccgaaatcgaccccgcgaaaacctaaaaaccgcgcgacgccgccccaaacacgaaaacgacaaattcaaacgcgtcccgaacactaaacgcgaaaaacgaccgacaccaacgcgaatcaaaaaacgaacgaaaaaaacgccccaactccgcctaacgctctcctcccgttataccgacaacttcctccgtccctctctcccaccgaaacgaaacgaccgcgatacacgaactcgcgccaaaaaccgcgccgtcaacctccgcctacaaataaaaaacgccaaactttatcactacgctattcacccaacgcaaaaactacacccaaaaaaatactatcctatt

SEQ ID NO: 20337 - DNA, 570 bp, Artificial Sequence
  chemically treated genomic DNA (Homo sapiens) CpG-island No: 20337
cgcgtttcgattcgttgtttatttattcgttagatttttagttcgggttcggtggttcgtttaggagtcggcgagattttaaacggaggaattgtcgtttggtagttcgatttttatttttttttttagttttcgtttatattcgagcgtattacgttcgttggttcgagagcgtgtttcgggtttttcgttacgttcgttttttttttcgtcgtttaatttttttttcgatgaggtttttaattattttttatttcggaaggtttcgggcgaggtttcgggcgaggttttgggcgaggcgtagtttttttagcgttatttaatatttattcgtttttttagtttttagggacgtcggggtgttgttttgtagcgcgtaataaatattttcggaaaaggtatcgtttagtaatcgggagtttcgtttttagtaggagttaataggtcgtcggttgagagttgtgataatggattggttcgaagttttttcggtgtacgtaggagttttgttcgtttttcgttgtacgatgggagtgtagtttaagatagataatgggaattcgtaagaag

SEQ ID NO: 20338 - DNA, 570 bp, Artificial Sequence
  chemically treated genomic DNA (Homo sapiens) CpG-island No: 20338
cttcttacgaattcccattatctatcttaaactacactcccatcgtacaacgaaaaacgaacaaaactcctacgtacaccgaaaaaacttcgaaccaatccattatcacaactctcaaccgacgacctattaactcctactaaaaacgaaactcccgattactaaacgataccttttccgaaaatatttattacgcgctacaaaacaacaccccgacgtccctaaaaactaaaaaaacgaataaatattaaataacgctaaaaaaactacgcctcgcccaaaacctcgcccgaaacctcgcccgaaaccttccgaaataaaaaataattaaaaacctcatcgaaaaaaaaattaaacgacgaaaaaaaaaacgaacgtaacgaaaaacccgaaacacgctctcgaaccaacgaacgtaatacgctcgaatataaacgaaaactaaaaaaaaaaataaaaatcgaactaccaaacgacaattcctccgtttaaaatctcgccgactcctaaacgaaccaccgaacccgaactaaaaatctaacgaataaataaacaacgaatcgaaacgcg

SEQ ID NO: 20339 - DNA, 570 bp, Artificial Sequence
  chemically treated genomic DNA (Homo sapiens) CpG-island No: 20339
ttttttgcggatttttattatttattttaaattatatttttatcgtgtaacggaaaacggatagagtttttgcgtgtatcgaagggatttcgagttaatttattgttatagtttttagtcggcgatttattggtttttgttggaggcgggattttcggttgttaggcggtatttttttcggaagtgtttgttgcgcgttgtagggtaatatttcggcgtttttggaagttgggggagcgggtgggtgttgggtggcgttgggggagttgcgtttcgtttagagtttcgttcggagtttcgttcggagtttttcggggtgggggatagttgaggattttatcgagggaggggttgggcggcggggaagggagcgagcgtggcgggggattcgaggtacgttttcgagttaacgagcgtgatgcgttcgagtgtgggcggggattgagggaagaagtgaaaatcggattgttaggcgatagttttttcgtttgaaatttcgtcggtttttgagcgggttatcgggttcgggttgggggtttggcgggtgagtgagtagcgggtcgggacgcg

SEQ ID NO: 20340 - DNA, 570 bp, Artificial Sequence
  chemically treated genomic DNA (Homo sapiens) CpG-island No: 20340
cgcgtcccgacccgctactcactcacccgccaaacccccaacccgaacccgataacccgctcaaaaaccgacgaaatttcaaacgaaaaaactatcgcctaacaatccgattttcacttcttccctcaatccccgcccacactcgaacgcatcacgctcgttaactcgaaaacgtacctcgaatcccccgccacgctcgctcccttccccgccgcccaacccctccctcgataaaatcctcaactatcccccaccccgaaaaactccgaacgaaactccgaacgaaactctaaacgaaacgcaactcccccaacgccacccaacacccacccgctcccccaacttccaaaaacgccgaaatattaccctacaacgcgcaacaaacacttccgaaaaaaataccgcctaacaaccgaaaatcccgcctccaacaaaaaccaataaatcgccgactaaaaactataacaataaattaactcgaaatcccttcgatacacgcaaaaactctatccgttttccgttacacgataaaaatataatttaaaataaataataaaaatccgcaaaaaa

SEQ ID NO: 20341 - DNA, 512 bp, Artificial Sequence
  chemically treated genomic DNA (Homo sapiens) CpG-island No: 20341
gtttggtagggtcgtttatagcgttgtgcgtttcgggtttcgttttttattaggttaggtgacgttcgggtgttcgtcgttttttatcgcgtcgtatgttgagtattagcgaacgttaggttcgtgtacgtttaagcgcggtttttgttcggattttttatggtttttaggtttcgttttttgttttcggtttcggacgttcgcggttagtttttcgcgattttgagaattaagagttaagtatcgggtaggagttgtttattttggtttgggtttggcggcgttcgtagagtcggttttggatcgagcgaggaggaggggttaataatagaggcggagggcggttgttaggaaatagcgttttcgggaggaagtgatttttttatcgtcgggtttttcgggtatttaatatcgtttttcggtttaacgtgtcgttggggtaattatttagacgaaggaagtgatattatttttttgggtttttggagaggggtttattattggtcgtttgt

SEQ ID NO: 20342 - DNA, 512 bp, Artificial Sequence
  chemically treated genomic DNA (Homo sapiens) CpG-island No: 20342
acaaacgaccaataataaacccctctccaaaaacccaaaaaaataatatcacttccttcgtctaaataattaccccaacgacacgttaaaccgaaaaacgatattaaatacccgaaaaacccgacgataaaaaaatcacttcctcccgaaaacgctatttcctaacaaccgccctccgcctctattattaacccctcctcctcgctcgatccaaaaccgactctacgaacgccgccaaacccaaaccaaaataaacaactcctacccgatacttaactcttaattctcaaaatcgcgaaaaactaaccgcgaacgtccgaaaccgaaaacaaaaaacgaaacctaaaaaccataaaaaatccgaacaaaaaccgcgcttaaacgtacacgaacctaacgttcgctaatactcaacatacgacgcgataaaaaacgacgaacacccgaacgtcacctaacctaataaaaaacgaaacccgaaacgcacaacgctataaacgaccctaccaaac

SEQ ID NO: 20343 - DNA, 512 bp, Artificial Sequence
  chemically treated genomic DNA (Homo sapiens) CpG-island No: 20343
ataagcgattaataatgagtttttttttaaagatttaggaaggtgatgttatttttttcgtttgggtggttgttttagcgatacgttgggtcgaagagcggtgttgggtattcgagagattcggcggtggggaagttattttttttcgaagacgttgttttttagtaatcgtttttcgtttttgttattagtttttttttttcgttcggtttaggatcggttttgcgggcgtcgttaggtttagattaaggtgagtagtttttattcgatgtttggtttttgatttttagggtcgcggagaattggtcgcgggcgttcggggtcgggaatagaaagcgggatttgggggttatgggggattcggatagagatcgcgtttggacgtgtacgggtttggcgttcgttggtgtttagtatacggcgcggtgaggagcggcgagtattcggacgttatttggtttggtagggaacggaattcggggcgtataacgttatgggcggttttgttaggt

SEQ ID NO: 20344 - DNA, 512 bp, Artificial Sequence
  chemically treated genomic DNA (Homo sapiens) CpG-island No: 20344
acctaacaaaaccgcccataacgttatacgccccgaattccgttccctaccaaaccaaataacgtccgaatactcgccgctcctcaccgcgccgtatactaaacaccaacgaacgccaaacccgtacacgtccaaacgcgatctctatccgaatcccccataacccccaaatcccgctttctattcccgaccccgaacgcccgcgaccaattctccgcgaccctaaaaatcaaaaaccaaacatcgaataaaaactactcaccttaatctaaacctaacgacgcccgcaaaaccgatcctaaaccgaacgaaaaaaaaaaactaataacaaaaacgaaaaacgattactaaaaaacaacgtcttcgaaaaaaaataacttccccaccgccgaatctctcgaatacccaacaccgctcttcgacccaacgtatcgctaaaacaaccacccaaacgaaaaaaataacatcaccttcctaaatctttaaaaaaaaactcattattaatcgcttat

SEQ ID NO: 20345 - DNA, 594 bp, Artificial Sequence
  chemically treated genomic DNA (Homo sapiens) CpG-island No: 20345
acggtaatcgatgtggtagtcgcgtaatttttcgaaatttaaaggttagagggcgtgtttagtggttaggtgtaggcggtggggtaagtaacggtttttggtagtttcgttttttcgattcgtttttttcgcgtttgtttattttcgttttttcgggtttgtaattttttttcgggtcgttttttttttaaggcggagttcggcgtggatttcgcgagattcggtttggcgtcgtgatttttatgtgggagttttagttttataagtaaatattttgcgcggcgtagatatggtttttttttatttttgaggcggtgtttgcggtagcgttttagagtggtttcggtcgtttttttttaagtcggttagtcgggcgcgcgcgttgagagtcgtcgtcgtttgtcgggttcggcgttcggtcggttcggtgggcgcgttcgttcgtttgtcgttgagggttcgagtcgtagggaaagcggcgcgggtcgggcggggcgcggcgtttagagtttagggggagataaaggggatcggtttttttttaggcgttaagatgtggatataggttcgtattattgatggttttaagacgtg

SEQ ID NO: 20346 - DNA, 594 bp, Artificial Sequence
  chemically treated genomic DNA (Homo sapiens) CpG-island No: 20346
cacgtcttaaaaccatcaataatacgaacctatatccacatcttaacgcctaaaaaaaaaccgatcccctttatctccccctaaactctaaacgccgcgccccgcccgacccgcgccgctttccctacgactcgaaccctcaacgacaaacgaacgaacgcgcccaccgaaccgaccgaacgccgaacccgacaaacgacgacgactctcaacgcgcgcgcccgactaaccgacttaaaaaaaaacgaccgaaaccactctaaaacgctaccgcaaacaccgcctcaaaaataaaaaaaaaccatatctacgccgcgcaaaatatttacttataaaactaaaactcccacataaaaatcacgacgccaaaccgaatctcgcgaaatccacgccgaactccgccttaaaaaaaaaacgacccgaaaaaaaattacaaacccgaaaaaacgaaaataaacaaacgcgaaaaaaacgaatcgaaaaaacgaaactaccaaaaaccgttacttaccccaccgcctacacctaaccactaaacacgccctctaacctttaaatttcgaaaaattacgcgactaccacatcgattaccgt

SEQ ID NO: 20347 - DNA, 594 bp, Artificial Sequence
  chemically treated genomic DNA (Homo sapiens) CpG-island No: 20347
tacgttttggagttattaatggtgcgaatttgtatttatattttggcgtttagagaggaatcggttttttttgtttttttttgagttttgggcgtcgcgtttcgttcggttcgcgtcgttttttttgcggttcgggtttttagcggtaggcgggcgagcgcgtttatcggatcgatcggacgtcgggttcgataggcggcgacgatttttagcgcgcgcgttcgattagtcgatttgaggagagacgatcggaattattttgaggcgttgtcgtagatatcgttttaaagataggaagaggttatgtttgcgtcgcgtagagtgtttatttatagagttggagtttttatatggaggttacggcgttaagtcggatttcgcgagatttacgtcgggtttcgttttaaagaggaagcggttcgggagagggttatagattcgagggaacgaaaatgggtaggcgcggagagggcgggtcggaggggcggggttattaaaagtcgttatttgttttatcgtttgtatttggttattgggtacgttttttagtttttgggtttcggaagattgcgcggttattatatcggttgtcgt

SEQ ID NO: 20348 - DNA, 594 bp, Artificial Sequence
  chemically treated genomic DNA (Homo sapiens) CpG-island No: 20348
acgacaaccgatataataaccgcgcaatcttccgaaacccaaaaactaaaaaacgtacccaataaccaaatacaaacgataaaacaaataacgacttttaataaccccgcccctccgacccgccctctccgcgcctacccattttcgttccctcgaatctataaccctctcccgaaccgcttcctctttaaaacgaaacccgacgtaaatctcgcgaaatccgacttaacgccgtaacctccatataaaaactccaactctataaataaacactctacgcgacgcaaacataacctcttcctatctttaaaacgatatctacgacaacgcctcaaaataattccgatcgtctctcctcaaatcgactaatcgaacgcgcgcgctaaaaatcgtcgccgcctatcgaacccgacgtccgatcgatccgataaacgcgctcgcccgcctaccgctaaaaacccgaaccgcaaaaaaaacgacgcgaaccgaacgaaacgcgacgcccaaaactcaaaaaaaaacaaaaaaaaccgattcctctctaaacgccaaaatataaatacaaattcgcaccattaataactccaaaacgta

SEQ ID NO: 20349 - DNA, 520 bp, Artificial Sequence
  chemically treated genomic DNA (Homo sapiens) CpG-island No: 20349
  misc_feature (236)..(236): n is either a, c, g or t
  misc_feature (482)..(482): n is either a, c, g or t
  misc_feature (519)..(519): n is either a, c, g or t
tttcggaacgttttagaagataattcgggcgtttcgtttattttggttttttttggttttgtaacgcgattcgcgcgttcgcgtttcggcggattggagttatagaaagcgtatcgggcgtttttaaatgttaatgagagtttagggttcgattttcgagttaagtttttttatttttttttttcgttcgtttttttttttcgggtcggtgcgtcgtttagaaaaatttgtgcggngttatttttggggtagtaagatcgagcgaggagtttaagagagagcgcgtagtacgaagttcgagtcgttttcgtcgcgcgattttatttcggtcgtcgtcgtttgcgtcgcgagattcgtttcggttttttcgagagcgagtttcggtcgtcgcgattattagtcgcgttaatcgtcgattaatcgttatcgaggcgtttgagcgagagtagaggaggaggaggtatgagtgagggcggcgaggntattattattattattattattttttcgtagttcgang

SEQ ID NO: 20350 - DNA, 520 bp, Artificial Sequence
  chemically treated genomic DNA (Homo sapiens) CpG-island No: 20350
  misc_feature (2)..(2): n is either a, c, g or t
  misc_feature (39)..(39): n is either a, c, g or t
  misc_feature (285)..(285): n is either a, c, g or t
cntcgaactacgaaaaaataataataataataataatancctcgccgccctcactcatacctcctcctcctctactctcgctcaaacgcctcgataacgattaatcgacgattaacgcgactaataatcgcgacgaccgaaactcgctctcgaaaaaaccgaaacgaatctcgcgacgcaaacgacgacgaccgaaataaaatcgcgcgacgaaaacgactcgaacttcgtactacgcgctctctcttaaactcctcgctcgatcttactaccccaaaaataacnccgcacaaatttttctaaacgacgcaccgacccgaaaaaaaaaaacgaacgaaaaaaaaaaataaaaaaacttaactcgaaaatcgaaccctaaactctcattaacatttaaaaacgcccgatacgctttctataactccaatccgccgaaacgcgaacgcgcgaatcgcgttacaaaaccaaaaaaaaccaaaataaacgaaacgcccgaattatcttctaaaacgttccgaaa

SEQ ID NO: 20351 - DNA, 520 bp, Artificial Sequence
  chemically treated genomic DNA (Homo sapiens) CpG-island No: 20351
  misc_feature (2)..(2): n is either a, c, g or t
  misc_feature (39)..(39): n is either a, c, g or t
  misc_feature (285)..(285): n is either a, c, g or t
tntcgagttgcgggagggtggtggtggtggtggtggtgntttcgtcgtttttatttatgttttttttttttttgttttcgtttaggcgtttcggtggcggttggtcggcggttagcgcggttggtggtcgcggcggtcggggttcgttttcggggaggtcggggcggatttcgcggcgtaggcggcggcggtcgaggtggggtcgcgcggcggaggcggttcgagtttcgtgttgcgcgtttttttttgggtttttcgttcgattttattgttttaaaaatggtntcgtataagtttttttaggcggcgtatcggttcgggagggaagggcgggcgaggggagagggtggggaaatttggttcgggagtcgggttttggatttttattagtatttaaaggcgttcggtgcgttttttatggttttaattcgtcgggacgcgagcgcgcgggtcgcgttgtagaattaaggaaagttagggtgaacggggcgttcgggttgttttttggagcgtttcgagg

SEQ ID NO: 20352 - DNA, 520 bp, Artificial Sequence
  chemically treated genomic DNA (Homo sapiens) CpG-island No: 20352
  misc_feature (236)..(236): n is either a, c, g or t
  misc_feature (482)..(482): n is either a, c, g or t
  misc_feature (519)..(519): n is either a, c, g or t
cctcgaaacgctccaaaaaacaacccgaacgccccgttcaccctaactttccttaattctacaacgcgacccgcgcgctcgcgtcccgacgaattaaaaccataaaaaacgcaccgaacgcctttaaatactaataaaaatccaaaacccgactcccgaaccaaatttccccaccctctcccctcgcccgcccttccctcccgaaccgatacgccgcctaaaaaaacttatacganaccatttttaaaacaataaaatcgaacgaaaaacccaaaaaaaaacgcgcaacacgaaactcgaaccgcctccgccgcgcgaccccacctcgaccgccgccgcctacgccgcgaaatccgccccgacctccccgaaaacgaaccccgaccgccgcgaccaccaaccgcgctaaccgccgaccaaccgccaccgaaacgcctaaacgaaaacaaaaaaaaaaaaaacataaataaaaacgacgaaancaccaccaccaccaccaccaccctcccgcaactcgana

SEQ ID NO: 20353 - DNA, 536 bp, Artificial Sequence
  chemically treated genomic DNA (Homo sapiens) CpG-island No: 20353
cggaacgcgtcgttttcggaaacgtttagatttcggtagttaggtcgggaggtatcgtttatttttttagagcggagcgtggtttaggttgagtcgtcgtatcgtgggtttcgggtttcggtgacgagtagttgttcgttttcggtgagcgcgggagaaggggtttagtggggtagtgggcgacgcggagggtttaggtttaggtcgcggtcgcgtcgtattcgttggttgtttattttgttttgttttagggtgtaatatttgttttgcgtcgttcgtgtcgttttagttatcgttaaattcgggtagcgattcggggcgtttgtagcggtgtcgaggaagaggacgggaacggtgttacggtattggtgggtttttaataggtttgcggcgaacgttttttcggagcgttagggaagggtttcggcgtagggatgtcggagggattgggaaggaatgtgaaattaagtggggaatgtggagaacgggcggagagagaaggaaattttacggggttagggttataggatttttat

SEQ ID NO: 20354 - DNA, 536 bp, Artificial Sequence
  chemically treated genomic DNA (Homo sapiens) CpG-island No: 20354
ataaaaatcctataaccctaaccccgtaaaatttccttctctctccgcccgttctccacattccccacttaatttcacattccttcccaatccctccgacatccctacgccgaaacccttccctaacgctccgaaaaaacgttcgccgcaaacctattaaaaacccaccaataccgtaacaccgttcccgtcctcttcctcgacaccgctacaaacgccccgaatcgctacccgaatttaacgataactaaaacgacacgaacgacgcaaaacaaatattacaccctaaaacaaaacaaaataaacaaccaacgaatacgacgcgaccgcgacctaaacctaaaccctccgcgtcgcccactaccccactaaaccccttctcccgcgctcaccgaaaacgaacaactactcgtcaccgaaacccgaaacccacgatacgacgactcaacctaaaccacgctccgctctaaaaaaataaacgatacctcccgacctaactaccgaaatctaaacgtttccgaaaacgacgcgttccg

SEQ ID NO: 20355 - DNA, 536 bp, Artificial Sequence
  chemically treated genomic DNA (Homo sapiens) CpG-island No: 20355
gtaggaattttgtagttttagtttcgtgggattttttttttttttcgttcgttttttatattttttatttagttttatatttttttttaattttttcgatatttttgcgtcggggtttttttttagcgtttcgggaaagcgttcgtcgtaggtttgttaggggtttattaatatcgtaatatcgttttcgttttttttttcggtatcgttgtaaacgtttcgggtcgttattcggatttgacggtggttggagcggtacgggcgacgtaaggtaggtattgtattttggggtaaggtaaggtggataattagcggatgcggcgcggtcgcggtttgggtttgggtttttcgcgtcgtttattgttttattgggttttttttttcgcgtttatcggaggcgggtagttgttcgttatcgagattcgagatttacggtgcggcggtttaatttgggttacgtttcgttttagaggagtgggcggtgtttttcggtttagttgtcggggtttaggcgttttcgaggacggcgcgtttcg

SEQ ID NO: 20356 - DNA, 536 bp, Artificial Sequence
  chemically treated genomic DNA (Homo sapiens) CpG-island No: 20356
cgaaacgcgccgtcctcgaaaacgcctaaaccccgacaactaaaccgaaaaacaccgcccactcctctaaaacgaaacgtaacccaaattaaaccgccgcaccgtaaatctcgaatctcgataacgaacaactacccgcctccgataaacgcgaaaaaaaaaacccaataaaacaataaacgacgcgaaaaacccaaacccaaaccgcgaccgcgccgcatccgctaattatccaccttaccttaccccaaaatacaatacctaccttacgtcgcccgtaccgctccaaccaccgtcaaatccgaataacgacccgaaacgtttacaacgataccgaaaaaaaaaacgaaaacgatattacgatattaataaacccctaacaaacctacgacgaacgctttcccgaaacgctaaaaaaaaaccccgacgcaaaaatatcgaaaaaattaaaaaaaaatataaaactaaataaaaaatataaaaaacgaacgaaaaaaaaaaaaaatcccacgaaactaaaactacaaaattcctac

SEQ ID NO: 20357 - DNA, 562 bp, Artificial Sequence
  chemically treated genomic DNA (Homo sapiens) CpG-island No: 20357
gaaattttatttgtgcgtttagagttcggttatcgacggatacgttaggggagtcggtcgagtttagcgtcgcgttgtagggtcgggcgggtaggagttttttagcgtttcgggttttcggttcgcgtttatttcgtgtcgggagttgtatttgagtttcgcgtcgaagtttttcgggtttttttcgtttttgcgggttcgatcgttttttatggttttcgaggtcgttcgcgggttttataggcgtcgtttttgtcggcggtcggtttttatggttcgtagggcgcggggcgcggggcgtaggcggcgggatttcgggtaggtttagcgcgttcgatcggcggcggtgttttcgttttggcgcgtttttttttttttttttttttttttcggttgtagtttcgtttttatatttcggttcggtttacgtaggtagttttagggtgtggtttcggttcgtttagttcgtcgcgttcgtttgcgtatttgttcggtttatttgttcgttttcgtcggttttgggggaggttttttttttcggttttgggtttgaaggtgaggg

SEQ ID NO: 20358 - DNA, 562 bp, Artificial Sequence
  chemically treated genomic DNA (Homo sapiens) CpG-island No: 20358
ccctcaccttcaaacccaaaaccgaaaaaaaaaacctcccccaaaaccgacgaaaacgaacaaataaaccgaacaaatacgcaaacgaacgcgacgaactaaacgaaccgaaaccacaccctaaaactacctacgtaaaccgaaccgaaatataaaaacgaaactacaaccgaaaaaaaaaaaaaaaaaaaaaaaaacgcgccaaaacgaaaacaccgccgccgatcgaacgcgctaaacctacccgaaatcccgccgcctacgccccgcgccccgcgccctacgaaccataaaaaccgaccgccgacaaaaacgacgcctataaaacccgcgaacgacctcgaaaaccataaaaaacgatcgaacccgcaaaaacgaaaaaaacccgaaaaacttcgacgcgaaactcaaatacaactcccgacacgaaataaacgcgaaccgaaaacccgaaacgctaaaaaactcctacccgcccgaccctacaacgcgacgctaaactcgaccgactcccctaacgtatccgtcgataaccgaactctaaacgcacaaataaaatttc

SEQ ID NO: 20359 - DNA, 562 bp, Artificial Sequence
  chemically treated genomic DNA (Homo sapiens) CpG-island No: 20359
tttttatttttaggtttagagtcgaggggaggagttttttttagggtcggcgggggcgggtaggtgagtcgggtaggtgcgtaggcgagcgcggcgggttgggcgggtcgaggttatattttgaaattatttgcgtgggtcgggtcggagtgtgagagcggagttgtagtcggagaaagaggaagagggagagagagcgcgttagggcgagggtatcgtcgtcggtcgggcgcgttgggtttgttcggaatttcgtcgtttgcgtttcgcgtttcgcgttttgcgggttatgggagtcggtcgtcggtagggacgacgtttgtgagattcgcgagcggtttcggggattatggggagcgatcgggttcgtaagggcggagggggttcgaaggatttcggcgcgggatttaagtataattttcggtacgaggtgagcgcgggtcggggattcggggcgttgggaagtttttgttcgttcgattttgtagcgcggcgttgggttcggtcggtttttttggcgtgttcgtcggtggtcgagttttgggcgtataggtggaatttt

SEQ ID NO: 20360 - DNA, 562 bp, Artificial Sequence
  chemically treated genomic DNA (Homo sapiens) CpG-island No: 20360
aaaattccacctatacgcccaaaactcgaccaccgacgaacacgccaaaaaaaccgaccgaacccaacgccgcgctacaaaatcgaacgaacaaaaacttcccaacgccccgaatccccgacccgcgctcacctcgtaccgaaaattatacttaaatcccgcgccgaaatccttcgaaccccctccgcccttacgaacccgatcgctccccataatccccgaaaccgctcgcgaatctcacaaacgtcgtccctaccgacgaccgactcccataacccgcaaaacgcgaaacgcgaaacgcaaacgacgaaattccgaacaaacccaacgcgcccgaccgacgacgataccctcgccctaacgcgctctctctccctcttcctctttctccgactacaactccgctctcacactccgacccgacccacgcaaataatttcaaaatataacctcgacccgcccaacccgccgcgctcgcctacgcacctacccgactcacctacccgcccccgccgaccctaaaaaaaactcctcccctcgactctaaacctaaaaataaaaa

SEQ ID NO: 20361 - DNA, 732 bp, Artificial Sequence
  chemically treated genomic DNA (Homo sapiens) CpG-island No: 20361
agggcggcgattagcgtatcgattttttttttgtttgtcgcgattcgcggtggggttcgtacgaagtagtcgcggtacgcggggcggggcgacgttaaagtaatttcggagtaacgcgcggggtcgtcggttcgatatacgtttttttttgagcggtcgtcgtcgggcgtacgcgtttcgtagttcgaacgtcgttttatttttagagaaattaggcggcggttgtttgggtttttgtgtttgtagaaaaacgcgtaaatgcgtgaaagatttcgagaaaaatcggtttattttttttcgttatttatttaggtatagttagtagttcgtgtttttaaatattgttgatttttagtaggttcgtttttttttcggttcggtcgatttcgggttcggttttttttttcgcgtttgttttttttagaggcggtaagggtttggtattcgtaatttcgcgcggttttattttttgaatcgtagcgggagtgattttttttttgtttcgttgtttcggggtcgcgaaagttatagatatgttgtcgtcgttattattatcggtaagtttcgagcgtttcgggtgaacggtaaattgggggagagacgtcggtttttcgggttgaattatttcgggaatgcggggaggggggatgtttcggggttaagcggacgggcggcggggtaggtttgaaggaggtattttggttagggatgtttcgtttttgcgtattttgg

SEQ ID NO: 20362 - DNA, 732 bp, Artificial Sequence
  chemically treated genomic DNA (Homo sapiens) CpG-island No: 20362
ccaaaatacgcaaaaacgaaacatccctaaccaaaatacctccttcaaacctaccccgccgcccgtccgcttaaccccgaaacatcccccctccccgcattcccgaaataattcaacccgaaaaaccgacgtctctcccccaatttaccgttcacccgaaacgctcgaaacttaccgataataataacgacgacaacatatctataactttcgcgaccccgaaacaacgaaacaaaaaaaaaatcactcccgctacgattcaaaaaataaaaccgcgcgaaattacgaataccaaacccttaccgcctctaaaaaaaacaaacgcgaaaaaaaaaaccgaacccgaaatcgaccgaaccgaaaaaaaaacgaacctactaaaaatcaacaatatttaaaaacacgaactactaactatacctaaataaataacgaaaaaaaataaaccgatttttctcgaaatctttcacgcatttacgcgtttttctacaaacacaaaaacccaaacaaccgccgcctaatttctctaaaaataaaacgacgttcgaactacgaaacgcgtacgcccgacgacgaccgctcaaaaaaaaacgtatatcgaaccgacgaccccgcgcgttactccgaaattactttaacgtcgccccgccccgcgtaccgcgactacttcgtacgaaccccaccgcgaatcgcgacaaacaaaaaaaaaatcgatacgctaatcgccgccct

SEQ ID NO: 20363 - DNA, 732 bp, Artificial Sequence
  chemically treated genomic DNA (Homo sapiens) CpG-island No: 20363
ttagagtgcgtagaagcgagatatttttggttagagtgttttttttaggtttgtttcgtcgttcgttcgtttggtttcggagtatttttttttttcgtattttcgaggtggtttagttcgagaggtcggcgttttttttttagtttgtcgtttattcggagcgttcgggatttgtcgatagtggtgacggcggtaatatgtttgtggttttcgcggtttcgaggtagcgaggtaagggggagattattttcgttgcgatttagaaggtgaaatcgcgcggggttgcggatgttaggtttttatcgtttttgggagagatagacgcggggggaagggtcgggttcggagtcgatcgggtcgaggaggaggcgggtttgttgggaattagtagtgtttgggaatacggattgttggttgtgtttgagtgggtggcggaagagggtgaatcggtttttttcggagttttttacgtatttacgcgtttttttatagatataaaagtttaaatagtcgtcgtttgatttttttagggatggggcggcgttcgggttgcggggcgcgtgcgttcggcggcggtcgtttagggaagggcgtgtgtcggatcggcggtttcgcgcgttgtttcggagttattttggcgtcgtttcgtttcgcgtgtcgcggttgtttcgtgcggattttatcgcgggtcgcggtaggtagaggggaagtcggtgcgttggtcgtcgtttt

SEQ ID NO: 20364 - DNA, 732 bp, Artificial Sequence
  chemically treated genomic DNA (Homo sapiens) CpG-island No: 20364
aaaacgacgaccaacgcaccgacttcccctctacctaccgcgacccgcgataaaatccgcacgaaacaaccgcgacacgcgaaacgaaacgacgccaaaataactccgaaacaacgcgcgaaaccgccgatccgacacacgcccttccctaaacgaccgccgccgaacgcacgcgccccgcaacccgaacgccgccccatccctaaaaaaatcaaacgacgactatttaaacttttatatctataaaaaaacgcgtaaatacgtaaaaaactccgaaaaaaaccgattcaccctcttccgccacccactcaaacacaaccaacaatccgtattcccaaacactactaattcccaacaaacccgcctcctcctcgacccgatcgactccgaacccgacccttccccccgcgtctatctctcccaaaaacgataaaaacctaacatccgcaaccccgcgcgatttcaccttctaaatcgcaacgaaaataatctcccccttacctcgctacctcgaaaccgcgaaaaccacaaacatattaccgccgtcaccactatcgacaaatcccgaacgctccgaataaacgacaaactaaaaaaaaaacgccgacctctcgaactaaaccacctcgaaaatacgaaaaaaaaaaatactccgaaaccaaacgaacgaacgacgaaacaaacctaaaaaaaacactctaaccaaaaatatctcgcttctacgcactctaa

SEQ ID NO: 20365 - DNA, 795 bp, Artificial Sequence
  chemically treated genomic DNA (Homo sapiens) CpG-island No: 20365
cggcgttttttgggaaggaggtggttttagagtgggggtttcgcgggcgcgtagggattggggaggtttcgagggagtaagatatttaaattcgggcggtgggggggcgggcggtgttagacgtttaacgattatttttttttcggttcgcgtcgagttcggttatatttttttcgcgatattcgcgatcgttttttaggattggcggtttcgggtttcgtttttatttatttatttacgtaggggggcgttttgtttaggtaatttttttcgcgcgtttcgtcggggatcgggcggggacgggagaaggaaaagggtttttggtttcgggattagggtttcggagggtgtcgggcggggagcggaatagggaacgggttggtggcggttttaagcgggagggacggatcgatacgcggttttttggcggttttgcgattcgtcgatttgcggaatttcgtcgtcgtttttatagtttcgcggttatcgtcgattcgggtcggttttcggggcgtcgcgggtgttaaagggcgagtttacgcggatgttacggtcgtcgcgggtaaggatcgcgaggttgcggttttgtttcgaatttcggttgcgttggttacgtttttttacgcgcggggcggtcgtttcgttattcgtacggcgtttcgtagttgtttcggttggggattcgcggggtgtagtcgttcgggtcgtaggaggttgatgttagcgtttcgtcgtgatcgcgtttgttttttagataattttaaattattttatttttttttttgttatttttta

SEQ ID NO: 20366 - DNA, 795 bp, Artificial Sequence
  chemically treated genomic DNA (Homo sapiens) CpG-island No: 20366
taaaaaataacaaaaaaaaaaataaaataatttaaaattatctaaaaaacaaacgcgatcacgacgaaacgctaacatcaacctcctacgacccgaacgactacaccccgcgaatccccaaccgaaacaactacgaaacgccgtacgaataacgaaacgaccgccccgcgcgtaaaaaaacgtaaccaacgcaaccgaaattcgaaacaaaaccgcaacctcgcgatccttacccgcgacgaccgtaacatccgcgtaaactcgccctttaacacccgcgacgccccgaaaaccgacccgaatcgacgataaccgcgaaactataaaaacgacgacgaaattccgcaaatcgacgaatcgcaaaaccgccaaaaaaccgcgtatcgatccgtccctcccgcttaaaaccgccaccaacccgttccctattccgctccccgcccgacaccctccgaaaccctaatcccgaaaccaaaaacccttttccttctcccgtccccgcccgatccccgacgaaacgcgcgaaaaaaattacctaaacaaaacgcccccctacgtaaataaataaataaaaacgaaacccgaaaccgccaatcctaaaaaacgatcgcgaatatcgcgaaaaaaatataaccgaactcgacgcgaaccgaaaaaaaaataatcgttaaacgtctaacaccgcccgcccccccaccgcccgaatttaaatatcttactccctcgaaacctccccaatccctacgcgcccgcgaaacccccactctaaaaccacctccttcccaaaaaacgccg

SEQ ID NO: 20367 - DNA, 795 bp, Artificial Sequence
  chemically treated genomic DNA (Homo sapiens) CpG-island No: 20367
taaagggtaatagaggagaaaatggaatgatttaaaattatttggagaataggcgcggttacggcggaacgttgatattagttttttgcggttcgggcggttgtatttcgcgaatttttagtcggagtagttgcggggcgtcgtgcgggtggcggagcggtcgtttcgcgcgtggaggagcgtggttagcgtagtcgggattcggagtagggtcgtaatttcgcggtttttgttcgcggcgatcgtgatattcgcgtagattcgttttttaatattcgcgacgtttcggggatcggttcgggtcggcggtggtcgcggggttgtgagggcggcgacgaggtttcgtaggtcggcgagtcgtaaggtcgttagggggtcgcgtgtcggttcgtttttttcgtttggggtcgttattagttcgttttttgtttcgtttttcgttcggtatttttcggagttttggtttcggagttaggggtttttttttttttttcgttttcgttcggttttcgacggggcgcgcgggaggaattgtttgagtaggacgtttttttgcgtaggtgggtgggtgggagcggggttcggggtcgttagttttggggggcgatcgcgggtgtcgcggggagggtgtggtcgggttcggcgcgggtcgggagggaggtggtcgttgggcgtttgatatcgttcgtttttttatcgttcgggtttaaatgttttgttttttcggagtttttttagtttttgcgcgttcgcgggatttttattttggagttattttttttttagaagacgtcg

SEQ ID NO: 20368 - DNA, 795 bp, Artificial Sequence
  chemically treated genomic DNA (Homo sapiens) CpG-island No: 20368
cgacgtcttctaaaaaaaaaataactccaaaataaaaatcccgcgaacgcgcaaaaactaaaaaaactccgaaaaaacaaaacatttaaacccgaacgataaaaaaacgaacgatatcaaacgcccaacgaccacctccctcccgacccgcgccgaacccgaccacaccctccccgcgacacccgcgatcgccccccaaaactaacgaccccgaaccccgctcccacccacccacctacgcaaaaaaacgtcctactcaaacaattcctcccgcgcgccccgtcgaaaaccgaacgaaaacgaaaaaaaaaaaaaaacccctaactccgaaaccaaaactccgaaaaataccgaacgaaaaacgaaacaaaaaacgaactaataacgaccccaaacgaaaaaaacgaaccgacacgcgaccccctaacgaccttacgactcgccgacctacgaaacctcgtcgccgccctcacaaccccgcgaccaccgccgacccgaaccgatccccgaaacgtcgcgaatattaaaaaacgaatctacgcgaatatcacgatcgccgcgaacaaaaaccgcgaaattacgaccctactccgaatcccgactacgctaaccacgctcctccacgcgcgaaacgaccgctccgccacccgcacgacgccccgcaactactccgactaaaaattcgcgaaatacaaccgcccgaaccgcaaaaaactaatatcaacgttccgccgtaaccgcgcctattctccaaataattttaaatcattccattttctcctctattacccttta

SEQ ID NO: 20369 - DNA, 538 bp, Artificial Sequence
  chemically treated genomic DNA (Homo sapiens) CpG-island No: 20369
cgagttttcgaagagcgagttttcgtagtttttttcggcgcgttcgtatttggcgttgttcggagttcgttcgcgacgtatagggacgggaggttcggtttttacgggagaggttgcggattgcgggtttcgtttcgaggtcgggggagtgggagatattcggcgattttcgagaggcgattttggtagtggtggcggtggcggtggcggtggcggtttattcgttttttggaagtatcgtttcgtttgggtggcgcgcgcgtcggtttttttttttttttttcgtcgcggttcgtttcggttcgtaaatttaaatattttaggcgttcgttcgtcgcgcgtgattttcgtttcgtcgtcgtttagttttgcgcgttttgttcggcggttttcgttcggtcgtttcgggtttttggtttcgcggagcgatgttgttgttggttgtcgtttttttcgtggttttcgtgttgttgttgtatatggtgttttcgtttattagttttaagtttttcgttttgttcggggcgtatgtggtggt

SEQ ID NO: 20370 - DNA, 538 bp, Artificial Sequence
  chemically treated genomic DNA (Homo sapiens) CpG-island No: 20370
accaccacatacgccccgaacaaaacgaaaaacttaaaactaataaacgaaaacaccatatacaacaacaacacgaaaaccacgaaaaaaacgacaaccaacaacaacatcgctccgcgaaaccaaaaacccgaaacgaccgaacgaaaaccgccgaacaaaacgcgcaaaactaaacgacgacgaaacgaaaatcacgcgcgacgaacgaacgcctaaaatatttaaatttacgaaccgaaacgaaccgcgacgaaaaaaaaaaaaaaaaaccgacgcgcgcgccacccaaacgaaacgatacttccaaaaaacgaataaaccgccaccgccaccgccaccgccaccactaccaaaatcgcctctcgaaaatcgccgaatatctcccactcccccgacctcgaaacgaaacccgcaatccgcaacctctcccgtaaaaaccgaacctcccgtccctatacgtcgcgaacgaactccgaacaacgccaaatacgaacgcgccgaaaaaaactacgaaaactcgctcttcgaaaactcg

SEQ ID NO: 20371 - DNA, 538 bp, Artificial Sequence
  chemically treated genomic DNA (Homo sapiens) CpG-island No: 20371
attattatatgcgtttcgggtagggcgaggggtttggggttgatgagcggagatattatgtatagtagtagtacgaaggttacgaggaaggcggtagttagtagtagtatcgtttcgcggggttaggggttcggagcggtcgggcgggggtcgtcgggtaaggcgcgtagggttgggcggcggcgaggcgagaattacgcgcggcgggcgggcgtttggagtgtttgggtttgcgggtcggggcgggtcgcggcggaggggaagaggaggagtcggcgcgcgcgttatttaggcggggcggtgtttttagggggcgagtaggtcgttatcgttatcgttatcgttattattgttagaatcgtttttcgggggtcgtcgggtgttttttattttttcggtttcgggacggggttcgtagttcgtagtttttttcgtggaaatcgggtttttcgtttttgtgcgtcgcgagcgggtttcggatagcgttagatgcgagcgcgtcgggaagggttgcgaagattcgtttttcgggagttcg

SEQ ID NO: 20372 - DNA, 538 bp, Artificial Sequence
  chemically treated genomic DNA (Homo sapiens) CpG-island No: 20372
cgaactcccgaaaaacgaatcttcgcaacccttcccgacgcgctcgcatctaacgctatccgaaacccgctcgcgacgcacaaaaacgaaaaacccgatttccacgaaaaaaactacgaactacgaaccccgtcccgaaaccgaaaaaataaaaaacacccgacgacccccgaaaaacgattctaacaataataacgataacgataacgataacgacctactcgccccctaaaaacaccgccccgcctaaataacgcgcgcgccgactcctcctcttcccctccgccgcgacccgccccgacccgcaaacccaaacactccaaacgcccgcccgccgcgcgtaattctcgcctcgccgccgcccaaccctacgcgccttacccgacgacccccgcccgaccgctccgaacccctaaccccgcgaaacgatactactactaactaccgccttcctcgtaaccttcgtactactactatacataatatctccgctcatcaaccccaaacccctcgccctacccgaaacgcatataataat

SEQ ID NO: 20373 - DNA, 537 bp, Artificial Sequence
  chemically treated genomic DNA (Homo sapiens) CpG-island No: 20373
atagggtacgataatcgggagatagtgatgaagtatatttattataagttgtcgtagaggggttacgagtgggatgcgggagatgtgggcgtcgcgttttcgggggtcgttttcgtatcgggtattttttttttttagttcgggtatacgttttatttagtcgtatttcgggattcggtcgttaggatttcgtcgttgtagatttcggttgttttcggcgtcgtcgcggggtttgcgtttagttcggtgttatttgtggtttatttgatttttcgttaggtcggcgacgatttttttcgtcgttatcgtcgcgatttcgtcgagatgtttagttagttgtatttgacgttttttatcgcgcggggacgttttgttacggtggtggaggagttttttagggacggggtgaattgggggaggattgtggttttttttgagttcggtggggttatgtgtgtggagagcgttaatcgggagatgtcgtttttggtggataatatcgttttgtggatgattgagtatttgaatcggtatttg

SEQ ID NO: 20374 - DNA, 537 bp, Artificial Sequence
  chemically treated genomic DNA (Homo sapiens) CpG-island No: 20374
caaataccgattcaaatactcaatcatccacaaaacgatattatccaccaaaaacgacatctcccgattaacgctctccacacacataaccccaccgaactcaaaaaaaaccacaatcctcccccaattcaccccgtccctaaaaaactcctccaccaccgtaacaaaacgtccccgcgcgataaaaaacgtcaaatacaactaactaaacatctcgacgaaatcgcgacgataacgacgaaaaaaatcgtcgccgacctaacgaaaaatcaaataaaccacaaataacaccgaactaaacgcaaaccccgcgacgacgccgaaaacaaccgaaatctacaacgacgaaatcctaacgaccgaatcccgaaatacgactaaataaaacgtatacccgaactaaaaaaaaaaaatacccgatacgaaaacgacccccgaaaacgcgacgcccacatctcccgcatcccactcgtaacccctctacgacaacttataataaatatacttcatcactatctcccgattatcgtaccctat

SEQ ID NO: 20375 - DNA, 537 bp, Artificial Sequence
  chemically treated genomic DNA (Homo sapiens) CpG-island No: 20375
taggtgtcggtttaggtatttagttatttatagggcgatgttgtttattaggggcgatatttttcggttgacgttttttatatatatgattttatcgaatttaaagaaggttataatttttttttagtttatttcgtttttgaagagtttttttattatcgtggtaaagcgttttcgcgcggtgaagggcgttaggtgtagttggttggatatttcggcgaagtcgcggcggtagcggcgggagaagtcgtcgtcggtttggcggagggttaggtggattataggtggtatcgggttgagcgtaggtttcgcggcggcgtcgggggtagtcggggtttgtagcggcgaggttttggcgatcgggtttcgggatgcggttggatggggcgtgtgttcgggttgggaggagaagatgttcggtgcgggggcggttttcgggggcgcggcgtttatatttttcgtattttattcgtagtttttttgcgatagtttataatggatgtattttattattatttttcggttatcgtattttgt

SEQ ID NO: 20376 - DNA, 537 bp, Artificial Sequence
  chemically treated genomic DNA (Homo sapiens) CpG-island No: 20376
acaaaatacgataaccgaaaaataataataaaatacatccattataaactatcgcaaaaaaactacgaataaaatacgaaaaatataaacgccgcgcccccgaaaaccgcccccgcaccgaacatcttctcctcccaacccgaacacacgccccatccaaccgcatcccgaaacccgatcgccaaaacctcgccgctacaaaccccgactacccccgacgccgccgcgaaacctacgctcaacccgataccacctataatccacctaaccctccgccaaaccgacgacgacttctcccgccgctaccgccgcgacttcgccgaaatatccaaccaactacacctaacgcccttcaccgcgcgaaaacgctttaccacgataataaaaaaactcttcaaaaacgaaataaactaaaaaaaaattataaccttctttaaattcgataaaatcatatatataaaaaacgtcaaccgaaaaatatcgcccctaataaacaacatcgccctataaataactaaatacctaaaccgacaccta

SEQ ID NO: 20377 - DNA, 588 bp, Artificial Sequence
  chemically treated genomic DNA (Homo sapiens) CpG-island No: 20377
ggattttagcgaggagttcggtatagatagcgaatgatcgtagttagatagtcgtttttgttttttttcggttttgcggtaggattcgtcggtgtaggggttttttttcggattttacgcgtgtttggagggttttcgggttagggaagggggttttggagacgtttcgggcggtcgggcggtggcgggacgcgggttttttaagaaggagcgaggggcgcggttaggtaggggcgggtttagggcggattagcgttgcgtcggcgtcggttcgggagtcggatttggagcgcgaggcgtcggtgggggcggagggggttgcgcggcggaggttttcgtggtttcggacgttttttttagttagcggtcgtcgttcgtcgtcgtttgcgtttttagttttttcgtttcggcgggttcggtcgtcgttttcggtagtttatttgggaagcgtttatttgggacgcgtttatttgggacgcgttatttgttttcgggcgtttgggttttaggatgaaggatcgtttggagtagttgaaggtcgtgagtttcgtcgtaggcggggtgttgttaggaggggtgttgtatggg

SEQ ID NO: 20378 - DNA, 588 bp, Artificial Sequence
  chemically treated genomic DNA (Homo sapiens) CpG-island No: 20378
cccatacaacacccctcctaacaacaccccgcctacgacgaaactcacgaccttcaactactccaaacgatccttcatcctaaaacccaaacgcccgaaaacaaataacgcgtcccaaataaacgcgtcccaaataaacgcttcccaaataaactaccgaaaacgacgaccgaacccgccgaaacgaaaaaactaaaaacgcaaacgacgacgaacgacgaccgctaactaaaaaaaacgtccgaaaccacgaaaacctccgccgcgcaaccccctccgcccccaccgacgcctcgcgctccaaatccgactcccgaaccgacgccgacgcaacgctaatccgccctaaacccgcccctacctaaccgcgcccctcgctccttcttaaaaaacccgcgtcccgccaccgcccgaccgcccgaaacgtctccaaaacccccttccctaacccgaaaaccctccaaacacgcgtaaaatccgaaaaaaaacccctacaccgacgaatcctaccgcaaaaccgaaaaaaaacaaaaacgactatctaactacgatcattcgctatctataccgaactcctcgctaaaatcc

SEQ ID NO: 20379 - DNA, 588 bp, Artificial Sequence
  chemically treated genomic DNA (Homo sapiens) CpG-island No: 20379
tttatgtagtattttttttggtagtatttcgtttgcggcgaaatttacggtttttagttgttttagacggttttttattttgaagtttaggcgttcggaggtaggtagcgcgttttaggtgagcgcgttttaggtgagcgttttttaggtgagttgtcggaagcggcggtcgggttcgtcggggcgaaggagttggaggcgtaggcggcggcgggcggcggtcgttagttaggaggagcgttcgaggttacgggagttttcgtcgcgtagtttttttcgtttttatcggcgtttcgcgttttaaattcggttttcgggtcggcgtcggcgtagcgttgattcgttttggattcgtttttatttggtcgcgtttttcgtttttttttaaagggttcgcgtttcgttatcgttcggtcgttcggggcgtttttaaagtttttttttttaattcgagagttttttagatacgcgtggagttcggggagaggtttttgtatcggcggattttgtcgtagggtcgaggaagagtaagagcgattgtttggttgcggttattcgttgtttgtgtcgggtttttcgttaggattt

SEQ ID NO: 20380 - DNA, 588 bp, Artificial Sequence
  chemically treated genomic DNA (Homo sapiens) CpG-island No: 20380
aaatcctaacgaaaaacccgacacaaacaacgaataaccgcaaccaaacaatcgctcttactcttcctcgaccctacgacaaaatccgccgatacaaaaacctctccccgaactccacgcgtatctaaaaaactctcgaattaaaaaaaaaaactttaaaaacgccccgaacgaccgaacgataacgaaacgcgaaccctttaaaaaaaaacgaaaaacgcgaccaaataaaaacgaatccaaaacgaatcaacgctacgccgacgccgacccgaaaaccgaatttaaaacgcgaaacgccgataaaaacgaaaaaaactacgcgacgaaaactcccgtaacctcgaacgctcctcctaactaacgaccgccgcccgccgccgcctacgcctccaactccttcgccccgacgaacccgaccgccgcttccgacaactcacctaaaaaacgctcacctaaaacgcgctcacctaaaacgcgctacctacctccgaacgcctaaacttcaaaataaaaaaccgtctaaaacaactaaaaaccgtaaatttcgccgcaaacgaaatactaccaaaaaaaatactacataaa

SEQ ID NO: 20381 - DNA, 579 bp, Artificial Sequence
  chemically treated genomic DNA (Homo sapiens) CpG-island No: 20381
cgtagtgcggtgtagttttagtggaagttttggcgaatttggcgcgcgttgcggtgtatagagggttaattggagttggcgttgggtggagaggaggagacgcgtttttattggcggaaagttatttaggggcggggttagtgaattttcgtattttattttttttttcgtaatttttttttttattttgtattttttttttttcgattgtgaagcgggtcgggatttgttaggttagattaaatcggatttcgggggcgatgcggttgttgtttttgttgcggattgttttttgggtcgcgtttttcggtttttttttgcgcgggggttttagttttcgttacgtagtttattggaattttagtaattttaggtagtcgggtcgaatcgggcgagcgtatagttaagtttgcgcgttttcgggttttgcgcgcgttcgttattcgttttttgcgcggcgtcgtttgagtttggtcgcgcgtcggggtttttttgtttgagtcggcgggggaggggggaggggcgaggggcgaggcgcgtttttgggttttttatagttcgtatgtgttggggggtagg

SEQ ID NO: 20382 - DNA, 579 bp, Artificial Sequence
  chemically treated genomic DNA (Homo sapiens) CpG-island No: 20382
cctaccccccaacacatacgaactataaaaaacccaaaaacgcgcctcgcccctcgcccctcccccctcccccgccgactcaaacaaaaaaaccccgacgcgcgaccaaactcaaacgacgccgcgcaaaaaacgaataacgaacgcgcgcaaaacccgaaaacgcgcaaacttaactatacgctcgcccgattcgacccgactacctaaaattactaaaattccaataaactacgtaacgaaaactaaaacccccgcgcaaaaaaaaaccgaaaaacgcgacccaaaaaacaatccgcaacaaaaacaacaaccgcatcgcccccgaaatccgatttaatctaacctaacaaatcccgacccgcttcacaatcgaaaaaaaaaaaatacaaaataaaaaaaaaaattacgaaaaaaaaaataaaatacgaaaattcactaaccccgcccctaaataactttccgccaataaaaacgcgtctcctcctctccacccaacgccaactccaattaaccctctatacaccgcaacgcgcgccaaattcgccaaaacttccactaaaactacaccgcactacg

SEQ ID NO: 20383 - DNA, 579 bp, Artificial Sequence
  chemically treated genomic DNA (Homo sapiens) CpG-island No: 20383
tttgttttttaatatatgcgggttgtgggagatttaggggcgcgtttcgtttttcgttttttttttttttttcgtcggtttaaataaaggagtttcggcgcgcggttaggtttaggcggcgtcgcgtaaagagcgggtggcgggcgcgcgtaaagttcgggagcgcgtagatttggttgtgcgttcgttcggttcggttcggttatttggggttattggagttttagtagattacgtggcggaggttggagttttcgcgtagaggggagtcgaggaacgcggtttagaggatagttcgtagtaggggtagtagtcgtatcgttttcgaggttcggtttggtttggtttggtaggtttcggttcgttttatagtcgaggagagaaaggtataaagtgaagagggaagttgcggaaaggggagtggggtacggagatttattgatttcgtttttgaataatttttcgttaatgggagcgcgtttttttttttttatttagcgttaattttagttaattttttgtgtatcgtagcgcgcgttaggttcgttaaagtttttattgaggttgtatcgtattgcg

SEQ ID NO: 20384 - DNA, 579 bp, Artificial Sequence
  chemically treated genomic DNA (Homo sapiens) CpG-island No: 20384
cgcaatacgatacaacctcaataaaaactttaacgaacctaacgcgcgctacgatacacaaaaaattaactaaaattaacgctaaataaaaaaaaaaaaacgcgctcccattaacgaaaaattattcaaaaacgaaatcaataaatctccgtaccccactcccctttccgcaacttccctcttcactttatacctttctctcctcgactataaaacgaaccgaaacctaccaaaccaaaccaaaccgaacctcgaaaacgatacgactactacccctactacgaactatcctctaaaccgcgttcctcgactcccctctacgcgaaaactccaacctccgccacgtaatctactaaaactccaataaccccaaataaccgaaccgaaccgaacgaacgcacaaccaaatctacgcgctcccgaactttacgcgcgcccgccacccgctctttacgcgacgccgcctaaacctaaccgcgcgccgaaactcctttatttaaaccgacgaaaaaaaaaaaaaaaacgaaaaacgaaacgcgcccctaaatctcccacaacccgcatatattaaaaaacaaa

SEQ ID NO: 20385 - DNA, 511 bp, Artificial Sequence
  chemically treated genomic DNA (Homo sapiens) CpG-island No: 20385
gttatatcgtgtaggtgaacgtgaacgattatttggatatttattgttcgtattataatagttcgggggtgggtttcggggcgggatcggggttcggaggcggggtagagtagtacgtgttgtatatggtgagtcgtaacggttatcgtatttgtaacgttagttagggttttaagcgttgggagtgtaatcggtcgtacgtttcgtatagttttattaagttttcggagaagttttagcgttatagcgttttttttttgggttacgagttttacgtcggttacgagtattattatatttgtgagtgacggcggtcgggcgggcgggtttgaacgcgagagtttgagtgatagtcggggggtggagtttttaggtttcggggcggggtcggcgcggcgggcgttaggtttcgcggttgagattagggaggaggcgtgggtacgggacgtttgaggggtttagtttagacgaggtcgtggggttaagagaggagtttggtgatagttttaag

SEQ ID NO: 20386 - DNA, 511 bp, Artificial Sequence
  chemically treated genomic DNA (Homo sapiens) CpG-island No: 20386
cttaaaactatcaccaaactcctctcttaaccccacgacctcgtctaaactaaacccctcaaacgtcccgtacccacgcctcctccctaatctcaaccgcgaaacctaacgcccgccgcgccgaccccgccccgaaacctaaaaactccaccccccgactatcactcaaactctcgcgttcaaacccgcccgcccgaccgccgtcactcacaaatataataatactcgtaaccgacgtaaaactcgtaacccaaaaaaaaaacgctataacgctaaaacttctccgaaaacttaataaaactatacgaaacgtacgaccgattacactcccaacgcttaaaaccctaactaacgttacaaatacgataaccgttacgactcaccatatacaacacgtactactctaccccgcctccgaaccccgatcccgccccgaaacccacccccgaactattataatacgaacaataaatatccaaataatcgttcacgttcacctacacgatataac

SEQ ID NO: 20387 - DNA, 511 bp, Artificial Sequence
  chemically treated genomic DNA (Homo sapiens) CpG-island No: 20387
tttgggattgttattaaattttttttttggttttacgatttcgtttgagttgaattttttaggcgtttcgtgtttacgttttttttttggttttagtcgcgagatttggcgttcgtcgcgtcggtttcgtttcggagtttaggggttttatttttcggttgttatttagattttcgcgtttagattcgttcgttcggtcgtcgttatttatagatgtagtagtattcgtggtcggcgtggaattcgtagtttagagagaaggcgttgtagcgttggaattttttcgagaatttgatggggttgtgcggggcgtgcggtcggttgtatttttagcgtttgaagttttggttggcgttgtaggtgcggtagtcgttgcggtttattatgtatagtacgtattgttttgtttcgttttcgggtttcggtttcgtttcggggtttattttcgagttgttgtagtgcgggtagtaaatatttagatagtcgtttacgtttatttgtacggtgtagt

SEQ ID NO: 20388 - DNA, 511 bp, Artificial Sequence
  chemically treated genomic DNA (Homo sapiens) CpG-island No: 20388
actacaccgtacaaataaacgtaaacgactatctaaatatttactacccgcactacaacaactcgaaaataaaccccgaaacgaaaccgaaacccgaaaacgaaacaaaacaatacgtactatacataataaaccgcaacgactaccgcacctacaacgccaaccaaaacttcaaacgctaaaaatacaaccgaccgcacgccccgcacaaccccatcaaattctcgaaaaaattccaacgctacaacgccttctctctaaactacgaattccacgccgaccacgaatactactacatctataaataacgacgaccgaacgaacgaatctaaacgcgaaaatctaaataacaaccgaaaaataaaacccctaaactccgaaacgaaaccgacgcgacgaacgccaaatctcgcgactaaaaccaaaaaaaaaacgtaaacacgaaacgcctaaaaaattcaactcaaacgaaatcgtaaaaccaaaaaaaaaatttaataacaatcccaaa

SEQ ID NO: 20389 - DNA, 668 bp, Artificial Sequence
  chemically treated genomic DNA (Homo sapiens) CpG-island No: 20389
  misc_feature (566)..(566): n is either a, c, g or t
  misc_feature (629)..(629): n is either a, c, g or t
  misc_feature (636)..(636): n is either a, c, g or t
ttcgtttcgttttcgggttggcgttaacgtttattttttaatagcgttattcgttggcggatattttgtatcgcggttgttcgtttttgcgtcgttggttgtgtcggcgttgcgtggtgtgttaggtattcgagacgttcgagttttacgtgtgtcggacgttggattgcgaggtcgtgtattgttggtcgtgttgggacgatatgcggtagcggtgttcggtttgtacgtttcgcgaagagtttttttttttcgtttttagtgatagtaacgacgatattgtttacgcggggtgaagaggcgttttgttcgttttttcgtatcgtttttttcggttaataaaatgttttgtacgttttacgtgggtcggggattggggtgagtcgcgtattgtttcgtttgtagtcgggaaagtttgttcgttcgattttttcgagttaggtcgcgtataggaggtagggaggtcgcgaagttattagggaggggttcggatttggcgtcgggtgaaggcgcgtcgtttaagtcggttcggatcgggtatcggtttttatttcgtatagttgcgnggaaagcggtagcgttgaatagcgcgggcgtagtgggcggtgtttcgttttcgaggtatcggngcgtagnggggcggtttttgtcgggggcggaatttggtt

SEQ ID NO: 20390 - DNA, 668 bp, Artificial Sequence
  chemically treated genomic DNA (Homo sapiens) CpG-island No: 20390
  misc_feature (33)..(33): n is either a, c, g or t
  misc_feature (40)..(40): n is either a, c, g or t
  misc_feature (103)..(103): n is either a, c, g or t
aaccaaattccgcccccgacaaaaaccgccccnctacgcnccgatacctcgaaaacgaaacaccgcccactacgcccgcgctattcaacgctaccgctttccncgcaactatacgaaataaaaaccgatacccgatccgaaccgacttaaacgacgcgccttcacccgacgccaaatccgaacccctccctaataacttcgcgacctccctacctcctatacgcgacctaactcgaaaaaatcgaacgaacaaactttcccgactacaaacgaaacaatacgcgactcaccccaatccccgacccacgtaaaacgtacaaaacattttattaaccgaaaaaaacgatacgaaaaaacgaacaaaacgcctcttcaccccgcgtaaacaatatcgtcgttactatcactaaaaacgaaaaaaaaaaactcttcgcgaaacgtacaaaccgaacaccgctaccgcatatcgtcccaacacgaccaacaatacacgacctcgcaatccaacgtccgacacacgtaaaactcgaacgtctcgaatacctaacacaccacgcaacgccgacacaaccaacgacgcaaaaacgaacaaccgcgatacaaaatatccgccaacgaataacgctattaaaaaataaacgttaacgccaacccgaaaacgaaacgaa

SEQ ID NO: 20391 - DNA, 668 bp, Artificial Sequence
  chemically treated genomic DNA (Homo sapiens) CpG-island No: 20391
  misc_feature (33)..(33): n is either a, c, g or t
  misc_feature (40)..(40): n is either a, c, g or t
  misc_feature (103)..(103): n is either a, c, g or t
agttaagtttcgttttcggtaaaggtcgttttnttgcgtntcggtgtttcgggagcgggatatcgtttattacgttcgcgttgtttagcgttatcgttttttncgtaattgtgcggaatgggagtcggtgttcggttcggatcggtttgggcggcgcgtttttattcggcgttaagttcggatttttttttagtagtttcgcggtttttttgttttttgtgcgcggtttggttcggagaggtcgggcgggtaggttttttcgattgtaggcgaggtagtgcgcggtttattttagttttcgatttacgtgaagcgtatagggtattttattaatcgggaaggacggtgcggaagagcgagtaggacgtttttttatttcgcgtaggtagtgtcgtcgttgttgttattaaaggcggaggaagagagtttttcgcggggcgtgtagatcgggtatcgttgtcgtatgtcgttttagtacgattagtagtatacggtttcgtagtttagcgttcggtatacgtaggattcgggcgtttcgggtgtttggtatattacgtagcgtcggtatagttagcggcgtaggagcgggtagtcgcggtgtaggatattcgttagcgggtggcgttgttgggaggtgggcgttagcgttagttcgggagcgaggcggg

SEQ ID NO: 20392 - DNA, 668 bp, Artificial Sequence
  chemically treated genomic DNA (Homo sapiens) CpG-island No: 20392
  misc_feature (566)..(566): n is either a, c, g or t
  misc_feature (629)..(629): n is either a, c, g or t
  misc_feature (636)..(636): n is either a, c, g or t
cccgcctcgctcccgaactaacgctaacgcccacctcccaacaacgccacccgctaacgaatatcctacaccgcgactacccgctcctacgccgctaactataccgacgctacgtaatataccaaacacccgaaacgcccgaatcctacgtataccgaacgctaaactacgaaaccgtatactactaatcgtactaaaacgacatacgacaacgatacccgatctacacgccccgcgaaaaactctcttcctccgcctttaataacaacaacgacgacactacctacgcgaaataaaaaaacgtcctactcgctcttccgcaccgtccttcccgattaataaaataccctatacgcttcacgtaaatcgaaaactaaaataaaccgcgcactacctcgcctacaatcgaaaaaacctacccgcccgacctctccgaaccaaaccgcgcacaaaaaacaaaaaaaccgcgaaactactaaaaaaaaatccgaacttaacgccgaataaaaacgcgccgcccaaaccgatccgaaccgaacaccgactcccattccgcacaattacgnaaaaaacgataacgctaaacaacgcgaacgtaataaacgatatcccgctcccgaaacaccganacgcaanaaaacgacctttaccgaaaacgaaacttaact

SEQ ID NO: 20393 - DNA, 703 bp, Artificial Sequence
  chemically treated genomic DNA (Homo sapiens) CpG-island No: 20393
tgtcgattttagtgttatttttcgcgtcgttaatacgcgggaaattttaaatgttggttttcgggagatgataggtttagtttcgtacgtttttcgttattagttttatcgcgtcgaggggggttttaatttaggttttggagaagcgtcgggtcggatttttggttgcggagtttcgggcgagtgagtgggcgggcgtttatcgcgatgatattgacgaaggtggttttgttcgagtattgtagttttacgagcgttagttttattttttttttttagaagagcgaacggaattagtttagtaggcgggagatgagcgttagtatgatggcggtcgggagcgagaacggacgggaggacggacgagcggcggcgtcgacgatttttatacgagcgggttttcgttcggattttttaacggttttttggtgtttcggcgcgatacgggcggatatcggcgggcggtagtagttagatttaggaagtcgagcggattatatgattcgttttattttttacgttcgtttcggcgtcgtcgtcggtatttacggtaagagcggcgcggttaattcggttaggttcgttcgtcgttggtatcgttatttggtgggtatgtttcgtagtatagcgtattttcgggtttttttgaggttttttttatatttatttattgttggtttattcgttatttatttatttatat

SEQ ID NO: 20394 - DNA, 703 bp, Artificial Sequence
  chemically treated genomic DNA (Homo sapiens) CpG-island No: 20394
atataaataaataaataacgaataaaccaacaataaataaatataaaaaaaacctcaaaaaaacccgaaaatacgctatactacgaaacatacccaccaaataacgataccaacgacgaacgaacctaaccgaattaaccgcgccgctcttaccgtaaataccgacgacgacgccgaaacgaacgtaaaaaataaaacgaatcatataatccgctcgacttcctaaatctaactactaccgcccgccgatatccgcccgtatcgcgccgaaacaccaaaaaaccgttaaaaaatccgaacgaaaacccgctcgtataaaaatcgtcgacgccgccgctcgtccgtcctcccgtccgttctcgctcccgaccgccatcatactaacgctcatctcccgcctactaaactaattccgttcgctcttctaaaaaaaaaaaataaaactaacgctcgtaaaactacaatactcgaacaaaaccaccttcgtcaatatcatcgcgataaacgcccgcccactcactcgcccgaaactccgcaaccaaaaatccgacccgacgcttctccaaaacctaaattaaaacccccctcgacgcgataaaactaataacgaaaaacgtacgaaactaaacctatcatctcccgaaaaccaacatttaaaatttcccgcgtattaacgacgcgaaaaataacactaaaatcgaca

SEQ ID NO: 20395 - DNA, 703 bp, Artificial Sequence
  chemically treated genomic DNA (Homo sapiens) CpG-island No: 20395
gtataagtggatgaatgacgaatgaattaataatgaatgaatgtagagaaagttttaagggggttcgagggtacgttgtgttgcggagtatgtttattaggtggcgatgttagcggcgggcgggtttggtcggattggtcgcgtcgtttttgtcgtgggtgtcgacggcggcgtcgggacgggcgtggggggtagggcgagttatatgattcgttcggttttttgggtttggttgttgtcgttcgtcggtgttcgttcgtgtcgcgtcggggtattaaggagtcgttggagggttcgggcggaggttcgttcgtgtggaagtcgtcgacgtcgtcgttcgttcgttttttcgttcgttttcgttttcggtcgttattatgttggcgtttatttttcgtttgttggattggtttcgttcgtttttttggaaggaagagatggagttgacgttcgtggggttgtagtattcgggtaagattattttcgttaatgttatcgcggtgagcgttcgtttatttattcgttcggggtttcgtagttaggagttcggttcggcgtttttttaaggtttgagttggggtttttttcggcgcgatgggattgatggcggggggcgtgcgaagttgggtttgttatttttcgagggttagtatttggaatttttcgcgtgttggcggcgcggggagtagtattgagatcggta

SEQ ID NO: 20396 - DNA, 703 bp, Artificial Sequence
  chemically treated genomic DNA (Homo sapiens) CpG-island No: 20396
taccgatctcaatactactccccgcgccgccaacacgcgaaaaattccaaatactaaccctcgaaaaataacaaacccaacttcgcacgccccccgccatcaatcccatcgcgccgaaaaaaaccccaactcaaaccttaaaaaaacgccgaaccgaactcctaactacgaaaccccgaacgaataaataaacgaacgctcaccgcgataacattaacgaaaataatcttacccgaatactacaaccccacgaacgtcaactccatctcttccttccaaaaaaacgaacgaaaccaatccaacaaacgaaaaataaacgccaacataataacgaccgaaaacgaaaacgaacgaaaaaacgaacgaacgacgacgtcgacgacttccacacgaacgaacctccgcccgaaccctccaacgactccttaataccccgacgcgacacgaacgaacaccgacgaacgacaacaaccaaacccaaaaaaccgaacgaatcatataactcgccctaccccccacgcccgtcccgacgccgccgtcgacacccacgacaaaaacgacgcgaccaatccgaccaaacccgcccgccgctaacatcgccacctaataaacatactccgcaacacaacgtaccctcgaacccccttaaaactttctctacattcattcattattaattcattcgtcattcatccacttatac

SEQ ID NO: 20397 - DNA, 559 bp, Artificial Sequence
  chemically treated genomic DNA (Homo sapiens) CpG-island No: 20397
tcgaggtcggtttgggttcgggtagttaggtttgacgcggtttcgcgttttttttcggtagagaagttcgggacggttatgtgcgtgggttgcgggagttagatttacgattagtttattttgcgggtgtcgttcgatttcgagtggtacgcggtttgttttaagtgtgtcgagtgtagttagtatttggacgagacgtgtacgtgtttcgtgagagacgggaagatttattgtaagcgggattatgttaggtgaggtcggcgggaacgcgggttgggttatcgcgcgtaggggtcggggtcgggattggggatggcggtttgttcgcgcgtttcggttttgtttagggagaaggttattcgtatttcgtacgggtgtcgtagcgttttttcgggttcgggaatgttcgtaggcgggttatcggagttttttggtggttataaagtgttttgagcgcgcgtcggagtcggattttttatggagatgagggcgggcgtaggtttaacgttgatatttgttaattttgggttagtaggttgttaggtattaagtgcgttaa

SEQ ID NO: 20398 - DNA, 559 bp, Artificial Sequence
  chemically treated genomic DNA (Homo sapiens) CpG-island No: 20398
ttaacgcacttaatacctaacaacctactaacccaaaattaacaaatatcaacgttaaacctacgcccgccctcatctccataaaaaatccgactccgacgcgcgctcaaaacactttataaccaccaaaaaactccgataacccgcctacgaacattcccgaacccgaaaaaacgctacgacacccgtacgaaatacgaataaccttctccctaaacaaaaccgaaacgcgcgaacaaaccgccatccccaatcccgaccccgacccctacgcgcgataacccaacccgcgttcccgccgacctcacctaacataatcccgcttacaataaatcttcccgtctctcacgaaacacgtacacgtctcgtccaaatactaactacactcgacacacttaaaacaaaccgcgtaccactcgaaatcgaacgacacccgcaaaataaactaatcgtaaatctaactcccgcaacccacgcacataaccgtcccgaacttctctaccgaaaaaaaacgcgaaaccgcgtcaaacctaactacccgaacccaaaccgacctcga

SEQ ID NO: 20399 - DNA, 559 bp, Artificial Sequence
  chemically treated genomic DNA (Homo sapiens) CpG-island No: 20399
ttggcgtatttgatatttaatagtttattggtttaaggttagtaggtgttagcgttggatttgcgttcgtttttatttttatggaagattcggtttcggcgcgcgtttagaatattttgtggttattagaagatttcggtgattcgtttgcgggtattttcgggttcgggggagcgttgcggtattcgtgcgggatgcggatggttttttttttgggtagggtcggggcgcgcgggtaggtcgttatttttagtttcggtttcggtttttgcgcgcggtggtttagttcgcgttttcgtcggttttatttgatatagtttcgtttgtagtaggttttttcgttttttacgaagtacgtgtacgtttcgtttaggtattggttgtattcggtatatttgaggtaggtcgcgtgttattcgaggtcgggcgatattcgtaggataaattggtcgtggatttgattttcgtagtttacgtatatggtcgtttcgggtttttttgtcggggaagggcgcggggtcgcgttaggtttgattgttcggatttaggtcggtttcgg

SEQ ID NO: 20400 - DNA, 559 bp, Artificial Sequence
  chemically treated genomic DNA (Homo sapiens) CpG-island No: 20400
ccgaaaccgacctaaatccgaacaatcaaacctaacgcgaccccgcgcccttccccgacaaaaaaacccgaaacgaccatatacgtaaactacgaaaatcaaatccacgaccaatttatcctacgaatatcgcccgacctcgaataacacgcgacctacctcaaatataccgaatacaaccaatacctaaacgaaacgtacacgtacttcgtaaaaaacgaaaaaacctactacaaacgaaactatatcaaataaaaccgacgaaaacgcgaactaaaccaccgcgcgcaaaaaccgaaaccgaaactaaaaataacgacctacccgcgcgccccgaccctacccaaaaaaaaaaccatccgcatcccgcacgaataccgcaacgctcccccgaacccgaaaatacccgcaaacgaatcaccgaaatcttctaataaccacaaaatattctaaacgcgcgccgaaaccgaatcttccataaaaataaaaacgaacgcaaatccaacgctaacacctactaaccttaaaccaataaactattaaatatcaaatacgccaa

SEQ ID NO: 20401 - DNA, 848 bp, Artificial Sequence
  chemically treated genomic DNA (Homo sapiens) CpG-island No: 20401
gtcgcgcggttttgtttttttatttagtcgatgattcgggtttcgagcgtttggtgggcgttttggcgtcggttttgtgttagttgtcgttgcgcgtggtcgtagatttgtggagtcgtcgtgaattgagcgcgtaggggttcgtggtttggttttacgcgtagcggcgttagattttgtaggagggcggcgtggtggttttgtttttttttttcggtgcggtggcgttgtgtagcgagtggttataggatggggtgttcgggttcggggcgtacggttcgtacgacgtttttcgcgtttcgtttagttgcgtgttgttcgattttttgtagggtcgggcgttcggtagttacgtgggggtttgtttcgataggttgttttattcggacgtcgtattcgttttttttcgtatcgtgttcgtttttatattgtttttttaattgttagattttttgggggttttgtagtagtttcgcgtttcgcgtttcgggcggttttaagagagagcggagtaagtgtttcgggttttttagttagttttggatagttatttttatttttcggggattttcgcgtcgggacgcggggtgggattaggggcgggatttggggcgggggacgggatttaaataaaggtagacgttgtttttttatttatgtggtttatacgcgttttcgttttagtggcggggttggtaaacgtcgttttttagtttcgcggttttataaagttcggataggtgtagttcggtgtcgtttttggttggttggcgtggggtgacgtaatgggatatggttcgttgttattggtttggtcgggaagtttcgtttttttggatatgaggttt

SEQ ID NO: 20402 - DNA, 848 bp, Artificial Sequence
  chemically treated genomic DNA (Homo sapiens) CpG-island No: 20402
aaacctcatatccaaaaaaacgaaacttcccgaccaaaccaataacaacgaaccatatcccattacgtcaccccacgccaaccaaccaaaaacgacaccgaactacacctatccgaactttataaaaccgcgaaactaaaaaacgacgtttaccaaccccgccactaaaacgaaaacgcgtataaaccacataaataaaaaaacaacgtctacctttatttaaatcccgtcccccgccccaaatcccgcccctaatcccaccccgcgtcccgacgcgaaaatccccgaaaaataaaaataactatccaaaactaactaaaaaacccgaaacacttactccgctctctcttaaaaccgcccgaaacgcgaaacgcgaaactactacaaaacccccaaaaaatctaacaattaaaaaaacaatataaaaacgaacacgatacgaaaaaaaacgaatacgacgtccgaataaaacaacctatcgaaacaaacccccacgtaactaccgaacgcccgaccctacaaaaaatcgaacaacacgcaactaaacgaaacgcgaaaaacgtcgtacgaaccgtacgccccgaacccgaacaccccatcctataaccactcgctacacaacgccaccgcaccgaaaaaaaaaaacaaaaccaccacgccgccctcctacaaaatctaacgccgctacgcgtaaaaccaaaccacgaacccctacgcgctcaattcacgacgactccacaaatctacgaccacgcgcaacgacaactaacacaaaaccgacgccaaaacgcccaccaaacgctcgaaacccgaatcatcgactaaataaaaaaacaaaaccgcgcgac

SEQ ID NO: 20403 - DNA, 848 bp, Artificial Sequence
  chemically treated genomic DNA (Homo sapiens) CpG-island No: 20403
gggttttatgtttaagggggcggagtttttcggttaagttaatggtaacgggttatgttttattacgttattttacgttagttaattagaggcggtatcgagttgtatttgttcgggttttatagggtcgcggggttagggaacgacgtttgttagtttcgttattgaaacgaagacgcgtgtgggttatatgggtagaaaaatagcgtttgtttttatttaagtttcgtttttcgttttaggtttcgtttttggttttatttcgcgtttcggcgcgggagttttcgggggatggaagtagttatttagggttggttgaagggttcgggatatttgtttcgtttttttttggagtcgttcggaacgcggggcgcgaggttgttgtagggtttttaggaagtttggtagttgggagggtagtgtgaagacgggtacggtgcggaaaagggcgggtacggcgttcgggtggagtagtttgtcgaagtaggtttttacgtagttgtcgggcgttcggttttgtaagaagtcgggtagtacgtagttgagcgaggcgcggaaggcgtcgtgcgggtcgtgcgtttcgggttcggatattttattttgtagttattcgttgtatagcgttatcgtatcgggagagaagagtaagattattacgtcgtttttttgtagggtttggcgtcgttgcgcgtgaaattaagttacgggtttttgcgcgtttagtttacgacggttttataggtttacggttacgcgtagcggtagttggtatagggtcgacgttagggcgtttattaggcgttcgaaattcgagttatcggttgagtagaggagtagagtcgcgcggt

SEQ ID NO: 20404 - DNA, 848 bp, Artificial Sequence
  chemically treated genomic DNA (Homo sapiens) CpG-island No: 20404
accgcgcgactctactcctctactcaaccgataactcgaatttcgaacgcctaataaacgccctaacgtcgaccctataccaactaccgctacgcgtaaccgtaaacctataaaaccgtcgtaaactaaacgcgcaaaaacccgtaacttaatttcacgcgcaacgacgccaaaccctacaaaaaaacgacgtaataatcttactcttctctcccgatacgataacgctatacaacgaataactacaaaataaaatatccgaacccgaaacgcacgacccgcacgacgccttccgcgcctcgctcaactacgtactacccgacttcttacaaaaccgaacgcccgacaactacgtaaaaacctacttcgacaaactactccacccgaacgccgtacccgcccttttccgcaccgtacccgtcttcacactaccctcccaactaccaaacttcctaaaaaccctacaacaacctcgcgccccgcgttccgaacgactccaaaaaaaaacgaaacaaatatcccgaacccttcaaccaaccctaaataactacttccatcccccgaaaactcccgcgccgaaacgcgaaataaaaccaaaaacgaaacctaaaacgaaaaacgaaacttaaataaaaacaaacgctatttttctacccatataacccacacgcgtcttcgtttcaataacgaaactaacaaacgtcgttccctaaccccgcgaccctataaaacccgaacaaatacaactcgataccgcctctaattaactaacgtaaaataacgtaataaaacataacccgttaccattaacttaaccgaaaaactccgcccccttaaacataaaaccc

SEQ ID NO: 20405 - DNA, 534 bp, Artificial Sequence
  chemically treated genomic DNA (Homo sapiens) CpG-island No: 20405
agggagggaggagggaggagtgggggaggcggtcggcggttcgcgtcgttcgttcgtttcgtttcgttttttttgtttttttatcgtttttttcgtttttttttttttttcgtcgagtttcgttgtttgttttgcgcgtttttttttttttttttttttttttttttttttttgcgtttttcggtcggtttttttttttttttttttttttttttttttttcgttcgtttttgcgttcgtgtgtttttttttttttttttcgtttgtttttttttttttttttattttttttttttttcgattgttttcgttgtttttttcgttttttttttcgggcgcgtttaatcgtttcgttttttcgtttaggcgttttattgtttatcgtttcgtcgttttttttttttcgcggtttttttggttacgcgtttgtttttttttagttcgcgttttttaaatttttattttttattttttattttttgttatttttatacgaattttttaattgtttttttattttgtttttatattttt

SEQ ID NO: 20406 - DNA, 534 bp, Artificial Sequence
  chemically treated genomic DNA (Homo sapiens) CpG-island No: 20406
aaaaatataaaaacaaaataaaaaaacaattaaaaaattcgtataaaaataacaaaaaataaaaaataaaaaataaaaatttaaaaaacgcgaactaaaaaaaaacaaacgcgtaaccaaaaaaaccgcgaaaaaaaaaaaacgacgaaacgataaacaataaaacgcctaaacgaaaaaacgaaacgattaaacgcgcccgaaaaaaaaaacgaaaaaaacaacgaaaacaatcgaaaaaaaaaaaaaataaaaaaaaaaaaaaaaacaaacgaaaaaaaaaaaaaaaaacacacgaacgcaaaaacgaacgaaaaaaaaaaaaaaaaaaaaaaaaaaaaaaaaaccgaccgaaaaacgcaaaaaaaaaaaaaaaaaaaaaaaaaaaaaaaaaaacgcgcaaaacaaacaacgaaactcgacgaaaaaaaaaaaaaaacgaaaaaaacgataaaaaaacaaaaaaaacgaaacgaaacgaacgaacgacgcgaaccgccgaccgcctcccccactcctccctcctccctccct

SEQ ID NO: 20407 - DNA, 534 bp, Artificial Sequence
  chemically treated genomic DNA (Homo sapiens) CpG-island No: 20407
aggagtgtgaggataggatggaaaagtagttgagaggttcgtgtggaagtagtaaggaatgggagatggagaatagaagtttagaggacgcgggttagggagagataggcgcgtaattaggagagtcgcgggggagggggggcggcggggcggtgggtagtgaagcgtttgagcgggggagcgaggcggttgggcgcgttcggaaggaggggcgagggaggtagcgggggtagtcgaggagagaggggggtgagaagagagagagaggtaagcgaaaggagaaagaagaggtatacggacgtaagagcgggcgagaaaagaggaagagagagagggggagggaaggtcggtcgggagacgtaagagagagaggagaagaggaaggaagagaggagacgcgtaaggtagataacggagttcggcgaggaggggggggaggcgagggggacggtggagaagtagggggggcgaggcggggcgggcgggcggcgcgggtcgtcggtcgttttttttatttttttttttttttttttt

SEQ ID NO: 20408 - DNA, 534 bp, Artificial Sequence
  chemically treated genomic DNA (Homo sapiens) CpG-island No: 20408
aaaaaaaaaaaaaaaaaaaataaaaaaaacgaccgacgacccgcgccgcccgcccgccccgcctcgccccccctacttctccaccgtccccctcgcctcccccccctcctcgccgaactccgttatctaccttacgcgtctcctctcttccttcctcttctcctctctctcttacgtctcccgaccgaccttccctccccctctctctcttcctcttttctcgcccgctcttacgtccgtatacctcttctttctcctttcgcttacctctctctctcttctcacccccctctctcctcgactacccccgctacctccctcgcccctccttccgaacgcgcccaaccgcctcgctcccccgctcaaacgcttcactacccaccgccccgccgccccccctcccccgcgactctcctaattacgcgcctatctctccctaacccgcgtcctctaaacttctattctccatctcccattccttactacttccacacgaacctctcaactacttttccatcctatcctcacactcct

SEQ ID NO: 20409 - DNA, 809 bp, Artificial Sequence
  chemically treated genomic DNA (Homo sapiens) CpG-island No: 20409
ttttttcgtcgttttcggttgtcgtttttttcgtttttttttttttttttcgttttttcgtgtttttttcgttttcgtttttcgttttttcgttcgtcgcgtttcggttttttttttcgttttgtcgtttttttcgttttgtttatttttttatttttttttatttttttttttttttttttttatttttttttatatttttcgtttttttttttcgtcgtatttttaattttttttttttcgtttttttttttttattttatagcgtttttcgtatttttttttttttcggtttttttttcgtcgtcgtttttttttttttttttttttcgtcgttttttttttttttttttttttttttttcgtttcgtttcgtttttgttcgttcggcgcgtcgcgtttttcgtttatttttttttcgtgcggttgcgttttttttttatttatatcgtattattattcgttttttttgtatttttttatgtttagtttattttgattttcgatttcgcgttttttttttgtttttttttttttttcgtttttttttttttttttcgttttcgtgtttatttcgttcgtttgtttatttatattattttaacgtttcgttttttttttttttttttttttttcgagtttttttttgatttttatattttttttttattttcgttgtcgcgcgttcgtcgttatcgttttttttttttcgcgtcgttttttttttttttttcggtttttttttttcgtttttggtttttttttttttttttttttttttttcgttcgttttttttgtttttttttcg

SEQ ID NO: 20410 - DNA, 809 bp, Artificial Sequence
  chemically treated genomic DNA (Homo sapiens) CpG-island No: 20410
cgaaaaaaaaacaaaaaaaacgaacgaaaaaaaaaaaaaaaaaaaaaaaaaaaccaaaaacgaaaaaaaaaaaccgaaaaaaaaaaaaaaaacgacgcgaaaaaaaaaaaacgataacgacgaacgcgcgacaacgaaaataaaaaaaaaatataaaaatcaaaaaaaaactcgaaaaaaaaaaaaaaaaaaaaaaaacgaaacgttaaaataatataaataaacaaacgaacgaaataaacacgaaaacgaaaaaaaaaaaaaaaaacgaaaaaaaaaaaaaaacaaaaaaaaaacgcgaaatcgaaaatcaaaataaactaaacataaaaaaatacaaaaaaaacgaataataatacgatataaataaaaaaaaaacgcaaccgcacgaaaaaaaaataaacgaaaaacgcgacgcgccgaacgaacaaaaacgaaacgaaacgaaaaaaaaaaaaaaaaaaaaaaaaaaaacgacgaaaaaaaaaaaaaaaaaaaaacgacgacgaaaaaaaaaccgaaaaaaaaaaaaatacgaaaaacgctataaaataaaaaaaaaaaaacgaaaaaaaaaaaattaaaaatacgacgaaaaaaaaaaacgaaaaatataaaaaaaaataaaaaaaaaaaaaaaaaaaaataaaaaaaaataaaaaaataaacaaaacgaaaaaaacgacaaaacgaaaaaaaaaaccgaaacgcgacgaacgaaaaaacgaaaaacgaaaacgaaaaaaacacgaaaaaacgaaaaaaaaaaaaaaaaacgaaaaaaacgacaaccgaaaacgacgaaaaaa

SEQ ID NO: 20411 - DNA, 809 bp, Artificial Sequence
  chemically treated genomic DNA (Homo sapiens) CpG-island No: 20411
cgggagggaggtaggggagacgagcggaggggagagagagaaggaggaaggggttagaagcggaggagggaggtcgaggggggagggggaggcgacgcgagggggggggggcggtgacgacgggcgcgcgataacgagagtgagagggagatgtgaaggttagaggagagttcgggaggaagaagagaggaggggggacgaggcgttggagtggtgtgggtgggtagacgagcgaggtgggtacggggacgaggagggagggggggggcgaaggagaaggaggggtaggagaggggcgcgggatcggaggttaagatgagttaggtatgaagaggtgtagggggagcgagtaatggtgcggtgtgagtagagagaggacgtagtcgtacgagaaggaggtggacgggaagcgcggcgcgtcgagcgagtaggggcggggcggggcgagagaggagaggggagaggggggaggggcggcgaagaagaagggaggggggggacggcggcggagagggggtcgagagagggggaggtgcgaagagcgttgtagagtggagaggggagggcgagaagggaggagttggaggtacggcggaggaggggggcgagggatgtagagagaggtaggaagggaaggggagaggagtagaggaaagtgagggagtgagtaaggcggggggagcgataggacggagggagaggtcgggacgcgacgagcgagaaggcgagaggcgagggcgggagagatacgagagggcgaagaggaggagagggagcggaggagacggtagtcggaggcgacgaaaaga

SEQ ID NO: 20412 - DNA, 809 bp, Artificial Sequence
  chemically treated genomic DNA (Homo sapiens) CpG-island No: 20412
tcttttcgtcgcctccgactaccgtctcctccgctccctctcctcctcttcgccctctcgtatctctcccgccctcgcctctcgccttctcgctcgtcgcgtcccgacctctccctccgtcctatcgctccccccgccttactcactccctcactttcctctactcctctccccttcccttcctacctctctctacatccctcgcccccctcctccgccgtacctccaactcctcccttctcgccctcccctctccactctacaacgctcttcgcacctccccctctctcgaccccctctccgccgccgtcccccccctcccttcttcttcgccgcccctcccccctctcccctctcctctctcgccccgccccgcccctactcgctcgacgcgccgcgcttcccgtccacctccttctcgtacgactacgtcctctctctactcacaccgcaccattactcgctccccctacacctcttcatacctaactcatcttaacctccgatcccgcgcccctctcctacccctccttctccttcgccccccccctccctcctcgtccccgtacccacctcgctcgtctacccacccacaccactccaacgcctcgtcccccctcctctcttcttcctcccgaactctcctctaaccttcacatctccctctcactctcgttatcgcgcgcccgtcgtcaccgccccccccccctcgcgtcgcctccccctcccccctcgacctccctcctccgcttctaaccccttcctccttctctctctcccctccgctcgtctcccctacctccctcccg

SEQ ID NO: 20413 - DNA, 573 bp, Artificial Sequence
  chemically treated genomic DNA (Homo sapiens) CpG-island No: 20413
tttgaaaagtttatcgcgtttcgtagggcgtttcggcggggttaatttgttcggttgcggggtatagttttaggggaattgggttagtaggtaggggtcggagttgcgcgttcgcggtggttagggcggtcgtcgggtcgtggggcgcgggcggttgtagtttgggcgttggggcgttttcgattcgtagtaaattttcgattaggaaatttttgtttaggttgttaaagtcgggcgtagcggggaggttgaggagcgcggaggaagttataacgttttagtacgtatcggcgtgggttgcgatcgcgttggggagtatagtgcggcgttaatcggtttgttgcgcgttcgttttgcgttcgtttgtcgttcgggcgtttcgtatcgtatttagagtcgtagtttttcgtcgtcgtttttcgtagggttggagcgcgcggagttaggtagggaggaaaggttattcgggacggcggcggatttggaacgatattatttatttgcgttgggcgtttttttaagggatgggaggagtgagtgtgggagggggaagttgtgagtttttttggtcga

SEQ ID NO: 20414 - DNA, 573 bp, Artificial Sequence
  chemically treated genomic DNA (Homo sapiens) CpG-island No: 20414
tcgaccaaaaaaactcacaacttccccctcccacactcactcctcccatcccttaaaaaaacgcccaacgcaaataaataatatcgttccaaatccgccgccgtcccgaataacctttcctccctacctaactccgcgcgctccaaccctacgaaaaacgacgacgaaaaactacgactctaaatacgatacgaaacgcccgaacgacaaacgaacgcaaaacgaacgcgcaacaaaccgattaacgccgcactatactccccaacgcgatcgcaacccacgccgatacgtactaaaacgttataacttcctccgcgctcctcaacctccccgctacgcccgactttaacaacctaaacaaaaatttcctaatcgaaaatttactacgaatcgaaaacgccccaacgcccaaactacaaccgcccgcgccccacgacccgacgaccgccctaaccaccgcgaacgcgcaactccgacccctacctactaacccaattcccctaaaactataccccgcaaccgaacaaattaaccccgccgaaacgccctacgaaacgcgataaacttttcaaa

SEQ ID NO: 20415 - DNA, 573 bp, Artificial Sequence
  chemically treated genomic DNA (Homo sapiens) CpG-island No: 20415
tcggttagagaaatttatagttttttttttttatatttattttttttattttttaaaaaaacgtttaacgtaaataaataatatcgttttaagttcgtcgtcgtttcgggtggttttttttttttgtttggtttcgcgcgttttagttttgcgggaggcggcggcgagaagttgcggttttgggtgcggtgcggggcgttcgggcgataggcgggcgtaaggcgggcgcgtagtagatcggttggcgtcgtattatgttttttagcgcggtcgtagtttacgtcggtgcgtattgggacgttgtggtttttttcgcgttttttaattttttcgttgcgttcggttttggtaatttgggtaagagttttttgatcgagaatttgttgcgggtcgggggcgttttaacgtttaggttgtagtcgttcgcgttttacgattcggcgatcgttttggttatcgcgggcgcgtagtttcggtttttgtttgttagtttagtttttttaaagttgtgtttcgtagtcgaataagttagtttcgtcggggcgttttacggaacgcggtgggttttttaag

SEQ ID NO: 20416 - DNA, 573 bp, Artificial Sequence
  chemically treated genomic DNA (Homo sapiens) CpG-island No: 20416
cttaaaaaacccaccgcgttccgtaaaacgccccgacgaaactaacttattcgactacgaaacacaactttaaaaaaactaaactaacaaacaaaaaccgaaactacgcgcccgcgataaccaaaacgatcgccgaatcgtaaaacgcgaacgactacaacctaaacgttaaaacgcccccgacccgcaacaaattctcgatcaaaaaactcttacccaaattaccaaaaccgaacgcaacgaaaaaattaaaaaacgcgaaaaaaaccacaacgtcccaatacgcaccgacgtaaactacgaccgcgctaaaaaacataatacgacgccaaccgatctactacgcgcccgccttacgcccgcctatcgcccgaacgccccgcaccgcacccaaaaccgcaacttctcgccgccgcctcccgcaaaactaaaacgcgcgaaaccaaacaaaaaaaaaaaaccacccgaaacgacgacgaacttaaaacgatattatttatttacgttaaacgtttttttaaaaaataaaaaaaataaatataaaaaaaaaaaactataaatttctctaaccga

SEQ ID NO: 20417 - DNA, 687 bp, Artificial Sequence
  chemically treated genomic DNA (Homo sapiens) CpG-island No: 20417
ttaggacgcgagttttgcgtagtcgaggttttttagcgttttttgtagtcgcgcgtaggtagagacggagttcggttttgcgttttcgtattacgttcgggattttatttagcggttcgtattcggagaagtagcgcgagtattcgaagttttcggttggcggtagaaatcgggagtggggtcgggcgagtgcgcggtattttaggtcggttcgaacgtttcgttcgcggtgggtcgatttttttttttttttttttttttttttttttagttcgttggcgtcggatacgttgcgttttattttttggggcgttttttttcgttggttaatcgtcgtatttcgtgtaattttggggtagtggtcgtttagtgttgaatgttttttatcgagagcgtatggtttgggaagcgaggcgcgaattcggttttcgaagggtcgtcgttcgggagacggtgatgttgttgttgtgtttgggggtttcgatcggtcgtttttataacgtggatattgagagcgcgttgttttattagggtttttataatacgttgttcggttattcggtcgtgttgtatagttacggggcgaatcgatggtgagtagagttggattgatgcgtttttagtagtttagagcggcgtgagaatggcgttttagggattttttgttcgatttaaattttttttttt

SEQ ID NO: 20418 - DNA, 687 bp, Artificial Sequence
  chemically treated genomic DNA (Homo sapiens) CpG-island No: 20418
aaaaaaaaaaatttaaatcgaacaaaaaatccctaaaacgccattctcacgccgctctaaactactaaaaacgcatcaatccaactctactcaccatcgattcgccccgtaactatacaacacgaccgaataaccgaacaacgtattataaaaaccctaataaaacaacgcgctctcaatatccacgttataaaaacgaccgatcgaaacccccaaacacaacaacaacatcaccgtctcccgaacgacgacccttcgaaaaccgaattcgcgcctcgcttcccaaaccatacgctctcgataaaaaacattcaacactaaacgaccactaccccaaaattacacgaaatacgacgattaaccaacgaaaaaaaacgccccaaaaaataaaacgcaacgtatccgacgccaacgaactaaaaaaaaaaaaaaaaaaaaaaaaaaaaaaatcgacccaccgcgaacgaaacgttcgaaccgacctaaaataccgcgcactcgcccgaccccactcccgatttctaccgccaaccgaaaacttcgaatactcgcgctacttctccgaatacgaaccgctaaataaaatcccgaacgtaatacgaaaacgcaaaaccgaactccgtctctacctacgcgcgactacaaaaaacgctaaaaaacctcgactacgcaaaactcgcgtcctaa

SEQ ID NO: 20419 - DNA, 687 bp, Artificial Sequence
  chemically treated genomic DNA (Homo sapiens) CpG-island No: 20419
agggaggaaagtttgaatcgggtagggaatttttagggcgttatttttacgtcgttttgagttgttgagggcgtattagtttaattttatttattatcggttcgtttcgtggttgtgtagtacgatcgagtagtcgaatagcgtgttgtgggggttttggtaaagtagcgcgtttttagtgtttacgttgtaggggcggtcggtcgggatttttaggtatagtaatagtattatcgtttttcggacggcggtttttcgggggtcgggttcgcgtttcgttttttaagttatgcgttttcggtggggaatatttaatattaaacggttattattttaaagttgtacgggatgcgacggttggttaacggggaagaacgttttaagagatgaggcgtagcgtgttcggcgttagcgggttaaaggaaggagagagggaagaggaggggaagtcggtttatcgcgggcggagcgttcgggtcggtttgggatgtcgcgtattcgttcggttttattttcggtttttgtcgttagtcgggagtttcgggtgttcgcgttgttttttcgggtacgggtcgttgggtggggtttcgggcgtggtgcggaggcgtagggtcgggtttcgtttttgtttacgcgcggttgtagggggcgttggggaatttcggttgcgtaggattcgcgttttgg

SEQ ID NO: 20420 - DNA, 687 bp, Artificial Sequence
  chemically treated genomic DNA (Homo sapiens) CpG-island No: 20420
ccaaaacgcgaatcctacgcaaccgaaattccccaacgccccctacaaccgcgcgtaaacaaaaacgaaacccgaccctacgcctccgcaccacgcccgaaaccccacccaacgacccgtacccgaaaaaacaacgcgaacacccgaaactcccgactaacgacaaaaaccgaaaataaaaccgaacgaatacgcgacatcccaaaccgacccgaacgctccgcccgcgataaaccgacttcccctcctcttccctctctccttcctttaacccgctaacgccgaacacgctacgcctcatctcttaaaacgttcttccccgttaaccaaccgtcgcatcccgtacaactttaaaataataaccgtttaatattaaatattccccaccgaaaacgcataacttaaaaaacgaaacgcgaacccgacccccgaaaaaccgccgtccgaaaaacgataatactattactatacctaaaaatcccgaccgaccgcccctacaacgtaaacactaaaaacgcgctactttaccaaaacccccacaacacgctattcgactactcgatcgtactacacaaccacgaaacgaaccgataataaataaaattaaactaatacgccctcaacaactcaaaacgacgtaaaaataacgccctaaaaattccctacccgattcaaactttcctccct

SEQ ID NO: 20421 - DNA, 1859 bp, Artificial Sequence
  chemically treated genomic DNA (Homo sapiens) CpG-island No: 20421
gaagagaaagcgtagtagtcgatagttttgattttcgggagttttttatttcgttttttacggcgaggagggcgcggagatttcgttgggggcggaggacgagatcgggaggcggggaggggggaggtaaattttgtttattcggttcggagttcggagcggtcgcggaagtcggaggtcggcgcgtagggcgagggtatcgggggcggggggtttcgtttttcgtttgattttttttgttttcggttagttagttagtaagtgcggttttttagattttcgagatagcgaacggatcgatcgggattgttagtcgtttcgggttaaggattcgttttattcgtgttttttattaggcgtttttaatttattggtgagcgcggcggttcgggcgttggatgcgggggcggtcgcgatggtttcgcgcgcgggatagtcggggttttaggggttgttgttcgtggcggcggcgttgagttagttcgcggtattttgttttttttagtgttattgtttcggcggttttaagttgttgttgcgttgcgcgtcgggagtcgagtttcgttagttttcgcgggacgtgtcgttcgacgcgcgtaattttattatcgtaggcgttaatttgacggtgttgcgcgcggtcgttttcgtcggcggggacggggacggcgattaggcggcgggcgtgcgtttgtcgtttttgagcgcgttgcgttttacgtataattatatcgaggtggtggaggacggcgttttcgacgggttgtttagtttggcggcgttcgattttagttataattcgttgcgcgttttgggcggcggcgtttttcgcgggttgttcgcgttgcgttcgttgtagtttaattacgcgttggtgcgcggcggtttcgcgttgttggtcgcgttggacgttgcgttggtatcgttggtcgagtttcgtttgttgggtttagcgggtaacgcgttgagtcgtttgtcgttagtcgttttgcgtttggcgcgtttggagtagttggacgtgcgttttaacgcgttggtcggtttggatttcgacgagttgcgcgcgttggagcgcgatggcggttttttcgggtcgcgtttgttgttcgtcgataattttttgcgttgcggttgtgtcgtacgttttttgttggtttggttgcgtaacgttacggagcgcgtgttcgattcgcggcgtttgcgttgcgtcgtttcgcgggcgttgttagatcggtcgttattggatttggacggggcgcggtttcgttgcgcggatagcggcgtcgacgttcgcggagaggaggcggaggtcgtcggttcggagttggaagttttttacgtgtttttcgggttggtgttggtatttatcggttttattttttttatggtgttttatttaaatcgtcgcggtatttagcgttggatgcgtaatttgcgcgaggcgtgtcgggattagatggagggttattattatcgttacgagtaggacgtcgattcgcgtcgcgcgttcgcgttcgtcgcgttcgcgggttttcgcgttattttttcgggttcggggttttgagcggcgttttcgggttcggggttttttttgtttggttcgaagtcgtggagatgagatattcgcgagtttcgagttttgagatttttttttgattcggaggcgttaagtcgtattttttcgttttcgttttcgagagtttttatcgttaaagatttagagatagtcggttcgaatttagaaatttcgtttgtttattttagttttcgaaattttttttttgaattattgaaagttcgtttttcgtttcggagtttatatagagaatttgttttttaaggttaaagttttgagattt

SEQ ID NO: 20422 - DNA, 1859 bp, Artificial Sequence
  chemically treated genomic DNA (Homo sapiens) CpG-island No: 20422
aaatctcaaaactttaaccttaaaaaacaaattctctatataaactccgaaacgaaaaacgaactttcaataattcaaaaaaaaaatttcgaaaactaaaataaacaaacgaaatttctaaattcgaaccgactatctctaaatctttaacgataaaaactctcgaaaacgaaaacgaaaaaatacgacttaacgcctccgaatcaaaaaaaaatctcaaaactcgaaactcgcgaatatctcatctccacgacttcgaaccaaacaaaaaaaaccccgaacccgaaaacgccgctcaaaaccccgaacccgaaaaaataacgcgaaaacccgcgaacgcgacgaacgcgaacgcgcgacgcgaatcgacgtcctactcgtaacgataataataaccctccatctaatcccgacacgcctcgcgcaaattacgcatccaacgctaaataccgcgacgatttaaataaaacaccataaaaaaaataaaaccgataaataccaacaccaacccgaaaaacacgtaaaaaacttccaactccgaaccgacgacctccgcctcctctccgcgaacgtcgacgccgctatccgcgcaacgaaaccgcgccccgtccaaatccaataacgaccgatctaacaacgcccgcgaaacgacgcaacgcaaacgccgcgaatcgaacacgcgctccgtaacgttacgcaaccaaaccaacaaaaaacgtacgacacaaccgcaacgcaaaaaattatcgacgaacaacaaacgcgacccgaaaaaaccgccatcgcgctccaacgcgcgcaactcgtcgaaatccaaaccgaccaacgcgttaaaacgcacgtccaactactccaaacgcgccaaacgcaaaacgactaacgacaaacgactcaacgcgttacccgctaaacccaacaaacgaaactcgaccaacgataccaacgcaacgtccaacgcgaccaacaacgcgaaaccgccgcgcaccaacgcgtaattaaactacaacgaacgcaacgcgaacaacccgcgaaaaacgccgccgcccaaaacgcgcaacgaattataactaaaatcgaacgccgccaaactaaacaacccgtcgaaaacgccgtcctccaccacctcgatataattatacgtaaaacgcaacgcgctcaaaaacgacaaacgcacgcccgccgcctaatcgccgtccccgtccccgccgacgaaaacgaccgcgcgcaacaccgtcaaattaacgcctacgataataaaattacgcgcgtcgaacgacacgtcccgcgaaaactaacgaaactcgactcccgacgcgcaacgcaacaacaacttaaaaccgccgaaacaataacactaaaaaaaacaaaataccgcgaactaactcaacgccgccgccacgaacaacaacccctaaaaccccgactatcccgcgcgcgaaaccatcgcgaccgcccccgcatccaacgcccgaaccgccgcgctcaccaataaattaaaaacgcctaataaaaaacacgaataaaacgaatccttaacccgaaacgactaacaatcccgatcgatccgttcgctatctcgaaaatctaaaaaaccgcacttactaactaactaaccgaaaacaaaaaaaatcaaacgaaaaacgaaaccccccgcccccgataccctcgccctacgcgccgacctccgacttccgcgaccgctccgaactccgaaccgaataaacaaaatttacctcccccctccccgcctcccgatctcgtcctccgcccccaacgaaatctccgcgccctcctcgccgtaaaaaacgaaataaaaaactcccgaaaatcaaaactatcgactactacgctttctcttc

SEQ ID NO: 20423 - DNA, 1859 bp, Artificial Sequence
  chemically treated genomic DNA (Homo sapiens) CpG-island No: 20423
aagttttagagttttggttttgaaggatagattttttgtgtgagtttcgagacggggaacggatttttagtggtttaggagggaggtttcggaaattagggtgggtaggcggggtttttggattcggatcggttatttttgggtttttgacggtgggagttttcggaggcgggaacgagagggtacggtttagcgttttcgagttaggggaaggttttagagttcggggttcgcgggtgttttatttttacggtttcgggttaggtaagggaagtttcgagttcgggggcgtcgtttagagtttcgagttcggggaggtggcgcgggagttcgcgggcgcggcgggcgcgggcgcgcggcgcgggtcggcgttttgttcgtagcggtagtggtagttttttatttggtttcggtacgtttcgcgtaggttgcgtatttagcgttggatgtcgcggcggtttaggtagagtattatgaggaagatgaggtcgatgagtgttagtattagttcgaagaatacgtaggaggtttttagtttcgggtcggcggttttcgtttttttttcgcgagcgtcggcgtcgttgttcgcgtagcgaagtcgcgtttcgtttaggtttagtagcggtcggtttagtagcgttcgcggggcggcgtagcgtaggcgtcgcgagtcgggtacgcgtttcgtggcgttgcgtagttaggttagtagggggcgtgcggtatagtcgtagcgtagggggttgtcggcgagtagtaggcgcggttcggggaggtcgttatcgcgttttagcgcgcgtagttcgtcggggtttaggtcggttagcgcgttgaggcgtacgtttagttgttttaggcgcgttaggcgtagggcggttggcggtagacggtttagcgcgttgttcgttaggtttagtaggcgaagttcggttagcggtgttagcgtagcgtttagcgcggttagtagcgcggggtcgtcgcgtattagcgcgtggttgagttgtagcgagcgtagcgcgggtagttcgcggaaggcgtcgtcgtttagggcgcgtagcgggttgtggttgaggtcgagcgtcgttaggttgggtagttcgtcgaaggcgtcgttttttattatttcgatgtggttgtgcgtgaggcgtagcgcgtttaggagcggtaggcgtacgttcgtcgtttggtcgtcgttttcgttttcgtcggcgaaggcggtcgcgcgtagtatcgttaggttggcgtttacgatggtgaggttgcgcgcgtcgggcggtacgtttcgcggaggttggcggagttcggttttcgacgcgtagcgtagtagtagtttggggtcgtcgaagtagtagtattggaaggggtagggtgtcgcgggttggtttagcgtcgtcgttacgagtagtagtttttggagtttcggttgtttcgcgcgcggggttatcgcggtcgttttcgtatttagcgttcgggtcgtcgcgtttattagtgagttgggagcgtttggtggggggtacgggtggggcgagtttttgattcggagcggttggtagtttcggtcggttcgttcgttgtttcgaaagtttgaggagtcgtatttattggttgattggtcgggggtaagaggggttagacggggagcggagtttttcgttttcggtgttttcgttttgcgcgtcggttttcggttttcgcggtcgtttcgggtttcgagtcgagtgggtagggtttgtttttttttttttcgtttttcggtttcgtttttcgtttttagcggagttttcgcgtttttttcgtcgtgggaggcggggtgggaggttttcgagaattagggttgtcggttgttgcgtttttttttt

SEQ ID NO: 20424 - DNA, 1859 bp, Artificial Sequence
  chemically treated genomic DNA (Homo sapiens) CpG-island No: 20424
aaaaaaaaaacgcaacaaccgacaaccctaattctcgaaaacctcccaccccgcctcccacgacgaaaaaaacgcgaaaactccgctaaaaacgaaaaacgaaaccgaaaaacgaaaaaaaaaaaaacaaaccctacccactcgactcgaaacccgaaacgaccgcgaaaaccgaaaaccgacgcgcaaaacgaaaacaccgaaaacgaaaaactccgctccccgtctaacccctcttacccccgaccaatcaaccaataaatacgactcctcaaactttcgaaacaacgaacgaaccgaccgaaactaccaaccgctccgaatcaaaaactcgccccacccgtaccccccaccaaacgctcccaactcactaataaacgcgacgacccgaacgctaaatacgaaaacgaccgcgataaccccgcgcgcgaaacaaccgaaactccaaaaactactactcgtaacgacgacgctaaaccaacccgcgacaccctaccccttccaatactactacttcgacgaccccaaactactactacgctacgcgtcgaaaaccgaactccgccaacctccgcgaaacgtaccgcccgacgcgcgcaacctcaccatcgtaaacgccaacctaacgatactacgcgcgaccgccttcgccgacgaaaacgaaaacgacgaccaaacgacgaacgtacgcctaccgctcctaaacgcgctacgcctcacgcacaaccacatcgaaataataaaaaacgacgccttcgacgaactacccaacctaacgacgctcgacctcaaccacaacccgctacgcgccctaaacgacgacgccttccgcgaactacccgcgctacgctcgctacaactcaaccacgcgctaatacgcgacgaccccgcgctactaaccgcgctaaacgctacgctaacaccgctaaccgaacttcgcctactaaacctaacgaacaacgcgctaaaccgtctaccgccaaccgccctacgcctaacgcgcctaaaacaactaaacgtacgcctcaacgcgctaaccgacctaaaccccgacgaactacgcgcgctaaaacgcgataacgacctccccgaaccgcgcctactactcgccgacaaccccctacgctacgactataccgcacgccccctactaacctaactacgcaacgccacgaaacgcgtacccgactcgcgacgcctacgctacgccgccccgcgaacgctactaaaccgaccgctactaaacctaaacgaaacgcgacttcgctacgcgaacaacgacgccgacgctcgcgaaaaaaaaacgaaaaccgccgacccgaaactaaaaacctcctacgtattcttcgaactaatactaacactcatcgacctcatcttcctcataatactctacctaaaccgccgcgacatccaacgctaaatacgcaacctacgcgaaacgtaccgaaaccaaataaaaaactaccactaccgctacgaacaaaacgccgacccgcgccgcgcgcccgcgcccgccgcgcccgcgaactcccgcgccacctccccgaactcgaaactctaaacgacgcccccgaactcgaaacttcccttacctaacccgaaaccgtaaaaataaaacacccgcgaaccccgaactctaaaaccttcccctaactcgaaaacgctaaaccgtaccctctcgttcccgcctccgaaaactcccaccgtcaaaaacccaaaaataaccgatccgaatccaaaaaccccgcctacccaccctaatttccgaaacctccctcctaaaccactaaaaatccgttccccgtctcgaaactcacacaaaaaatctatccttcaaaaccaaaactctaaaactt

SEQ ID NO: 20425 - DNA, 605 bp, Artificial Sequence
  chemically treated genomic DNA (Homo sapiens) CpG-island No: 20425
ggtttatcgcgcgcgtcggtttttattgtttttttcgaggtcggtttaggaatttttcgggaaattgttttttatttcgttttcgtacgtacgcgttacgtttgtttattttgaagtttcgttttcggttattttttggttttttttatttttttttggaatgtcgttatgtcggcgatgaatatttatgaggtatacgcggttttttcgttttgttagtttttcgttttttcgttttcggcgtatgattaatatttaatgagtttagattcgcggttggttcgtcgggttgaggcgggggtagcgggcggggtcggcgttggggagttcgcgattcgggcggggagggcgtgtgtcgggggggcggtggcggcgaggcgggcgcgcgggatggaatattgagatatcgacggaatgtttcgaatcgttatataattttttggaacggtcgcgtataacgttattggtttttttttttttcgcgcgtcgtcgtcgttttttattttcgttttatcgttttttttttcgttcgttgttttcggagttgggggggaaacgcgaagttttattgtaatggagttcgtcgtcgcggttacggtatagcg

SEQ ID NO: 20426 - DNA, 605 bp, Artificial Sequence
  chemically treated genomic DNA (Homo sapiens) CpG-island No: 20426
cgctataccgtaaccgcgacgacgaactccattacaataaaacttcgcgtttcccccccaactccgaaaacaacgaacgaaaaaaaaaacgataaaacgaaaataaaaaacgacgacgacgcgcgaaaaaaaaaaaaaccaataacgttatacgcgaccgttccaaaaaattatataacgattcgaaacattccgtcgatatctcaatattccatcccgcgcgcccgcctcgccgccaccgcccccccgacacacgccctccccgcccgaatcgcgaactccccaacgccgaccccgcccgctacccccgcctcaacccgacgaaccaaccgcgaatctaaactcattaaatattaatcatacgccgaaaacgaaaaaacgaaaaactaacaaaacgaaaaaaccgcgtatacctcataaatattcatcgccgacataacgacattccaaaaaaaaataaaaaaaaccaaaaaataaccgaaaacgaaacttcaaaataaacaaacgtaacgcgtacgtacgaaaacgaaataaaaaacaatttcccgaaaaattcctaaaccgacctcgaaaaaaacaataaaaaccgacgcgcgcgataaacc

SEQ ID NO: 20427 - DNA, 605 bp, Artificial Sequence
  chemically treated genomic DNA (Homo sapiens) CpG-island No: 20427
cgttgtatcgtggtcgcggcggcgggttttattgtagtggggtttcgcgttttttttttagtttcggaggtagcgggcggagagggaggcgatgaggcggaggtgggagacggcggcggcgcgcggagaagggagaagttaatggcgttgtgcgcggtcgttttaggggattatgtggcgattcggagtatttcgtcggtgttttagtgttttatttcgcgcgttcgtttcgtcgttatcgttttttcgatatacgtttttttcgttcgggtcgcgggttttttagcgtcggtttcgttcgttattttcgttttaattcggcgaattagtcgcggatttgggtttattgaatattaattatgcgtcgggagcgggaaggcgggaggttggtagggcgggagggtcgcgtgtgttttataaatatttatcgtcggtatgacggtattttagggaggagtggggagagttaggggatggtcggaggcggagttttagggtaaataaacgtgacgcgtgcgtacgagggcggggtggggggtagtttttcgggaggtttttgagtcggtttcggagagggtagtgaagatcgacgcgcgcggtaaatt

SEQ ID NO: 20428 - DNA, 605 bp, Artificial Sequence
  chemically treated genomic DNA (Homo sapiens) CpG-island No: 20428
aatttaccgcgcgcgtcgatcttcactaccctctccgaaaccgactcaaaaacctcccgaaaaactaccccccaccccgccctcgtacgcacgcgtcacgtttatttaccctaaaactccgcctccgaccatcccctaactctccccactcctccctaaaataccgtcataccgacgataaatatttataaaacacacgcgaccctcccgccctaccaacctcccgccttcccgctcccgacgcataattaatattcaataaacccaaatccgcgactaattcgccgaattaaaacgaaaataacgaacgaaaccgacgctaaaaaacccgcgacccgaacgaaaaaaacgtatatcgaaaaaacgataacgacgaaacgaacgcgcgaaataaaacactaaaacaccgacgaaatactccgaatcgccacataatcccctaaaacgaccgcgcacaacgccattaacttctcccttctccgcgcgccgccgccgtctcccacctccgcctcatcgcctccctctccgcccgctacctccgaaactaaaaaaaaaacgcgaaaccccactacaataaaacccgccgccgcgaccacgatacaacg

SEQ ID NO: 20429 - DNA, 768 bp, Artificial Sequence
  chemically treated genomic DNA (Homo sapiens) CpG-island No: 20429
gtgtgtattttttattatttgtattttgcgtagtaattcgggttgggtacgtacgagagggtggcgttttacgcggttttttagaaaggcgcgcggtagtaagcggtagcgtacgttttcgaagacggtgggtagcgcgcgttggcgtttagtttgcgtttcggcgtcgtcgttattcgtttatcgtattatcgtttcgaatattgttttttttttttttacgttaaggtcgtcgttggagatgatggcgatgagttcgtcggtcgagagttcgaggaagttagcgtcgcgcgttattagcgtgaagtgagcgtagatgaagtcgcgggtagttacggcgagacgcgcgtagtcgagtaggaggtcgagacggaagacggttaagtagttggagaggtataggcgtttttgtaggaaggatacgtagatggtgaagatggaagggatttggaagcggtgtgtcgcggcgaataaattttgtacgttcgttttatttagcgcgatttttgatgtgtataggtagtgtagtatttgggttattacgttcggggatattttttttaggtgtagttcgttcgcgcgtttcggttcggttagaaagcgcgttcggaagtaggggttgtaggcggttagtattaggcgatggtacgggaattcgcgttcgttcgttcgtattatatagtcgaggaatttgttatggtttagtatgtttttgagttcgttttgtaggagcgtttgttggtataatcgttgttttttcgtttgttt

SEQ ID NO: 20430 - DNA, 768 bp, Artificial Sequence
  chemically treated genomic DNA (Homo sapiens) CpG-island No: 20430
aaacaaacgaaaaaacaacgattataccaacaaacgctcctacaaaacgaactcaaaaacatactaaaccataacaaattcctcgactatataatacgaacgaacgaacgcgaattcccgtaccatcgcctaatactaaccgcctacaacccctacttccgaacgcgctttctaaccgaaccgaaacgcgcgaacgaactacacctaaaaaaaatatccccgaacgtaataacccaaatactacactacctatacacatcaaaaatcgcgctaaataaaacgaacgtacaaaatttattcgccgcgacacaccgcttccaaatcccttccatcttcaccatctacgtatccttcctacaaaaacgcctatacctctccaactacttaaccgtcttccgtctcgacctcctactcgactacgcgcgtctcgccgtaactacccgcgacttcatctacgctcacttcacgctaataacgcgcgacgctaacttcctcgaactctcgaccgacgaactcatcgccatcatctccaacgacgaccttaacgtaaaaaaaaaaaaaacaatattcgaaacgataatacgataaacgaataacgacgacgccgaaacgcaaactaaacgccaacgcgcgctacccaccgtcttcgaaaacgtacgctaccgcttactaccgcgcgcctttctaaaaaaccgcgtaaaacgccaccctctcgtacgtacccaacccgaattactacgcaaaatacaaataataaaaaatacacac

SEQ ID NO: 20431 - DNA, 768 bp, Artificial Sequence
  chemically treated genomic DNA (Homo sapiens) CpG-island No: 20431
gagtaggcggaggagtagcggttgtattagtagacgtttttgtaagacgggtttaaagatatgttggattatggtaagtttttcgattgtgtggtgcgggcgggcgagcgcgagttttcgtgttatcgtttggtgttggtcgtttgtagtttttattttcgggcgcgttttttagtcgagtcggagcgcgcgggcgagttgtatttggaggaggtgttttcggacgtggtggtttaggtgttgtattatttgtatatattagagatcgcgttggatgaggcgagcgtgtaggatttgttcgtcgcggtatatcgtttttagattttttttatttttattatttgcgtgttttttttgtagaagcgtttgtgtttttttaattgtttggtcgtttttcgtttcggttttttgttcgattgcgcgcgtttcgtcgtggttgttcgcgattttatttgcgtttattttacgttggtggcgcgcgacgttgattttttcggattttcggtcgacgagtttatcgttattatttttagcgacggttttaacgtggagaaggaggaggtagtgttcgaggcggtgatgcggtgggcgggtagcggcgacgtcgaggcgtaggttgagcgttagcgcgcgttgtttatcgttttcgagagcgtgcgttgtcgtttgttgtcgcgcgtttttttggaaagtcgcgtggagcgttattttttcgtgcgtgtttagttcgagttgttgcgtaaggtgtagatggtgaaggatgtatat

SEQ ID NO: 20432 - DNA, 768 bp, Artificial Sequence
  chemically treated genomic DNA (Homo sapiens) CpG-island No: 20432
atatacatccttcaccatctacaccttacgcaacaactcgaactaaacacgcacgaaaaaataacgctccacgcgactttccaaaaaaacgcgcgacaacaaacgacaacgcacgctctcgaaaacgataaacaacgcgcgctaacgctcaacctacgcctcgacgtcgccgctacccgcccaccgcatcaccgcctcgaacactacctcctccttctccacgttaaaaccgtcgctaaaaataataacgataaactcgtcgaccgaaaatccgaaaaaatcaacgtcgcgcgccaccaacgtaaaataaacgcaaataaaatcgcgaacaaccacgacgaaacgcgcgcaatcgaacaaaaaaccgaaacgaaaaacgaccaaacaattaaaaaaacacaaacgcttctacaaaaaaaacacgcaaataataaaaataaaaaaaatctaaaaacgatataccgcgacgaacaaatcctacacgctcgcctcatccaacgcgatctctaatatatacaaataatacaacacctaaaccaccacgtccgaaaacacctcctccaaatacaactcgcccgcgcgctccgactcgactaaaaaacgcgcccgaaaataaaaactacaaacgaccaacaccaaacgataacacgaaaactcgcgctcgcccgcccgcaccacacaatcgaaaaacttaccataatccaacatatctttaaacccgtcttacaaaaacgtctactaatacaaccgctactcctccgcctactc

SEQ ID NO: 20433 - DNA, 2345 bp, Artificial Sequence
  chemically treated genomic DNA (Homo sapiens) CpG-island No: 20433
tatcgtagtttcggatattatatcgtagtttcggatattatatcgtagttacggatattatatcgtagttacggatattatatcgtagttacggatattatatcgtagtttcggatattatatcgtagtttcggatattatatcgtagttacggatattatatcgtagttacggatattatatcgtagtttcggatattatatcgtagttacggatattatatcgtagtttcggatattatatcgtagtttcggatattatatcgtagtttcggatattatatcgtagttacggatattatatcgtagtttcggatattatatcgtagtttcggatattatatcgtagtttcggatattatatcgtagttacggatattatatcgtagttacggatattatatcgtagtttcgtaaattatatcgtagttacggatattatatcgtagtttcggatattatatcgtagttacggatattatatcgtagttacggatattatatcgtagttacggatattatatcgtagtttcggatattatatcgtagttacggatattatatcgtagtttcggatattatatcgtagttacggatattatatcgtagttacggatattatatcgtagtttcggatattatatcgtagtttcggatattatatcgtagttacggatattatatcgtagttacggatattatatcgtagttacggatattatatcgtagttacggatattatatcgtagtttcggatattatatcgtagtttcggatattatatcgtagtttcggatattatatcgtagttacggatattatatcgtagtttcggatattatatcgtagtttcggatattatatcgtagttacggatattatatcgtagtttcggatattatatcgtagtttcggatattatatcgtagtttcggatattatatcgtagtttcgggaagtatatcgtagtttcgggaagtatatcgtagtttcgggaagtatatcgtagttacggatattatatcgtagtttcggatattatatcgtagtttcggatattatatcgtagttacggatattatatcgtagttacggatattatatcgtagtttcgtaaattatatcgtagttacggatattatatcgtagtttcggatattatatcgtagtttcggatattatatcgtagtttcggatattatatcgtagttacggatattatatcgtagttacggatattatatcgtagttacggatattatatcgtaatttgggatattatatcgtagtttcggagagagatcgtagtttcggaaattatatcggtagttacggatattatatcgtagtttcggatattatatcgtagtttcggatattatatcgtagttacggatattatatcgtagttacggatattatatcgtagttacggatattatatcgtagtttcggatattatatcgtagtttcggatattatatcgtagtttcggatattatatcgtagttacggatattatatcgtagtttcggatattatatcgtagtttcggatattatatcgtagttacggatattatatcgtagttacggatattatatcgtagtttcggatattatatcgtagtttcggatattatatcgtagtttcggatattatatcgtagtttcgggaagtatatcgtagtttcgggaagtatatcgtagtttcgggaagtatatcgtagttacggatattatatcgtagtttcggatattatatcgtagtttcggatattatatcgtagttacggatattatatcgtagttacggatattatatcgtagtttcggatattatatcgtagttacggaaattatatcgtagttacggatattatatcgtagttacggatattatatcgtagtttcggatattatatcgtagtttcggatattatatcgtagtttcggatattatatcgtagtttcggatattatatcgtagttacggaaattatatcgtagttacggaaattatatcgtagttacggatattatatcgtagtttcgtaaattttatcgtagtttcggaaattttatcgtagttacggaaattatatcgtagtttcgggaaattatatcgtagtttcggaaattatatcgtagttatggaaattatatcgcggttacggaaattatatcgcggttacggaaattatatcgcggttacggaaattatatcgcggttacggaaattatatcgcggttacggaaattatatcgtagtttcggaaattatatcgtagttacggaaattatatcgtagtttcggaaattatatcgtagttttggaaattatatt

SEQ ID NO: 20434 - DNA, 2345 bp, Artificial Sequence
  chemically treated genomic DNA (Homo sapiens) CpG-island No: 20434
aatataatttccaaaactacgatataatttccgaaactacgatataatttccgtaactacgatataatttccgaaactacgatataatttccgtaaccgcgatataatttccgtaaccgcgatataatttccgtaaccgcgatataatttccgtaaccgcgatataatttccgtaaccgcgatataatttccataactacgatataatttccgaaactacgatataatttcccgaaactacgatataatttccgtaactacgataaaatttccgaaactacgataaaatttacgaaactacgatataatatccgtaactacgatataatttccgtaactacgatataatttccgtaactacgatataatatccgaaactacgatataatatccgaaactacgatataatatccgaaactacgatataatatccgaaactacgatataatatccgtaactacgatataatatccgtaactacgatataatttccgtaactacgatataatatccgaaactacgatataatatccgtaactacgatataatatccgtaactacgatataatatccgaaactacgatataatatccgaaactacgatataatatccgtaactacgatatacttcccgaaactacgatatacttcccgaaactacgatatacttcccgaaactacgatataatatccgaaactacgatataatatccgaaactacgatataatatccgaaactacgatataatatccgtaactacgatataatatccgtaactacgatataatatccgaaactacgatataatatccgaaactacgatataatatccgtaactacgatataatatccgaaactacgatataatatccgaaactacgatataatatccgaaactacgatataatatccgtaactacgatataatatccgtaactacgatataatatccgtaactacgatataatatccgaaactacgatataatatccgaaactacgatataatatccgtaactaccgatataatttccgaaactacgatctctctccgaaactacgatataatatcccaaattacgatataatatccgtaactacgatataatatccgtaactacgatataatatccgtaactacgatataatatccgaaactacgatataatatccgaaactacgatataatatccgaaactacgatataatatccgtaactacgatataatttacgaaactacgatataatatccgtaactacgatataatatccgtaactacgatataatatccgaaactacgatataatatccgaaactacgatataatatccgtaactacgatatacttcccgaaactacgatatacttcccgaaactacgatatacttcccgaaactacgatataatatccgaaactacgatataatatccgaaactacgatataatatccgaaactacgatataatatccgtaactacgatataatatccgaaactacgatataatatccgaaactacgatataatatccgtaactacgatataatatccgaaactacgatataatatccgaaactacgatataatatccgaaactacgatataatatccgtaactacgatataatatccgtaactacgatataatatccgtaactacgatataatatccgtaactacgatataatatccgaaactacgatataatatccgaaactacgatataatatccgtaactacgatataatatccgtaactacgatataatatccgaaactacgatataatatccgtaactacgatataatatccgaaactacgatataatatccgtaactacgatataatatccgtaactacgatataatatccgtaactacgatataatatccgaaactacgatataatatccgtaactacgatataatttacgaaactacgatataatatccgtaactacgatataatatccgtaactacgatataatatccgaaactacgatataatatccgaaactacgatataatatccgaaactacgatataatatccgtaactacgatataatatccgaaactacgatataatatccgaaactacgatataatatccgaaactacgatataatatccgtaactacgatataatatccgaaactacgatataatatccgtaactacgatataatatccgtaactacgatataatatccgaaactacgatataatatccgaaactacgatataatatccgtaactacgatataatatccgtaactacgatataatatccgtaactacgatataatatccgaaactacgatataatatccgaaactacgata

SEQ ID NO: 20435 - DNA, 2345 bp, Artificial Sequence
  chemically treated genomic DNA (Homo sapiens) CpG-island No: 20435
ggtgtaatttttaaagttgcggtgtaattttcgaagttgcggtgtaattttcgtagttgcggtgtaattttcgagattgcggtgtaattttcgtggtcgcggtgtaattttcgtagtcgcggtgtaattttcgtagtcgcggtgtaattttcgtagtcgcggtgtaattttcgtagtcgcggtgtaatttttatagttgcggtgtaattttcgagattgcggtgtgatttttcgagattgcggtgtgattttcgtagttgcggtgggattttcgagattgcggtggaatttacgaggttgcggtgtaatgttcgtggttgcggtgtaattttcgtggttgcggtgtaattttcgtggttgcggtgtaatgttcgaggttgcggtgtaatgttcgaggttgcggtgtaatgttcgaggttgcggtgtaatgttcgaggttgcggtgtaatgttcgtggttgcggtgtaatgttcgtggttgcggtgtaattttcgtggttgcggtgtaatgttcgaggttgcggtgtaatgttcgtggttgcggtgtaatgttcgtggttgcggtgtaatgttcgaggttgcggtgtaatgttcgaggttgcggtgtaatgttcgtggttgcggtgtatttttcgaggttgcggtgtatttttcgaggttgcggtgtatttttcgaggttgcggtgtaatgttcgaggttgcggtgtaatgttcgaggttgcggtgtaatgttcgaggttgcggtgtaatgttcgtggttgcggtgtaatgttcgtggttgcggtgtaatgttcgaggttgcggtgtaatgttcgaggttgcggtgtaatgttcgtggttgcggtgtaatgttcgaggttgcggtgtaatgttcgaggttgcggtgtaatgttcgaggttgcggtgtaatgttcgtggttgcggtgtaatgttcgtggttgcggtgtaatgttcgtggttgcggtgtaatgttcgaggttgcggtgtaatgttcgaggttgcggtgtaatgttcgtggttgtcggtgtaattttcgaggttgcggttttttttcgaggttgcggtgtaatgttttaggttgcggtgtaatgttcgtggttgcggtgtaatgttcgtggttgcggtgtaatgttcgtggttgcggtgtaatgttcgaggttgcggtgtaatgttcgaggttgcggtgtaatgttcgaggttgcggtgtaatgttcgtggttgcggtgtaatttacgaggttgcggtgtaatgttcgtggttgcggtgtaatgttcgtggttgcggtgtaatgttcgaggttgcggtgtaatgttcgaggttgcggtgtaatgttcgtggttgcggtgtatttttcgaggttgcggtgtatttttcgaggttgcggtgtatttttcgaggttgcggtgtaatgttcgaggttgcggtgtaatgttcgaggttgcggtgtaatgttcgaggttgcggtgtaatgttcgtggttgcggtgtaatgttcgaggttgcggtgtaatgttcgaggttgcggtgtaatgttcgtggttgcggtgtaatgttcgaggttgcggtgtaatgttcgaggttgcggtgtaatgttcgaggttgcggtgtaatgttcgtggttgcggtgtaatgttcgtggttgcggtgtaatgttcgtggttgcggtgtaatgttcgtggttgcggtgtaatgttcgaggttgcggtgtaatgttcgaggttgcggtgtaatgttcgtggttgcggtgtaatgttcgtggttgcggtgtaatgttcgaggttgcggtgtaatgttcgtggttgcggtgtaatgttcgaggttgcggtgtaatgttcgtggttgcggtgtaatgttcgtggttgcggtgtaatgttcgtggttgcggtgtaatgttcgaggttgcggtgtaatgttcgtggttgcggtgtaatttacgaggttgcggtgtaatgttcgtggttgcggtgtaatgttcgtggttgcggtgtaatgttcgaggttgcggtgtaatgttcgaggttgcggtgtaatgttcgaggttgcggtgtaatgttcgtggttgcggtgtaatgttcgaggttgcggtgtaatgttcgaggttgcggtgtaatgttcgaggttgcggtgtaatgttcgtggttgcggtgtaatgttcgaggttgcggtgtaatgttcgtggttgcggtgtaatgttcgtggttgcggtgtaatgttcgaggttgcggtgtaatgttcgaggttgcggtgtaatgttcgtggttgcggtgtaatgttcgtggttgcggtgtaatgttcgtggttgcggtgtaatgttcgaggttgcggtgtaatgttcgaggttgcggtg

SEQ ID NO: 20436 - DNA, 2345 bp, Artificial Sequence
  chemically treated genomic DNA (Homo sapiens) CpG-island No: 20436
caccgcaacctcgaacattacaccgcaacctcgaacattacaccgcaaccacgaacattacaccgcaaccacgaacattacaccgcaaccacgaacattacaccgcaacctcgaacattacaccgcaacctcgaacattacaccgcaaccacgaacattacaccgcaaccacgaacattacaccgcaacctcgaacattacaccgcaaccacgaacattacaccgcaacctcgaacattacaccgcaacctcgaacattacaccgcaacctcgaacattacaccgcaaccacgaacattacaccgcaacctcgaacattacaccgcaacctcgaacattacaccgcaacctcgaacattacaccgcaaccacgaacattacaccgcaaccacgaacattacaccgcaacctcgtaaattacaccgcaaccacgaacattacaccgcaacctcgaacattacaccgcaaccacgaacattacaccgcaaccacgaacattacaccgcaaccacgaacattacaccgcaacctcgaacattacaccgcaaccacgaacattacaccgcaacctcgaacattacaccgcaaccacgaacattacaccgcaaccacgaacattacaccgcaacctcgaacattacaccgcaacctcgaacattacaccgcaaccacgaacattacaccgcaaccacgaacattacaccgcaaccacgaacattacaccgcaaccacgaacattacaccgcaacctcgaacattacaccgcaacctcgaacattacaccgcaacctcgaacattacaccgcaaccacgaacattacaccgcaacctcgaacattacaccgcaacctcgaacattacaccgcaaccacgaacattacaccgcaacctcgaacattacaccgcaacctcgaacattacaccgcaacctcgaacattacaccgcaacctcgaaaaatacaccgcaacctcgaaaaatacaccgcaacctcgaaaaatacaccgcaaccacgaacattacaccgcaacctcgaacattacaccgcaacctcgaacattacaccgcaaccacgaacattacaccgcaaccacgaacattacaccgcaacctcgtaaattacaccgcaaccacgaacattacaccgcaacctcgaacattacaccgcaacctcgaacattacaccgcaacctcgaacattacaccgcaaccacgaacattacaccgcaaccacgaacattacaccgcaaccacgaacattacaccgcaacctaaaacattacaccgcaacctcgaaaaaaaaccgcaacctcgaaaattacaccgacaaccacgaacattacaccgcaacctcgaacattacaccgcaacctcgaacattacaccgcaaccacgaacattacaccgcaaccacgaacattacaccgcaaccacgaacattacaccgcaacctcgaacattacaccgcaacctcgaacattacaccgcaacctcgaacattacaccgcaaccacgaacattacaccgcaacctcgaacattacaccgcaacctcgaacattacaccgcaaccacgaacattacaccgcaaccacgaacattacaccgcaacctcgaacattacaccgcaacctcgaacattacaccgcaacctcgaacattacaccgcaacctcgaaaaatacaccgcaacctcgaaaaatacaccgcaacctcgaaaaatacaccgcaaccacgaacattacaccgcaacctcgaacattacaccgcaacctcgaacattacaccgcaaccacgaacattacaccgcaaccacgaacattacaccgcaacctcgaacattacaccgcaaccacgaaaattacaccgcaaccacgaacattacaccgcaaccacgaacattacaccgcaacctcgaacattacaccgcaacctcgaacattacaccgcaacctcgaacattacaccgcaacctcgaacattacaccgcaaccacgaaaattacaccgcaaccacgaaaattacaccgcaaccacgaacattacaccgcaacctcgtaaattccaccgcaatctcgaaaatcccaccgcaactacgaaaatcacaccgcaatctcgaaaaatcacaccgcaatctcgaaaattacaccgcaactataaaaattacaccgcgactacgaaaattacaccgcgactacgaaaattacaccgcgactacgaaaattacaccgcgactacgaaaattacaccgcgaccacgaaaattacaccgcaatctcgaaaattacaccgcaactacgaaaattacaccgcaacttcgaaaattacaccgcaactttaaaaattacacc

SEQ ID NO: 20437 - DNA, 660 bp, Artificial Sequence
  chemically treated genomic DNA (Homo sapiens) CpG-island No: 20437
cgtatttattttttttcgcgtatagattcgtttttatacgttcgggcgggtgatttcggagggtcgcgcggggttgtgtgcgcgggcgggggcgggatgtgtttggagggggtagagcgttttttttcggtttcggagggtttacgcggatcggttgagcgttttattagtcggttttgtatttattatttagatttgcgcgttttggtgggagtatcgtagtttcgggtcggtttttcgaacgtcgagcgtttattcgcggagattagcgtaggaggcgggttcgcgcgtaaggaggcgggcgatagggtggagtcgtcgtagttggtagtcgtacggttttatttgttgtagcgtcggagcgcgttcgtttgagaaggtagagcgcggtgcggatttgtgtttcgcgcgtcggttggtagggtagggtcgcggttgttaggaggttcgggaatagtttcgacggagcggcgcggagagggcgtttttcggaaggtgagatttgagcgcggtagcggcgttagcgttcgttataaggcggggtttcggggagggggtttcggcggtttgttggagagttttgttattgttttgtatgaggtgggggatgttttttgcgcggatttcgcgtttaggtaaaattttggaacgtattaggta

SEQ ID NO: 20438 - DNA, 660 bp, Artificial Sequence
  chemically treated genomic DNA (Homo sapiens) CpG-island No: 20438
tacctaatacgttccaaaattttacctaaacgcgaaatccgcgcaaaaaacatcccccacctcatacaaaacaataacaaaactctccaacaaaccgccgaaaccccctccccgaaaccccgccttataacgaacgctaacgccgctaccgcgctcaaatctcaccttccgaaaaacgccctctccgcgccgctccgtcgaaactattcccgaacctcctaacaaccgcgaccctaccctaccaaccgacgcgcgaaacacaaatccgcaccgcgctctaccttctcaaacgaacgcgctccgacgctacaacaaataaaaccgtacgactaccaactacgacgactccaccctatcgcccgcctccttacgcgcgaacccgcctcctacgctaatctccgcgaataaacgctcgacgttcgaaaaaccgacccgaaactacgatactcccaccaaaacgcgcaaatctaaataataaatacaaaaccgactaataaaacgctcaaccgatccgcgtaaaccctccgaaaccgaaaaaaaacgctctaccccctccaaacacatcccgcccccgcccgcgcacacaaccccgcgcgaccctccgaaatcacccgcccgaacgtataaaaacgaatctatacgcgaaaaaaaataaatacg

SEQ ID NO: 20439 - DNA, 660 bp, Artificial Sequence
  chemically treated genomic DNA (Homo sapiens) CpG-island No: 20439
tgtttagtgcgttttagagttttgtttggacgcggggttcgcgtagaaggtattttttattttatgtagaatagtagtaaggttttttagtaaatcgtcggggtttttttttcgagatttcgttttgtagcgggcgttggcgtcgttgtcgcgtttagattttatttttcggggagcgtttttttcgcgtcgtttcgtcgggattgttttcgggttttttggtagtcgcggttttgttttgttagtcggcgcgcggagtataggttcgtatcgcgttttgtttttttaggcgggcgcgtttcgacgttgtaataggtagagtcgtgcggttgttagttgcggcgattttattttgtcgttcgtttttttgcgcgcgggttcgttttttgcgttggttttcgcgggtagacgttcggcgttcgaagggtcgattcggggttgcggtgtttttattagggcgcgtagatttgggtagtggatgtagaatcggttggtgggacgtttagtcggttcgcgtgggtttttcggggtcgggagagggcgttttgttttttttagatatatttcgttttcgttcgcgtatatagtttcgcgcggtttttcggaattattcgttcgggcgtgtgggagcgaatttgtacgcggagaggaatggatacg

SEQ ID NO: 20440 - DNA, 660 bp, Artificial Sequence
  chemically treated genomic DNA (Homo sapiens) CpG-island No: 20440
cgtatccattcctctccgcgtacaaattcgctcccacacgcccgaacgaataattccgaaaaaccgcgcgaaactatatacgcgaacgaaaacgaaatatatctaaaaaaaacaaaacgccctctcccgaccccgaaaaacccacgcgaaccgactaaacgtcccaccaaccgattctacatccactacccaaatctacgcgccctaataaaaacaccgcaaccccgaatcgacccttcgaacgccgaacgtctacccgcgaaaaccaacgcaaaaaacgaacccgcgcgcaaaaaaacgaacgacaaaataaaatcgccgcaactaacaaccgcacgactctacctattacaacgtcgaaacgcgcccgcctaaaaaaacaaaacgcgatacgaacctatactccgcgcgccgactaacaaaacaaaaccgcgactaccaaaaaacccgaaaacaatcccgacgaaacgacgcgaaaaaaacgctccccgaaaaataaaatctaaacgcgacaacgacgccaacgcccgctacaaaacgaaatctcgaaaaaaaaaccccgacgatttactaaaaaaccttactactattctacataaaataaaaaataccttctacgcgaaccccgcgtccaaacaaaactctaaaacgcactaaaca

SEQ ID NO: 20441 - DNA, 882 bp, Artificial Sequence
  chemically treated genomic DNA (Homo sapiens) CpG-island No: 20441
agcgttggggttcggtcggaggtcggagttttcggacgtcgtagttttcggacgtcgtttagtatagttttttttttcgtgcgttcgttttggattttttttatttttaagtttcggtagtcgattcggagattcgggaggttataggtttagcgcgatattacgattataattaggaggtattatcgtcgatttatttggggaggtatttataaagttagtagattgatattcgtgttttagtcgtcggcggtttgcgaagcgatagttaaaggaattaggatttaggatttcggcgttttgtttattcgtagattttcggatcgcgtttttttttcgtcgtttcgtttcgtttcgtttcgtttcgcgatcgtttttttgcgggaaattcgagttggttcgagtttgttttgaagacgcgttacgtttttttttttatttgagtcggatagggagtcggggtggaaattgcgttcgtattttagcgttaagtagacgtgaattttgcgttcgtttttcgggatttttagcgttaaggagaatttcgaggagagtagggggagtggaggggaacggcggcgataaagcggatttgaaattaggagttaaggaggacgtggggagtggcgttataggagttatcgaggcggcggtcgggggagtttcgcggttgcgggagagttcggcggttatgggcgagtcggcggtggggcgttcgggagttggttgagcgtcggggtttttatttttcgggggtgtgggcgagatttcgtcgacgttcggtgtcgtgggtttgggggttgttttcgggggttcggttatggttggtcggggttttagttggggttcgggttatttgaacgaggataacgcgcgtttttt

SEQ ID NO: 20442 - DNA, 882 bp, Artificial Sequence
  chemically treated genomic DNA (Homo sapiens) CpG-island No: 20442
aaaaaacgcgcgttatcctcgttcaaataacccgaaccccaactaaaaccccgaccaaccataaccgaacccccgaaaacaacccccaaacccacgacaccgaacgtcgacgaaatctcgcccacacccccgaaaaataaaaaccccgacgctcaaccaactcccgaacgccccaccgccgactcgcccataaccgccgaactctcccgcaaccgcgaaactcccccgaccgccgcctcgataactcctataacgccactccccacgtcctccttaactcctaatttcaaatccgctttatcgccgccgttcccctccactccccctactctcctcgaaattctccttaacgctaaaaatcccgaaaaacgaacgcaaaattcacgtctacttaacgctaaaatacgaacgcaatttccaccccgactccctatccgactcaaataaaaaaaaaaacgtaacgcgtcttcaaaacaaactcgaaccaactcgaatttcccgcaaaaaaacgatcgcgaaacgaaacgaaacgaaacgaaacgacgaaaaaaaaacgcgatccgaaaatctacgaataaacaaaacgccgaaatcctaaatcctaattcctttaactatcgcttcgcaaaccgccgacgactaaaacacgaatatcaatctactaactttataaatacctccccaaataaatcgacgataatacctcctaattataatcgtaatatcgcgctaaacctataacctcccgaatctccgaatcgactaccgaaacttaaaaataaaaaaaatccaaaacgaacgcacgaaaaaaaaaactatactaaacgacgtccgaaaactacgacgtccgaaaactccgacctccgaccgaaccccaacgct

SEQ ID NO: 20443 - DNA, 882 bp, Artificial Sequence
  chemically treated genomic DNA (Homo sapiens) CpG-island No: 20443
agaaagcgcgcgttgttttcgtttaggtggttcgggttttagttgaaatttcggttagttatggtcgggttttcgggggtagtttttaggtttacggtatcgggcgtcggcggagtttcgtttatattttcgggaaataagggtttcggcgtttagttagttttcgggcgttttatcgtcggttcgtttatgatcgtcgggttttttcgtagtcgcgaggttttttcggtcgtcgtttcggtagtttttgtggcgttattttttacgttttttttgatttttagttttaaattcgttttgtcgtcgtcgtttttttttattttttttgtttttttcggagttttttttaacgttgaaggtttcggggaacgggcgtagagtttacgtttgtttggcgttgggatgcgggcgtagtttttatttcggttttttgttcggtttagataggggagggggcgtggcgcgtttttagggtaagttcgagttaattcgagtttttcgtaaagagacggtcgcggggcggggcggggcggggcggggcggcggggggggggcgcggttcggaggtttgcgggtaagtagagcgtcggggttttgggttttggtttttttgattatcgtttcgtaggtcgtcgacggttaggatacgggtgttagtttgttggttttgtaggtgtttttttaggtagatcgacgatggtgttttttagttgtggtcgtggtgtcgcgttgagtttgtggtttttcgagttttcgaatcggttgtcggggtttagggatggagggggtttagggcgggcgtacggagagaggggttgtgttgagcggcgttcgagggttgcggcgttcgagggtttcgattttcggtcgggttttaacgtt

SEQ ID NO: 20444 - DNA, 882 bp, Artificial Sequence
  chemically treated genomic DNA (Homo sapiens) CpG-island No: 20444
aacgttaaaacccgaccgaaaatcgaaaccctcgaacgccgcaaccctcgaacgccgctcaacacaacccctctctccgtacgcccgccctaaaccccctccatccctaaaccccgacaaccgattcgaaaactcgaaaaaccacaaactcaacgcgacaccacgaccacaactaaaaaacaccatcgtcgatctacctaaaaaaacacctacaaaaccaacaaactaacacccgtatcctaaccgtcgacgacctacgaaacgataatcaaaaaaaccaaaacccaaaaccccgacgctctacttacccgcaaacctccgaaccgcgccccccccccgccgccccgccccgccccgccccgccccgcgaccgtctctttacgaaaaactcgaattaactcgaacttaccctaaaaacgcgccacgccccctcccctatctaaaccgaacaaaaaaccgaaataaaaactacgcccgcatcccaacgccaaacaaacgtaaactctacgcccgttccccgaaaccttcaacgttaaaaaaaactccgaaaaaaacaaaaaaaataaaaaaaaacgacgacgacaaaacgaatttaaaactaaaaatcaaaaaaaacgtaaaaaataacgccacaaaaactaccgaaacgacgaccgaaaaaacctcgcgactacgaaaaaacccgacgatcataaacgaaccgacgataaaacgcccgaaaactaactaaacgccgaaacccttatttcccgaaaatataaacgaaactccgccgacgcccgataccgtaaacctaaaaactacccccgaaaacccgaccataactaaccgaaatttcaactaaaacccgaaccacctaaacgaaaacaacgcgcgctttct

SEQ ID NO: 20445 - DNA, 634 bp, Artificial Sequence
  chemically treated genomic DNA (Homo sapiens) CpG-island No: 20445
gagtcgcgggggtgcggggcgcgtagttcgttttatttcgggagagtcgcgatcgtcgttttcgacgcgtgtattaagtgggggtgttcggttcgggataaaggatcgggacgcggatcgcgggcgggcgttattgtttagttttagcgtggagggcgagatcgtggtttcgaatttttttaaatttggcggttcggggcgcgtgggggggacgtttcgttatttgcgcggttataaaggagagatttatggtgtcgttgtagttagcgttcgagttttcgttgttgtcgttgtcgttgcgggttagtcgtttgtatagttggcggggatcgggttgagtagcgagcgttcggagatcgtacggcgtattcggttgtttttgggtttttggttttagatttttattaggcggagggtttcgagcgcgggggcgggcggggcggggtggggcggggttcggcggacggggcgtttttttacgtgattatttttcgttttattttcggggcggggttcgttagaaattttaagcgttcgtaatcgttttttttcgtgggcgggatggggaaattgaggttcgaggtcgtttcgttggttggtgtaagaattagtttgtaatttaagttttgagttg

SEQ ID NO: 20446 - DNA, 634 bp, Artificial Sequence
  chemically treated genomic DNA (Homo sapiens) CpG-island No: 20446
caactcaaaacttaaattacaaactaattcttacaccaaccaacgaaacgacctcgaacctcaatttccccatcccgcccacgaaaaaaaacgattacgaacgcttaaaatttctaacgaaccccgccccgaaaataaaacgaaaaataatcacgtaaaaaaacgccccgtccgccgaaccccgccccaccccgccccgcccgcccccgcgctcgaaaccctccgcctaataaaaatctaaaaccaaaaacccaaaaacaaccgaatacgccgtacgatctccgaacgctcgctactcaacccgatccccgccaactatacaaacgactaacccgcaacgacaacgacaacaacgaaaactcgaacgctaactacaacgacaccataaatctctcctttataaccgcgcaaataacgaaacgtcccccccacgcgccccgaaccgccaaatttaaaaaaattcgaaaccacgatctcgccctccacgctaaaactaaacaataacgcccgcccgcgatccgcgtcccgatcctttatcccgaaccgaacacccccacttaatacacgcgtcgaaaacgacgatcgcgactctcccgaaataaaacgaactacgcgccccgcacccccgcgactc

SEQ ID NO: 20447 - DNA, 634 bp, Artificial Sequence
  chemically treated genomic DNA (Homo sapiens) CpG-island No: 20447
tagtttaggatttgggttgtaggttggtttttgtattaattagcggggcggtttcgggttttagtttttttatttcgtttacgaagggaggcgattgcgagcgtttggggtttttgacggatttcgtttcgggggtggggcggggagtggttacgtggaggggcgtttcgttcgtcgagtttcgttttatttcgtttcgttcgttttcgcgttcggggtttttcgtttagtagagatttggagttagaagtttagagatagtcgagtgcgtcgtgcggttttcggacgttcgttgtttagttcgattttcgttaattgtgtaggcggttgattcgtagcggtagcggtagtagcgaggattcgagcgttggttgtagcgatattatggattttttttttatggtcgcgtaggtaacggggcgttttttttacgcgtttcgggtcgttaagtttggggaggttcggggttacggtttcgttttttacgttggggttgggtagtggcgttcgttcgcgattcgcgtttcggttttttgtttcgagtcggatatttttatttggtgtacgcgtcgggggcggcgatcgcggttttttcggggtggggcgggttgcgcgtttcgtattttcgcggttt

SEQ ID NO: 20448 - DNA, 634 bp, Artificial Sequence
  chemically treated genomic DNA (Homo sapiens) CpG-island No: 20448
aaaccgcgaaaatacgaaacgcgcaacccgccccaccccgaaaaaaccgcgatcgccgcccccgacgcgtacaccaaataaaaatatccgactcgaaacaaaaaaccgaaacgcgaatcgcgaacgaacgccactacccaaccccaacgtaaaaaacgaaaccgtaaccccgaacctccccaaacttaacgacccgaaacgcgtaaaaaaaacgccccgttacctacgcgaccataaaaaaaaaatccataatatcgctacaaccaacgctcgaatcctcgctactaccgctaccgctacgaatcaaccgcctacacaattaacgaaaatcgaactaaacaacgaacgtccgaaaaccgcacgacgcactcgactatctctaaacttctaactccaaatctctactaaacgaaaaaccccgaacgcgaaaacgaacgaaacgaaataaaacgaaactcgacgaacgaaacgcccctccacgtaaccactccccgccccacccccgaaacgaaatccgtcaaaaaccccaaacgctcgcaatcgcctcccttcgtaaacgaaataaaaaaactaaaacccgaaaccgccccgctaattaatacaaaaaccaacctacaacccaaatcctaaacta

SEQ ID NO: 20449 - DNA, 565 bp, Artificial Sequence
  chemically treated genomic DNA (Homo sapiens) CpG-island No: 20449
agttttcgcggttcggagtttatttcgtttttttcggttcgcggggtcgacgagttcggaggggtgtcgcgggaggtgagttcggcgacgtcgtaagcggtttcgacgttttcgacgttttcgacgtttggtttcgagttttttttcggtttttttcgggttattttttttttgttttagtttcgtagggtttttatgttcgttcgtttcgtttttttcgttcgcggtttcgttcgcgcggagtggcggatattaaatgttataatatacggagcgtttggttcgtcgttcgtagaattcggcggttcgtagcggggaataggggtcgttcgtttttttttaggttttcgttcggtttcgcgttttcggttttcggttttattttgtatttcggttgtcggtttggtcgcgggttttgttttttcgttttaagattgacgtcgtgttttgttttttattcgtagttcgcgttttttatattcgtttatcggcgtttggttttaggttttgatatttatttagttggtgtttagtgttcgatgagtggataagtgaatgatttttt

SEQ ID NO: 20450 - DNA, 565 bp, Artificial Sequence
  chemically treated genomic DNA (Homo sapiens) CpG-island No: 20450
aaaaaatcattcacttatccactcatcgaacactaaacaccaactaaataaatatcaaaacctaaaaccaaacgccgataaacgaatataaaaaacgcgaactacgaataaaaaacaaaacacgacgtcaatcttaaaacgaaaaaacaaaacccgcgaccaaaccgacaaccgaaatacaaaataaaaccgaaaaccgaaaacgcgaaaccgaacgaaaacctaaaaaaaaacgaacgacccctattccccgctacgaaccgccgaattctacgaacgacgaaccaaacgctccgtatattataacatttaatatccgccactccgcgcgaacgaaaccgcgaacgaaaaaaacgaaacgaacgaacataaaaaccctacgaaactaaaacaaaaaaaaaataacccgaaaaaaaccgaaaaaaaactcgaaaccaaacgtcgaaaacgtcgaaaacgtcgaaaccgcttacgacgtcgccgaactcacctcccgcgacacccctccgaactcgtcgaccccgcgaaccgaaaaaaacgaaataaactccgaaccgcgaaaact

SEQ ID NO: 20451 - DNA, 565 bp, Artificial Sequence
  chemically treated genomic DNA (Homo sapiens) CpG-island No: 20451
aaggagttatttatttatttatttatcgaatattgaatattaattggatgagtgttaaggtttggggttaggcgtcggtgggcggatgtaagggacgcgggttgcgagtgggggatagaatacgacgttaattttaaggcgaaggagtagagttcgcggttagatcggtagtcgggatgtagggtggggtcgggggtcgagggcgcgggatcgagcggaggtttgaggaggggcgggcggtttttgtttttcgttgcggatcgtcggattttgcgggcggcgagttaggcgtttcgtgtgttgtggtatttagtgttcgttatttcgcgcgggcgagatcgcgggcgagggagacggggcggacgggtatggagattttgcggggttgaggtaagggaagagtggttcgggggaggtcgaggaggggttcggggttaggcgtcgggggcgtcgggggcgtcggggtcgtttgcggcgtcgtcggatttatttttcgcggtattttttcggattcgtcggtttcgcgggtcggaggaggcgggatggatttcgggtcgcgggggtt

SEQ ID NO: 20452 - DNA, 565 bp, Artificial Sequence
  chemically treated genomic DNA (Homo sapiens) CpG-island No: 20452
aacccccgcgacccgaaatccatcccgcctcctccgacccgcgaaaccgacgaatccgaaaaaataccgcgaaaaataaatccgacgacgccgcaaacgaccccgacgcccccgacgcccccgacgcctaaccccgaacccctcctcgacctcccccgaaccactcttcccttacctcaaccccgcaaaatctccatacccgtccgccccgtctccctcgcccgcgatctcgcccgcgcgaaataacgaacactaaataccacaacacacgaaacgcctaactcgccgcccgcaaaatccgacgatccgcaacgaaaaacaaaaaccgcccgcccctcctcaaacctccgctcgatcccgcgccctcgacccccgaccccaccctacatcccgactaccgatctaaccgcgaactctactccttcgccttaaaattaacgtcgtattctatcccccactcgcaacccgcgtcccttacatccgcccaccgacgcctaaccccaaaccttaacactcatccaattaatattcaatattcgataaataaataaataaataactcctt

SEQ ID NO: 20453 - DNA, 590 bp, Artificial Sequence
  chemically treated genomic DNA (Homo sapiens) CpG-island No: 20453
ttcggcgaggtttcggtggggaggggtagggatggtttagtttcgtttcgttagggcggggtttgcgtttgcgcgtttagcggtcgggcgtgtaatttacgggtgcgcgtttacgatcgttagattcgagtagtttttggaatacgttgcggggttttcgggtttgagttaggtttgttttttacgtaggtgtttcgcgcgtttcgtttagttatgtcgttcggtatttatgtagcgttggtgattggaggtaataagggtatcggtttggttatcgtgcgcgatttgtgtcggttgttttcgggggacgtggtgtttacggcgcgggacgtgacgcggggttaggcggtcgtatagtagttgtaggcggagggtttgagttcgcgtttttattagttggatatcgacgatttgtagagtattcgcgttttgcgcgattttttgcgtaaggagtacgggggtttggacgtgttggttaataacgcgggtatcgtttttaagggtatggggaggggacgtggttttttcgaagaagaatcgatgtattggggtttttggcgtttgcggggtttataacgtttttttaggga

SEQ ID NO: 20454 - DNA, 590 bp, Artificial Sequence
  chemically treated genomic DNA (Homo sapiens) CpG-island No: 20454
tccctaaaaaaacgttataaaccccgcaaacgccaaaaaccccaatacatcgattcttcttcgaaaaaaccacgtcccctccccatacccttaaaaacgatacccgcgttattaaccaacacgtccaaacccccgtactccttacgcaaaaaatcgcgcaaaacgcgaatactctacaaatcgtcgatatccaactaataaaaacgcgaactcaaaccctccgcctacaactactatacgaccgcctaaccccgcgtcacgtcccgcgccgtaaacaccacgtcccccgaaaacaaccgacacaaatcgcgcacgataaccaaaccgatacccttattacctccaatcaccaacgctacataaataccgaacgacataactaaacgaaacgcgcgaaacacctacgtaaaaaacaaacctaactcaaacccgaaaaccccgcaacgtattccaaaaactactcgaatctaacgatcgtaaacgcgcacccgtaaattacacgcccgaccgctaaacgcgcaaacgcaaaccccgccctaacgaaacgaaactaaaccatccctacccctccccaccgaaacctcgccgaa

SEQ ID NO: 20455 - DNA, 590 bp, Artificial Sequence
  chemically treated genomic DNA (Homo sapiens) CpG-island No: 20455
tttttagggaggcgttatggatttcgtagacgttaggagttttagtgtatcggttttttttcggggaggttacgttttttttttatatttttgaaggcgatgttcgcgttgttgattagtacgtttaggttttcgtattttttgcgtaggaagtcgcgtagggcgcggatgttttgtagatcgtcgatgtttagttggtggaagcgcgggtttaggtttttcgtttgtagttgttgtacggtcgtttggtttcgcgttacgtttcgcgtcgtgagtattacgtttttcgagaatagtcggtataggtcgcgtacgatggttaagtcgatgtttttgttgtttttagttattagcgttatatggatgtcggacgatatggttgaacggggcgcgcggaatatttgcgtggagaatagatttggtttaggttcgggagtttcgtagcgtgttttagagattgttcgagtttggcggtcgtgggcgcgtattcgtgggttatacgttcggtcgttgagcgcgtaggcgtaggtttcgttttagcggggcggggttgaattatttttatttttttttatcggaatttcgtcggg

SEQ ID NO: 20456 - DNA, 590 bp, Artificial Sequence
  chemically treated genomic DNA (Homo sapiens) CpG-island No: 20456
cccgacgaaattccgataaaaaaaaataaaaataattcaaccccgccccgctaaaacgaaacctacgcctacgcgctcaacgaccgaacgtataacccacgaatacgcgcccacgaccgccaaactcgaacaatctctaaaacacgctacgaaactcccgaacctaaaccaaatctattctccacgcaaatattccgcgcgccccgttcaaccatatcgtccgacatccatataacgctaataactaaaaacaacaaaaacatcgacttaaccatcgtacgcgacctataccgactattctcgaaaaacgtaatactcacgacgcgaaacgtaacgcgaaaccaaacgaccgtacaacaactacaaacgaaaaacctaaacccgcgcttccaccaactaaacatcgacgatctacaaaacatccgcgccctacgcgacttcctacgcaaaaaatacgaaaacctaaacgtactaatcaacaacgcgaacatcgccttcaaaaatataaaaaaaaaacgtaacctccccgaaaaaaaaccgatacactaaaactcctaacgtctacgaaatccataacgcctccctaaaaa

SEQ ID NO: 20457 - DNA, 762 bp, Artificial Sequence
  chemically treated genomic DNA (Homo sapiens) CpG-island No: 20457
ttcgttttttagtttcgtttcgttcgcggaaatttcgttttcgcgcgtttatggtttatttttaggtttcgtttttgagttcgtttttaggcgtttagtttcgttttttagtttcgttttaagcgtcgaggttcggtttttaggtttcgtttcgattcgcgcggtggggaagagtcgttgtcgttggtttttcggttttttttcggcggttttggttttcggtcgcgtcgtagttttgtttagttttttttttttagttcggagggttttttcgcgtcgtacgtgagcgcgttcgttaatagggttattgtcgcggtaagtcgtgtttgcgttttgttcggcgtttagtttttagtcgttgggcgaagtcggaggagtcgggtatttttttttcgtcggttcgcgggttttttttcgggtttagagggtttgggcggcgtcgtggggcggttcggggtgtaggtggtttatcggcgcgcggttcgggtttgcggcgcgttttgttgtagtgcgggggcggagagttcggggtcggagatcgggagggtagcggggagattgggtggggttttttagggttattcgattttggcgcggaggatatgatgtcggttacgttttcgtcgagcggggcggtaggtgtaggtttaggggtgggtcgcggttcgcgcgttttttcggggtcggtttacgaagagacgtttagtttttgtttgttggtgttttggttggggaggaggttggggacgtagatttgtgaga

SEQ ID NO: 20458 - DNA, 762 bp, Artificial Sequence
  chemically treated genomic DNA (Homo sapiens) CpG-island No: 20458
tctcacaaatctacgtccccaacctcctccccaaccaaaacaccaacaaacaaaaactaaacgtctcttcgtaaaccgaccccgaaaaaacgcgcgaaccgcgacccacccctaaacctacacctaccgccccgctcgacgaaaacgtaaccgacatcatatcctccgcgccaaaatcgaataaccctaaaaaaccccacccaatctccccgctaccctcccgatctccgaccccgaactctccgcccccgcactacaacaaaacgcgccgcaaacccgaaccgcgcgccgataaaccacctacaccccgaaccgccccacgacgccgcccaaaccctctaaacccgaaaaaaaacccgcgaaccgacgaaaaaaaaatacccgactcctccgacttcgcccaacgactaaaaactaaacgccgaacaaaacgcaaacacgacttaccgcgacaataaccctattaacgaacgcgctcacgtacgacgcgaaaaaaccctccgaactaaaaaaaaaaaactaaacaaaactacgacgcgaccgaaaaccaaaaccgccgaaaaaaaaccgaaaaaccaacgacaacgactcttccccaccgcgcgaatcgaaacgaaacctaaaaaccgaacctcgacgcttaaaacgaaactaaaaaacgaaactaaacgcctaaaaacgaactcaaaaacgaaacctaaaaataaaccataaacgcgcgaaaacgaaatttccgcgaacgaaacgaaactaaaaaacgaa

SEQ ID NO: 20459 - DNA, 762 bp, Artificial Sequence
  chemically treated genomic DNA (Homo sapiens) CpG-island No: 20459
ttttataggtttgcgtttttagttttttttttagttagggtattagtaaataaaggttgagcgttttttcgtgggtcggtttcgggagggcgcgcgggtcgcgatttatttttggatttgtatttgtcgtttcgttcggcgagggcgtggtcggtattatatttttcgcgttagggtcgggtaattttaggggattttatttagttttttcgttgttttttcggttttcggtttcgagtttttcgttttcgtattgtagtagagcgcgtcgtaggttcgggtcgcgcgtcggtaagttatttgtatttcgggtcgttttacggcgtcgtttaagttttttggattcggagaaggattcgcgggtcggcggggaggagatgttcggttttttcggtttcgtttagcggttgaggattggacgtcggatagggcgtaggtacgatttatcgcggtagtggttttgttggcgggcgcgtttacgtgcggcgcggaggagtttttcgggttgggggagagagattgggtagggttgcggcgcggtcgggagttagaatcgtcgaggaagagtcggagaattagcggtagcggtttttttttatcgcgcgggtcggggcggagtttggaagtcgggtttcggcgtttggggcggggttggaaggcggggttggacgtttggaggcgggtttaggggcgggatttggaggtgggttataggcgcgcgggggcggggttttcgcgggcggggcggaattagaagacggg

SEQ ID NO: 20460 - DNA, 762 bp, Artificial Sequence
  chemically treated genomic DNA (Homo sapiens) CpG-island No: 20460
cccgtcttctaattccgccccgcccgcgaaaaccccgcccccgcgcgcctataacccacctccaaatcccgcccctaaacccgcctccaaacgtccaaccccgccttccaaccccgccccaaacgccgaaacccgacttccaaactccgccccgacccgcgcgataaaaaaaaaccgctaccgctaattctccgactcttcctcgacgattctaactcccgaccgcgccgcaaccctacccaatctctctcccccaacccgaaaaactcctccgcgccgcacgtaaacgcgcccgccaacaaaaccactaccgcgataaatcgtacctacgccctatccgacgtccaatcctcaaccgctaaacgaaaccgaaaaaaccgaacatctcctccccgccgacccgcgaatccttctccgaatccaaaaaacttaaacgacgccgtaaaacgacccgaaatacaaataacttaccgacgcgcgacccgaacctacgacgcgctctactacaatacgaaaacgaaaaactcgaaaccgaaaaccgaaaaaacaacgaaaaaactaaataaaatcccctaaaattacccgaccctaacgcgaaaaatataataccgaccacgccctcgccgaacgaaacgacaaatacaaatccaaaaataaatcgcgacccgcgcgccctcccgaaaccgacccacgaaaaaacgctcaacctttatttactaataccctaactaaaaaaaaaactaaaaacgcaaacctataaaa

SEQ ID NO: 20461 - DNA, 611 bp, Artificial Sequence
  chemically treated genomic DNA (Homo sapiens) CpG-island No: 20461
gtcgtttcgttattttttagtcgggttgcggcggaggtcgtttttggttttgtagttcgtttaagatggcggcgtagttatttcgcgggatacgttttagcgcggtgagtagtcgcgaggggtggagcgggtcgtgttttaggagggcgggcgggtaagcgaaggggggtcggtagtgggcggtggcggtttgtggggtcgacgcggcggcgggggttgcggcggggttcggggagggggcggttatttcgttttcgtcggcggaatagttcggttgcgggtcgggttgcgtttcgtcgtttttgtattgtgtttttgttttgtttcggggcgggttagggtcgcggtttttttttttagtttttttttagttttttagtagttgtcgttcgcgggcgaggtttcggcgggagatcggtttgttttcggggtcgcggggtttttgatttttttttgttcgttgggcgtcgtggtgggagggagcgggtttcgcgtttagaaacgtcggcggtttcgacgtttcgggggcggggggacggggttgcgggtttgtttgcgggcgagtggagttaggatgagtgtgtttgatgtttgttagtgtttgtagtttt

SEQ ID NO: 20462 - DNA, 611 bp, Artificial Sequence
  chemically treated genomic DNA (Homo sapiens) CpG-island No: 20462
aaaactacaaacactaacaaacatcaaacacactcatcctaactccactcgcccgcaaacaaacccgcaaccccgtccccccgcccccgaaacgtcgaaaccgccgacgtttctaaacgcgaaacccgctccctcccaccacgacgcccaacgaacaaaaaaaaatcaaaaaccccgcgaccccgaaaacaaaccgatctcccgccgaaacctcgcccgcgaacgacaactactaaaaaactaaaaaaaaactaaaaaaaaaaaccgcgaccctaacccgccccgaaacaaaacaaaaacacaatacaaaaacgacgaaacgcaacccgacccgcaaccgaactattccgccgacgaaaacgaaataaccgccccctccccgaaccccgccgcaacccccgccgccgcgtcgaccccacaaaccgccaccgcccactaccgaccccccttcgcttacccgcccgccctcctaaaacacgacccgctccacccctcgcgactactcaccgcgctaaaacgtatcccgcgaaataactacgccgccatcttaaacgaactacaaaaccaaaaacgacctccgccgcaacccgactaaaaaataacgaaacgac

SEQ ID NO: 20463 - DNA, 611 bp, Artificial Sequence
  chemically treated genomic DNA (Homo sapiens) CpG-island No: 20463
gaagttgtaggtattgataggtattaggtatatttattttgattttattcgttcgtaggtaggttcgtagtttcgttttttcgttttcgggacgtcgaggtcgtcggcgtttttggacgcggaattcgtttttttttattacgacgtttagcggatagaagagggttaggggtttcgcggtttcgagagtagatcgatttttcgtcgaggtttcgttcgcggacgatagttgttgggagattaggagggagttgggaggaggagtcgcgattttggttcgtttcgaagtaaaatagaaatataatgtagaggcgacggaacgtagttcggttcgtagtcgagttgtttcgtcgacgggagcgagatggtcgtttttttttcgggtttcgtcgtagttttcgtcgtcgcgtcggttttataagtcgttatcgtttattgtcggttttttttcgtttgttcgttcgtttttttgggatacggttcgttttatttttcgcggttgtttatcgcgttgaggcgtatttcgcggggtggttgcgtcgttattttgagcgagttataaagttaggaacggttttcgtcgtaattcgattgggaggtggcggaacgat

SEQ ID NO: 20464 - DNA, 611 bp, Artificial Sequence
  chemically treated genomic DNA (Homo sapiens) CpG-island No: 20464
atcgttccgccacctcccaatcgaattacgacgaaaaccgttcctaactttataactcgctcaaaataacgacgcaaccaccccgcgaaatacgcctcaacgcgataaacaaccgcgaaaaataaaacgaaccgtatcccaaaaaaacgaacgaacaaacgaaaaaaaaccgacaataaacgataacgacttataaaaccgacgcgacgacgaaaactacgacgaaacccgaaaaaaaaacgaccatctcgctcccgtcgacgaaacaactcgactacgaaccgaactacgttccgtcgcctctacattatatttctattttacttcgaaacgaaccaaaatcgcgactcctcctcccaactccctcctaatctcccaacaactatcgtccgcgaacgaaacctcgacgaaaaatcgatctactctcgaaaccgcgaaacccctaaccctcttctatccgctaaacgtcgtaataaaaaaaaacgaattccgcgtccaaaaacgccgacgacctcgacgtcccgaaaacgaaaaaacgaaactacgaacctacctacgaacgaataaaatcaaaataaatatacctaatacctatcaatacctacaacttc

SEQ ID NO: 20465 - DNA, 532 bp, Artificial Sequence
  chemically treated genomic DNA (Homo sapiens) CpG-island No: 20465
ttcgttttggcgtttatgagtgggcggggtttttttggggtatcgtttacgtcgggcgggatttgagggtcgttggaggggcggggcgtttatgaggtttcgtttatgcgggggcggggtttgcggcgcgcgggaagcggcgcgcgttgcgcgggaggtgacggtgtttttgattgttcgggtttttttaggtacggtttttttggttcgggtagtttcgcggtttttttggtcgcgtcggttcgggttagaggttttcgtcgagggcgggtttttgggtttcgggatagtttcggagcggcgcgcgttggggcggcggggtttcgtttattttcggtttcgcgcggttttttttcggcggttttagttttagtttttcgggtttagcgttcggtttttgggaaaggcggggtttttttttcgtttcgtcgtttcggttttttatttcgtttggttttttttttcgggaggtttttttcggggcgggttttttttcgggtttttagggcgcgtttttagtttttattaagcg

SEQ ID NO: 20466 - DNA, 532 bp, Artificial Sequence
  chemically treated genomic DNA (Homo sapiens) CpG-island No: 20466
cgcttaataaaaactaaaaacgcgccctaaaaacccgaaaaaaaacccgccccgaaaaaaacctcccgaaaaaaaaaaccaaacgaaataaaaaaccgaaacgacgaaacgaaaaaaaaaccccgcctttcccaaaaaccgaacgctaaacccgaaaaactaaaactaaaaccgccgaaaaaaaaccgcgcgaaaccgaaaataaacgaaaccccgccgccccaacgcgcgccgctccgaaactatcccgaaacccaaaaacccgccctcgacgaaaacctctaacccgaaccgacgcgaccaaaaaaaccgcgaaactacccgaaccaaaaaaaccgtacctaaaaaaacccgaacaatcaaaaacaccgtcacctcccgcgcaacgcgcgccgcttcccgcgcgccgcaaaccccgcccccgcataaacgaaacctcataaacgccccgcccctccaacgaccctcaaatcccgcccgacgtaaacgataccccaaaaaaaccccgcccactcataaacgccaaaacgaa

SEQ ID NO: 20467 - DNA, 532 bp, Artificial Sequence
  chemically treated genomic DNA (Homo sapiens) CpG-island No: 20467
cgtttagtaggggttaggggcgcgttttgagagttcggggaggggttcgtttcgggaggagtttttcggaagagggggttaaacggggtaggggatcggggcggcggggcgagaggagaatttcgttttttttagggatcgggcgttgggttcgggaagttgggattgaggtcgtcgggaggaggtcgcgcggggtcgggggtggacggggtttcgtcgttttaacgcgcgtcgtttcggagttatttcggggtttaggggttcgttttcggcgagggtttttggttcggatcgacgcgattaaaagagtcgcggagttgttcgggttagggaagtcgtatttggagggattcggatagttagaggtatcgttatttttcgcgtagcgcgcgtcgtttttcgcgcgtcgtaggtttcgttttcgtatgggcgggattttatagacgtttcgtttttttagcggtttttaggtttcgttcgacgtgggcggtattttagggaagtttcgtttatttatagacgttaaggcgag

SEQ ID NO: 20468 - DNA, 532 bp, Artificial Sequence
  chemically treated genomic DNA (Homo sapiens) CpG-island No: 20468
ctcgccttaacgtctataaataaacgaaacttccctaaaataccgcccacgtcgaacgaaacctaaaaaccgctaaaaaaacgaaacgtctataaaatcccgcccatacgaaaacgaaacctacgacgcgcgaaaaacgacgcgcgctacgcgaaaaataacgatacctctaactatccgaatccctccaaatacgacttccctaacccgaacaactccgcgactcttttaatcgcgtcgatccgaaccaaaaaccctcgccgaaaacgaacccctaaaccccgaaataactccgaaacgacgcgcgttaaaacgacgaaaccccgtccacccccgaccccgcgcgacctcctcccgacgacctcaatcccaacttcccgaacccaacgcccgatccctaaaaaaaacgaaattctcctctcgccccgccgccccgatcccctaccccgtttaaccccctcttccgaaaaactcctcccgaaacgaacccctccccgaactctcaaaacgcgcccctaacccctactaaacg

SEQ ID NO: 20469 - DNA, 780 bp, Artificial Sequence
  chemically treated genomic DNA (Homo sapiens) CpG-island No: 20469
ttcgattgtacgcgtttttttgggatttcgtattggcgagtcgtttttttcggcgttggacgttttatttgtttcggcgtcgtcggaagagttttgtagagtgagtttttagggttatttcgttgttttttttttcgttttcgtagtcgttgtagttagcgtgggagtcgggtaggtcgcgtggggcgttggatttatcgagaggttagcgtcgtcgtcgggggagggcgtgtttcgtacgtgtgtgttcgcgcgtgttcgcgttcgcgtgtgttagcgcgcgtgttttggtcgtgcgcgtcgagtcgggtcgtattaattttttcggcgtcgacgggtttagtttatggtgtgggcgtcgggtttagggaggtttcggttttcgttaatcgcggagtagggcggtcgtttcgacgcgcgatttgcgaattcggagtgcgcgtcgggggcggggtagggacgcgtgggcgggaatgtacgcgcgtggttaggtgcgcgtgggtgcgagcgcgcgggagttttcgagtgcgcgcgtgttcgtgtgcgcgtgggtgtgggtgtgttcgcgtgttcgtgcgcgcgttttcggggttaagagcgcgggtcgcgcgggtaggtttggatattacgcgttttgttcgggtttaggacgcggttggcggtttcgggaggaagaggaggaggaagaggaggaggcggaggaggaggaagaggaggagggaggcggaggagtagaggttgggacggtcggaggagagagttcggttttagtaggaaagg

SEQ ID NO: 20470 - DNA, 780 bp, Artificial Sequence
  chemically treated genomic DNA (Homo sapiens) CpG-island No: 20470
cctttcctactaaaaccgaactctctcctccgaccgtcccaacctctactcctccgcctccctcctcctcttcctcctcctccgcctcctcctcttcctcctcctcttcctcccgaaaccgccaaccgcgtcctaaacccgaacaaaacgcgtaatatccaaacctacccgcgcgacccgcgctcttaaccccgaaaacgcgcgcacgaacacgcgaacacacccacacccacgcgcacacgaacacgcgcgcactcgaaaactcccgcgcgctcgcacccacgcgcacctaaccacgcgcgtacattcccgcccacgcgtccctaccccgcccccgacgcgcactccgaattcgcaaatcgcgcgtcgaaacgaccgccctactccgcgattaacgaaaaccgaaacctccctaaacccgacgcccacaccataaactaaacccgtcgacgccgaaaaaattaatacgacccgactcgacgcgcacgaccaaaacacgcgcgctaacacacgcgaacgcgaacacgcgcgaacacacacgtacgaaacacgccctcccccgacgacgacgctaacctctcgataaatccaacgccccacgcgacctacccgactcccacgctaactacaacgactacgaaaacgaaaaaaaaaacaacgaaataaccctaaaaactcactctacaaaactcttccgacgacgccgaaacaaataaaacgtccaacgccgaaaaaaacgactcgccaatacgaaatcccaaaaaaacgcgtacaatcgaa

SEQ ID NO: 20471 - DNA, 780 bp, Artificial Sequence
  chemically treated genomic DNA (Homo sapiens) CpG-island No: 20471
ttttttttgttggggtcggattttttttttcggtcgttttagtttttgttttttcgttttttttttttttttttttttttttcgtttttttttttttttttttttttttttttcggagtcgttagtcgcgttttaaattcgagtagggcgcgtagtgtttaaatttgttcgcgcggttcgcgtttttggtttcgagggcgcgcgtacggatacgcgagtatatttatatttacgcgtatacggatacgcgcgtattcgaagattttcgcgcgttcgtatttacgcgtatttggttacgcgcgtgtattttcgtttacgcgtttttgtttcgttttcggcgcgtatttcgggttcgtaagtcgcgcgtcggggcggtcgttttgtttcgcgattggcgggagtcggagtttttttgaattcggcgtttatattatgggttgagttcgtcggcgtcgagggagttagtgcgattcggttcggcgcgtacggttaaggtacgcgcgttggtatacgcgggcgcggatacgcgcggatatatacgtgcgggatacgttttttttcgacggcggcgttaatttttcggtaagtttagcgttttacgcgatttgttcggtttttacgttggttatagcggttgcggggacggggaggaaggtagcggggtggttttaggggtttattttgtagggttttttcgacggcgtcgggataggtggggcgtttagcgtcgggagggacggttcgttagtgcggggttttagggaggcgcgtgtagtcggg

SEQ ID NO: 20472 - DNA, 780 bp, Artificial Sequence
  chemically treated genomic DNA (Homo sapiens) CpG-island No: 20472
cccgactacacgcgcctccctaaaaccccgcactaacgaaccgtccctcccgacgctaaacgccccacctatcccgacgccgtcgaaaaaaccctacaaaataaacccctaaaaccaccccgctaccttcctccccgtccccgcaaccgctataaccaacgtaaaaaccgaacaaatcgcgtaaaacgctaaacttaccgaaaaattaacgccgccgtcgaaaaaaaacgtatcccgcacgtatatatccgcgcgtatccgcgcccgcgtataccaacgcgcgtaccttaaccgtacgcgccgaaccgaatcgcactaactccctcgacgccgacgaactcaacccataatataaacgccgaattcaaaaaaactccgactcccgccaatcgcgaaacaaaacgaccgccccgacgcgcgacttacgaacccgaaatacgcgccgaaaacgaaacaaaaacgcgtaaacgaaaatacacgcgcgtaaccaaatacgcgtaaatacgaacgcgcgaaaatcttcgaatacgcgcgtatccgtatacgcgtaaatataaatatactcgcgtatccgtacgcgcgccctcgaaaccaaaaacgcgaaccgcgcgaacaaatttaaacactacgcgccctactcgaatttaaaacgcgactaacgactccgaaaaaaaaaaaaaaaaaaaaaaaaaaaaacgaaaaaaaaaaaaaaaaaaaaaaaaaacgaaaaaacaaaaactaaaacgaccgaaaaaaaaaatccgaccccaacaaaaaaaa

SEQ ID NO: 20473 - DNA, 609 bp, Artificial Sequence
  chemically treated genomic DNA (Homo sapiens) CpG-island No: 20473
gaaaggtagcgtcggcgttacgtgtatacgggttgggtcgtttcgttagttgttagggttattgtcgcgtttatttttagagcgcgttgcgagtcgcggcgtttttgtgacgttattagttcgcgcgtcgtcgtcgtcgttttttgtgtagtcgcggttcgggcggacggtggttggttgtttcgtagcgttcggttggttgtagcggtatcgcgggttgcgcggtcggggatgttttagcgggcgcgatggttttcgttatgtagtcggtcgagatttaatttgtttagcggttggcgtttagcgagaagggtattcgggatcgagcggtgaagaagttgcgttagtatattagcgtgaagacgtagagggagataggtgggcgtacggtcgcggttagtcgcgttatatggcgggtcgggggtcggggttggggttagggttagggtttcggtacggaatgcggtttttacgtgttgtcgtgatatttagcgtgtgtttcggttttcgcgttgtcggaatcgttttttgttgtgtttagtgtttttttatatttaaggaaacgggttgagggggtttcgttatttatgaaagttatagtaagcgggg

SEQ ID NO: 20474 - DNA, 609 bp, Artificial Sequence
  chemically treated genomic DNA (Homo sapiens) CpG-island No: 20474
ccccgcttactataactttcataaataacgaaaccccctcaacccgtttccttaaatataaaaaaacactaaacacaacaaaaaacgattccgacaacgcgaaaaccgaaacacacgctaaatatcacgacaacacgtaaaaaccgcattccgtaccgaaaccctaaccctaaccccaaccccgacccccgacccgccatataacgcgactaaccgcgaccgtacgcccacctatctccctctacgtcttcacgctaatatactaacgcaacttcttcaccgctcgatcccgaatacccttctcgctaaacgccaaccgctaaacaaattaaatctcgaccgactacataacgaaaaccatcgcgcccgctaaaacatccccgaccgcgcaacccgcgataccgctacaaccaaccgaacgctacgaaacaaccaaccaccgtccgcccgaaccgcgactacacaaaaaacgacgacgacgacgcgcgaactaataacgtcacaaaaacgccgcgactcgcaacgcgctctaaaaataaacgcgacaataaccctaacaactaacgaaacgacccaacccgtatacacgtaacgccgacgctacctttc

SEQ ID NO: 20475 - DNA, 609 bp, Artificial Sequence
  chemically treated genomic DNA (Homo sapiens) CpG-island No: 20475
tttcgtttattgtgatttttataagtaacggaatttttttaattcgtttttttaagtgtaaaaaggtattagatatagtaagaagcggtttcggtagcgcggaaatcgaagtatacgttgggtgttacgataatacgtggaagtcgtatttcgtgtcggggttttggttttagttttagtttcggttttcggttcgttatgtggcgcggttgatcgcggtcgtgcgtttatttgtttttttttgcgtttttacgttgatgtattggcgtagtttttttatcgttcggtttcggatgtttttttcgttggacgttagtcgttgggtaaattggatttcggtcggttgtatggcgggggttatcgcgttcgttggagtattttcggtcgcgtaattcgcggtgtcgttgtagttagtcgagcgttgcggagtagttagttatcgttcgttcgggtcgcgattgtatagaaggcggcggcggcggcgcgcgggttgatggcgttataaaggcgtcgcggttcgtagcgcgttttgggagtgagcgcggtagtggttttggtagttggcggagcggtttagttcgtgtgtacgtggcgtcggcgttgtttttt

SEQ ID NO: 20476 - DNA, 609 bp, Artificial Sequence
  chemically treated genomic DNA (Homo sapiens) CpG-island No: 20476
aaaaaacaacgccgacgccacgtacacacgaactaaaccgctccgccaactaccaaaaccactaccgcgctcactcccaaaacgcgctacgaaccgcgacgcctttataacgccatcaacccgcgcgccgccgccgccgccttctatacaatcgcgacccgaacgaacgataactaactactccgcaacgctcgactaactacaacgacaccgcgaattacgcgaccgaaaatactccaacgaacgcgataacccccgccatacaaccgaccgaaatccaatttacccaacgactaacgtccaacgaaaaaaacatccgaaaccgaacgataaaaaaactacgccaatacatcaacgtaaaaacgcaaaaaaaaacaaataaacgcacgaccgcgatcaaccgcgccacataacgaaccgaaaaccgaaactaaaactaaaaccaaaaccccgacacgaaatacgacttccacgtattatcgtaacacccaacgtatacttcgatttccgcgctaccgaaaccgcttcttactatatctaatacctttttacacttaaaaaaacgaattaaaaaaattccgttacttataaaaatcacaataaacgaaa

SEQ ID NO: 20477 - DNA, 1372 bp, Artificial Sequence
  chemically treated genomic DNA (Homo sapiens) CpG-island No: 20477
gttttcgcgcggtttttgggaagggacgcggatcggatgcgggtttcgggttttgtaggtagttgagagcgcggtttttttgggtattcggggttcggggttattttcgcgttttcgtattatttttacgttcgcgcgtattttcgtggttattcgcgttgcgagagtgtcgcgttcggaggttaggggcgtggagttcgggttttcgagttttttttgcgtgcggcggggcgcggggcgcggggcgcggggcgtagggttgaggcggagtataatggttgaatgaatgaatgaacgaacgaatgaacggcgttgtagagttttttttaggcggaatgaaagtgtaaatttagcgtttcgggcggtagagtggcgggggttatttggcgcggtcgcgcggttagggttcggtttcgtttttttttagttcgggggcggggtttgcgtggttgttttcgtttcggttcgttttcggttagttttcggcgtcgcgcggaattcgcgggttcggagtcgttcgttgaggttagaaggaggcgtttgcgttgatcgggttcgtcgcgcgttagagttagagtcgtagtcgaggggagtcggggtcggagttcgagttcgagtcgagtcggagttcgagcgagcggcggagatcgtgttttcgtttcggtttcgcgtcgtcgcggttaggttcggtatggaggaggagtgtcgggtgttttttatatagagttacgttattcgcggttacgtgggtaatcgggcggttacgttttcgttgtaggtacgtattcgttcgtagttcgggtttacgtaattcgagttcgtgattttggcggggttgttcgagacgagttttagtttttcgagggaggttcgggagttgcgggtagagtttggcgcgggcgttttggaggtaggcgcgggatgagtttttcgttttgtttggtttgcgggggcggaagcggagggttgagcgttttgcgggtttttgcgggtgggacgggttcggcgtcggggtacgcgggtaggagggagttttgtgtattagttatggcgtagtcgttcgttttcgttttttttcgtcgatcgggttaattgtcgcgggggcgggcgggcggtgcggttttcggaggcgaggaaatgtcgtagagtttcgaggagtttcggagtagttacgcgagtcgggattttgtttcgttggaacgtagaagcggtcgtggagttcgagacgttcgcgcgtttattttttgggtttttgtgcgtggggaagttaggaagaagacgtcgagtgaggttacggtgtttacgagggtggatttttttcggtttgattacgttaggaggtggtcgaagggaagagggtggggtaggggtt

SEQ ID NO: 20478 - DNA, 1372 bp, Artificial Sequence
  chemically treated genomic DNA (Homo sapiens) CpG-island No: 20478
aacccctaccccaccctcttcccttcgaccacctcctaacgtaatcaaaccgaaaaaaatccaccctcgtaaacaccgtaacctcactcgacgtcttcttcctaacttccccacgcacaaaaacccaaaaaataaacgcgcgaacgtctcgaactccacgaccgcttctacgttccaacgaaacaaaatcccgactcgcgtaactactccgaaactcctcgaaactctacgacatttcctcgcctccgaaaaccgcaccgcccgcccgcccccgcgacaattaacccgatcgacgaaaaaaaacgaaaacgaacgactacgccataactaatacacaaaactccctcctacccgcgtaccccgacgccgaacccgtcccacccgcaaaaacccgcaaaacgctcaaccctccgcttccgcccccgcaaaccaaacaaaacgaaaaactcatcccgcgcctacctccaaaacgcccgcgccaaactctacccgcaactcccgaacctccctcgaaaaactaaaactcgtctcgaacaaccccgccaaaatcacgaactcgaattacgtaaacccgaactacgaacgaatacgtacctacaacgaaaacgtaaccgcccgattacccacgtaaccgcgaataacgtaactctatataaaaaacacccgacactcctcctccataccgaacctaaccgcgacgacgcgaaaccgaaacgaaaacacgatctccgccgctcgctcgaactccgactcgactcgaactcgaactccgaccccgactcccctcgactacgactctaactctaacgcgcgacgaacccgatcaacgcaaacgcctccttctaacctcaacgaacgactccgaacccgcgaattccgcgcgacgccgaaaactaaccgaaaacgaaccgaaacgaaaacaaccacgcaaaccccgcccccgaactaaaaaaaaacgaaaccgaaccctaaccgcgcgaccgcgccaaataacccccgccactctaccgcccgaaacgctaaatttacactttcattccgcctaaaaaaaactctacaacgccgttcattcgttcgttcattcattcattcaaccattatactccgcctcaaccctacgccccgcgccccgcgccccgcgccccgccgcacgcaaaaaaaactcgaaaacccgaactccacgcccctaacctccgaacgcgacactctcgcaacgcgaataaccacgaaaatacgcgcgaacgtaaaaataatacgaaaacgcgaaaataaccccgaaccccgaatacccaaaaaaaccgcgctctcaactacctacaaaacccgaaacccgcatccgatccgcgtcccttcccaaaaaccgcgcgaaaac

SEQ ID NO: 20479 - DNA, 1372 bp, Artificial Sequence
  chemically treated genomic DNA (Homo sapiens) CpG-island No: 20479
agtttttgttttattttttttttttcggttattttttggcgtggttaggtcgaggggaatttattttcgtgggtatcgtgattttattcggcgttttttttttgatttttttacgtataggggtttaggaggtgagcgcgcgagcgtttcgagttttacggtcgtttttgcgttttagcggggtaaggtttcggttcgcgtgattgtttcgggatttttcggggttttgcgatattttttcgttttcgggagtcgtatcgttcgttcgttttcgcggtagttggttcggtcggcgggaaggggcgaggacgagcggttgcgttatagttggtgtatagggtttttttttattcgcgtatttcgacgtcggattcgttttattcgtaggggttcgtagagcgtttagtttttcgttttcgttttcgtaagttaagtagagcgggaggtttatttcgcgtttgtttttagggcgttcgcgttaggttttgttcgtagttttcgagtttttttcggggaattgaggttcgtttcgggtagtttcgttaaggttacgggttcgggttacgtaagttcgggttgcgggcggatgcgtatttgtagcgggaacgtggtcgttcggttgtttacgtagtcgcggatgacgtggttttgtatggagagtattcggtattttttttttatgtcgggtttggtcgcggcggcgcggggtcgaggcgggggtacggttttcgtcgttcgttcgggtttcggttcggttcgggttcgggtttcggtttcggtttttttcggttgcgattttggttttggcgcgcggcggattcgattagcgtagacgtttttttttgattttagcgggcggtttcgaattcgcgagtttcgcgcggcgtcgggggttggtcgggggcggatcggggcggggatagttacgtaggtttcgttttcgggttgggaggaagcgaaatcggattttggtcgcgcggtcgcgttaggtggttttcgttattttgtcgttcgaaacgttgggtttgtatttttatttcgtttggagagggttttgtagcgtcgtttattcgttcgtttatttatttatttaattattgtgtttcgttttagttttgcgtttcgcgtttcgcgtttcgcgtttcgtcgtacgtaggggagattcgggggttcgggttttacgtttttgattttcgggcgcgatattttcgtaacgcggatggttacgagagtgcgcgcgggcgtgggaatagtgcggaggcgcgaaagtgatttcggatttcggatatttaagggaatcgcgtttttaattgtttgtagggttcggagttcgtattcgattcgcgtttttttttaggggtcgcgcgggagt

SEQ ID NO: 20480 - DNA, 1372 bp, Artificial Sequence
  chemically treated genomic DNA (Homo sapiens) CpG-island No: 20480
actcccgcgcgacccctaaaaaaaaacgcgaatcgaatacgaactccgaaccctacaaacaattaaaaacgcgattcccttaaatatccgaaatccgaaatcactttcgcgcctccgcactattcccacgcccgcgcgcactctcgtaaccatccgcgttacgaaaatatcgcgcccgaaaatcaaaaacgtaaaacccgaacccccgaatctcccctacgtacgacgaaacgcgaaacgcgaaacgcgaaacgcaaaactaaaacgaaacacaataattaaataaataaataaacgaacgaataaacgacgctacaaaaccctctccaaacgaaataaaaatacaaacccaacgtttcgaacgacaaaataacgaaaaccacctaacgcgaccgcgcgaccaaaatccgatttcgcttcctcccaacccgaaaacgaaacctacgtaactatccccgccccgatccgcccccgaccaacccccgacgccgcgcgaaactcgcgaattcgaaaccgcccgctaaaatcaaaaaaaaacgtctacgctaatcgaatccgccgcgcgccaaaaccaaaatcgcaaccgaaaaaaaccgaaaccgaaacccgaacccgaaccgaaccgaaacccgaacgaacgacgaaaaccgtacccccgcctcgaccccgcgccgccgcgaccaaacccgacataaaaaaaaaataccgaatactctccatacaaaaccacgtcatccgcgactacgtaaacaaccgaacgaccacgttcccgctacaaatacgcatccgcccgcaacccgaacttacgtaacccgaacccgtaaccttaacgaaactacccgaaacgaacctcaattccccgaaaaaaactcgaaaactacgaacaaaacctaacgcgaacgccctaaaaacaaacgcgaaataaacctcccgctctacttaacttacgaaaacgaaaacgaaaaactaaacgctctacgaacccctacgaataaaacgaatccgacgtcgaaatacgcgaataaaaaaaaaccctatacaccaactataacgcaaccgctcgtcctcgccccttcccgccgaccgaaccaactaccgcgaaaacgaacgaacgatacgactcccgaaaacgaaaaaatatcgcaaaaccccgaaaaatcccgaaacaatcacgcgaaccgaaaccttaccccgctaaaacgcaaaaacgaccgtaaaactcgaaacgctcgcgcgctcacctcctaaacccctatacgtaaaaaaatcaaaaaaaaaacgccgaataaaatcacgatacccacgaaaataaattcccctcgacctaaccacgccaaaaaataaccgaaaaaaaaaaaataaaacaaaaact

SEQ ID NO: 20481 - DNA, 764 bp, Artificial Sequence
  chemically treated genomic DNA (Homo sapiens) CpG-island No: 20481
agggaggttttttacggttatagttcgggttagtttaggggtgcgtagcggggttaaagcggtttttttcgttttaggagtcgcggtcgcgttttgaggttaaggtaggatttcgggtcggtttcgttttcgcggtttatttatttggtcggcgatgtgttgggtttcggcggtggtcggttgcgtggcggagggcgtttcgtatattattttggcggcgacggagggaatttggcgaggggattcggcgaggggacgcggcggttttttagtttaagtaggcgttggggttacgtgacgcgcgggcggaattaaggggcggggaggaggtattttggtttcggagttttttgcggggtcgcggtggtttcgtaagaagggacgcgcggggcggggcgcggggcggggcgcggggcggggaatttggttattattcgtcgtaggttgggttttcgcgtttagcgttggtgtcgggagggagcgtttttttttcggggttggtatcgttttttcgggcgtcgagttatacggatcggggcgggggcgcggtcgggtgtcgtcggtgggttgggcgcgtagggtgggacgatagggaaggggtagtcggagtaggcgtaattttgtagggtggcggggttcgggtcgcgtacgagggagggcggggcgtagcgttgtaggggttaggggttaggggtttcggtttcgcgggagtaggtgtgcgggttgtagtggatattatcgtttgtgatcgagaatattgaagg

SEQ ID NO: 20482 - DNA, 764 bp, Artificial Sequence
  chemically treated genomic DNA (Homo sapiens) CpG-island No: 20482
ccttcaatattctcgatcacaaacgataatatccactacaacccgcacacctactcccgcgaaaccgaaacccctaacccctaacccctacaacgctacgccccgccctccctcgtacgcgacccgaaccccgccaccctacaaaattacgcctactccgactaccccttccctatcgtcccaccctacgcgcccaacccaccgacgacacccgaccgcgcccccgccccgatccgtataactcgacgcccgaaaaaacgataccaaccccgaaaaaaaaacgctccctcccgacaccaacgctaaacgcgaaaacccaacctacgacgaataataaccaaattccccgccccgcgccccgccccgcgccccgccccgcgcgtcccttcttacgaaaccaccgcgaccccgcaaaaaactccgaaaccaaaatacctcctccccgccccttaattccgcccgcgcgtcacgtaaccccaacgcctacttaaactaaaaaaccgccgcgtcccctcgccgaatcccctcgccaaattccctccgtcgccgccaaaataatatacgaaacgccctccgccacgcaaccgaccaccgccgaaacccaacacatcgccgaccaaataaataaaccgcgaaaacgaaaccgacccgaaatcctaccttaacctcaaaacgcgaccgcgactcctaaaacgaaaaaaaccgctttaaccccgctacgcacccctaaactaacccgaactataaccgtaaaaaacctccct

SEQ ID NO: 20483 - DNA, 764 bp, Artificial Sequence
  chemically treated genomic DNA (Homo sapiens) CpG-island No: 20483
tttttagtgttttcggttataagcggtgatgtttattgtagttcgtatatttgttttcgcggggtcgggatttttgatttttgatttttgtagcgttgcgtttcgttttttttcgtgcgcggttcggatttcgttattttgtaggattgcgtttatttcgattgttttttttttatcgttttattttgcgcgtttaatttatcggcgatattcggtcgcgttttcgtttcggttcgtgtgattcggcgttcggaaagacgatattagtttcgggaggggggcgttttttttcgatattagcgttgggcgcggagatttagtttgcggcgagtggtggttaggtttttcgtttcgcgtttcgtttcgcgtttcgtttcgcgcgtttttttttgcggggttatcgcgatttcgtaggggatttcgaagttaaagtgtttttttttcgttttttggtttcgttcgcgcgttacgtgattttagcgtttatttgggttgaggagtcgtcgcgttttttcgtcgagttttttcgttagatttttttcgtcgtcgttaagatgatgtgcggggcgtttttcgttacgtagtcggttatcgtcgagatttagtatatcgtcgattaggtgggtgggtcgcggggacggggtcggttcggagttttgttttagttttagggcgcggtcgcggtttttggagcgaaagaagtcgttttggtttcgttgcgtatttttgggttggttcgggttgtggtcgtgagaggttttttt

SEQ ID NO: 20484 - DNA, 764 bp, Artificial Sequence
  chemically treated genomic DNA (Homo sapiens) CpG-island No: 20484
aaaaaaacctctcacgaccacaacccgaaccaacccaaaaatacgcaacgaaaccaaaacgacttctttcgctccaaaaaccgcgaccgcgccctaaaactaaaacaaaactccgaaccgaccccgtccccgcgacccacccacctaatcgacgatatactaaatctcgacgataaccgactacgtaacgaaaaacgccccgcacatcatcttaacgacgacgaaaaaaatctaacgaaaaaactcgacgaaaaaacgcgacgactcctcaacccaaataaacgctaaaatcacgtaacgcgcgaacgaaaccaaaaaacgaaaaaaaaacactttaacttcgaaatcccctacgaaatcgcgataaccccgcaaaaaaaaacgcgcgaaacgaaacgcgaaacgaaacgcgaaacgaaaaacctaaccaccactcgccgcaaactaaatctccgcgcccaacgctaatatcgaaaaaaaacgcccccctcccgaaactaatatcgtctttccgaacgccgaatcacacgaaccgaaacgaaaacgcgaccgaatatcgccgataaattaaacgcgcaaaataaaacgataaaaaaaaaacaatcgaaataaacgcaatcctacaaaataacgaaatccgaaccgcgcacgaaaaaaaacgaaacgcaacgctacaaaaatcaaaaatcaaaaatcccgaccccgcgaaaacaaatatacgaactacaataaacatcaccgcttataaccgaaaacactaaaaa

SEQ ID NO: 20485 - DNA, 671 bp, Artificial Sequence
  chemically treated genomic DNA (Homo sapiens) CpG-island No: 20485
gcgtaggcgcgcgttcgttggtttcgtttatgcgtataggtagggagcgcgcgttttttttgtagttttcggttttcgggggttgtagttgcgcggttcggttattgcgcggcggtggcgtgcgtttgggcggtgtcgcgggttgtgacgttacgttacgcgtcggggttaggaggaggcgggcgtaggaggcgcgtgtttagtgtgttgggtattaggcgatttcgggatagggggtttcggtcgtcggcgttatggtttcgcgcgtgtagttttcgtttgagatttagttggtttagcgtttggcggggaatgagtaggtgattcgggatcgggcggtgaggaagtttcggaaatatatcgtcgttaggatttagcgggtcgtaggttggcgggggtgtgggcggttggcgtttcgggggtcggttgggttggtgcgggtgtgggcggcggcggtcggagttgggggtttttcgagttttgtggaatttttacgtggtcgggtcgggtaggcggggtttattggtttgttttcgttgttatcggtttacggttttcgtcgtcgttttttttcgtggtgcggtgattttggtttttttgcgagaacgtttttttttagtttcgtaattttttttttagtttaggcgttttttttttttagtagattatgt

SEQ ID NO: 20486 - DNA, 671 bp, Artificial Sequence
  chemically treated genomic DNA (Homo sapiens) CpG-island No: 20486
acataatctactaaaaaaaaaaaacgcctaaactaaaaaaaaaattacgaaactaaaaaaaaacgttctcgcaaaaaaaccaaaatcaccgcaccacgaaaaaaaacgacgacgaaaaccgtaaaccgataacaacgaaaacaaaccaataaaccccgcctacccgacccgaccacgtaaaaattccacaaaactcgaaaaacccccaactccgaccgccgccgcccacacccgcaccaacccaaccgacccccgaaacgccaaccgcccacacccccgccaacctacgacccgctaaatcctaacgacgatatatttccgaaacttcctcaccgcccgatcccgaatcacctactcattccccgccaaacgctaaaccaactaaatctcaaacgaaaactacacgcgcgaaaccataacgccgacgaccgaaaccccctatcccgaaatcgcctaatacccaacacactaaacacgcgcctcctacgcccgcctcctcctaaccccgacgcgtaacgtaacgtcacaacccgcgacaccgcccaaacgcacgccaccgccgcgcaataaccgaaccgcgcaactacaacccccgaaaaccgaaaactacaaaaaaaacgcgcgctccctacctatacgcataaacgaaaccaacgaacgcgcgcctacgc

SEQ ID NO: 20487 - DNA, 671 bp, Artificial Sequence
  chemically treated genomic DNA (Homo sapiens) CpG-island No: 20487
atatggtttattggagggaggggacgtttgagttaggaaaggggttacggggttggggaggagcgttttcgtagagggattagagttatcgtattacgagggaaagcggcggcgggggtcgtgggtcggtaatagcgggaataggttagtggatttcgtttgttcggttcggttacgtggaggttttatagggttcggagggtttttagtttcggtcgtcgtcgtttatattcgtattagtttagtcggttttcgagacgttagtcgtttatattttcgttaatttgcggttcgttgagttttggcgacgatgtattttcggagtttttttatcgttcggtttcgggttatttgtttatttttcgttaggcgttgagttagttggattttaggcgggagttgtacgcgcgaaattatgacgtcgacggtcgagattttttgtttcggagtcgtttggtatttagtatattgagtacgcgttttttgcgttcgtttttttttggtttcggcgcgtggcgtgacgttatagttcgcgatatcgtttaggcgtacgttatcgtcgcgtagtggtcgagtcgcgtaattgtagttttcggaggtcgaaggttatagagggggcgcgcgttttttgtttgtgcgtatgggcggaattagcgagcgcgcgtttgcgt

SEQ ID NO: 20488 - DNA, 671 bp, Artificial Sequence
  chemically treated genomic DNA (Homo sapiens) CpG-island No: 20488
acgcaaacgcgcgctcgctaattccgcccatacgcacaaacaaaaaacgcgcgccccctctataaccttcgacctccgaaaactacaattacgcgactcgaccactacgcgacgataacgtacgcctaaacgatatcgcgaactataacgtcacgccacgcgccgaaaccaaaaaaaaacgaacgcaaaaaacgcgtactcaatatactaaataccaaacgactccgaaacaaaaaatctcgaccgtcgacgtcataatttcgcgcgtacaactcccgcctaaaatccaactaactcaacgcctaacgaaaaataaacaaataacccgaaaccgaacgataaaaaaactccgaaaatacatcgtcgccaaaactcaacgaaccgcaaattaacgaaaatataaacgactaacgtctcgaaaaccgactaaactaatacgaatataaacgacgacgaccgaaactaaaaaccctccgaaccctataaaacctccacgtaaccgaaccgaacaaacgaaatccactaacctattcccgctattaccgacccacgacccccgccgccgctttccctcgtaatacgataactctaatccctctacgaaaacgctcctccccaaccccgtaacccctttcctaactcaaacgtcccctccctccaataaaccatat

SEQ ID NO: 20489 - DNA, 1247 bp, Artificial Sequence
  chemically treated genomic DNA (Homo sapiens) CpG-island No: 20489
ttcgcgggattttagtttggtttttcgtcgttttttttcgtttagtttcgatttttttgattttcgcgtttttcgcggtttcggttcgtttttttttttagttcgggttttagtttcgttcgttagcggattttacgtaggtttcgcgttcggtttcgtcggcgttttcggtttatattttttttcgcgcgcgtgtttcgtcgtgtcgttttcgtgtttttttcgcgttttttttcgcgtcgttttttcgcgttttttttcgcgtttttttttcgtgtttttttagcgtgtttttcggtcgtttcgcgcgcgtcggcggaattgtgggatcgtcgcgtataggaagtggcggcggcggcgcggtcgagggcggagggcggagggcggcgggatgggggtcgggggcggcgggcgtcgtattcgttgaggtttcgacgtagggtcgggtcgggtttagggtcgaggagcgcggcggttagagcggggtcgcggaggcgacgtcggggacgttcgcgcgacgagtaggtggcggcggttgtaggtgagtatcgaggtttttattcgaggtcgggtcgtttttttttttttttacgtttcgtcgtcgttcgaggtcgttttttcgtcgtcggaggtcgtttttgttttagtcgttcgatttcgggtcgttcggggtttcgcgtcgtaatgggtcggtcgcgtttcgcggggcgcggggtttgggaaggcgcggggtcgggaggaggtttgggttcgggttttgtgcgtttttcgtaatttcggttttttcggcggtttggtttagcgcgaggtttcggtcgtttttcgtagtagtttcggtggcgttgggtttagcggggaggttcgggggttcggggcgttcgggaggggttcgggtcgggtcgagggagggcgagtgggttttcgcggggacgttttattttttcgttttggattttgtttcgggtttcgttcggttttttcgtggataggacgcgttcgtcgtttggtttcggggcgcggcggattcgggattttttttaggggtttttttttcgcgcgtttaggttaagggagtagttttatttttgtcgtttcgcgcggggagggttgcggggttcggggttggttgtgggttcggttcggagatcggcggcgcgtttgtatcgggcgggttaggggatggggttagttcgggggtaagagtcgtgggggcgaaaatttatttttggttattttaggatttttgg

SEQ ID NO: 20490 - DNA, 1247 bp, Artificial Sequence
  chemically treated genomic DNA (Homo sapiens) CpG-island No: 20490
ccaaaaatcctaaaataaccaaaaataaattttcgcccccacgactcttacccccgaactaaccccatcccctaacccgcccgatacaaacgcgccgccgatctccgaaccgaacccacaaccaaccccgaaccccgcaaccctccccgcgcgaaacgacaaaaataaaactactcccttaacctaaacgcgcgaaaaaaaaacccctaaaaaaaatcccgaatccgccgcgccccgaaaccaaacgacgaacgcgtcctatccacgaaaaaaccgaacgaaacccgaaacaaaatccaaaacgaaaaaataaaacgtccccgcgaaaacccactcgccctccctcgacccgacccgaacccctcccgaacgccccgaacccccgaacctccccgctaaacccaacgccaccgaaactactacgaaaaacgaccgaaacctcgcgctaaaccaaaccgccgaaaaaaccgaaattacgaaaaacgcacaaaacccgaacccaaacctcctcccgaccccgcgccttcccaaaccccgcgccccgcgaaacgcgaccgacccattacgacgcgaaaccccgaacgacccgaaatcgaacgactaaaacaaaaacgacctccgacgacgaaaaaacgacctcgaacgacgacgaaacgtaaaaaaaaaaaaaaacgacccgacctcgaataaaaacctcgatactcacctacaaccgccgccacctactcgtcgcgcgaacgtccccgacgtcgcctccgcgaccccgctctaaccgccgcgctcctcgaccctaaacccgacccgaccctacgtcgaaacctcaacgaatacgacgcccgccgcccccgacccccatcccgccgccctccgccctccgccctcgaccgcgccgccgccgccacttcctatacgcgacgatcccacaattccgccgacgcgcgcgaaacgaccgaaaaacacgctaaaaaaacacgaaaaaaaaacgcgaaaaaaaacgcgaaaaaacgacgcgaaaaaaaacgcgaaaaaaacacgaaaacgacacgacgaaacacgcgcgcgaaaaaaaatataaaccgaaaacgccgacgaaaccgaacgcgaaacctacgtaaaatccgctaacgaacgaaactaaaacccgaactaaaaaaaaaaacgaaccgaaaccgcgaaaaacgcgaaaatcaaaaaaatcgaaactaaacgaaaaaaaacgacgaaaaaccaaactaaaatcccgcgaa

SEQ ID NO: 20491 - DNA, 1247 bp, Artificial Sequence
  chemically treated genomic DNA (Homo sapiens) CpG-island No: 20491
ttaagggttttggggtggttaggagtgggttttcgtttttacggtttttgttttcggattgattttattttttgattcgttcggtgtaaacgcgtcgtcggttttcgggtcgaatttatagttaatttcgggtttcgtagtttttttcgcgcggagcggtaaaagtgaaattgtttttttggtttgggcgcgcgaggaggaggtttttggggggggtttcgggttcgtcgcgtttcgaaattaggcggcgggcgcgttttgtttacgggggagtcgagcggggttcggagtagagtttaggacggagggatgggacgttttcgcgggaatttattcgttttttttcggttcggttcgggtttttttcgggcgtttcgaattttcgggttttttcgttgggtttagcgttatcgaggttgttgcgggaagcggtcggggtttcgcgttggattaggtcgtcggggaggtcggggttgcggggggcgtataggattcgggtttagattttttttcggtttcgcgtttttttaggtttcgcgtttcgcggagcgcggtcggtttattgcggcgcggggtttcgggcggttcgaggtcggacggttggggtaggggcgattttcggcggcgggagggcgatttcgggcggcggcggggcgtgggggaagaggggggcggttcgatttcgggtgggggtttcggtgtttatttgtagtcgtcgttatttgttcgtcgcgcgggcgttttcggcgtcgttttcgcggtttcgttttggtcgtcgcgtttttcggttttgggttcggttcggttttgcgtcggggttttagcgagtgcggcgttcgtcgttttcggtttttatttcgtcgtttttcgtttttcgttttcggtcgcgtcgtcgtcgttattttttgtgcgcggcgattttatagtttcgtcggcgcgcgcggggcggtcgagggatacgttggggggatacgggggaaggacgcggggggggacgcggggggacggcgcggggggggacgcggaggggatacgggggcgatacggcgggatacgcgcgcggagagaggtgtgggtcgagggcgtcggcggggtcgggcgcggagtttgcgtgggattcgttaacggacggggttggggttcgggttgggggagggggcgggtcgggatcgcggggggcgcggggattaggggggtcggggttgaacggggggaggcggcgaaggattaggttggggtttcgcgag

SEQ ID NO: 20492 - DNA, 1247 bp, Artificial Sequence
  chemically treated genomic DNA (Homo sapiens) CpG-island No: 20492
ctcgcgaaaccccaacctaatccttcgccgcctccccccgttcaaccccgacccccctaatccccgcgccccccgcgatcccgacccgccccctcccccaacccgaaccccaaccccgtccgttaacgaatcccacgcaaactccgcgcccgaccccgccgacgccctcgacccacacctctctccgcgcgcgtatcccgccgtatcgcccccgtatcccctccgcgtccccccccgcgccgtccccccgcgtccccccccgcgtccttcccccgtatccccccaacgtatccctcgaccgccccgcgcgcgccgacgaaactataaaatcgccgcgcacaaaaaataacgacgacgacgcgaccgaaaacgaaaaacgaaaaacgacgaaataaaaaccgaaaacgacgaacgccgcactcgctaaaaccccgacgcaaaaccgaaccgaacccaaaaccgaaaaacgcgacgaccaaaacgaaaccgcgaaaacgacgccgaaaacgcccgcgcgacgaacaaataacgacgactacaaataaacaccgaaacccccacccgaaatcgaaccgcccccctcttcccccacgccccgccgccgcccgaaatcgccctcccgccgccgaaaatcgcccctaccccaaccgtccgacctcgaaccgcccgaaaccccgcgccgcaataaaccgaccgcgctccgcgaaacgcgaaacctaaaaaaacgcgaaaccgaaaaaaaatctaaacccgaatcctatacgccccccgcaaccccgacctccccgacgacctaatccaacgcgaaaccccgaccgcttcccgcaacaacctcgataacgctaaacccaacgaaaaaacccgaaaattcgaaacgcccgaaaaaaacccgaaccgaaccgaaaaaaaacgaataaattcccgcgaaaacgtcccatccctccgtcctaaactctactccgaaccccgctcgactcccccgtaaacaaaacgcgcccgccgcctaatttcgaaacgcgacgaacccgaaaccccccccaaaaacctcctcctcgcgcgcccaaaccaaaaaaacaatttcacttttaccgctccgcgcgaaaaaaactacgaaacccgaaattaactataaattcgacccgaaaaccgacgacgcgtttacaccgaacgaatcaaaaaataaaatcaatccgaaaacaaaaaccgtaaaaacgaaaacccactcctaaccaccccaaaacccttaa

SEQ ID NO: 20493 - DNA, 880 bp, Artificial Sequence
  chemically treated genomic DNA (Homo sapiens) CpG-island No: 20493
ggaaacgggaagagtttagcggtaggcggaaggtacgcgtcggggatatttagcggcgagggtttgcgggagtttttagcgcgataaggagttcggtcggggagtagcggttcgtcgcgggacgttcgagttgcggggaacgcgagggtagcgaggtcggcgtttttggttcgggagcgtttaggttcgtttatcgcgcgcgaggttcgtttgtcgagttttggttttagtttcggcgtagggtttagcggggcgtttattgtcgagggaggaagatggacgtgtttcgggagtttcgtttcgttttttattttttatttttcggtttcgcgcggtcggttcgggcgtattttcgtcggaggcgaagcgcggcgaagattcgtttcgtgaagtttcgcgcgtttcggaaatggttatgcggcggcgtcgaggtcggaagtggttgaggtcggtagtagcgggcggtagttgcggcgtaatcggtttcggagttgtttggcgcggtcgggcgggcggcgtcgtttaggttcgggtttcggttgggttcggcgcggtttcggggttgtttatggggcgcggggggtcgggtcggtgacgtcggacgtttatggacgtttttgaggagtcgttgtcgtcggtgatttatattatggagaataagtttatcgttatttgtgagtgttcggaggcggggagggcgcggcggtcgttgggcgggttcgggttttggcgttatgtattcggcgtttttagatttttagttttcggcgcgtttcgggttgggtcgttttttggaggtgtgattagggttgcggttgaggcggggttttttgatttttcggggacgttttttgattttttcgtcgggcgatttttgatt

SEQ ID NO: 20494 - DNA, 880 bp, Artificial Sequence
  chemically treated genomic DNA (Homo sapiens) CpG-island No: 20494
aatcaaaaatcgcccgacgaaaaaatcaaaaaacgtccccgaaaaatcaaaaaaccccgcctcaaccgcaaccctaatcacacctccaaaaaacgacccaacccgaaacgcgccgaaaactaaaaatctaaaaacgccgaatacataacgccaaaacccgaacccgcccaacgaccgccgcgccctccccgcctccgaacactcacaaataacgataaacttattctccataatataaatcaccgacgacaacgactcctcaaaaacgtccataaacgtccgacgtcaccgacccgaccccccgcgccccataaacaaccccgaaaccgcgccgaacccaaccgaaacccgaacctaaacgacgccgcccgcccgaccgcgccaaacaactccgaaaccgattacgccgcaactaccgcccgctactaccgacctcaaccacttccgacctcgacgccgccgcataaccatttccgaaacgcgcgaaacttcacgaaacgaatcttcgccgcgcttcgcctccgacgaaaatacgcccgaaccgaccgcgcgaaaccgaaaaataaaaaataaaaaacgaaacgaaactcccgaaacacgtccatcttcctccctcgacaataaacgccccgctaaaccctacgccgaaactaaaaccaaaactcgacaaacgaacctcgcgcgcgataaacgaacctaaacgctcccgaaccaaaaacgccgacctcgctaccctcgcgttccccgcaactcgaacgtcccgcgacgaaccgctactccccgaccgaactccttatcgcgctaaaaactcccgcaaaccctcgccgctaaatatccccgacgcgtaccttccgcctaccgctaaactcttcccgtttcc

SEQ ID NO: 20495 - DNA, 880 bp, Artificial Sequence
  chemically treated genomic DNA (Homo sapiens) CpG-island No: 20495
ggttagaggtcgttcggcgggaaggttagagggcgttttcgaaaagttagagggtttcgttttagtcgtagttttggttatatttttaggaagcggtttagttcggagcgcgtcgggggttgaaggtttgggggcgtcgggtgtataacgttagggttcgggttcgtttaacgatcgtcgcgtttttttcgttttcgggtatttataggtgacgatgggtttgttttttatggtgtagattatcggcggtagcggttttttagaggcgtttatgggcgttcggcgttatcggttcggtttttcgcgttttatgggtagtttcgaggtcgcgtcgggtttagtcggagttcgagtttgagcggcgtcgttcgttcggtcgcgttaggtagtttcggagtcggttgcgtcgtagttgtcgttcgttgttgtcggttttagttattttcggtttcggcgtcgtcgtatgattattttcggggcgcgcgaggttttacggggcgggttttcgtcgcgtttcgttttcgacggaagtgcgttcgggtcggtcgcgcgggatcgggaggtgggaagtgggaggcggagcggggttttcgggatacgtttatttttttttttcggtagtgggcgtttcgttgggttttgcgtcggagttgaggttaggattcggtaggcgggtttcgcgcgcggtgagcgagtttggacgttttcggattagagacgtcggtttcgttgttttcgcgtttttcgtagttcgggcgtttcgcggcgggtcgttgtttttcggtcgggttttttatcgcgttgggggttttcgtaggttttcgtcgttgagtgttttcggcgcgtgtttttcgtttatcgttgggtttttttcgttttt

SEQ ID NO: 20496 - DNA, 880 bp, Artificial Sequence
  chemically treated genomic DNA (Homo sapiens) CpG-island No: 20496
aaaaacgaaaaaaacccaacgataaacgaaaaacacgcgccgaaaacactcaacgacgaaaacctacgaaaacccccaacgcgataaaaaacccgaccgaaaaacaacgacccgccgcgaaacgcccgaactacgaaaaacgcgaaaacaacgaaaccgacgtctctaatccgaaaacgtccaaactcgctcaccgcgcgcgaaacccgcctaccgaatcctaacctcaactccgacgcaaaacccaacgaaacgcccactaccgaaaaaaaaaaataaacgtatcccgaaaaccccgctccgcctcccacttcccacctcccgatcccgcgcgaccgacccgaacgcacttccgtcgaaaacgaaacgcgacgaaaacccgccccgtaaaacctcgcgcgccccgaaaataatcatacgacgacgccgaaaccgaaaataactaaaaccgacaacaacgaacgacaactacgacgcaaccgactccgaaactacctaacgcgaccgaacgaacgacgccgctcaaactcgaactccgactaaacccgacgcgacctcgaaactacccataaaacgcgaaaaaccgaaccgataacgccgaacgcccataaacgcctctaaaaaaccgctaccgccgataatctacaccataaaaaacaaacccatcgtcacctataaatacccgaaaacgaaaaaaacgcgacgatcgttaaacgaacccgaaccctaacgttatacacccgacgcccccaaaccttcaacccccgacgcgctccgaactaaaccgcttcctaaaaatataaccaaaactacgactaaaacgaaaccctctaacttttcgaaaacgccctctaaccttcccgccgaacgacctctaacc

SEQ ID NO: 20497 - DNA, 889 bp, Artificial Sequence
  chemically treated genomic DNA (Homo sapiens) CpG-island No: 20497
agcgttcgcggttttttttttttggtagggatttcgttttcgagttcgttttcgtacggttgtgcgttttgttatgggtttcggtgttaggtttcgtcgtttattgtcgtttacgtttcgtcggtcgtttcggcgttttcgtcgttcgtttttcggattcgtattgttagttcggtatttttaggcgagtttcgtaggtttcgcgttcgagtcgagttggggacgcgcgggtcgagttatttcgtttttgatcgcggcgttttcgtttttttttcggtttatttgtttagtcgtatggtgcgggcggagatttcgggtcgcggagatttcggggcgcggagatttcggggcgcggagaatttgggtcgcgggagatttcggagaggagtaatttcggggcgcgggagatcggttttaattgcgttttcgtagcgttcgaggttttgagcgtttagcgcgcggtgtgttggaggtagtcgtgttttcgtttcgttttcgtttcgttttcggtttggtttttttggcgatcgagatcgtttcgggataggaggcggggcgttgcgcggcggtttcggaaagttcggttttgtttaggcgtgtgttcgtcggtcggaggcgggatagaggtaggtcggtttgttcgtttggacgcggatttgggcgtcgtaggtgttttgggaagcgtaggggtggggggtattcggtaggaaggtggttaggggtgttgcgggtgtcggcgtagcgagggagggtatcgtgggaggtaagggtcgtttttcgcgtcgcgtataatgcgtcggttttgcggtttttttcgagtaggagttcggggatttaggttttaaggttgggagagcgttaggtttttggtcggttgcgtttcgatgat

SEQ ID NO: 20498 - DNA, 889 bp, Artificial Sequence
  chemically treated genomic DNA (Homo sapiens) CpG-island No: 20498
atcatcgaaacgcaaccgaccaaaaacctaacgctctcccaaccttaaaacctaaatccccgaactcctactcgaaaaaaaccgcaaaaccgacgcattatacgcgacgcgaaaaacgacccttacctcccacgataccctccctcgctacgccgacacccgcaacacccctaaccaccttcctaccgaataccccccacccctacgcttcccaaaacacctacgacgcccaaatccgcgtccaaacgaacaaaccgacctacctctatcccgcctccgaccgacgaacacacgcctaaacaaaaccgaactttccgaaaccgccgcgcaacgccccgcctcctatcccgaaacgatctcgatcgccaaaaaaaccaaaccgaaaacgaaacgaaaacgaaacgaaaacacgactacctccaacacaccgcgcgctaaacgctcaaaacctcgaacgctacgaaaacgcaattaaaaccgatctcccgcgccccgaaattactcctctccgaaatctcccgcgacccaaattctccgcgccccgaaatctccgcgccccgaaatctccgcgacccgaaatctccgcccgcaccatacgactaaacaaataaaccgaaaaaaaaacgaaaacgccgcgatcaaaaacgaaataactcgacccgcgcgtccccaactcgactcgaacgcgaaacctacgaaactcgcctaaaaataccgaactaacaatacgaatccgaaaaacgaacgacgaaaacgccgaaacgaccgacgaaacgtaaacgacaataaacgacgaaacctaacaccgaaacccataacaaaacgcacaaccgtacgaaaacgaactcgaaaacgaaatccctaccaaaaaaaaaaaaccgcgaacgct

SEQ ID NO: 20499 - DNA, 889 bp, Artificial Sequence
  chemically treated genomic DNA (Homo sapiens) CpG-island No: 20499
attatcggagcgtagtcggttaggggtttggcgtttttttagttttggggtttgggttttcggatttttgttcggggagggtcgtaggatcggcgtattgtgcgcggcgcggggaacggtttttgttttttacggtgttttttttcgttgcgtcggtattcgtagtatttttggttatttttttgtcgggtattttttatttttgcgttttttagggtatttacggcgtttaggttcgcgtttaggcggataggtcgatttgtttttgtttcgttttcggtcgacgggtatacgtttgggtagagtcgaatttttcggagtcgtcgcgtagcgtttcgttttttgtttcggggcggtttcggtcgttagaggagttaggtcgggggcggggcggggacggggcggggatacggttgtttttagtatatcgcgcgttgggcgtttagagtttcgggcgttgcgggagcgtagttagagtcgatttttcgcgtttcgaggttgttttttttcgaggtttttcgcggtttaagtttttcgcgtttcgaggttttcgcgtttcgaggttttcgcggttcgaggttttcgttcgtattatgcggttgggtaggtgagtcggggaaggagcggaggcgtcgcggttaggggcggggtggttcggttcgcgcgtttttagttcggttcggacgcggggtttgcggggttcgtttggaggtgtcgggttggtagtgcgggttcgaggagcgggcggcggaggcgtcggggcggtcggcggggcgtggacggtagtgggcggcggggtttggtatcgggatttatggtaggacgtatagtcgtgcgggggcgggttcgggggcggggtttttgttagggaaggaggatcgcgaacgtt

SEQ ID NO: 20500 - DNA, 889 bp, Artificial Sequence
  chemically treated genomic DNA (Homo sapiens) CpG-island No: 20500
aacgttcgcgatcctccttccctaacaaaaaccccgcccccgaacccgcccccgcacgactatacgtcctaccataaatcccgataccaaaccccgccgcccactaccgtccacgccccgccgaccgccccgacgcctccgccgcccgctcctcgaacccgcactaccaacccgacacctccaaacgaaccccgcaaaccccgcgtccgaaccgaactaaaaacgcgcgaaccgaaccaccccgcccctaaccgcgacgcctccgctccttccccgactcacctacccaaccgcataatacgaacgaaaacctcgaaccgcgaaaacctcgaaacgcgaaaacctcgaaacgcgaaaaacttaaaccgcgaaaaacctcgaaaaaaaacaacctcgaaacgcgaaaaatcgactctaactacgctcccgcaacgcccgaaactctaaacgcccaacgcgcgatatactaaaaacaaccgtatccccgccccgtccccgccccgcccccgacctaactcctctaacgaccgaaaccgccccgaaacaaaaaacgaaacgctacgcgacgactccgaaaaattcgactctacccaaacgtatacccgtcgaccgaaaacgaaacaaaaacaaatcgacctatccgcctaaacgcgaacctaaacgccgtaaataccctaaaaaacgcaaaaataaaaaatacccgacaaaaaaataaccaaaaatactacgaataccgacgcaacgaaaaaaaacaccgtaaaaaacaaaaaccgttccccgcgccgcgcacaatacgccgatcctacgaccctccccgaacaaaaatccgaaaacccaaaccccaaaactaaaaaaacgccaaacccctaaccgactacgctccgataat

SEQ ID NO: 20501 - DNA, 534 bp, Artificial Sequence
  chemically treated genomic DNA (Homo sapiens) CpG-island No: 20501
gggggataggggggacggcggcggggaagggtagggagggcggcggcgaaggcgtaggaagttttgaagtcgggcggttttttttttttaggttacgttgagagacgggggttggggggatttaaaatcgcgcgtttggtaggggcggggcgggggttatttgtttttcggcgggaagagttgggtagggttcgcggagtgtagggcggaggtattggcggttcgtattcgggtgaggtgaggcgcgtaatcgtatttgagtcggattttttaggacgagtttcgtttttggagttagaaaattcggtttagcgttagcgtggacgtgcgtttttcgggatacgtttagggacgtcggttaggatcggcgaggttggaggggtggcgatgttgggggttgaggtttttcgtttcggggcgggcggttgttggtaagggatcgtatggtttcgtaggtgaggagggcgtaggtgaggagggcgtaggtgagtcgggcgggttgcgggtagcgttattttttttcggaggtttttt

SEQ ID NO: 20502 - DNA, 534 bp, Artificial Sequence
  chemically treated genomic DNA (Homo sapiens) CpG-island No: 20502
aaaaaacctccgaaaaaaaataacgctacccgcaacccgcccgactcacctacgccctcctcacctacgccctcctcacctacgaaaccatacgatcccttaccaacaaccgcccgccccgaaacgaaaaacctcaacccccaacatcgccacccctccaacctcgccgatcctaaccgacgtccctaaacgtatcccgaaaaacgcacgtccacgctaacgctaaaccgaattttctaactccaaaaacgaaactcgtcctaaaaaatccgactcaaatacgattacgcgcctcacctcacccgaatacgaaccgccaatacctccgccctacactccgcgaaccctacccaactcttcccgccgaaaaacaaataacccccgccccgcccctaccaaacgcgcgattttaaatccccccaacccccgtctctcaacgtaacctaaaaaaaaaaaaccgcccgacttcaaaacttcctacgccttcgccgccgccctccctacccttccccgccgccgtcccccctatccccc

SEQ ID NO: 20503 - DNA, 534 bp, Artificial Sequence
  chemically treated genomic DNA (Homo sapiens) CpG-island No: 20503
ggagggttttcgggaggaggtggcgttgttcgtagttcgttcggtttatttgcgttttttttatttgcgttttttttatttgcggggttatgcggttttttattagtagtcgttcgtttcggggcgaggaattttagtttttaatatcgttatttttttagtttcgtcggttttagtcggcgtttttgggcgtgtttcgggaagcgtacgtttacgttggcgttggatcgggttttttgattttagggacgggattcgttttaaagagttcggtttagatgcggttacgcgttttattttattcgggtgcggatcgttagtgttttcgttttgtatttcgcgggttttgtttagtttttttcgtcggagggtaggtggttttcgtttcgtttttgttaggcgcgcgattttaaatttttttaattttcgttttttagcgtggtttgggagggggaagtcgttcggttttagggttttttgcgttttcgtcgtcgttttttttgttttttttcgtcgtcgttttttttatttttt

SEQ ID NO: 20504 - DNA, 534 bp, Artificial Sequence
  chemically treated genomic DNA (Homo sapiens) CpG-island No: 20504
aaaaaataaaaaaaacgacgacgaaaaaaaacaaaaaaaacgacgacgaaaacgcaaaaaaccctaaaaccgaacgacttccccctcccaaaccacgctaaaaaacgaaaattaaaaaaatttaaaatcgcgcgcctaacaaaaacgaaacgaaaaccacctaccctccgacgaaaaaaactaaacaaaacccgcgaaatacaaaacgaaaacactaacgatccgcacccgaataaaataaaacgcgtaaccgcatctaaaccgaactctttaaaacgaatcccgtccctaaaatcaaaaaacccgatccaacgccaacgtaaacgtacgcttcccgaaacacgcccaaaaacgccgactaaaaccgacgaaactaaaaaaataacgatattaaaaactaaaattcctcgccccgaaacgaacgactactaataaaaaaccgcataaccccgcaaataaaaaaaacgcaaataaaaaaaacgcaaataaaccgaacgaactacgaacaacgccacctcctcccgaaaaccctcc

SEQ ID NO: 20505 - DNA, 833 bp, Artificial Sequence
  chemically treated genomic DNA (Homo sapiens) CpG-island No: 20505
cgtatagcgggaaggtggtttcggcgggtcgagggcgtaggatttttgtttcgtttagggttcgttttgcgaggaggcgtcgggggcgggttcggggcggggcgggcggaaggcgcgcgcggggcggggcggggacggcgacgcggcgtaggcggcgggagtgcgagttgggttcgtgtttcggtcgtcgttatggtcgcggtggatttggagaagttgcgggcgtcgggcgcgggtaaggttatcggcgttttgattagcggcggcgacgcgtaaggtgggcgggggtttcggtcgcgtcgcggcgtagggggtggagggcgttttcgttttggttttttcggagcgttcgtcgagtttcgggattcgggtttcgggtcggttcggtttttcgtttcggtttttcgtttcggttttttgtttcgggtttgtttttcgttttttttcggcgcggttttcggtttacgtgcggtcggttacgttttcggttttcgtttgggttttggcgtcgttcgcgttttgtttcgggggtgtgttcgattttgggtcgcggggtaggatttttcgaggagttttcgaggttacgcgagcggagggcgtcggtttcgttatttttagagtttggttttttttggttttgaagcgattcggggattcggtgtttttcgagggtcggcgttaggttgcgggttttcgggattttttttcggttgggcgggggcggatttattttcggatcgcgtttttttttcggggttttcgcggtcgttttttttgtgggtttagttggggaagagggcggtggggagatgggttgttcggggtattgagta

SEQ ID NO: 20506 - DNA, 833 bp, Artificial Sequence
  chemically treated genomic DNA (Homo sapiens) CpG-island No: 20506
tactcaataccccgaacaacccatctccccaccgccctcttccccaactaaacccacaaaaaaaacgaccgcgaaaaccccgaaaaaaaaacgcgatccgaaaataaatccgcccccgcccaaccgaaaaaaaatcccgaaaacccgcaacctaacgccgaccctcgaaaaacaccgaatccccgaatcgcttcaaaaccaaaaaaaaccaaactctaaaaataacgaaaccgacgccctccgctcgcgtaacctcgaaaactcctcgaaaaatcctaccccgcgacccaaaatcgaacacacccccgaaacaaaacgcgaacgacgccaaaacccaaacgaaaaccgaaaacgtaaccgaccgcacgtaaaccgaaaaccgcgccgaaaaaaaacgaaaaacaaacccgaaacaaaaaaccgaaacgaaaaaccgaaacgaaaaaccgaaccgacccgaaacccgaatcccgaaactcgacgaacgctccgaaaaaaccaaaacgaaaacgccctccaccccctacgccgcgacgcgaccgaaacccccgcccaccttacgcgtcgccgccgctaatcaaaacgccgataaccttacccgcgcccgacgcccgcaacttctccaaatccaccgcgaccataacgacgaccgaaacacgaacccaactcgcactcccgccgcctacgccgcgtcgccgtccccgccccgccccgcgcgcgccttccgcccgccccgccccgaacccgcccccgacgcctcctcgcaaaacgaaccctaaacgaaacaaaaatcctacgccctcgacccgccgaaaccaccttcccgctatacg

SEQ ID NO: 20507 - DNA, 833 bp, Artificial Sequence
  chemically treated genomic DNA (Homo sapiens) CpG-island No: 20507
tgtttaatgtttcgggtagtttatttttttatcgtttttttttttagttagatttataaggaaggcggtcgcgagggtttcgaggaggaggcgcggttcgggagtgagttcgttttcgtttagtcgggaggaggtttcggaagttcgtagtttggcgtcggttttcgggaggtatcgggttttcgggtcgttttagaattaggaagggttaggttttgggggtggcgggatcggcgtttttcgttcgcgtggtttcggggatttttcgggaggttttgtttcgcggtttagagtcggatatattttcggggtagggcgcgggcggcgttaagatttaggcggaggtcgagaacgtggtcggtcgtacgtaggtcggagatcgcgtcggggaagagcgggggatagattcggggtaggaggtcggggcgggaggtcggggcgggaggtcgggtcggttcgagattcgggtttcggggttcggcgggcgtttcggagaggttagggcggaggcgttttttattttttgcgtcgcgacgcggtcgggattttcgtttattttgcgcgtcgtcgtcgttggttaggacgtcgatggttttgttcgcgttcgacgttcgtagtttttttaggtttatcgcggttatggcggcggtcgaaatacgggtttagttcgtattttcgtcgtttgcgtcgcgtcgtcgttttcgtttcgtttcgcgcgcgtttttcgttcgtttcgtttcgggttcgttttcggcgttttttcgtaggacggattttggacggagtagggattttgcgttttcggttcgtcggggttattttttcgttgtgcg

SEQ ID NO: 20508 - DNA, 833 bp, Artificial Sequence
  chemically treated genomic DNA (Homo sapiens) CpG-island No: 20508
cgcacaacgaaaaaataaccccgacgaaccgaaaacgcaaaatccctactccgtccaaaatccgtcctacgaaaaaacgccgaaaacgaacccgaaacgaaacgaacgaaaaacgcgcgcgaaacgaaacgaaaacgacgacgcgacgcaaacgacgaaaatacgaactaaacccgtatttcgaccgccgccataaccgcgataaacctaaaaaaactacgaacgtcgaacgcgaacaaaaccatcgacgtcctaaccaacgacgacgacgcgcaaaataaacgaaaatcccgaccgcgtcgcgacgcaaaaaataaaaaacgcctccgccctaacctctccgaaacgcccgccgaaccccgaaacccgaatctcgaaccgacccgacctcccgccccgacctcccgccccgacctcctaccccgaatctatcccccgctcttccccgacgcgatctccgacctacgtacgaccgaccacgttctcgacctccgcctaaatcttaacgccgcccgcgccctaccccgaaaatatatccgactctaaaccgcgaaacaaaacctcccgaaaaatccccgaaaccacgcgaacgaaaaacgccgatcccgccacccccaaaacctaacccttcctaattctaaaacgacccgaaaacccgatacctcccgaaaaccgacgccaaactacgaacttccgaaacctcctcccgactaaacgaaaacgaactcactcccgaaccgcgcctcctcctcgaaaccctcgcgaccgccttccttataaatctaactaaaaaaaaaaacgataaaaaaataaactacccgaaacattaaaca

SEQ ID NO: 20509 - DNA, 948 bp, Artificial Sequence
  chemically treated genomic DNA (Homo sapiens) CpG-island No: 20509
tcgtcgttttcgtttttgtttttttttttttttatttcgttttcgtttcgtttcgtttcggttttttttttcggtttcgttttcgtttcgtttcggttttttttttcggtttcgttttcgtttcgtttcggttttttttttcggtttcgttttcgtttcgtttcggttttttttttcggtttcgtttttttttcgtttcggtttcgtttttttttcgtttcggtttcgtttttttttcgtttcggttttttttttcggtttcgttttcgtttcgtttcggttttttttttcggtttcgtttttttttcgtttcggttttttttttcggtttcgttttcgtttcgtttcggtttttttttttatttcggggcggtcgcggttaggtttcgttttattagtagttgagtttgcgtacgttgtgtagtttcgaggttttggttcgggttagaattatttttcgcgttagttttatggcggtcgtttaggttcgatcggcgggcgttttcggttttttgatttcgggcgggtgacgattgcgcggcgcgtgtttttaggggcggggttcgcgtcgttaggggcggattttgagtcgattggcggttcggtgaggagagcggggcgacgcgagttcgttggggtcgtttgggcgtcgttgatacgttggttttgtttttgtttatgcgcggtttggggcgtttttttttgacgcgattttaacgcgatttcggaagcgcgtagcgagtagagggtgggtgtaggtggcggttttcgagtcggtttagtgagggttgaattgttgtttttaggaatcgagcggggtgggttcggttcgacgcgtattatggtcgagtgtttaggtttgattttgagcgtaggtttagcgtggatggtatgggcgttatatagttttaagttacgcgatttaaatttttggaataaatttagggt

SEQ ID NO: 20510 - DNA, 948 bp, Artificial Sequence
  chemically treated genomic DNA (Homo sapiens) CpG-island No: 20510
accctaaatttattccaaaaatttaaatcgcgtaacttaaaactatataacgcccataccatccacgctaaacctacgctcaaaatcaaacctaaacactcgaccataatacgcgtcgaaccgaacccaccccgctcgattcctaaaaacaacaattcaaccctcactaaaccgactcgaaaaccgccacctacacccaccctctactcgctacgcgcttccgaaatcgcgttaaaatcgcgtcaaaaaaaaacgccccaaaccgcgcataaacaaaaacaaaaccaacgtatcaacgacgcccaaacgaccccaacgaactcgcgtcgccccgctctcctcaccgaaccgccaatcgactcaaaatccgcccctaacgacgcgaaccccgcccctaaaaacacgcgccgcgcaatcgtcacccgcccgaaatcaaaaaaccgaaaacgcccgccgatcgaacctaaacgaccgccataaaactaacgcgaaaaataattctaacccgaaccaaaacctcgaaactacacaacgtacgcaaactcaactactaataaaacgaaacctaaccgcgaccgccccgaaataaaaaaaaaaaccgaaacgaaacgaaaacgaaaccgaaaaaaaaaaccgaaacgaaaaaaaaacgaaaccgaaaaaaaaaaccgaaacgaaacgaaaacgaaaccgaaaaaaaaaaccgaaacgaaaaaaaaacgaaaccgaaacgaaaaaaaaacgaaaccgaaacgaaaaaaaaacgaaaccgaaaaaaaaaaccgaaacgaaacgaaaacgaaaccgaaaaaaaaaaccgaaacgaaacgaaaacgaaaccgaaaaaaaaaaccgaaacgaaacgaaaacgaaaccgaaaaaaaaaaccgaaacgaaacgaaacgaaaacgaaataaaaaaaaaaaaaaacaaaaacgaaaacgacga

SEQ ID NO: 20511 - DNA, 948 bp, Artificial Sequence
  chemically treated genomic DNA (Homo sapiens) CpG-island No: 20511
gttttgggtttattttaagagtttgaatcgcgtaatttggagttgtgtagcgtttatgttatttacgttaggtttgcgtttagagttaggtttaggtattcggttatgatgcgcgtcggatcgagtttatttcgttcggtttttgggagtagtagtttagtttttattgggtcgattcggggatcgttatttgtatttattttttgttcgttgcgcgttttcggggtcgcgttagaatcgcgttagagaagggcgttttaggtcgcgtatgagtaggagtagagttaacgtgttagcggcgtttaagcggttttagcgggttcgcgtcgtttcgttttttttatcgagtcgttaatcggtttaggattcgtttttgacgacgcgggtttcgtttttggagatacgcgtcgcgtagtcgttattcgttcgggattaggaggtcgggggcgttcgtcggtcgggtttgggcggtcgttatgaagttgacgcggaagatggttttgattcgggttaaggtttcggagttgtatagcgtgcgtaagtttaattgttggtgaggcggggtttggtcgcggtcgtttcggggtggggggaggagtcggggcggggcgagggcggagtcggagggaggagtcggggcggggagagggcggagtcggagggaggagtcggggcgggacgagggcggagtcggagggaggagtcggggcggggagagggcggagtcggggcggggagagggcggagtcggggcggggagagggcggagtcggagggaggagtcggggcgggacgagggcggagtcggagggaggagtcggggcgggacgagggcggagtcggagggaggagtcggggcgggacgagggcggagtcggagggaggagtcggggcggggcggggcgggggcggagtggaaggggggaggggtaggggcgagggcggcga

SEQ ID NO: 20512 - DNA, 948 bp, Artificial Sequence
  chemically treated genomic DNA (Homo sapiens) CpG-island No: 20512
tcgccgccctcgcccctacccctccccccttccactccgcccccgccccgccccgccccgactcctccctccgactccgccctcgtcccgccccgactcctccctccgactccgccctcgtcccgccccgactcctccctccgactccgccctcgtcccgccccgactcctccctccgactccgccctctccccgccccgactccgccctctccccgccccgactccgccctctccccgccccgactcctccctccgactccgccctcgtcccgccccgactcctccctccgactccgccctctccccgccccgactcctccctccgactccgccctcgccccgccccgactcctccccccaccccgaaacgaccgcgaccaaaccccgcctcaccaacaattaaacttacgcacgctatacaactccgaaaccttaacccgaatcaaaaccatcttccgcgtcaacttcataacgaccgcccaaacccgaccgacgaacgcccccgacctcctaatcccgaacgaataacgactacgcgacgcgtatctccaaaaacgaaacccgcgtcgtcaaaaacgaatcctaaaccgattaacgactcgataaaaaaaacgaaacgacgcgaacccgctaaaaccgcttaaacgccgctaacacgttaactctactcctactcatacgcgacctaaaacgcccttctctaacgcgattctaacgcgaccccgaaaacgcgcaacgaacaaaaaataaatacaaataacgatccccgaatcgacccaataaaaactaaactactactcccaaaaaccgaacgaaataaactcgatccgacgcgcatcataaccgaatacctaaacctaactctaaacgcaaacctaacgtaaataacataaacgctacacaactccaaattacgcgattcaaactcttaaaataaacccaaaac

SEQ ID NO: 20513 - DNA, 1132 bp, Artificial Sequence
  chemically treated genomic DNA (Homo sapiens) CpG-island No: 20513
tcgtcggtttaaaaggagatacgtgtttttaatttttcgaaggtatatattcgcgcgagggttcggttttaggtttttgggggagggcgggttcgtaggcggggtgtttgggtttagttttttttggcgtgtttttggttttagttgcgggcgcgggacgcggcgcgggagacgtttttcgggttgagtgacgtagagcgttgcgggcggttttattgtatcgggtacgcggcgtacgttcgggcgagatgtggatggtttcgcggggttagggcggcggtgttgcgcggggacgcgggtgacgtcggggcgcgggcggtttcgagtaggtaggtgttcgtcggggtcggggcgagggcgcgagttcgggtgcggggattgaggcggtcgtttcgggagtttgtgaaggttgaggcggggtgtaagggcgcggatcggggtgtcgagtgcgtgtaggggtgcggggtgcggggatcgaggcggtcggtttcggtgttgttgtagggcgcggcggaatgtaggggcgcggtggggtgtaggggcgtaggcggggttcggggcgttggtgtagggcgcggtggggtgtaagggcgtaggcggggttcggggcgttggtgtagggtacggcggggtgtaggggcgcgggtggggttcgaggcgttggtgtagggcgcggtggggtgtaggggcgcgaaggggtttcgggtattggtgtagggtgcggtggggtgtaggggcgggcggggttcggggcgttggtgtaggggtatcggtggggttcggggcgcggattggagtatttagtgtgcgtagaggcgcggggcgttgattgggagtcgggtgcggtttgtttgcgggacgttttgtcgttggagcgattttgttcggttggcgcgaggggattcggggatgagggatttagtcgttttcgtgtttttgttcgttcgtcgggatagtaggtttcgtttttggggcgtttatttttttcgttttcgtattcgtttttgtttgtttagttttcgaagcgttggtttttacgcggggattttagaagatgttcgagtaatttttagagagggtagggaggttatacggtgtatcgagggagtgtagggcgcgtttgttttagttt

SEQ ID NO: 20514 - DNA, 1132 bp, Artificial Sequence
  chemically treated genomic DNA (Homo sapiens) CpG-island No: 20514
aaactaaaacaaacgcgccctacactccctcgatacaccgtataacctccctaccctctctaaaaattactcgaacatcttctaaaatccccgcgtaaaaaccaacgcttcgaaaactaaacaaacaaaaacgaatacgaaaacgaaaaaaataaacgccccaaaaacgaaacctactatcccgacgaacgaacaaaaacacgaaaacgactaaatccctcatccccgaatcccctcgcgccaaccgaacaaaatcgctccaacgacaaaacgtcccgcaaacaaaccgcacccgactcccaatcaacgccccgcgcctctacgcacactaaatactccaatccgcgccccgaaccccaccgatacccctacaccaacgccccgaaccccgcccgcccctacaccccaccgcaccctacaccaatacccgaaaccccttcgcgcccctacaccccaccgcgccctacaccaacgcctcgaaccccacccgcgcccctacaccccgccgtaccctacaccaacgccccgaaccccgcctacgcccttacaccccaccgcgccctacaccaacgccccgaaccccgcctacgcccctacaccccaccgcgcccctacattccgccgcgccctacaacaacaccgaaaccgaccgcctcgatccccgcaccccgcacccctacacgcactcgacaccccgatccgcgcccttacaccccgcctcaaccttcacaaactcccgaaacgaccgcctcaatccccgcacccgaactcgcgccctcgccccgaccccgacgaacacctacctactcgaaaccgcccgcgccccgacgtcacccgcgtccccgcgcaacaccgccgccctaaccccgcgaaaccatccacatctcgcccgaacgtacgccgcgtacccgatacaataaaaccgcccgcaacgctctacgtcactcaacccgaaaaacgtctcccgcgccgcgtcccgcgcccgcaactaaaaccaaaaacacgccaaaaaaaactaaacccaaacaccccgcctacgaacccgccctcccccaaaaacctaaaaccgaaccctcgcgcgaatatataccttcgaaaaattaaaaacacgtatctccttttaaaccgacga

SEQ ID NO: 20515 - DNA, 1132 bp, Artificial Sequence
  chemically treated genomic DNA (Homo sapiens) CpG-island No: 20515
ggattgggataggcgcgttttgtattttttcggtatatcgtgtggtttttttgttttttttggaggttgttcgggtattttttgaaattttcgcgtgaaagttagcgtttcggagattgggtaggtagaggcgggtgcggggacggaggaagtaagcgttttagaagcggggtttgttgtttcggcggacgggtaggggtacgaggacggttgagttttttattttcgggttttttcgcgttagtcggatagggtcgttttagcggtaaggcgtttcgtagatagatcgtattcggtttttagttagcgtttcgcgtttttgcgtatattgggtgttttagttcgcgtttcgaattttatcggtgtttttgtattagcgtttcgaatttcgttcgtttttgtattttatcgtattttgtattagtgttcggagttttttcgcgtttttgtattttatcgcgttttgtattagcgtttcgagttttattcgcgtttttgtatttcgtcgtgttttgtattagcgtttcgaatttcgtttgcgtttttgtattttatcgcgttttgtattagcgtttcgaatttcgtttgcgtttttgtattttatcgcgtttttgtatttcgtcgcgttttgtagtagtatcggggtcggtcgtttcggttttcgtatttcgtatttttgtacgtattcggtatttcgattcgcgtttttgtatttcgttttaatttttataagttttcgggacggtcgttttagttttcgtattcgggttcgcgttttcgtttcggtttcggcgggtatttatttgttcggagtcgttcgcgtttcggcgttattcgcgttttcgcgtagtatcgtcgttttggtttcgcggggttatttatatttcgttcgagcgtgcgtcgcgtgttcggtgtagtggagtcgttcgtagcgttttgcgttatttagttcggagagcgtttttcgcgtcgcgtttcgcgttcgtagttagagttaaggatacgttagggaaggttgggtttagatatttcgtttgcgagttcgtttttttttagagatttggaatcggattttcgcgcggatgtgtgttttcggagggttgggggtacgtgtttttttttaaatcggcga

SEQ ID NO: 20516 - DNA, 1132 bp, Artificial Sequence
  chemically treated genomic DNA (Homo sapiens) CpG-island No: 20516
tcgccgatttaaaaaaaaacacgtacccccaaccctccgaaaacacacatccgcgcgaaaatccgattccaaatctctaaaaaaaaacgaactcgcaaacgaaatatctaaacccaaccttccctaacgtatccttaactctaactacgaacgcgaaacgcgacgcgaaaaacgctctccgaactaaataacgcaaaacgctacgaacgactccactacaccgaacacgcgacgcacgctcgaacgaaatataaataaccccgcgaaaccaaaacgacgatactacgcgaaaacgcgaataacgccgaaacgcgaacgactccgaacaaataaatacccgccgaaaccgaaacgaaaacgcgaacccgaatacgaaaactaaaacgaccgtcccgaaaacttataaaaattaaaacgaaatacaaaaacgcgaatcgaaataccgaatacgtacaaaaatacgaaatacgaaaaccgaaacgaccgaccccgatactactacaaaacgcgacgaaatacaaaaacgcgataaaatacaaaaacgcaaacgaaattcgaaacgctaatacaaaacgcgataaaatacaaaaacgcaaacgaaattcgaaacgctaatacaaaacacgacgaaatacaaaaacgcgaataaaactcgaaacgctaatacaaaacgcgataaaatacaaaaacgcgaaaaaactccgaacactaatacaaaatacgataaaatacaaaaacgaacgaaattcgaaacgctaatacaaaaacaccgataaaattcgaaacgcgaactaaaacacccaatatacgcaaaaacgcgaaacgctaactaaaaaccgaatacgatctatctacgaaacgccttaccgctaaaacgaccctatccgactaacgcgaaaaaacccgaaaataaaaaactcaaccgtcctcgtacccctacccgtccgccgaaacaacaaaccccgcttctaaaacgcttacttcctccgtccccgcacccgcctctacctacccaatctccgaaacgctaactttcacgcgaaaatttcaaaaaatacccgaacaacctccaaaaaaaacaaaaaaaccacacgatataccgaaaaaatacaaaacgcgcctatcccaatcc

SEQ ID NO: 20517 - DNA, 604 bp, Artificial Sequence
  chemically treated genomic DNA (Homo sapiens) CpG-island No: 20517
tcgggcgttgtggggagtaggcggagtgtgcgggggtcggggtgtgggtgacgtttgatcgggtgttgcggggagtaggtggagtgtgcgggggtcggggtgtgggtgagttttgatcgggtgttgcggggagtaggtggagtgtgcgggggaggcggggtgtgggtgacgtttgatcgggtgttgcggggagtaggtggagtgtgcgggggaggcggggtgtgggtgacgtttgatcgggtgttgcggcgagtaggtggagtgtgcgggggtcggggtgtgggtgagttttgatcgggtgttgcggggagtaggtggagtgtgcgggggaggcggggtgtgggtgacgtttgatcgggtgttgcggggagtaggtggagtgtgcgggggaggcggggtgtgggtgacgtttgatcgggtgttgcggggagtaggtggagtgtgcgggggtcggggtgtgggtgagttttgatcgggtgttgcggggagtaggtggagtgtgcgggggaggcggggtgtgggtgacgtttgatcgggtgttgtgaggagtaggtggagtgtgcgggggaggcgggtatatttaggagattgggtgtaattttcg

SEQ ID NO: 20518 - DNA, 604 bp, Artificial Sequence
  chemically treated genomic DNA (Homo sapiens) CpG-island No: 20518
cgaaaattacacccaatctcctaaatatacccgcctcccccgcacactccacctactcctcacaacacccgatcaaacgtcacccacaccccgcctcccccgcacactccacctactccccgcaacacccgatcaaaactcacccacaccccgacccccgcacactccacctactccccgcaacacccgatcaaacgtcacccacaccccgcctcccccgcacactccacctactccccgcaacacccgatcaaacgtcacccacaccccgcctcccccgcacactccacctactccccgcaacacccgatcaaaactcacccacaccccgacccccgcacactccacctactcgccgcaacacccgatcaaacgtcacccacaccccgcctcccccgcacactccacctactccccgcaacacccgatcaaacgtcacccacaccccgcctcccccgcacactccacctactccccgcaacacccgatcaaaactcacccacaccccgacccccgcacactccacctactccccgcaacacccgatcaaacgtcacccacaccccgacccccgcacactccgcctactccccacaacgcccga

SEQ ID NO: 20519 - DNA, 604 bp, Artificial Sequence
  chemically treated genomic DNA (Homo sapiens) CpG-island No: 20519
cgggagttgtatttaattttttgagtgtgttcgtttttttcgtatattttatttgttttttatagtattcggttagacgttatttatatttcgtttttttcgtatattttatttgtttttcgtagtattcggttagaatttatttatatttcggttttcgtatattttatttgtttttcgtagtattcggttagacgttatttatatttcgtttttttcgtatattttatttgtttttcgtagtattcggttagacgttatttatatttcgtttttttcgtatattttatttgtttttcgtagtattcggttagaatttatttatatttcggttttcgtatattttatttgttcgtcgtagtattcggttagacgttatttatatttcgtttttttcgtatattttatttgtttttcgtagtattcggttagacgttatttatatttcgtttttttcgtatattttatttgtttttcgtagtattcggttagaatttatttatatttcggttttcgtatattttatttgtttttcgtagtattcggttagacgttatttatatttcggttttcgtatatttcgtttgttttttatagcgttcgg

SEQ ID NO: 20520 - DNA, 604 bp, Artificial Sequence
  chemically treated genomic DNA (Homo sapiens) CpG-island No: 20520
ccgaacgctataaaaaacaaacgaaatatacgaaaaccgaaatataaataacgtctaaccgaatactacgaaaaacaaataaaatatacgaaaaccgaaatataaataaattctaaccgaatactacgaaaaacaaataaaatatacgaaaaaaacgaaatataaataacgtctaaccgaatactacgaaaaacaaataaaatatacgaaaaaaacgaaatataaataacgtctaaccgaatactacgacgaacaaataaaatatacgaaaaccgaaatataaataaattctaaccgaatactacgaaaaacaaataaaatatacgaaaaaaacgaaatataaataacgtctaaccgaatactacgaaaaacaaataaaatatacgaaaaaaacgaaatataaataacgtctaaccgaatactacgaaaaacaaataaaatatacgaaaaccgaaatataaataaattctaaccgaatactacgaaaaacaaataaaatatacgaaaaaaacgaaatataaataacgtctaaccgaatactataaaaaacaaataaaatatacgaaaaaaacgaacacactcaaaaaattaaatacaactcccg

SEQ ID NO: 20521 - DNA, 851 bp, Artificial Sequence
  chemically treated genomic DNA (Homo sapiens) CpG-island No: 20521
ggggcgagagcgcggtatattcgtatatacgtcgttcgtcgcggcgggcgattaggaattcgtttggattcgcggcggggtaggggtcgtcgtttttttcggggttgtcgttttcggttttcggttttttttttttagtgggagttggcgagagtagggcggagtagagcgggtaggaggagcgggtgcggttagtaggggtcgcggtcgggggtcgggttttcggatttttgggtcgggtttcggatttcggagaggagtcgtcgtggttttgggagttcgtgttagagtcgttcgttcgtcgtttcgcgcgttagtttttttcgcggtcgtttcgtcgcggtttttttttcgtttttttcgagttttttttttttttttcgagtttcgcgcgtttttttttttttcggcgtaaagtttcgcgttcgtaaatcggtttcgtcgagagcgtttagcgtcgcgggggcgtttagagttaagcgtatatttttgcggggcgcgtagggggcggcggcgttcggggttgcgtttttgtcgggggtaggggtttcgtcgtttttttttcgtaggtagtttcggcggcgttttcggacgtttcgtgaaagacgttattgtggcggtcgagcggattggggttcggggcggttttttttttttttttttgttcgggtcggattacgtcgtttttttttgtgggtcgcggtcggtgttcggcgtttttcgtcgtcggtcgggttggtttagattcgtcgttttcgtttatttaggcgtttttaaagtttttttttatttttttttatttttagttttttttttttttttggatgtaaacgttttatttatttttaaaa

SEQ ID NO: 20522 - DNA, 851 bp, Artificial Sequence
  chemically treated genomic DNA (Homo sapiens) CpG-island No: 20522
ttttaaaaataaataaaacgtttacatccaaaaaaaaaaaaaaaactaaaaataaaaaaaaataaaaaaaaactttaaaaacgcctaaataaacgaaaacgacgaatctaaaccaacccgaccgacgacgaaaaacgccgaacaccgaccgcgacccacaaaaaaaaacgacgtaatccgacccgaacaaaaaaaaaaaaaaaaaaccgccccgaaccccaatccgctcgaccgccacaataacgtctttcacgaaacgtccgaaaacgccgccgaaactacctacgaaaaaaaaacgacgaaacccctacccccgacaaaaacgcaaccccgaacgccgccgccccctacgcgccccgcaaaaatatacgcttaactctaaacgcccccgcgacgctaaacgctctcgacgaaaccgatttacgaacgcgaaactttacgccgaaaaaaaaaaaaacgcgcgaaactcgaaaaaaaaaaaaaaaactcgaaaaaaacgaaaaaaaaaccgcgacgaaacgaccgcgaaaaaaactaacgcgcgaaacgacgaacgaacgactctaacacgaactcccaaaaccacgacgactcctctccgaaatccgaaacccgacccaaaaatccgaaaacccgacccccgaccgcgacccctactaaccgcacccgctcctcctacccgctctactccgccctactctcgccaactcccactaaaaaaaaaaaaccgaaaaccgaaaacgacaaccccgaaaaaaacgacgacccctaccccgccgcgaatccaaacgaattcctaatcgcccgccgcgacgaacgacgtatatacgaatataccgcgctctcgcccc

SEQ ID NO: 20523 - DNA, 851 bp, Artificial Sequence
  chemically treated genomic DNA (Homo sapiens) CpG-island No: 20523
ttttaaaaataaatgaaacgtttgtatttaaaagggggaggagggttggagatgggagggagtgggagggggttttaaaggcgtttgggtgggcggaggcggcgaatttggattagttcggtcggcgacgaagagcgtcgggtatcggtcgcggtttataaaggggagcggcgtggttcggttcgggtaaaagggggaaggaaaaatcgtttcgggttttagttcgttcggtcgttataatggcgttttttacggggcgttcgggggcgtcgtcgaggttgtttgcgagaagggggcggcggggtttttattttcggtaggagcgtagtttcgggcgtcgtcgttttttgcgcgtttcgtagagatgtgcgtttggttttgggcgttttcgcggcgttgggcgttttcggcggggtcggtttgcgggcgcggagttttgcgtcggggaagaaagggacgcgcggggttcgggggaggagggaggggttcggggagggcggggggagagtcgcggcggagcggtcgcgggggaggttggcgcgcggagcggcgggcgggcggttttggtacgggtttttagagttacggcggttttttttcgagattcggaattcggtttagagattcggaaattcggttttcggtcgcggtttttgttggtcgtattcgttttttttgttcgttttgtttcgttttgttttcgttagtttttattggaggaagaaagtcgagaatcgggagcggtagtttcggaggaggcggcggtttttgtttcgtcgcgggtttaagcggatttttagtcgttcgtcgcggcgggcggcgtgtgtgcgagtgtgtcgcgttttcgtttt

SEQ ID NO: 20524 - DNA, 851 bp, Artificial Sequence
  chemically treated genomic DNA (Homo sapiens) CpG-island No: 20524
aaaacgaaaacgcgacacactcgcacacacgccgcccgccgcgacgaacgactaaaaatccgcttaaacccgcgacgaaacaaaaaccgccgcctcctccgaaactaccgctcccgattctcgactttcttcctccaataaaaactaacgaaaacaaaacgaaacaaaacgaacaaaaaaaacgaatacgaccaacaaaaaccgcgaccgaaaaccgaatttccgaatctctaaaccgaattccgaatctcgaaaaaaaaccgccgtaactctaaaaacccgtaccaaaaccgcccgcccgccgctccgcgcgccaacctcccccgcgaccgctccgccgcgactctccccccgccctccccgaacccctccctcctcccccgaaccccgcgcgtccctttcttccccgacgcaaaactccgcgcccgcaaaccgaccccgccgaaaacgcccaacgccgcgaaaacgcccaaaaccaaacgcacatctctacgaaacgcgcaaaaaacgacgacgcccgaaactacgctcctaccgaaaataaaaaccccgccgcccccttctcgcaaacaacctcgacgacgcccccgaacgccccgtaaaaaacgccattataacgaccgaacgaactaaaacccgaaacgatttttccttcccccttttacccgaaccgaaccacgccgctcccctttataaaccgcgaccgatacccgacgctcttcgtcgccgaccgaactaatccaaattcgccgcctccgcccacccaaacgcctttaaaaccccctcccactccctcccatctccaaccctcctcccccttttaaatacaaacgtttcatttatttttaaaa

SEQ ID NO: 20525 - DNA, 535 bp, Artificial Sequence
  chemically treated genomic DNA (Homo sapiens) CpG-island No: 20525
ttcgttcgttggttttagagcggacgttgggacgttcggggtttggtagttttgcgttcggttaggagcgggcgggcgagtattagtttgcgttttggagaaggggcgtagcgtcgtagttgaggtcggagtagtttttcgcgggcgtaggatatttgttagtgagcgttcggattgtacggttttcgggtagtgtttgtcggcgaggggcgggagttcgggtgatttggttatttttattttcggtttaggttcggagggcggtcgttttttatcgtttttttttttttattggtagagcgcgttgcgggcggattttcgggttcggagtagtttatcggttattttatcgtttattcggttttcggtgttttttttcggtcgttttatttagtaatttttcgtgttttgtttttcgattggaaatgttttacggaagcgttttggatagggttttcgttaggcgataagagttcggtgttgagatgtgttacgtttttatttttttattaattatggatggaaataaataagg

SEQ ID NO: 20526 - DNA, 535 bp, Artificial Sequence
  chemically treated genomic DNA (Homo sapiens) CpG-island No: 20526
ccttatttatttccatccataattaataaaaaaataaaaacgtaacacatctcaacaccgaactcttatcgcctaacgaaaaccctatccaaaacgcttccgtaaaacatttccaatcgaaaaacaaaacacgaaaaattactaaataaaacgaccgaaaaaaaacaccgaaaaccgaataaacgataaaataaccgataaactactccgaacccgaaaatccgcccgcaacgcgctctaccaataaaaaaaaaaaaacgataaaaaacgaccgccctccgaacctaaaccgaaaataaaaataaccaaatcacccgaactcccgcccctcgccgacaaacactacccgaaaaccgtacaatccgaacgctcactaacaaatatcctacgcccgcgaaaaactactccgacctcaactacgacgctacgccccttctccaaaacgcaaactaatactcgcccgcccgctcctaaccgaacgcaaaactaccaaaccccgaacgtcccaacgtccgctctaaaaccaacgaacgaa

SEQ ID NO: 20527 - DNA, 535 bp, Artificial Sequence
  chemically treated genomic DNA (Homo sapiens) CpG-island No: 20527
ttttatttgtttttatttataattgatggggagatgagaacgtaatatattttagtatcgagtttttgtcgtttggcggagattttgtttaagacgttttcgtaaagtatttttagtcggggaataaagtacggaaagttgttgggtagagcggtcgggaggagatatcgggagtcgggtgggcggtggggtggtcggtgggttgtttcgggttcgggagttcgttcgtagcgcgttttgttagtaaggggagagggacggtgggaagcggtcgtttttcgggtttgggtcggggatggggatggttaagttattcgagttttcgtttttcgtcggtaggtattattcgggggtcgtgtaattcgggcgtttattgataggtattttacgttcgcgaggggttgtttcggttttaattgcggcgttgcgttttttttttaggacgtaggttaatgttcgttcgttcgtttttagtcgggcgtagagttgttagatttcgggcgttttagcgttcgttttggggttaacgggcggg

SEQ ID NO: 20528 - DNA, 535 bp, Artificial Sequence
  chemically treated genomic DNA (Homo sapiens) CpG-island No: 20528
cccgcccgttaaccccaaaacgaacgctaaaacgcccgaaatctaacaactctacgcccgactaaaaacgaacgaacgaacattaacctacgtcctaaaaaaaaaacgcaacgccgcaattaaaaccgaaacaacccctcgcgaacgtaaaatacctatcaataaacgcccgaattacacgacccccgaataatacctaccgacgaaaaacgaaaactcgaataacttaaccatccccatccccgacccaaacccgaaaaacgaccgcttcccaccgtccctctccccttactaacaaaacgcgctacgaacgaactcccgaacccgaaacaacccaccgaccaccccaccgcccacccgactcccgatatctcctcccgaccgctctacccaacaactttccgtactttattccccgactaaaaatactttacgaaaacgtcttaaacaaaatctccgccaaacgacaaaaactcgatactaaaatatattacgttctcatctccccatcaattataaataaaaacaaataaaa

SEQ ID NO: 20529 - DNA, 515 bp, Artificial Sequence
  chemically treated genomic DNA (Homo sapiens) CpG-island No: 20529
cggttaggtttcgggggcgtgcggagggcgggttttcgcgcggtcgtcgtttttttaggtcgttaggggtgaggaggtgacgttgcgggtttggtggcggttggttttttatataggaatttttttcgttatcgttttttcgaaggtcgtttttcgttttatttttagtattgggcgttcgcgttttttaatttagttcgtcgtcgagtagacggcgcgtcgcggtaattgggtataggggttttttttagagtcgtttagtcgataaatgaaacgttagtttttttgtgatttcgcgtgtgtggggcggcggtggttgcgagtcggggcgtagggtcggtcggtagtcgttgtttttttatagttttagattttgcgcggtttgtcggcggttggcgatttttttttttttttcgaggcgttcgagtttttgattttttttcggggcgtttgtggtttttttttttttttcggggcgttcgagtttttgattttttttcggggcgtttgtggtt

SEQ ID NO: 20530 - DNA, 515 bp, Artificial Sequence
  chemically treated genomic DNA (Homo sapiens) CpG-island No: 20530
aaccacaaacgccccgaaaaaaaatcaaaaactcgaacgccccgaaaaaaaaaaaaaaaccacaaacgccccgaaaaaaaatcaaaaactcgaacgcctcgaaaaaaaaaaaaaaatcgccaaccgccgacaaaccgcgcaaaatctaaaactataaaaaaacaacgactaccgaccgaccctacgccccgactcgcaaccaccgccgccccacacacgcgaaatcacaaaaaaactaacgtttcatttatcgactaaacgactctaaaaaaaacccctatacccaattaccgcgacgcgccgtctactcgacgacgaactaaattaaaaaacgcgaacgcccaatactaaaaataaaacgaaaaacgaccttcgaaaaaacgataacgaaaaaaattcctatataaaaaaccaaccgccaccaaacccgcaacgtcacctcctcacccctaacgacctaaaaaaacgacgaccgcgcgaaaacccgccctccgcacgcccccgaaacctaaccg

SEQ ID NO: 20531 - DNA, 515 bp, Artificial Sequence
  chemically treated genomic DNA (Homo sapiens) CpG-island No: 20531
ggttataggcgtttcgggaggggattagaggttcgggcgtttcgggaggggaagggaggttataggcgtttcgggaggggattagaggttcgggcgtttcgggaggggaagggaggtcgttagtcgtcggtaggtcgcgtagggtttggggttgtgaaagagtagcggttgtcggtcggttttgcgtttcggttcgtagttatcgtcgttttatatacgcgggattataggggagttgacgttttatttatcgattgagcgattttgaaaaaggtttttgtgtttaattatcgcggcgcgtcgtttgttcggcggcgggttgagttgggaggcgcgggcgtttagtgttgggggtggagcggggggcggttttcgagggagcggtggcgaggaggatttttgtgtgaaaaattagtcgttattaagttcgtagcgttatttttttatttttggcggtttgggaaagcggcggtcgcgcgggggttcgtttttcgtacgttttcgaggtttagtcg

SEQ ID NO: 20532 - DNA, 515 bp, Artificial Sequence
  chemically treated genomic DNA (Homo sapiens) CpG-island No: 20532
cgactaaacctcgaaaacgtacgaaaaacgaacccccgcgcgaccgccgctttcccaaaccgccaaaaataaaaaaataacgctacgaacttaataacgactaatttttcacacaaaaatcctcctcgccaccgctccctcgaaaaccgccccccgctccacccccaacactaaacgcccgcgcctcccaactcaacccgccgccgaacaaacgacgcgccgcgataattaaacacaaaaacctttttcaaaatcgctcaatcgataaataaaacgtcaactcccctataatcccgcgtatataaaacgacgataactacgaaccgaaacgcaaaaccgaccgacaaccgctactctttcacaaccccaaaccctacgcgacctaccgacgactaacgacctcccttcccctcccgaaacgcccgaacctctaatcccctcccgaaacgcctataacctcccttcccctcccgaaacgcccgaacctctaatcccctcccgaaacgcctataacc

SEQ ID NO: 20533 - DNA, 1126 bp, Artificial Sequence
  chemically treated genomic DNA (Homo sapiens) CpG-island No: 20533
gttatttttaggagtaattttatatcgattttcgtattttggggtcgggataaagatattattttttcgttttttttattcggtgagtttcgttcggtttcggttaaattttattttttcgtttttcgagtttaatatagaattaagggttgatttttggtagcgatgagtataagttaagatgcgttttgggaggttcggacgtttttcgttttcggttatttcggtaattaggtcgggtattaagcggtagcgtagagggagggattttaaggtttcggtcgaggaagtcgtaggtagtttcgtagtacgagttcgatttatattttcggtagtttagtggagtatcgattcgaatcgtttttgtttttataggggttgtcgcgtcgggaaagcggttagtgggtaatatttgtcggggcgggaggcgtcggggttttttcgtgtatatatttgcgcgtgggtcgggtttaggtcgatcggaattttggattatgcgatttcggtttatcgtgttagggttcgtcgcgcgatcgttgtgttagatgggggaaggggacgcgggcggcggcgatatttattcggtaacgttttttttttcgtcggcggtagtagtagagttagcgattttcggtattatttttcgtcgtcgtttagttttcggtagcggttattaatcgtttattcggtatcgttaagtcgatataatcgtcggcgtttcgggcgttcgttcgtcgcggtttcgaattttaggaggtagggaggggttcgggcggataaggacgcgagtaggtttttcggttttgggtttggggtcgggggatagaaggtcgcggtttgttagagtcgaggggtttaggcgattgggggattttgaggtaacgtcgagggttcggtagggtcgcggatatcgtcgcggtttggtttgttattgtcgatttcgttttttttttcgcggcgtatgtcgggaaacggtttgtcgggggaggggcgcgtttggaggcgtagagaggcgtttacgtaggttcggaagtcggtagtttgtcgggaagggggcggtttcgttttcggtttttcggtcggtaggttggttgttttggtttgattttgggagatttcgttgggg

SEQ ID NO: 20534 - DNA, 1126 bp, Artificial Sequence
  chemically treated genomic DNA (Homo sapiens) CpG-island No: 20534
ccccaacgaaatctcccaaaatcaaaccaaaacaaccaacctaccgaccgaaaaaccgaaaacgaaaccgcccccttcccgacaaactaccgacttccgaacctacgtaaacgcctctctacgcctccaaacgcgcccctcccccgacaaaccgtttcccgacatacgccgcgaaaaaaaaaacgaaatcgacaataacaaaccaaaccgcgacgatatccgcgaccctaccgaaccctcgacgttacctcaaaatcccccaatcgcctaaacccctcgactctaacaaaccgcgaccttctatcccccgaccccaaacccaaaaccgaaaaacctactcgcgtccttatccgcccgaacccctccctacctcctaaaattcgaaaccgcgacgaacgaacgcccgaaacgccgacgattatatcgacttaacgataccgaataaacgattaataaccgctaccgaaaactaaacgacgacgaaaaataataccgaaaatcgctaactctactactaccgccgacgaaaaaaaaaacgttaccgaataaatatcgccgccgcccgcgtccccttcccccatctaacacaacgatcgcgcgacgaaccctaacacgataaaccgaaatcgcataatccaaaattccgatcgacctaaacccgacccacgcgcaaatatatacacgaaaaaaccccgacgcctcccgccccgacaaatattacccactaaccgctttcccgacgcgacaacccctataaaaacaaaaacgattcgaatcgatactccactaaactaccgaaaatataaatcgaactcgtactacgaaactacctacgacttcctcgaccgaaaccttaaaatccctccctctacgctaccgcttaatacccgacctaattaccgaaataaccgaaaacgaaaaacgtccgaacctcccaaaacgcatcttaacttatactcatcgctaccaaaaatcaacccttaattctatattaaactcgaaaaacgaaaaaataaaatttaaccgaaaccgaacgaaactcaccgaataaaaaaaacgaaaaaataatatctttatcccgaccccaaaatacgaaaatcgatataaaattactcctaaaaataac

SEQ ID NO: 20535 - DNA, 1126 bp, Artificial Sequence
  chemically treated genomic DNA (Homo sapiens) CpG-island No: 20535
ttttagcggagttttttagggttaggttaggatagttaatttgtcggtcggagagtcggaggcggggtcgtttttttttcggtaggttgtcgattttcggatttgcgtagacgtttttttgcgtttttaggcgcgtttttttttcggtaggtcgtttttcggtatgcgtcgcggaggaagagacggagtcgataataataaattaagtcgcggcggtgttcgcggttttgtcgagttttcggcgttgttttagaattttttagtcgtttgggtttttcggttttgataggtcgcggttttttgtttttcggttttagatttagagtcgaggggtttgttcgcgtttttgttcgttcggatttttttttgttttttagagttcggggtcgcggcgggcgggcgttcgggacgtcggcggttgtgtcggtttagcggtgtcgaatgggcggttggtaatcgttgtcgaggattaggcggcggcggaagatggtgtcgggggtcgttggttttgttgttgtcgtcggcgaaggaggaggcgttgtcgggtaagtgtcgtcgtcgttcgcgttttttttttttatttggtatagcggtcgcgcggcgggttttggtacggtgggtcggggtcgtatggtttagggtttcggtcggtttgagttcggtttacgcgtaggtgtgtgtacgggagggtttcggcgtttttcgtttcggtaggtgttgtttattggtcgttttttcggcgcgatagtttttgtggagataaaagcggttcgagtcgatgttttattaggttgtcggaggtgtgggtcggattcgtgttgcggggttgtttgcggttttttcggtcggagttttgggatttttttttttgcgttgtcgtttagtattcggtttagttgtcggagtggtcgagggcgagggacgttcgaattttttaagacgtattttgatttgtgtttatcgttgttagggattagtttttaattttgtgttggattcgagaaacgggagagtggagtttggtcgaggtcgaacgaagtttatcgaatgggaggaacggagagatgatgtttttgtttcgattttagagtgcgaggatcggtataaagttatttttaggaatgat

SEQ ID NO: 20536 - DNA, 1126 bp, Artificial Sequence
  chemically treated genomic DNA (Homo sapiens) CpG-island No: 20536
atcattcctaaaaataactttataccgatcctcgcactctaaaatcgaaacaaaaacatcatctctccgttcctcccattcgataaacttcgttcgacctcgaccaaactccactctcccgtttctcgaatccaacacaaaattaaaaactaatccctaacaacgataaacacaaatcaaaatacgtcttaaaaaattcgaacgtccctcgccctcgaccactccgacaactaaaccgaatactaaacgacaacgcaaaaaaaaaaatcccaaaactccgaccgaaaaaaccgcaaacaaccccgcaacacgaatccgacccacacctccgacaacctaataaaacatcgactcgaaccgcttttatctccacaaaaactatcgcgccgaaaaaacgaccaataaacaacacctaccgaaacgaaaaacgccgaaaccctcccgtacacacacctacgcgtaaaccgaactcaaaccgaccgaaaccctaaaccatacgaccccgacccaccgtaccaaaacccgccgcgcgaccgctataccaaataaaaaaaaaaaacgcgaacgacgacgacacttacccgacaacgcctcctccttcgccgacgacaacaacaaaaccaacgacccccgacaccatcttccgccgccgcctaatcctcgacaacgattaccaaccgcccattcgacaccgctaaaccgacacaaccgccgacgtcccgaacgcccgcccgccgcgaccccgaactctaaaaaacaaaaaaaaatccgaacgaacaaaaacgcgaacaaacccctcgactctaaatctaaaaccgaaaaacaaaaaaccgcgacctatcaaaaccgaaaaacccaaacgactaaaaaattctaaaacaacgccgaaaactcgacaaaaccgcgaacaccgccgcgacttaatttattattatcgactccgtctcttcctccgcgacgcataccgaaaaacgacctaccgaaaaaaaaacgcgcctaaaaacgcaaaaaaacgtctacgcaaatccgaaaatcgacaacctaccgaaaaaaaaacgaccccgcctccgactctccgaccgacaaattaactatcctaacctaaccctaaaaaactccgctaaaa

SEQ ID NO: 20537 - DNA, 881 bp, Artificial Sequence
  chemically treated genomic DNA (Homo sapiens) CpG-island No: 20537
agattcgcggcggtgggggtaaaaaattgtagcggtgggcgtaaaaagtcggggcggtgggggaaaaagttagggcgacgggggtaataagttatggcggcggggttaaaaagtcgtggttgcggaggtaaaaagttgcggtggcggaggtaaaaagttacggtgatgggcgtaaaaagtcgtaaaaagtcgtagtattgggggtaaaaagtcgcgacggcgggggtaaaaagttcgggcggtgggggtaagaagtcggggtaggaaaaatttgcggcgataggggaaaaaattcgcggcggcgggggttaaaagtcgcggcggtaaaaagtcgtaaaaagtcggggcggcgggggtaagaagtcgcggcgggaaaaatttgcggcggcgggggcgaaaagtcgtaaaaagtcgcggcgtcgggggttaaaagttataaaaagtcgcggcggcggtggtaaaaagtcgtagcggaaaaagtcgcggtgacgggggttaaaagttgtagcggtagggggaaaaaagtcgcggcggcgagggtaaaaagtcgcggcggtggggggagaaagacgtaaaaagttgcggcggtaaaaagtcgcggttgcgagggtaaagatttttaaaaagtcgcggtagtaggggttaaatttcgcgaggtcgggggtagaaagtcgcggtggcgggggtagaaagtaacggaggcgggggtaaaaagtcgaggcggcggaggtataaagtcgtaaaaattcgtagtagcgggggtaaaaatttatggcggtaaaaagtcgcgtcggcgggggtaaagtagtggaaatggggtagaaggttagaatagtttggtatttttggagtgtgatgtggaaggaaaagtgtagaggaag

SEQ ID NO: 20538 - DNA, 881 bp, Artificial Sequence
  chemically treated genomic DNA (Homo sapiens) CpG-island No: 20538
cttcctctacacttttccttccacatcacactccaaaaataccaaactattctaaccttctaccccatttccactactttacccccgccgacgcgactttttaccgccataaatttttacccccgctactacgaatttttacgactttatacctccgccgcctcgactttttacccccgcctccgttactttctacccccgccaccgcgactttctacccccgacctcgcgaaatttaacccctactaccgcgactttttaaaaatctttaccctcgcaaccgcgactttttaccgccgcaactttttacgtctttctccccccaccgccgcgactttttaccctcgccgccgcgacttttttccccctaccgctacaacttttaacccccgtcaccgcgactttttccgctacgactttttaccaccgccgccgcgactttttataacttttaacccccgacgccgcgactttttacgacttttcgcccccgccgccgcaaatttttcccgccgcgacttcttacccccgccgccccgactttttacgactttttaccgccgcgacttttaacccccgccgccgcgaattttttcccctatcgccgcaaatttttcctaccccgacttcttacccccaccgcccgaactttttacccccgccgtcgcgactttttacccccaatactacgactttttacgactttttacgcccatcaccgtaactttttacctccgccaccgcaactttttacctccgcaaccacgactttttaaccccgccgccataacttattacccccgtcgccctaactttttcccccaccgccccgactttttacgcccaccgctacaattttttacccccaccgccgcgaatct

SEQ ID NO: 20539 - DNA, 881 bp, Artificial Sequence
  chemically treated genomic DNA (Homo sapiens) CpG-island No: 20539
ttttttttgtatttttttttttatattatattttaggaatgttaagttgttttggttttttattttatttttattattttgttttcgtcgacgcggttttttgtcgttatggatttttgttttcgttgttgcgggtttttgcggttttatgttttcgtcgtttcgattttttgttttcgttttcgttgttttttgttttcgttatcgcggttttttgttttcggtttcgcggaatttagtttttgttgtcgcggttttttggggatttttgttttcgtagtcgcggttttttgtcgtcgtagttttttgcgtttttttttttttatcgtcgcggttttttgttttcgtcgtcgcggtttttttttttttgtcgttgtagtttttagttttcgttatcgcgatttttttcgttgcggttttttgttatcgtcgtcgcggttttttatgatttttggttttcggcgtcgcggttttttacggtttttcgttttcgtcgtcgtaggtttttttcgtcgcggttttttgttttcgtcgtttcggttttttgcggttttttgtcgtcgcggtttttggttttcgtcgtcgcgagtttttttttttgtcgtcgtaggttttttttgtttcggttttttgtttttatcgttcgggttttttgttttcgtcgtcgcggttttttgtttttaatgttgcggttttttacggttttttgcgtttattatcgtagttttttgttttcgttatcgtagttttttgttttcgtaattacggttttttgatttcgtcgttatggtttgttgttttcgtcgttttggtttttttttttatcgtttcggttttttgcgtttatcgttgtagttttttgtttttatcgtcgcgggttt

SEQ ID NO: 20540 - DNA, 881 bp, Artificial Sequence
  chemically treated genomic DNA (Homo sapiens) CpG-island No: 20540
aaacccgcgacgataaaaacaaaaaactacaacgataaacgcaaaaaaccgaaacgataaaaaaaaaaaccaaaacgacgaaaacaacaaaccataacgacgaaatcaaaaaaccgtaattacgaaaacaaaaaactacgataacgaaaacaaaaaactacgataataaacgcaaaaaaccgtaaaaaaccgcaacattaaaaacaaaaaaccgcgacgacgaaaacaaaaaacccgaacgataaaaacaaaaaaccgaaacaaaaaaaacctacgacgacaaaaaaaaaaactcgcgacgacgaaaaccaaaaaccgcgacgacaaaaaaccgcaaaaaaccgaaacgacgaaaacaaaaaaccgcgacgaaaaaaacctacgacgacgaaaacgaaaaaccgtaaaaaaccgcgacgccgaaaaccaaaaatcataaaaaaccgcgacgacgataacaaaaaaccgcaacgaaaaaaatcgcgataacgaaaactaaaaactacaacgacaaaaaaaaaaaaaccgcgacgacgaaaacaaaaaaccgcgacgataaaaaaaaaaaaacgcaaaaaactacgacgacaaaaaaccgcgactacgaaaacaaaaatccccaaaaaaccgcgacaacaaaaactaaattccgcgaaaccgaaaacaaaaaaccgcgataacgaaaacaaaaaacaacgaaaacgaaaacaaaaaatcgaaacgacgaaaacataaaaccgcaaaaacccgcaacaacgaaaacaaaaatccataacgacaaaaaaccgcgtcgacgaaaacaaaataataaaaataaaataaaaaaccaaaacaacttaacattcctaaaatataatataaaaaaaaaaatacaaaaaaaa

SEQ ID NO: 20541 - DNA, 887 bp, Artificial Sequence
  chemically treated genomic DNA (Homo sapiens) CpG-island No: 20541
cggtcgtcggtcgtcggtttttagacgcgtcgtcgttgttatggtttagtttttgtgttcgtcgtttttcgagttttggatgttttttgcggtttggggtttaattcggcggtcgtcgtttttcgataaggattgcggtcgttttttcgtttcgtttttagatttatggggtagtattttagtcgatagtttcgtggcgagtttcgcgcggttaggtatttttcgggattttcgcgtttttttcgtaggtaggcgcggcgcgcgtagtagtcgtttgggtagcgggtagaggtagagcgttagtgagcgggagaaattgcgtatgcgtacgttggttcgcgttttgtacgagttgcgtcgttttttatcgtcgttcgtggcgttcgcgggttagagtttgattaagatcgagacgttgcgtttggttattcgttatatcggttatttgtcggtcgtgttaggttttagcgaggagagtttttagcgtcggtgtcggtagcgcggtgacgcggggttttttcggggttgttcgttgtgtttcgacgattgtttcgcgtagatgtagatacggacgtaggttgaggggtaggggtaggggcgcgggttgggtttggtattcgtcgttcgcgtcggggcgttttggggattttcgtttgtttgtttcggagttcgagttgtattcgagtcgcgcgattcgtttgcgttgttcgtcgaggcggcgtgttttgaagggtaggcgatggagttaagtttatcgttttcggttagtgttttttttttcgcgtttttttcgttcgtgttttcgcgtatagttttatcgttcgttaaggtgaggattaggtattttgttgtttttcgtcggtagtttggttatttggttattatag

SEQ ID NO: 20542 - DNA, 887 bp, Artificial Sequence
  chemically treated genomic DNA (Homo sapiens) CpG-island No: 20542
ctataataaccaaataaccaaactaccgacgaaaaacaacaaaatacctaatcctcaccttaacgaacgataaaactatacgcgaaaacacgaacgaaaaaaacgcgaaaaaaaaaacactaaccgaaaacgataaacttaactccatcgcctacccttcaaaacacgccgcctcgacgaacaacgcaaacgaatcgcgcgactcgaatacaactcgaactccgaaacaaacaaacgaaaatccccaaaacgccccgacgcgaacgacgaataccaaacccaacccgcgcccctacccctacccctcaacctacgtccgtatctacatctacgcgaaacaatcgtcgaaacacaacgaacaaccccgaaaaaaccccgcgtcaccgcgctaccgacaccgacgctaaaaactctcctcgctaaaacctaacacgaccgacaaataaccgatataacgaataaccaaacgcaacgtctcgatcttaatcaaactctaacccgcgaacgccacgaacgacgataaaaaacgacgcaactcgtacaaaacgcgaaccaacgtacgcatacgcaatttctcccgctcactaacgctctacctctacccgctacccaaacgactactacgcgcgccgcgcctacctacgaaaaaaacgcgaaaatcccgaaaaatacctaaccgcgcgaaactcgccacgaaactatcgactaaaatactaccccataaatctaaaaacgaaacgaaaaaacgaccgcaatccttatcgaaaaacgacgaccgccgaattaaaccccaaaccgcaaaaaacatccaaaactcgaaaaacgacgaacacaaaaactaaaccataacaacgacgacgcgtctaaaaaccgacgaccgacgaccg

SEQ ID NO: 20543 - DNA, 887 bp, Artificial Sequence
  chemically treated genomic DNA (Homo sapiens) CpG-island No: 20543
ttatggtggttaggtggttaggttgtcggcggggagtagtagggtgtttggtttttattttggcgggcggtggggttgtgcgcgggggtacggacgaagggggcgcggggaaggggatattaatcggggacggtgggtttggttttatcgtttgttttttagggtacgtcgtttcggcgaatagcgtaggcgggtcgcgcggttcgggtgtagttcgggtttcggggtaggtaggcggggatttttaggacgtttcggcgcggacggcggatattaggtttagttcgcgtttttgtttttgttttttagtttgcgttcgtgtttgtatttgcgcggggtagtcgtcggggtatagcgggtagtttcgaggggatttcgcgttatcgcgttgtcggtatcggcgttggagatttttttcgttgaggtttagtacggtcgataggtggtcgatatagcggatagttaggcgtagcgtttcgattttggttaggttttggttcgcgggcgttacggacggcggtagaaagcggcgtagttcgtgtagggcgcgggttagcgtgcgtatgcgtagtttttttcgtttattggcgttttgtttttgttcgttgtttaggcggttgttgcgcgcgtcgcgtttatttacggagggggcgcgggggtttcggagggtgtttggtcgcgcggggttcgttacggggttgtcggttggggtgttgttttatgagtttggggacgagacgagggagcggtcgtagtttttgtcggagggcggcggtcgtcgagttgggttttaggtcgtagagagtatttaggattcggagagcggcgggtataggggttgggttatggtagcggcggcgcgtttgggggtcggcggtcggcggtcg

SEQ ID NO: 20544 - DNA, 887 bp, Artificial Sequence
  chemically treated genomic DNA (Homo sapiens) CpG-island No: 20544
cgaccgccgaccgccgacccccaaacgcgccgccgctaccataacccaacccctatacccgccgctctccgaatcctaaatactctctacgacctaaaacccaactcgacgaccgccgccctccgacaaaaactacgaccgctccctcgtctcgtccccaaactcataaaacaacaccccaaccgacaaccccgtaacgaaccccgcgcgaccaaacaccctccgaaacccccgcgccccctccgtaaataaacgcgacgcgcgcaacaaccgcctaaacaacgaacaaaaacaaaacgccaataaacgaaaaaaactacgcatacgcacgctaacccgcgccctacacgaactacgccgctttctaccgccgtccgtaacgcccgcgaaccaaaacctaaccaaaatcgaaacgctacgcctaactatccgctatatcgaccacctatcgaccgtactaaacctcaacgaaaaaaatctccaacgccgataccgacaacgcgataacgcgaaatcccctcgaaactacccgctataccccgacgactaccccgcgcaaatacaaacacgaacgcaaactaaaaaacaaaaacaaaaacgcgaactaaacctaatatccgccgtccgcgccgaaacgtcctaaaaatccccgcctacctaccccgaaacccgaactacacccgaaccgcgcgacccgcctacgctattcgccgaaacgacgtaccctaaaaaacaaacgataaaaccaaacccaccgtccccgattaatatccccttccccgcgcccccttcgtccgtacccccgcgcacaaccccaccgcccgccaaaataaaaaccaaacaccctactactccccgccgacaacctaaccacctaaccaccataa

SEQ ID NO: 20545 - DNA, 593 bp, Artificial Sequence
  chemically treated genomic DNA (Homo sapiens) CpG-island No: 20545
cggttgtcgttcgagtcggtagaacgaggtttttgagcgggtttcgggttgagcggcggtagattttcgtttttcgggttttagcgttgtcgcgtatgcggttgaacggcggagtcgcggtcgcgtaggcgtcggaggtcgtgggaggtgatatagttgtagggggagttggggaagagtcgcgtaggcgtcggaggaggtcggggtaggtgacgtagttgtagggggagttggggaagagtcgcgtaggcgtcggaggaggtcgtgggaggtgacgtagttgtagggggagttggggaagagtcgcgtaggcgtcggaggaggtcgtgggaggtgacgtagttgtagggggagttggggaagagtcgcgtaggcgtcggaggaggtcgtgggaggtgacgtagttgtagggggagttggggaagagtcgcgtaggcgtcggaggaggtcgtgggaggtgacgtagttgtagggggagttggggaagagtcgcgtaggcgtcggagagttttgcggagtatttttttgtgttgagtttcggatttattttttggttttatagacgaggaagttgaggatttgagagttgtata

SEQ ID NO: 20546 - DNA, 593 bp, Artificial Sequence
  chemically treated genomic DNA (Homo sapiens) CpG-island No: 20546
tatacaactctcaaatcctcaacttcctcgtctataaaaccaaaaaataaatccgaaactcaacacaaaaaaatactccgcaaaactctccgacgcctacgcgactcttccccaactccccctacaactacgtcacctcccacgacctcctccgacgcctacgcgactcttccccaactccccctacaactacgtcacctcccacgacctcctccgacgcctacgcgactcttccccaactccccctacaactacgtcacctcccacgacctcctccgacgcctacgcgactcttccccaactccccctacaactacgtcacctcccacgacctcctccgacgcctacgcgactcttccccaactccccctacaactacgtcacctaccccgacctcctccgacgcctacgcgactcttccccaactccccctacaactatatcacctcccacgacctccgacgcctacgcgaccgcgactccgccgttcaaccgcatacgcgacaacgctaaaacccgaaaaacgaaaatctaccgccgctcaacccgaaacccgctcaaaaacctcgttctaccgactcgaacgacaaccg

SEQ ID NO: 20547 - DNA, 593 bp, Artificial Sequence
  chemically treated genomic DNA (Homo sapiens) CpG-island No: 20547
tgtatagtttttagatttttagttttttcgtttgtaaaattaaggaatgaattcgggatttagtatagggggatgtttcgtaagatttttcggcgtttgcgcggtttttttttagttttttttgtagttacgttattttttacggtttttttcggcgtttgcgcggtttttttttagttttttttgtagttacgttattttttacggtttttttcggcgtttgcgcggtttttttttagttttttttgtagttacgttattttttacggtttttttcggcgtttgcgcggtttttttttagttttttttgtagttacgttattttttacggtttttttcggcgtttgcgcggtttttttttagttttttttgtagttacgttatttatttcggtttttttcggcgtttgcgcggtttttttttagttttttttgtagttatgttattttttacggttttcggcgtttgcgcggtcgcggtttcgtcgtttaatcgtatgcgcgatagcgttgaggttcggggagcgaggatttgtcgtcgtttagttcggagttcgtttagaaatttcgttttgtcgattcggacggtagtcg

SEQ ID NO: 20548 - DNA, 593 bp, Artificial Sequence
  chemically treated genomic DNA (Homo sapiens) CpG-island No: 20548
cgactaccgtccgaatcgacaaaacgaaatttctaaacgaactccgaactaaacgacgacaaatcctcgctccccgaacctcaacgctatcgcgcatacgattaaacgacgaaaccgcgaccgcgcaaacgccgaaaaccgtaaaaaataacataactacaaaaaaaactaaaaaaaaaccgcgcaaacgccgaaaaaaaccgaaataaataacgtaactacaaaaaaaactaaaaaaaaaccgcgcaaacgccgaaaaaaaccgtaaaaaataacgtaactacaaaaaaaactaaaaaaaaaccgcgcaaacgccgaaaaaaaccgtaaaaaataacgtaactacaaaaaaaactaaaaaaaaaccgcgcaaacgccgaaaaaaaccgtaaaaaataacgtaactacaaaaaaaactaaaaaaaaaccgcgcaaacgccgaaaaaaaccgtaaaaaataacgtaactacaaaaaaaactaaaaaaaaaccgcgcaaacgccgaaaaatcttacgaaacatccccctatactaaatcccgaattcattccttaattttacaaacgaaaaaactaaaaatctaaaaactataca

SEQ ID NO: 20549 - DNA, 645 bp, Artificial Sequence
  chemically treated genomic DNA (Homo sapiens) CpG-island No: 20549
tcgacgtaatagttgaaagggaaggacgcggagattattcggtattcgttttaggcgtttttagagttttcgtttaggcggttcgtgggggtcggggtcgcggtcgcggtcgcggatcggggatagagtaatggggcgggcgcgtagcgtcggttgtatttttagagttttttatcgtcgttttacggtcgtttagcgcgcgtcgggattgtattttttataggtttacgttgcggagtatcgtttattcgagttttacgcgagtgcgttgtcgcgaggtgtttttgtcgtagttttcgttcgttcgtagagtttttgaaaggcggcgggaggcggcgagcgttatggttagttcgggttgtttgttgtgcgtgttgggtttgttattttgcggggcggcgagtttcgagttgtttagattttacggcgatatcgttaagaagtttattatcggtaaggaggttgtgcggggtcgtagtagacggggaggagttgggtgttggcgttgggcgtttttcgtcgtcgcgttttagttggcgcgtttcgtcgggaaaaatttttagatgtgtttcgtttttggtgtaaggaggaattcgggttgggtattatttaggtcgtattgaaatgtatttggttgaggtattt

SEQ ID NO: 20550 - DNA, 645 bp, Artificial Sequence
  chemically treated genomic DNA (Homo sapiens) CpG-island No: 20550
aaatacctcaaccaaatacatttcaatacgacctaaataatacccaacccgaattcctccttacaccaaaaacgaaacacatctaaaaatttttcccgacgaaacgcgccaactaaaacgcgacgacgaaaaacgcccaacgccaacacccaactcctccccgtctactacgaccccgcacaacctccttaccgataataaacttcttaacgatatcgccgtaaaatctaaacaactcgaaactcgccgccccgcaaaataacaaacccaacacgcacaacaaacaacccgaactaaccataacgctcgccgcctcccgccgcctttcaaaaactctacgaacgaacgaaaactacgacaaaaacacctcgcgacaacgcactcgcgtaaaactcgaataaacgatactccgcaacgtaaacctataaaaaatacaatcccgacgcgcgctaaacgaccgtaaaacgacgataaaaaactctaaaaatacaaccgacgctacgcgcccgccccattactctatccccgatccgcgaccgcgaccgcgaccccgacccccacgaaccgcctaaacgaaaactctaaaaacgcctaaaacgaataccgaataatctccgcgtccttccctttcaactattacgtcga

SEQ ID NO: 20551 - DNA, 645 bp, Artificial Sequence
  chemically treated genomic DNA (Homo sapiens) CpG-island No: 20551
aggtattttaattaggtatattttagtacgatttaaatggtgtttagttcgggtttttttttgtattaaaagcgaagtatatttgggggtttttttcggcgggacgcgttagttggagcgcggcggcgggaggcgtttagcgttaatatttagttttttttcgtttgttgcggtttcgtatagtttttttatcgatgatgggttttttggcggtgtcgtcgtggggtttagatagttcgaggttcgtcgtttcgtagagtagtaggtttagtacgtatagtaggtagttcggattggttatggcgttcgtcgtttttcgtcgttttttaaaagttttgcgggcgggcgggggttgcggtagggatatttcgcggtagcgtattcgcgtgagattcgggtgggcggtgtttcgtagcgtgggtttatgggaaatgtagtttcggcgcgcgttaggcggtcgtggggcggcggtgggaggttttgggagtgtagtcggcgttgcgcgttcgttttattgttttgttttcggttcgcgatcgcgatcgcgatttcgatttttacgggtcgtttaagcggagattttggaaacgtttggggcgggtatcgggtggttttcgcgttttttttttttaattgttacgtcga

SEQ ID NO: 20552 - DNA, 645 bp, Artificial Sequence
  chemically treated genomic DNA (Homo sapiens) CpG-island No: 20552
tcgacgtaacaattaaaaaaaaaaaacgcgaaaaccacccgatacccgccccaaacgtttccaaaatctccgcttaaacgacccgtaaaaatcgaaatcgcgatcgcgatcgcgaaccgaaaacaaaacaataaaacgaacgcgcaacgccgactacactcccaaaacctcccaccgccgccccacgaccgcctaacgcgcgccgaaactacatttcccataaacccacgctacgaaacaccgcccacccgaatctcacgcgaatacgctaccgcgaaatatccctaccgcaacccccgcccgcccgcaaaacttttaaaaaacgacgaaaaacgacgaacgccataaccaatccgaactacctactatacgtactaaacctactactctacgaaacgacgaacctcgaactatctaaaccccacgacgacaccgccaaaaaacccatcatcgataaaaaaactatacgaaaccgcaacaaacgaaaaaaaactaaatattaacgctaaacgcctcccgccgccgcgctccaactaacgcgtcccgccgaaaaaaacccccaaatatacttcgcttttaatacaaaaaaaaacccgaactaaacaccatttaaatcgtactaaaatatacctaattaaaatacct

SEQ ID NO: 20553 - DNA, 500 bp, Artificial Sequence
  chemically treated genomic DNA (Homo sapiens) CpG-island No: 20553
  misc_feature (494)..(494): n is either a, c, g or t
tgtagcggtatatcggtagttttttgcgttaaggcgtcgattaattttataaatcgttgtaaggcgttggtagttcgttcggcgagggtttttttttgtaatagtttacgatatgtttgttagagtgttaattggcgatcgcgcgatgtttgacgtattacgtttagcgttcggttattaatatttcgcgttggcgtatttattatacgtttaaaggtcgcgtcgtcgttgcggttggtaattaggcgtagatacgagagcgtatttttgattttttggcgttcgaagaagcgtatttcgtcgtaaatacggtacggtatattggtttgtaataacgttttttcgagtattcgcgattgggcgttgttgcggtagagaatggcgtattcggtaagcgtttcgtcgttgttttgttaggttttgatgcggttaattataaaacgcgttttatcgagttcgttaaaagcgtaatagagggaaataagtttatcgtncgcgtt

SEQ ID NO: 20554 - DNA, 500 bp, Artificial Sequence
  chemically treated genomic DNA (Homo sapiens) CpG-island No: 20554
  misc_feature (7)..(7): n is either a, c, g or t
aacgcgnacgataaacttatttccctctattacgcttttaacgaactcgataaaacgcgttttataattaaccgcatcaaaacctaacaaaacaacgacgaaacgcttaccgaatacgccattctctaccgcaacaacgcccaatcgcgaatactcgaaaaaacgttattacaaaccaatataccgtaccgtatttacgacgaaatacgcttcttcgaacgccaaaaaatcaaaaatacgctctcgtatctacgcctaattaccaaccgcaacgacgacgcgacctttaaacgtataataaatacgccaacgcgaaatattaataaccgaacgctaaacgtaatacgtcaaacatcgcgcgatcgccaattaacactctaacaaacatatcgtaaactattacaaaaaaaaaccctcgccgaacgaactaccaacgccttacaacgatttataaaattaatcgacgccttaacgcaaaaaactaccgatataccgctaca

SEQ ID NO: 20555 - DNA, 500 bp, Artificial Sequence
  chemically treated genomic DNA (Homo sapiens) CpG-island No: 20555
  misc_feature (7)..(7): n is either a, c, g or t
ggcgcgnacggtgagtttatttttttttattgcgtttttaacgaattcgatgaagcgcgttttgtggttaatcgtattaaaatttggtaggataacggcggagcgtttgtcgagtgcgttattttttatcgtagtaacgtttagtcgcgggtgttcgaagaggcgttattgtaggttagtatgtcgtatcgtatttacggcgggatgcgttttttcgaacgttaggaaattaaagatgcgttttcgtatttgcgtttgattgttaatcgtaacgacgacgcggtttttgagcgtgtggtgaatacgttaacgcggggtattggtgatcggacgttggacgtggtacgttagatatcgcgcgatcgttagttaatattttggtaggtatgtcgtgagttgttgtaggaaaaagttttcgtcgggcgagttgttagcgttttgtagcgatttatggaattaatcgacgttttagcgtaggaaattgtcgatatgtcgttgta

SEQ ID NO: 20556 - DNA, 500 bp, Artificial Sequence
  chemically treated genomic DNA (Homo sapiens) CpG-island No: 20556
  misc_feature (494)..(494): n is either a, c, g or t
tacaacgacatatcgacaatttcctacgctaaaacgtcgattaattccataaatcgctacaaaacgctaacaactcgcccgacgaaaactttttcctacaacaactcacgacatacctaccaaaatattaactaacgatcgcgcgatatctaacgtaccacgtccaacgtccgatcaccaataccccgcgttaacgtattcaccacacgctcaaaaaccgcgtcgtcgttacgattaacaatcaaacgcaaatacgaaaacgcatctttaatttcctaacgttcgaaaaaacgcatcccgccgtaaatacgatacgacatactaacctacaataacgcctcttcgaacacccgcgactaaacgttactacgataaaaaataacgcactcgacaaacgctccgccgttatcctaccaaattttaatacgattaaccacaaaacgcgcttcatcgaattcgttaaaaacgcaataaaaaaaaataaactcaccgtncgcgcc

SEQ ID NO: 20557 - DNA, 653 bp, Artificial Sequence
  chemically treated genomic DNA (Homo sapiens) CpG-island No: 20557
  misc_feature (140)..(140): n is either a, c, g or t
  misc_feature (538)..(538): n is either a, c, g or t
ttacgtcgtattcggtaattaacgtttgatgcgacgttggcgcgttttattaggtttatatcgttgtgaagtgcggtatttcgtaggttagataaggcggttacgtcgtattcgatatttaacgttcgagtcggttgttngttgcgacgttggcgcgttttattaggtttatatcgttgtgaagtgttttatttcgtaggtcggataaggcggttacgtcgtattcgatatttaacgtttaagtcggttgtttgatgcgacgttggcgcgttttattaggtttatatcgttgtgaagtgttttatttcgtaggttggataaggcggttacgtcgtattcgatatttaacgttcgagtcggttgtttgatgcgacgttggcgcgttttattaggtttatatcgttgtgaagtgttttatttcgtaggtcggataaggcggttacgtcgtattcgatatttaacgtttaagtcggttgtttgatgcgacgttggcgcgttttattaggtttatatcgttgtgaagtgttttatttcgtangttggataaggcggttacgtcgtatttaatatttaacgttcgagtcggttgtttgatgcgacgttggcgcgttttattagtatacgttatattcggtatattatgtcggatgtgg

SEQ ID NO: 20558 - DNA, 653 bp, Artificial Sequence
  chemically treated genomic DNA (Homo sapiens) CpG-island No: 20558
  misc_feature (116)..(116): n is either a, c, g or t
  misc_feature (514)..(514): n is either a, c, g or t
ccacatccgacataatataccgaatataacgtatactaataaaacgcgccaacgtcgcatcaaacaaccgactcgaacgttaaatattaaatacgacgtaaccgccttatccaacntacgaaataaaacacttcacaacgatataaacctaataaaacgcgccaacgtcgcatcaaacaaccgacttaaacgttaaatatcgaatacgacgtaaccgccttatccgacctacgaaataaaacacttcacaacgatataaacctaataaaacgcgccaacgtcgcatcaaacaaccgactcgaacgttaaatatcgaatacgacgtaaccgccttatccaacctacgaaataaaacacttcacaacgatataaacctaataaaacgcgccaacgtcgcatcaaacaaccgacttaaacgttaaatatcgaatacgacgtaaccgccttatccgacctacgaaataaaacacttcacaacgatataaacctaataaaacgcgccaacgtcgcaacnaacaaccgactcgaacgttaaatatcgaatacgacgtaaccgccttatctaacctacgaaataccgcacttcacaacgatataaacctaataaaacgcgccaacgtcgcatcaaacgttaattaccgaatacgacgtaa

SEQ ID NO: 20559 - DNA, 653 bp, Artificial Sequence
  chemically treated genomic DNA (Homo sapiens) CpG-island No: 20559
  misc_feature (116)..(116): n is either a, c, g or t
  misc_feature (514)..(514): n is either a, c, g or t
ttatattcggtatggtatgtcggatgtggcgtatgttgataagacgcgttagcgtcgtattaggtaatcggttcgggcgttagatgttggatgcggcgtaatcgttttatttaatntacggggtggagtattttatagcggtgtaggtttgataagacgcgttagcgtcgtattaggtaatcggtttgggcgttagatgtcggatgcggcgtaatcgttttattcgatttacggggtggagtattttatagcggtgtaggtttgataagacgcgttagcgtcgtattaggtaatcggttcggacgttggatgtcggatgcggcgtaatcgttttatttaatttacggggtggagtattttatagcggtgtaggtttgataagacgcgttagcgtcgtattaggtaatcggtttgggcgttagatgtcggatgcggcgtaatcgttttattcgatttacggggtggagtattttatagcggtgtaggtttgataagacgcgttagcgtcgtaatnggtaatcggttcgggcgttggatgtcggatgcggcgtgatcgttttgtttgatttacggggtgtcgtattttatagcggtgtaggtttgataagacgcgttagcgtcgtattaggcgttgattgtcggatgcggcgtga

SEQ ID NO: 20560 - DNA, 653 bp, Artificial Sequence
  chemically treated genomic DNA (Homo sapiens) CpG-island No: 20560
  misc_feature (140)..(140): n is either a, c, g or t
  misc_feature (538)..(538): n is either a, c, g or t
tcacgccgcatccgacaatcaacgcctaatacgacgctaacgcgtcttatcaaacctacaccgctataaaatacgacaccccgtaaatcaaacaaaacgatcacgccgcatccgacatccaacgcccgaaccgattaccnattacgacgctaacgcgtcttatcaaacctacaccgctataaaatactccaccccgtaaatcgaataaaacgattacgccgcatccgacatctaacgcccaaaccgattacctaatacgacgctaacgcgtcttatcaaacctacaccgctataaaatactccaccccgtaaattaaataaaacgattacgccgcatccgacatccaacgtccgaaccgattacctaatacgacgctaacgcgtcttatcaaacctacaccgctataaaatactccaccccgtaaatcgaataaaacgattacgccgcatccgacatctaacgcccaaaccgattacctaatacgacgctaacgcgtcttatcaaacctacaccgctataaaatactccaccccgtanattaaataaaacgattacgccgcatccaacatctaacgcccgaaccgattacctaatacgacgctaacgcgtcttatcaacatacgccacatccgacataccataccgaatataa

SEQ ID NO: 20561 - DNA, 738 bp, Artificial Sequence
  chemically treated genomic DNA (Homo sapiens) CpG-island No: 20561
agtttcgtcgcgttatgtttgagtcgggcgcgtttcggttcgtgtttcgtcgtcgtttttcggttttcgcgtcgtttcggagttcgggtcgtagtttgcgtcgttcgtagcggttttgagttcggtttcgtcgatcggtttttggagttcgaacgttgttcggggacgaaggcgtaggaagcgcgtagggaacgagatcgaaggaaggagcgggaaggagagcgtagtcgtcgtttggttttgcgcgtttcgggagcgtcgtgcggttttgttcgcgggtttcgggtgtgcgcggggcggcgtcgcggaatatgacggcgttttgggtggttttcgtttttttttggggatcgttgtgcgtcggtaagaattgggcgcggcgcggggacgtcgagagggcgcgcggggttggtttttggcgtcgcgcggtgtttattaataaagggcgggttcggggtttcgtcgtcgtattatttgtatttagtttttattttcgggggcgtgggttgggggcgcggtgggcgttcggttcgtcgaatttgggggtacgattttgtttgtgtagttatttgcgggattttggtttttagaggcgtttttgcgatgggggtcgggacgcggagttttagggtcggagttcgggttacgcgggcgcgtggaatttagggaaagagtgaggaaaatttgagtttggggaaggcggttaagaggggtgggtagattttattgggggtggta

SEQ ID NO: 20562 - DNA, 738 bp, Artificial Sequence
  chemically treated genomic DNA (Homo sapiens) CpG-island No: 20562
taccacccccaataaaatctacccacccctcttaaccgccttccccaaactcaaattttcctcactctttccctaaattccacgcgcccgcgtaacccgaactccgaccctaaaactccgcgtcccgacccccatcgcaaaaacgcctctaaaaaccaaaatcccgcaaataactacacaaacaaaatcgtacccccaaattcgacgaaccgaacgcccaccgcgcccccaacccacgcccccgaaaataaaaactaaatacaaataatacgacgacgaaaccccgaacccgccctttattaataaacaccgcgcgacgccaaaaaccaaccccgcgcgccctctcgacgtccccgcgccgcgcccaattcttaccgacgcacaacgatccccaaaaaaaaacgaaaaccacccaaaacgccgtcatattccgcgacgccgccccgcgcacacccgaaacccgcgaacaaaaccgcacgacgctcccgaaacgcgcaaaaccaaacgacgactacgctctccttcccgctccttccttcgatctcgttccctacgcgcttcctacgccttcgtccccgaacaacgttcgaactccaaaaaccgatcgacgaaaccgaactcaaaaccgctacgaacgacgcaaactacgacccgaactccgaaacgacgcgaaaaccgaaaaacgacgacgaaacacgaaccgaaacgcgcccgactcaaacataacgcgacgaaact

SEQ ID NO: 20563 - DNA, 738 bp, Artificial Sequence
  chemically treated genomic DNA (Homo sapiens) CpG-island No: 20563
tgttatttttaatgagatttgtttattttttttggtcgttttttttaggtttaggttttttttattttttttttgggttttacgcgttcgcgtagttcgaatttcgattttgaggtttcgcgtttcggtttttatcgtaggggcgtttttaggaattagaatttcgtagatgattatatagataagatcgtgtttttaagttcggcgagtcgggcgtttatcgcgtttttagtttacgttttcggaggtgagggttgaatataggtggtgcggcgacgaggtttcgggttcgttttttgttggtaaatatcgcgcggcgttagaggttagtttcgcgcgttttttcggcgttttcgcgtcgcgtttagtttttatcggcgtatagcgatttttagaggagggcgagggttatttagggcgtcgttatgtttcgcggcgtcgtttcgcgtatattcggagttcgcgggtagggtcgtacggcgttttcggggcgcgtagggttaggcggcggttgcgttttttttttcgttttttttttcggtttcgttttttgcgcgttttttgcgttttcgttttcgagtagcgttcgggttttaagggtcggtcggcggggtcgggtttagggtcgttgcgggcggcgtaggttgcggttcgggtttcggggcgacgcgggggtcggggggcggcggcggggtacgggtcggggcgcgttcgatttaggtatagcgcggcggggtt

SEQ ID NO: 20564 - DNA, 738 bp, Artificial Sequence
  chemically treated genomic DNA (Homo sapiens) CpG-island No: 20564
aaccccgccgcgctatacctaaatcgaacgcgccccgacccgtaccccgccgccgccccccgacccccgcgtcgccccgaaacccgaaccgcaacctacgccgcccgcaacgaccctaaacccgaccccgccgaccgacccttaaaacccgaacgctactcgaaaacgaaaacgcaaaaaacgcgcaaaaaacgaaaccgaaaaaaaaaacgaaaaaaaaaacgcaaccgccgcctaaccctacgcgccccgaaaacgccgtacgaccctacccgcgaactccgaatatacgcgaaacgacgccgcgaaacataacgacgccctaaataaccctcgccctcctctaaaaatcgctatacgccgataaaaactaaacgcgacgcgaaaacgccgaaaaaacgcgcgaaactaacctctaacgccgcgcgatatttaccaacaaaaaacgaacccgaaacctcgtcgccgcaccacctatattcaaccctcacctccgaaaacgtaaactaaaaacgcgataaacgcccgactcgccgaacttaaaaacacgatcttatctatataatcatctacgaaattctaattcctaaaaacgcccctacgataaaaaccgaaacgcgaaacctcaaaatcgaaattcgaactacgcgaacgcgtaaaacccaaaaaaaaaataaaaaaaacctaaacctaaaaaaaacgaccaaaaaaaataaacaaatctcattaaaaataaca

SEQ ID NO: 20565 - DNA, 505 bp, Artificial Sequence
  chemically treated genomic DNA (Homo sapiens) CpG-island No: 20565
ggcgggaggcggcgtttagttaaggataatagaagattacgtcgcgtgggttaaaggaaatagtttcgttaataaataagtttttggtcgacgtattttattttttttatttatataagattttatttttttttcggagtcgcggaggttgttttgttaaattgtttggattacgacgattttttaggaggtcgggtcgtttatttaatatggcggtttcggttaattttgttagtcgggtttggagaacggaaagttcggagggattagaatttttgtattcgataagtttgtcggtaattttcgttagtcgattagagggcggagttgaggtcggtttagttcggaggcgggaaggataatttggattcgtagtttcgtcggaagtggttttagtttcgaggtcgggcgttttcggttattttcggcgtttttagggttggttttcgttattttcgggagtcgtggaggtacgaatttaagatatgtttattttattaattta

SEQ ID NO: 20566 - DNA, 505 bp, Artificial Sequence
  chemically treated genomic DNA (Homo sapiens) CpG-island No: 20566
taaattaataaaataaacatatcttaaattcgtacctccacgactcccgaaaataacgaaaaccaaccctaaaaacgccgaaaataaccgaaaacgcccgacctcgaaactaaaaccacttccgacgaaactacgaatccaaattatccttcccgcctccgaactaaaccgacctcaactccgccctctaatcgactaacgaaaattaccgacaaacttatcgaatacaaaaattctaatccctccgaactttccgttctccaaacccgactaacaaaattaaccgaaaccgccatattaaataaacgacccgacctcctaaaaaatcgtcgtaatccaaacaatttaacaaaacaacctccgcgactccgaaaaaaaaataaaatcttatataaataaaaaaaataaaatacgtcgaccaaaaacttatttattaacgaaactatttcctttaacccacgcgacgtaatcttctattatccttaactaaacgccgcctcccgcc

SEQ ID NO: 20567 - DNA, 505 bp, Artificial Sequence
  chemically treated genomic DNA (Homo sapiens) CpG-island No: 20567
taaattaataaaataggtatgttttaagttcgtatttttacggttttcgaagatgacgggaattagttttagaagcgtcggagatgatcgaagacgttcggtttcgaggttggggttattttcggcggaattgcgggtttaagttgtttttttcgttttcgggttgggtcgattttagtttcgttttttggtcggttgacggaaattgtcgataaatttgtcgaatgtaaggattttagttttttcgggtttttcgttttttaggttcggttgatagagttagtcgaggtcgttatattgaataagcgattcggttttttagggggtcgtcgtggtttagatagtttagtagaatagttttcgcggtttcggggagaaggtgaggttttgtatggatgggaagggtgaggtgcgtcggttagaggtttatttattgacgggattgttttttttggtttacgcgacgtagttttttgttgtttttgattgggcgtcgtttttcgtt

SEQ ID NO: 20568 - DNA, 505 bp, Artificial Sequence
  chemically treated genomic DNA (Homo sapiens) CpG-island No: 20568
aacgaaaaacgacgcccaatcaaaaacaacaaaaaactacgtcgcgtaaaccaaaaaaaacaatcccgtcaataaataaacctctaaccgacgcacctcacccttcccatccatacaaaacctcaccttctccccgaaaccgcgaaaactattctactaaactatctaaaccacgacgaccccctaaaaaaccgaatcgcttattcaatataacgacctcgactaactctatcaaccgaacctaaaaaacgaaaaacccgaaaaaactaaaatccttacattcgacaaatttatcgacaatttccgtcaaccgaccaaaaaacgaaactaaaatcgacccaacccgaaaacgaaaaaaacaacttaaacccgcaattccgccgaaaataaccccaacctcgaaaccgaacgtcttcgatcatctccgacgcttctaaaactaattcccgtcatcttcgaaaaccgtaaaaatacgaacttaaaacatacctattttattaattta

SEQ ID NO: 20569 - DNA, 552 bp, Artificial Sequence
  chemically treated genomic DNA (Homo sapiens) CpG-island No: 20569
tttgcgttcggggattagacgggaggtggagttgcgcggggagggcgggcgagtcgggcgttcgttttgagagtcggtttttttttttttttttgcgtggggcggggtggtgcgtttcgagtttttaggagttcgacgcgggcgggtgtcgaggggaggggagtggcggcggcggcgggcggttttcgttttagtttcggtagtggcgtcggcgacggcggtgtcgaggtagtcgttagcgttcggttaagtgttagtcggtagcgacggcgttagagttgggagttggggacgcgcgcgtcggattttttatagttttcgtttagagtttgaggcgtcggggtcgggggagtcggggggcgggcgggcgagcgggtcggggggagggtgggggatggcgcggattttgcggtcgttttcgttgtgttttggaggcggtaaagtataattttttttcgttttttttttcggagtcgggtttttgttgtagttttcgacgttattttcgttgttgttgttgtttttttcgttgttgtttttttttaggttttg

SEQ ID NO: 20570 - DNA, 552 bp, Artificial Sequence
  chemically treated genomic DNA (Homo sapiens) CpG-island No: 20570
caaaacctaaaaaaaaacaacaacgaaaaaaacaacaacaacaacgaaaataacgtcgaaaactacaacaaaaacccgactccgaaaaaaaaaacgaaaaaaaattatactttaccgcctccaaaacacaacgaaaacgaccgcaaaatccgcgccatcccccaccctccccccgacccgctcgcccgcccgccccccgactcccccgaccccgacgcctcaaactctaaacgaaaactataaaaaatccgacgcgcgcgtccccaactcccaactctaacgccgtcgctaccgactaacacttaaccgaacgctaacgactacctcgacaccgccgtcgccgacgccactaccgaaactaaaacgaaaaccgcccgccgccgccgccactcccctcccctcgacacccgcccgcgtcgaactcctaaaaactcgaaacgcaccaccccgccccacgcaaaaaaaaaaaaaaaaaccgactctcaaaacgaacgcccgactcgcccgccctccccgcgcaactccacctcccgtctaatccccgaacgcaaa

SEQ ID NO: 20571 - DNA, 552 bp, Artificial Sequence
  chemically treated genomic DNA (Homo sapiens) CpG-island No: 20571
tagagtttggagaagagtagtagcgggaagagtagtagtagtagcggaggtggcgtcgggggttgtagtaggagttcggtttcgaggagagaagcggaggaaagttgtgttttgtcgtttttaggatatagcggggacggtcgtagggttcgcgttattttttatttttttttcggttcgttcgttcgttcgtttttcggttttttcggtttcggcgttttaggttttgggcggaggttgtggaaggttcggcgcgcgcgtttttagtttttagttttagcgtcgtcgttgtcggttgatatttggtcgaacgttggcggttgtttcgatatcgtcgtcgtcgacgttattgtcgaggttgaagcgggagtcgttcgtcgtcgtcgttattttttttttttcggtattcgttcgcgtcgaatttttgggaattcggaacgtattatttcgttttacgtaagagggggaaaagaaatcgatttttagagcgggcgttcgattcgttcgtttttttcgcgtaattttatttttcgtttgattttcgggcgtaag

SEQ ID NO: 20572 - DNA, 552 bp, Artificial Sequence
  chemically treated genomic DNA (Homo sapiens) CpG-island No: 20572
cttacgcccgaaaatcaaacgaaaaataaaattacgcgaaaaaaacgaacgaatcgaacgcccgctctaaaaatcgatttcttttccccctcttacgtaaaacgaaataatacgttccgaattcccaaaaattcgacgcgaacgaataccgaaaaaaaaaaaataacgacgacgacgaacgactcccgcttcaacctcgacaataacgtcgacgacgacgatatcgaaacaaccgccaacgttcgaccaaatatcaaccgacaacgacgacgctaaaactaaaaactaaaaacgcgcgcgccgaaccttccacaacctccgcccaaaacctaaaacgccgaaaccgaaaaaaccgaaaaacgaacgaacgaacgaaccgaaaaaaaaataaaaaataacgcgaaccctacgaccgtccccgctatatcctaaaaacgacaaaacacaactttcctccgcttctctcctcgaaaccgaactcctactacaacccccgacgccacctccgctactactactactcttcccgctactactcttctccaaactcta

SEQ ID NO: 20573 - DNA, 730 bp, Artificial Sequence
  chemically treated genomic DNA (Homo sapiens) CpG-island No: 20573
cgcgttcgtcgttcgttcgggtttagtttcgggatttaggagtttttttcgtcgtcgtttttcggtgttcgttatcgtttttcggtgttcgtcgttttcgcgggttcggcgcgttgttttcggggcgttagtcgatttcgcggtcgggatttatcgagtagtaggagtcggtgcgtttgttgtaggtcgcgtttttggtcgcgtagtatgcggtcgatgtttcggtttatttttttcgtttttttgatcgtttcgcgttttttggtcgtttcgcgtttttcggtatttagttgttcggtgcgttgtcgtttttttttcggtttgtttgttttgggtcgagcgtatgtcgggtttttttcgtcgtttcgagggagtagggttcgggtcgtgttttttgcggtcgttcggattggggttagggtcggggtcggggcgggttgcgcgttttttatcggcggtttcgaggtcgcgtaggggtcgttttttgggttttcgaaaagtagcggtcgtagattgtagtatagatttatgtgggcgcggtatagcgggggcggcgcgcgggattagggtaggttgggcgtcgagggcggtttggttttcgcgtttagtttaggtcggcgttttagcggaggggcgggagggggttgtattcggattttgttcggcgttgtcggtcgttagttgcgggaagggggtgcggtaggtcggggtcgagggttatagtttttta

SEQ ID NO: 20574 - DNA, 730 bp, Artificial Sequence
  chemically treated genomic DNA (Homo sapiens) CpG-island No: 20574
taaaaaactataaccctcgaccccgacctaccgcacccccttcccgcaactaacgaccgacaacgccgaacaaaatccgaatacaaccccctcccgcccctccgctaaaacgccgacctaaactaaacgcgaaaaccaaaccgccctcgacgcccaacctaccctaatcccgcgcgccgcccccgctataccgcgcccacataaatctatactacaatctacgaccgctacttttcgaaaacccaaaaaacgacccctacgcgacctcgaaaccgccgataaaaaacgcgcaacccgccccgaccccgaccctaaccccaatccgaacgaccgcaaaaaacacgacccgaaccctactccctcgaaacgacgaaaaaaacccgacatacgctcgacccaaaacaaacaaaccgaaaaaaaaacgacaacgcaccgaacaactaaataccgaaaaacgcgaaacgaccaaaaaacgcgaaacgatcaaaaaaacgaaaaaaataaaccgaaacatcgaccgcatactacgcgaccaaaaacgcgacctacaacaaacgcaccgactcctactactcgataaatcccgaccgcgaaatcgactaacgccccgaaaacaacgcgccgaacccgcgaaaacgacgaacaccgaaaaacgataacgaacaccgaaaaacgacgacgaaaaaaactcctaaatcccgaaactaaacccgaacgaacgacgaacgcg

SEQ ID NO: 20575 - DNA, 730 bp, Artificial Sequence
  chemically treated genomic DNA (Homo sapiens) CpG-island No: 20575
tgaggggttgtggttttcggtttcggtttgtcgtatttttttttcgtagttggcggtcggtagcgtcgaatagggttcgggtgtagttttttttcgttttttcgttgaggcgtcggtttgaattgggcgcgggaattaggtcgttttcggcgtttagtttgttttagtttcgcgcgtcgttttcgttgtgtcgcgtttatatgggtttgtgttatagtttgcggtcgttgtttttcgggggtttaggggacgatttttgcgcggtttcggagtcgtcggtggaggacgcgtagttcgtttcggtttcggttttggttttagttcgggcggtcgtaagggatacggttcggattttgttttttcggggcggcgaagggagttcggtatgcgttcggtttaaagtagataagtcgaaggagaagcggtagcgtatcgagtagttgagtgtcgaggagcgcgaggcggttaaggagcgcgaggcggttaaggaggcgaggaaagtgagtcggggtatcgatcgtatgttgcgcgattagaagcgcgatttgtagtagacgtatcggtttttgttgttcggtaggtttcggtcgcgaggtcggttgacgtttcggggatagcgcgtcgggttcgcgggggcggcgggtatcggggagcggtggcgggtatcggggagcggcggcgggaggggtttttgaatttcgggattggattcggacgggcggcgggcgcg

SEQ ID NO: 20576 - DNA, 730 bp, Artificial Sequence
  chemically treated genomic DNA (Homo sapiens) CpG-island No: 20576
cgcgcccgccgcccgtccgaatccaatcccgaaattcaaaaacccctcccgccgccgctccccgatacccgccaccgctccccgatacccgccgcccccgcgaacccgacgcgctatccccgaaacgtcaaccgacctcgcgaccgaaacctaccgaacaacaaaaaccgatacgtctactacaaatcgcgcttctaatcgcgcaacatacgatcgataccccgactcactttcctcgcctccttaaccgcctcgcgctccttaaccgcctcgcgctcctcgacactcaactactcgatacgctaccgcttctccttcgacttatctactttaaaccgaacgcataccgaactcccttcgccgccccgaaaaaacaaaatccgaaccgtatcccttacgaccgcccgaactaaaaccaaaaccgaaaccgaaacgaactacgcgtcctccaccgacgactccgaaaccgcgcaaaaatcgtcccctaaacccccgaaaaacaacgaccgcaaactataacacaaacccatataaacgcgacacaacgaaaacgacgcgcgaaactaaaacaaactaaacgccgaaaacgacctaattcccgcgcccaattcaaaccgacgcctcaacgaaaaaacgaaaaaaaactacacccgaaccctattcgacgctaccgaccgccaactacgaaaaaaaaatacgacaaaccgaaaccgaaaaccacaacccctca

SEQ ID NO: 20577 - DNA, 536 bp, Artificial Sequence
  chemically treated genomic DNA (Homo sapiens) CpG-island No: 20577
cgtcgtttttttatttatttaggcgaggtggtttggatttgtatttcgttgaagaagttttttatgcgatattttcgttagtatttcgcgcggatttggttgggcggcggcggggagttagtttgttatcgtacggcggtcgggatcgtagtttttgggtgcgtagtgcgtttttcgttgcgtttttttagagcgcgggtttcgtgtttgtgttcggcgcgacgcgatttttttgttagtcgggtttcgcgtgtttttcgcgtttttcgtagttttcgcgtagttcgtagcgttttttagtttcgtttcgcggtcgcgggaattcggcgtttgtagtttcgttcggaatcgatcgttaggcgttgttgtcgtcggttacgtaacgcggggtttttgtttggtattagttttaggtgttttgtttcgggtcgtgttgtcgcgcgatattggggatttaataggtcgtcggttatttagttggtttcgtagtttttttgcggtttagcggttttttatttaggagaaaattatatttg

SEQ ID NO: 20578 - DNA, 536 bp, Artificial Sequence
  chemically treated genomic DNA (Homo sapiens) CpG-island No: 20578
caaatataattttctcctaaataaaaaaccgctaaaccgcaaaaaaactacgaaaccaactaaataaccgacgacctattaaatccccaatatcgcgcgacaacacgacccgaaacaaaacacctaaaactaataccaaacaaaaaccccgcgttacgtaaccgacgacaacaacgcctaacgatcgattccgaacgaaactacaaacgccgaattcccgcgaccgcgaaacgaaactaaaaaacgctacgaactacgcgaaaactacgaaaaacgcgaaaaacacgcgaaacccgactaacaaaaaaatcgcgtcgcgccgaacacaaacacgaaacccgcgctctaaaaaaacgcaacgaaaaacgcactacgcacccaaaaactacgatcccgaccgccgtacgataacaaactaactccccgccgccgcccaaccaaatccgcgcgaaatactaacgaaaatatcgcataaaaaacttcttcaacgaaatacaaatccaaaccacctcgcctaaataaataaaaaaacgacg

SEQ ID NO: 20579 - DNA, 536 bp, Artificial Sequence
  chemically treated genomic DNA (Homo sapiens) CpG-island No: 20579
taaatgtggtttttttttgggtgggaggtcgttgagtcgtagggaagttgcggggttagttgagtagtcggcggtttgttgggtttttagtgtcgcgcgatagtacgattcgagataaggtatttggggttggtgttaggtagaggtttcgcgttgcgtggtcggcggtaatagcgtttggcggtcggtttcgggcggggttgtaggcgtcgggttttcgcggtcgcgaggcggggttggagggcgttgcgggttgcgcggaggttgcgggaagcgcggggagtacgcggagttcgattagtagggagatcgcgtcgcgtcgggtataggtacgggattcgcgttttaggagggcgtagcgagaggcgtattgcgtatttaggggttgcggtttcggtcgtcgtgcggtgataagttgatttttcgtcgtcgtttagttaagttcgcgcggggtgttggcggagatgtcgtatgggaggtttttttaacgaggtgtaaatttaagttatttcgtttgagtgaatgaagggacggcg

SEQ ID NO: 20580 - DNA, 536 bp, Artificial Sequence
  chemically treated genomic DNA (Homo sapiens) CpG-island No: 20580
cgccgtcccttcattcactcaaacgaaataacttaaatttacacctcgttaaaaaaacctcccatacgacatctccgccaacaccccgcgcgaacttaactaaacgacgacgaaaaatcaacttatcaccgcacgacgaccgaaaccgcaacccctaaatacgcaatacgcctctcgctacgccctcctaaaacgcgaatcccgtacctatacccgacgcgacgcgatctccctactaatcgaactccgcgtactccccgcgcttcccgcaacctccgcgcaacccgcaacgccctccaaccccgcctcgcgaccgcgaaaacccgacgcctacaaccccgcccgaaaccgaccgccaaacgctattaccgccgaccacgcaacgcgaaacctctacctaacaccaaccccaaataccttatctcgaatcgtactatcgcgcgacactaaaaacccaacaaaccgccgactactcaactaaccccgcaacttccctacgactcaacgacctcccacccaaaaaaaaaccacattta

SEQ ID NO: 20581 - DNA, 538 bp, Artificial Sequence
  chemically treated genomic DNA (Homo sapiens) CpG-island No: 20581
gacgatgttcgcgtgattttgtaggacgaattcgtggtttagtattggggggtttttggtgttttttttgcgaatcgttatggtggggtcgtcgttcgcgtttgtaggtgtttcgtttcggttttgttttttttagttgtttatcgattcgtcgtcgtttttcgttggttgttttttacggtttcgttgtagtcgttcgttggggttttattttttattttatagttagtacgtagtcgtcgggtcgttcgggggaaaaaaaaaaaatataatagttagttcgtagcgggggcgagtatgcgtattagggagacgacgttttttggtgtcgcggtcgttttcgcgagtttatagcgttatttggggatcggaggtcgttggttcgcggtcgggcgagcgtgtaggaatgtgagcggcgtttttttgtttcgcgtcgggttcgggtttgggagtcgtttgaggcgcgagttttttgcgtttgtttagtagtttgaggtcgcggtcgggtgtttttttgtttttttggttatttagggat

SEQ ID NO: 20582 - DNA, 538 bp, Artificial Sequence
  chemically treated genomic DNA (Homo sapiens) CpG-island No: 20582
atccctaaataaccaaaaaaacaaaaaaacacccgaccgcgacctcaaactactaaacaaacgcaaaaaactcgcgcctcaaacgactcccaaacccgaacccgacgcgaaacaaaaaaacgccgctcacattcctacacgctcgcccgaccgcgaaccaacgacctccgatccccaaataacgctataaactcgcgaaaacgaccgcgacaccaaaaaacgtcgtctccctaatacgcatactcgcccccgctacgaactaactattatattttttttttttcccccgaacgacccgacgactacgtactaactataaaataaaaaataaaaccccaacgaacgactacaacgaaaccgtaaaaaacaaccaacgaaaaacgacgacgaatcgataaacaactaaaaaaaacaaaaccgaaacgaaacacctacaaacgcgaacgacgaccccaccataacgattcgcaaaaaaaacaccaaaaaccccccaatactaaaccacgaattcgtcctacaaaatcacgcgaacatcgtc

SEQ ID NO: 20583 - DNA, 538 bp, Artificial Sequence
  chemically treated genomic DNA (Homo sapiens) CpG-island No: 20583
atttttggatggttaggagggtaggagggtattcggtcgcggttttaggttgttgagtaggcgtaggaagttcgcgttttaaacgatttttaaattcgggttcggcgcgaagtagggaagcgtcgtttatatttttgtacgttcgttcggtcgcgggttagcggttttcggtttttaggtggcgttgtgggttcgcggaggcggtcgcggtattagggagcgtcgtttttttggtgcgtatgttcgttttcgttgcgggttagttgttgtgttttttttttttttttcgggcggttcggcggttgcgtattggttgtgggatgggaagtgaagttttagcgagcggttgtagcggggtcgtgaggagtagttagcgggaggcggcggcgagtcggtgagtagttgggaagagtagaatcggggcggagtatttgtaggcgcgggcggcggttttattatggcgattcgtaagaaaagtattaagagttttttagtgttgagttacgaattcgttttgtagaattacgcggatatcgtt

SEQ ID NO: 20584 - DNA, 538 bp, Artificial Sequence
  chemically treated genomic DNA (Homo sapiens) CpG-island No: 20584
aacgatatccgcgtaattctacaaaacgaattcgtaactcaacactaaaaaactcttaatacttttcttacgaatcgccataataaaaccgccgcccgcgcctacaaatactccgccccgattctactcttcccaactactcaccgactcgccgccgcctcccgctaactactcctcacgaccccgctacaaccgctcgctaaaacttcacttcccatcccacaaccaatacgcaaccgccgaaccgcccgaaaaaaaaaaaaaaaacacaacaactaacccgcaacgaaaacgaacatacgcaccaaaaaaacgacgctccctaataccgcgaccgcctccgcgaacccacaacgccacctaaaaaccgaaaaccgctaacccgcgaccgaacgaacgtacaaaaatataaacgacgcttccctacttcgcgccgaacccgaatttaaaaatcgtttaaaacgcgaacttcctacgcctactcaacaacctaaaaccgcgaccgaataccctcctaccctcctaaccatccaaaaat

SEQ ID NO: 20585 - DNA, 874 bp, Artificial Sequence
  chemically treated genomic DNA (Homo sapiens) CpG-island No: 20585
ggtgtttacgggattgataggtaggtaggtaggtcgcgggttgggattcggatattaaagtaaaagtatcgttgggcgtcggaggagtcgcggggtttttattttttttttgattgatttttaaattttaatttgtatttttttcgtcgtttcgttttttttttttcgatttcgttttatcgtttttcggtttttttgtttttttttttttttcggttttttttttcgcgttttttttttttgcgttttcggtttgttttttttttttttttttcgtttttttttttttttttttttttttttttcggtttttttcgttttttttttttttttttttttttttcgttttttttttttgcgttttcgttttttgtttttttttttcgtgtttgtagacgcgcggatcgtttatgcgtttttcgcgggtagaatgttgggtagtagcgttaagagcgtgtagttcgaggtggagttgagtagcggcggcggcgacgagggcgcggacgaatcgcggggcgtcggtaggaaggcggtagcggcggacggtagaggtatgttgtttaagcgcgttaaggcgttcggcggcggcggcggtatggttaaggttagcgcggttgagttgaaggtttttaagttcggtagcgtggatagtcgtgttttcggcgggtcgttcgtttttaatttgcgtaagtagaagttatttattaatttttttttttttacggatttcgagaaaaagttgtagttttatgagttcgaatggagcgacgatatggttaaggcgtttaaaggtttaggtaaggtggggtttaagggtcgtgaagtttcgttgatgtttaagacgttgtttaagtcggagtattcgtttttttag

SEQ ID NO: 20586 - DNA, 874 bp, Artificial Sequence
  chemically treated genomic DNA (Homo sapiens) CpG-island No: 20586
ctaaaaaaacgaatactccgacttaaacaacgtcttaaacatcaacgaaacttcacgacccttaaaccccaccttacctaaacctttaaacgccttaaccatatcgtcgctccattcgaactcataaaactacaactttttctcgaaatccgtaaaaaaaaaaaaattaataaataacttctacttacgcaaattaaaaacgaacgacccgccgaaaacacgactatccacgctaccgaacttaaaaaccttcaactcaaccgcgctaaccttaaccataccgccgccgccgccgaacgccttaacgcgcttaaacaacatacctctaccgtccgccgctaccgccttcctaccgacgccccgcgattcgtccgcgccctcgtcgccgccgccgctactcaactccacctcgaactacacgctcttaacgctactacccaacattctacccgcgaaaaacgcataaacgatccgcgcgtctacaaacacgaaaaaaaaaaacaaaaaacgaaaacgcaaaaaaaaaaaacgaaaaaaaaaaaaaaaaaaaaaaaaaacgaaaaaaaccgaaaaaaaaaaaaaaaaaaaaaaaaaaaaacgaaaaaaaaaaaaaaaaaacaaaccgaaaacgcaaaaaaaaaaaacgcgaaaaaaaaaaccgaaaaaaaaaaaaaaacaaaaaaaccgaaaaacgataaaacgaaatcgaaaaaaaaaaaacgaaacgacgaaaaaaatacaaattaaaatttaaaaatcaatcaaaaaaaaaataaaaaccccgcgactcctccgacgcccaacgatacttttactttaatatccgaatcccaacccgcgacctacctacctacctatcaatcccgtaaacacc

SEQ ID NO: 20587 - DNA, 874 bp, Artificial Sequence
  chemically treated genomic DNA (Homo sapiens) CpG-island No: 20587
ttggaagagcgagtgtttcgatttggatagcgttttggatattagcggagttttacggtttttggattttattttgtttaagtttttgggcgttttggttatatcgtcgttttattcgggtttataaagttgtagttttttttcggagttcgtgagaaaagagaggttggtgagtgatttttgtttgcgtaggttggaggcgggcggttcgtcggggatacggttgtttacgttgtcggatttgaagatttttagtttagtcgcgttggttttggttatgtcgtcgtcgtcgtcgggcgttttggcgcgtttgggtagtatgtttttgtcgttcgtcgttgtcgtttttttgtcggcgtttcgcggttcgttcgcgttttcgtcgtcgtcgtcgttgtttagttttatttcgggttgtacgtttttgacgttgttgtttagtattttgttcgcgaggagcgtatggacgattcgcgcgtttgtaggtacggggggagggggtagggggcgggagcgtaggaggaggaggcgggggaggaggagggggagagagaggacggaagaaatcgaggaagaaggggagagaagggggagagagcgagggaggagggagagaggtaagtcgagggcgtaggggaaagaaacgcgaggaaggaagtcgggaaaaaggaaagagtagggaagtcggggagcgatagggcggggtcggaggaaaaggggcggggcggcggggaaaatataaattaaaatttaaaaattagttaaaggaaggatggaagtttcgcggttttttcggcgtttagcggtgtttttgttttggtgttcggattttagttcgcggtttgtttgtttgtttgttagtttcgtggatatt

SEQ ID NO: 20588 - DNA, 874 bp, Artificial Sequence
  chemically treated genomic DNA (Homo sapiens) CpG-island No: 20588
aatatccacgaaactaacaaacaaacaaacaaaccgcgaactaaaatccgaacaccaaaacaaaaacaccgctaaacgccgaaaaaaccgcgaaacttccatccttcctttaactaatttttaaattttaatttatattttccccgccgccccgccccttttcctccgaccccgccctatcgctccccgacttccctactctttcctttttcccgacttccttcctcgcgtttctttcccctacgccctcgacttacctctctccctcctccctcgctctctcccccttctctccccttcttcctcgatttcttccgtcctctctctccccctcctcctcccccgcctcctcctcctacgctcccgccccctaccccctccccccgtacctacaaacgcgcgaatcgtccatacgctcctcgcgaacaaaatactaaacaacaacgtcaaaaacgtacaacccgaaataaaactaaacaacgacgacgacgacgaaaacgcgaacgaaccgcgaaacgccgacaaaaaaacgacaacgacgaacgacaaaaacatactacccaaacgcgccaaaacgcccgacgacgacgacgacataaccaaaaccaacgcgactaaactaaaaatcttcaaatccgacaacgtaaacaaccgtatccccgacgaaccgcccgcctccaacctacgcaaacaaaaatcactcaccaacctctcttttctcacgaactccgaaaaaaaactacaactttataaacccgaataaaacgacgatataaccaaaacgcccaaaaacttaaacaaaataaaatccaaaaaccgtaaaactccgctaatatccaaaacgctatccaaatcgaaacactcgctcttccaa

SEQ ID NO: 20589 - DNA, 740 bp, Artificial Sequence
  chemically treated genomic DNA (Homo sapiens) CpG-island No: 20589
gttcgcgtttttcgcggtgttttcgtttttgggttgcgttagttcgaggcggtgtcggtttttttgttttttcgagtcgtagatgttgcgggcgttttcgggaaaagatttgggcggcgcgttcgttcggtaagttttgagtatttagggacgcggtggcgacgcggttagtgagtcggttttttttagttcgttgtttttttcggttatttttttttgcgaggggtattagcgtggggaggttgggcgttattcgcggagggtagttcgttggcggtcgttttttatttttaatttttattggagattttttatttcgggatcgttcgcgcgggcgtggtcgggtttcgcgtttcgcgtagcggggtggtataggcggttagggagggtttacgtattcggcgcgagttagaagttttcggtcggtttgtagtgtttaagttttatggcgagggtagttcgagtggtcgtcgcggttgtaggttcgtatgtcgggtatcgtattaggcgtttagtaggtaggggtagggaaggtagggttgcgttggcggtcggtgtttagttatcggcgatcggggacgttcggagatatttggtttttcggaagcgtttttcggaaatgggattcgattcggtttgcgggcggcgggtgtttagaagaagaggttgcgggtaagtagtgttttttttttggtttttcggattttttttagttttttcgtggtttgatgggcggtcgg

SEQ ID NO: 20590 - DNA, 740 bp, Artificial Sequence
  chemically treated genomic DNA (Homo sapiens) CpG-island No: 20590
ccgaccgcccatcaaaccacgaaaaaactaaaaaaaatccgaaaaaccaaaaaaaaaacactacttacccgcaacctcttcttctaaacacccgccgcccgcaaaccgaatcgaatcccatttccgaaaaacgcttccgaaaaaccaaatatctccgaacgtccccgatcgccgataactaaacaccgaccgccaacgcaaccctaccttccctacccctacctactaaacgcctaatacgatacccgacatacgaacctacaaccgcgacgaccactcgaactaccctcgccataaaacttaaacactacaaaccgaccgaaaacttctaactcgcgccgaatacgtaaaccctccctaaccgcctataccaccccgctacgcgaaacgcgaaacccgaccacgcccgcgcgaacgatcccgaaataaaaaatctccaataaaaattaaaaataaaaaacgaccgccaacgaactaccctccgcgaataacgcccaacctccccacgctaatacccctcgcaaaaaaaaataaccgaaaaaaacaacgaactaaaaaaaaccgactcactaaccgcgtcgccaccgcgtccctaaatactcaaaacttaccgaacgaacgcgccgcccaaatcttttcccgaaaacgcccgcaacatctacgactcgaaaaaacaaaaaaaccgacaccgcctcgaactaacgcaacccaaaaacgaaaacaccgcgaaaaacgcgaac

SEQ ID NO: 20591 - DNA, 740 bp, Artificial Sequence
  chemically treated genomic DNA (Homo sapiens) CpG-island No: 20591
tcggtcgtttattaggttacgagggggttaagaggagttcggggaattagagagggggtattgtttgttcgtagtttttttttttaaatattcgtcgttcgtaagtcgggtcgaattttattttcgaagggcgttttcgggagattaggtgttttcgagcgttttcgatcgtcggtaattgggtatcggtcgttagcgtagttttattttttttgtttttatttgttagacgtttggtgcggtgttcggtatgcggatttatagtcgcgacggttattcgggttgttttcgttatgggatttgggtattgtaggtcgatcggaggtttttagttcgcgtcgggtgcgtgggttttttttggtcgtttgtgttatttcgttgcgcgaggcgcggagttcgattacgttcgcgcggacggtttcggggtgaggaatttttagtggggattgagggtagagggcggtcgttagcgagttgtttttcgcggatggcgtttagtttttttacgttggtgtttttcgtaaggagaggtggtcgggaaaggtaacggattgaggaaagtcggtttattggtcgcgtcgttatcgcgtttttgagtgtttagaatttatcgagcgagcgcgtcgtttagattttttttcggaggcgttcgtagtatttgcgattcggggaggtaaaggagtcggtatcgtttcggattggcgtagtttaggagcgagagtatcgcggggagcgcgggt

SEQ ID NO: 20592 - DNA, 740 bp, Artificial Sequence
  chemically treated genomic DNA (Homo sapiens) CpG-island No: 20592
acccgcgctccccgcgatactctcgctcctaaactacgccaatccgaaacgataccgactcctttacctccccgaatcgcaaatactacgaacgcctccgaaaaaaaatctaaacgacgcgctcgctcgataaattctaaacactcaaaaacgcgataacgacgcgaccaataaaccgactttcctcaatccgttacctttcccgaccacctctccttacgaaaaacaccaacgtaaaaaaactaaacgccatccgcgaaaaacaactcgctaacgaccgccctctaccctcaatccccactaaaaattcctcaccccgaaaccgtccgcgcgaacgtaatcgaactccgcgcctcgcgcaacgaaataacacaaacgaccaaaaaaaacccacgcacccgacgcgaactaaaaacctccgatcgacctacaatacccaaatcccataacgaaaacaacccgaataaccgtcgcgactataaatccgcataccgaacaccgcaccaaacgtctaacaaataaaaacaaaaaaaataaaactacgctaacgaccgatacccaattaccgacgatcgaaaacgctcgaaaacacctaatctcccgaaaacgcccttcgaaaataaaattcgacccgacttacgaacgacgaatatttaaaaaaaaaaactacgaacaaacaataccccctctctaattccccgaactcctcttaaccccctcgtaacctaataaacgaccga

SEQ ID NO: 20593 - DNA, 765 bp, Artificial Sequence
  chemically treated genomic DNA (Homo sapiens) CpG-island No: 20593
tttcgcgaaattgacggaagagttcgggtgtttttttttgtgtttttttcggtaggtttgtacgaagaaggcgtacgaggatattttgtttcgcggtttgttggggttttttttatttatgttgatagattcgcgtttatttgacggggtcgaggggggagaggggaagtcggagggtcggcgcggagttcgtagttgttagggcgggcgttggcggggtttcgtttttcgtttaaattcgttttcgttttgttcgcgttttttttttttcgagggcgtttttttaagggcggtcgttcgcgttttcgttcgcgtttcggcgtatatttttttttttttttttttttcggttcgagcggtcgcggtttagtttagtaagtggttttcggggttcgagacgtcgtcgttcgttttttatcgagttcggtgatttcgtaagcgtttttaaaacgttttttttgatagaaatgttttttagtttttacgtcgcgagttttatttaatcgttaagtatttcgtgatcgatattgaaaatttttagaatcgggttcggttaggggtagttttcgtttttttcgattgttcgtcggttttttatagatttagttttcgtcggttcgtattttaaatgtcgttcgtcgggttagatttcgagagttattgcgtcgagatcgagtagaggttttgagggaatggggaaaggtaggtttacgaattcgagggtattggagggtatttttgtttggtgcgagtttttttttagag

SEQ ID NO: 20594 - DNA, 765 bp, Artificial Sequence
  chemically treated genomic DNA (Homo sapiens) CpG-island No: 20594
ctctaaaaaaaaactcgcaccaaacaaaaataccctccaataccctcgaattcgtaaacctacctttccccattccctcaaaacctctactcgatctcgacgcaataactctcgaaatctaacccgacgaacgacatttaaaatacgaaccgacgaaaactaaatctataaaaaaccgacgaacaatcgaaaaaaacgaaaactacccctaaccgaacccgattctaaaaattttcaatatcgatcacgaaatacttaacgattaaataaaactcgcgacgtaaaaactaaaaaacatttctatcaaaaaaaacgttttaaaaacgcttacgaaatcaccgaactcgataaaaaacgaacgacgacgtctcgaaccccgaaaaccacttactaaactaaaccgcgaccgctcgaaccgaaaaaaaaaaaaaaaaaaaaatatacgccgaaacgcgaacgaaaacgcgaacgaccgcccttaaaaaaacgccctcgaaaaaaaaaaaacgcgaacaaaacgaaaacgaatttaaacgaaaaacgaaaccccgccaacgcccgccctaacaactacgaactccgcgccgaccctccgacttcccctctcccccctcgaccccgtcaaataaacgcgaatctatcaacataaataaaaaaaaccccaacaaaccgcgaaacaaaatatcctcgtacgccttcttcgtacaaacctaccgaaaaaaacacaaaaaaaaacacccgaactcttccgtcaatttcgcgaaa

SEQ ID NO: 20595 - DNA, 765 bp, Artificial Sequence
  chemically treated genomic DNA (Homo sapiens) CpG-island No: 20595
ttttgaggaaaagttcgtattaggtaagaatattttttaatattttcgggttcgtggatttgtttttttttatttttttagagtttttattcggtttcggcgtagtggttttcggggtttgattcggcgagcggtatttggggtgcgggtcggcgagggttgggtttgtggagggtcggcgggtagtcggaggaggcggaaattgtttttgatcgggttcggttttgggagtttttaatgtcggttacgaggtgtttagcggttaagtgaggttcgcgacgtgggagttgggggatatttttgttaggaaaggcgttttgagggcgtttgcggagttatcggattcggtgaagggcgggcggcggcgtttcgggtttcgggagttatttgttgggttgagtcgcggtcgttcgggtcgggaggaggaggaggaggagggtgtgcgtcggggcgcgggcgggggcgcgggcggtcgtttttgggaggacgttttcgggaggaggggggcgcgggtagggcgggagcggatttgggcgggaagcggagtttcgttagcgttcgttttggtagttgcgggtttcgcgtcgatttttcggtttttttttttttttttcggtttcgttaggtggacgcggatttgttaatatgggtaaaggagattttaataagtcgcggggtaaaatgttttcgtacgtttttttcgtgtagatttgtcgggaagagtataagaagaaatattcggattttttcgttaatttcgcggaa

SEQ ID NO: 20596 - DNA, 765 bp, Artificial Sequence
  chemically treated genomic DNA (Homo sapiens) CpG-island No: 20596
ttccgcgaaattaacgaaaaaatccgaatatttcttcttatactcttcccgacaaatctacacgaaaaaaacgtacgaaaacattttaccccgcgacttattaaaatctcctttacccatattaacaaatccgcgtccacctaacgaaaccgaaaaaaaaaaaaaaaaaccgaaaaatcgacgcgaaacccgcaactaccaaaacgaacgctaacgaaactccgcttcccgcccaaatccgctcccgccctacccgcgcccccctcctcccgaaaacgtcctcccaaaaacgaccgcccgcgcccccgcccgcgccccgacgcacaccctcctcctcctcctcctcccgacccgaacgaccgcgactcaacccaacaaataactcccgaaacccgaaacgccgccgcccgcccttcaccgaatccgataactccgcaaacgccctcaaaacgcctttcctaacaaaaatatcccccaactcccacgtcgcgaacctcacttaaccgctaaacacctcgtaaccgacattaaaaactcccaaaaccgaacccgatcaaaaacaatttccgcctcctccgactacccgccgaccctccacaaacccaaccctcgccgacccgcaccccaaataccgctcgccgaatcaaaccccgaaaaccactacgccgaaaccgaataaaaactctaaaaaaataaaaaaaaacaaatccacgaacccgaaaatattaaaaaatattcttacctaatacgaacttttcctcaaaa

SEQ ID NO: 20597 - DNA, 606 bp, Artificial Sequence
  chemically treated genomic DNA (Homo sapiens) CpG-island No: 20597
gttgtcggagcggagagaggcggagcggttaggagagaggggatttttgttagcgtcggtttcgggagttcggagatatgaacggttttacgtttgacgagatgagtcgcggcggggatgcggtcgtcgtagtggtcgtagtggtcgttgtcgcggtcgtcgtcgtttcggcggggaacgggatcggcgcgggtatcggggttgaggtgtcgggcgcgggggcggttttagcggttgggttttcgggggcggtcgggtcgggtttcgggtaattgtgttgtttgcgggaggatggtgagcggtgcggtcgggcggtaggtaacgttagttttagtaagaggatttagaagagtattttttagaagaaggtgaagatcgagttggataagagcgtaagtaaatcgcgggatcgttttgttttttcgtttttcggtggggttttaggagtcgggtaaaggtacgggttgtcggcggggttttttagataatcgtattggttgtagtgcggtttcgtggagtttgtgtttggaagtaaataataaagtcgttgtaatttttatcgttattttaatatatatattatatataggttgtcgtttttttttt

SEQ ID NO: 20598 - DNA, 606 bp, Artificial Sequence
  chemically treated genomic DNA (Homo sapiens) CpG-island No: 20598
aaaaaaaaaacgacaacctatatataatatatatattaaaataacgataaaaattacaacgactttattatttacttccaaacacaaactccacgaaaccgcactacaaccaatacgattatctaaaaaaccccgccgacaacccgtacctttacccgactcctaaaaccccaccgaaaaacgaaaaaacaaaacgatcccgcgatttacttacgctcttatccaactcgatcttcaccttcttctaaaaaatactcttctaaatcctcttactaaaactaacgttacctaccgcccgaccgcaccgctcaccatcctcccgcaaacaacacaattacccgaaacccgacccgaccgcccccgaaaacccaaccgctaaaaccgcccccgcgcccgacacctcaaccccgatacccgcgccgatcccgttccccgccgaaacgacgacgaccgcgacaacgaccactacgaccactacgacgaccgcatccccgccgcgactcatctcgtcaaacgtaaaaccgttcatatctccgaactcccgaaaccgacgctaacaaaaatcccctctctcctaaccgctccgcctctctccgctccgacaac

SEQ ID NO: 20599 - DNA, 606 bp, Artificial Sequence
  chemically treated genomic DNA (Homo sapiens) CpG-island No: 20599
aagaggggaacgatagtttgtgtgtggtgtgtgtgttggggtggcggtaggagttgtagcgattttgttatttgtttttaaatatagattttacgagatcgtattgtagttagtgcggttgtttgggggatttcgtcgataattcgtgtttttgttcggtttttggggttttatcgaggggcgggagggtagggcggtttcgcggtttatttacgtttttatttagttcgatttttatttttttttgggagatgtttttttggatttttttgttgaagttggcgttgtttgtcgttcggtcgtatcgtttattattttttcgtaggtagtatagttgttcggggttcggttcggtcgttttcgggggtttagtcgttgagatcgttttcgcgttcggtattttagtttcggtgttcgcgtcggtttcgtttttcgtcgaggcggcggcggtcgcggtagcgattattgcggttattgcggcggtcgtattttcgtcgcggtttatttcgttaggcgtgaagtcgtttatgttttcgagttttcgaggtcggcgttgatagaaatttttttttttttggtcgtttcgttttttttcgtttcggtagt

SEQ ID NO: 20600 - DNA, 606 bp, Artificial Sequence
  chemically treated genomic DNA (Homo sapiens) CpG-island No: 20600
actaccgaaacgaaaaaaaacgaaacgaccaaaaaaaaaaaaatttctatcaacgccgacctcgaaaactcgaaaacataaacgacttcacgcctaacgaaataaaccgcgacgaaaatacgaccgccgcaataaccgcaataatcgctaccgcgaccgccgccgcctcgacgaaaaacgaaaccgacgcgaacaccgaaactaaaataccgaacgcgaaaacgatctcaacgactaaacccccgaaaacgaccgaaccgaaccccgaacaactatactacctacgaaaaaataataaacgatacgaccgaacgacaaacaacgccaacttcaacaaaaaaatccaaaaaaacatctcccaaaaaaaaataaaaatcgaactaaataaaaacgtaaataaaccgcgaaaccgccctaccctcccgcccctcgataaaaccccaaaaaccgaacaaaaacacgaattatcgacgaaatcccccaaacaaccgcactaactacaatacgatctcgtaaaatctatatttaaaaacaaataacaaaatcgctacaactcctaccgccaccccaacacacacaccacacacaaactatcgttcccctctt

SEQ ID NO: 20601 - DNA, 1020 bp, Artificial Sequence
  chemically treated genomic DNA (Homo sapiens) CpG-island No: 20601
tatgagttatattcgcgatttttggaatttggaacggtttttttagtttcggcggacgtcggtttttaggtcgtgttattgggagtaggcgggcgtcgcgattggtcgcggtcggttttattcggtgggcgagttttatcggcgaggcggaaaggaagtggcggtcgtcgcggttttgtattaattatgttcggttagcgggcgaatgttattcggcgttcggagtcgggtcggagggtacggggcgggtattcgcgtttttatttcgtcgcggttcgcgtttcgggatttcgaggggacgtcggtttttattgcgtcgttcggttttcggaggtttttcgtttttatttcgttcgtttcgtagtcgaggcgggttaggtttagcgcgcgaggtcggtcgggggcgtttgcggggattcgggggcgtacggcgttaggtcgcggttcgggcggttgatttttcggtacggtgtttttttgggacgcgtcgttcgagtttttggcgcgttgggataagtgtaatgataaagttttagggttcgatcgggcgttggtcggcgggaaggaggacgcggcgttttttttgagcggcggcggcggcggtttagtttttaggaagtagggcgcgtcggttaggttcggcgttcggttcggtttcgagttcgttttttcgtttcggtcgttggtattcgacgttcgcgattcgatttcgagttcggtaggtaggcgagtttttggatcgtcgcggggcgttttagtaagttttttttggtcgtggttggaggcgtttttttcggtcggggagcggtgtttgtttatttacgttggaggtagtttggagaggcgtcgtcgcgggtatcgagaaggattcgtttttttttttcggattcggtggcggcggtggttgtatatatatatacgcgcgtatatataaatacgtatatatatataattttgttttaaatgaggttcgattttagttgatttgtatttttatatataatatttggggcgtagaag

SEQ ID NO: 20602 - DNA, 1020 bp, Artificial Sequence
  chemically treated genomic DNA (Homo sapiens) CpG-island No: 20602
cttctacgccccaaatattatatataaaaatacaaatcaactaaaatcgaacctcatttaaaacaaaattatatatatatacgtatttatatatacgcgcgtatatatatatacaaccaccgccgccaccgaatccgaaaaaaaaaaacgaatccttctcgatacccgcgacgacgcctctccaaactacctccaacgtaaataaacaaacaccgctccccgaccgaaaaaaacgcctccaaccacgaccaaaaaaaacttactaaaacgccccgcgacgatccaaaaactcgcctacctaccgaactcgaaatcgaatcgcgaacgtcgaataccaacgaccgaaacgaaaaaacgaactcgaaaccgaaccgaacgccgaacctaaccgacgcgccctacttcctaaaaactaaaccgccgccgccgccgctcaaaaaaaacgccgcgtcctccttcccgccgaccaacgcccgatcgaaccctaaaactttatcattacacttatcccaacgcgccaaaaactcgaacgacgcgtcccaaaaaaacaccgtaccgaaaaatcaaccgcccgaaccgcgacctaacgccgtacgcccccgaatccccgcaaacgcccccgaccgacctcgcgcgctaaacctaacccgcctcgactacgaaacgaacgaaataaaaacgaaaaacctccgaaaaccgaacgacgcaataaaaaccgacgtcccctcgaaatcccgaaacgcgaaccgcgacgaaataaaaacgcgaatacccgccccgtaccctccgacccgactccgaacgccgaataacattcgcccgctaaccgaacataattaatacaaaaccgcgacgaccgccacttcctttccgcctcgccgataaaactcgcccaccgaataaaaccgaccgcgaccaatcgcgacgcccgcctactcccaataacacgacctaaaaaccgacgtccgccgaaactaaaaaaaccgttccaaattccaaaaatcgcgaatataactcata

SEQ ID NO: 20603 - DNA, 1020 bp, Artificial Sequence
  chemically treated genomic DNA (Homo sapiens) CpG-island No: 20603
tttttgcgttttaggtgttgtgtgtgggggtgtaggttagttggagtcgggttttatttaaaataaaattgtgtgtatgtgcgtgtttgtgtgtgcgcgcgtgtgtgtgtgtgtagttatcgtcgttatcggattcgaaggaggggagcgggtttttttcggtgttcgcggcggcgtttttttaggttgtttttagcgtaaataagtaggtatcgtttttcggtcgggaggagcgtttttagttacggttagaggaaatttgttggggcgtttcgcggcggtttaggggttcgtttgtttgtcgggttcggggtcgggtcgcgggcgtcgggtgttagcggtcggggcgggagggcgggttcggagtcgggtcgggcgtcgggtttggtcgacgcgttttgttttttgggggttgggtcgtcgtcgtcgtcgtttagaagggacgtcgcgttttttttttcgtcggttagcgttcggtcgggttttggggttttgttattgtatttgttttagcgcgttaggggttcgggcggcgcgttttaggaaggtatcgtgtcgaggggttagtcgttcgggtcgcggtttagcgtcgtgcgttttcgggttttcgtaggcgttttcggtcggtttcgcgcgttgggtttgattcgtttcggttacggagcgggcgaggtgggggcggggagttttcggggatcgagcggcgtagtgggggtcggcgttttttcggggtttcggggcgcgggtcgcggcggggtggggacgcgagtgttcgtttcgtgtttttcgattcggtttcgggcgtcgggtgatattcgttcgttggtcgaatatggttggtgtaaagtcgcggcggtcgttatttttttttcgtttcgtcggtagggttcgtttatcgagtgaagtcggtcgcggttaatcgcggcgttcgtttgtttttagtggtacggtttgggggtcggcgttcgtcggggttggggaagtcgttttaagttttaagggtcgcgggtgtaatttatg

SEQ ID NO: 20604 - DNA, 1020 bp, Artificial Sequence
  chemically treated genomic DNA (Homo sapiens) CpG-island No: 20604
cataaattacacccgcgacccttaaaacttaaaacgacttccccaaccccgacgaacgccgacccccaaaccgtaccactaaaaacaaacgaacgccgcgattaaccgcgaccgacttcactcgataaacgaaccctaccgacgaaacgaaaaaaaaataacgaccgccgcgactttacaccaaccatattcgaccaacgaacgaatatcacccgacgcccgaaaccgaatcgaaaaacacgaaacgaacactcgcgtccccaccccgccgcgacccgcgccccgaaaccccgaaaaaacgccgacccccactacgccgctcgatccccgaaaactccccgcccccacctcgcccgctccgtaaccgaaacgaatcaaacccaacgcgcgaaaccgaccgaaaacgcctacgaaaacccgaaaacgcacgacgctaaaccgcgacccgaacgactaacccctcgacacgataccttcctaaaacgcgccgcccgaacccctaacgcgctaaaacaaatacaataacaaaaccccaaaacccgaccgaacgctaaccgacgaaaaaaaaaacgcgacgtcccttctaaacgacgacgacgacgacccaacccccaaaaaacaaaacgcgtcgaccaaacccgacgcccgacccgactccgaacccgccctcccgccccgaccgctaacacccgacgcccgcgacccgaccccgaacccgacaaacaaacgaacccctaaaccgccgcgaaacgccccaacaaatttcctctaaccgtaactaaaaacgctcctcccgaccgaaaaacgatacctacttatttacgctaaaaacaacctaaaaaaacgccgccgcgaacaccgaaaaaaacccgctcccctccttcgaatccgataacgacgataactacacacacacacacgcgcgcacacacaaacacgcacatacacacaattttattttaaataaaacccgactccaactaacctacacccccacacacaacacctaaaacgcaaaaa

SEQ ID NO: 20605 - DNA, 772 bp, Artificial Sequence
  chemically treated genomic DNA (Homo sapiens) CpG-island No: 20605
tgtcgtcgggagcggcgtacgtagtttcgtattcgtttattcggtttcgggcggcggcgcggtttatgcggttgggggcggaggttgggagcgggtggcgggcgcggcggttcgggttcgggcggtgattggtcgtttgttggtcgcgattgaggttcgggaggcgggcggggagcgtaggcggagttcgttgtcgtcgagttgaaaagatgttgttgtttttggtgttttatacgtattttatgcgttatttgttgtttagcgtcgtgtttttgggtacggcgtttatttacgtgttggtttggggggtttggcggttgtttttcgtttttttgttcgttcgtttttattaagcgttggacgatcggttttattgcgtttattagagtatggtgtttttttttttcgagaattatatcggggtttaggtgagtcgtttttcgttttcgggtttcggcgtttattcgagttttcgggggcgcggattttttcgtttttttatagttggcgagggttattcggtcggttcggcggatttagtacggagagtacgtgtcgttttttcgttttttttttcgtatgttttttgtcgttttgtcgagatcgttttttaggaagttgtggttgcgtcgttttgaggttacgagtgggattcgtcgttttttttttcgtttttcgtttgggtttgatgttgtttagtaaagtgggtgtagatgtacgttttaaataatagggtacgcgtttagtagtttttggtttttggtttaaagag

SEQ ID NO: 20606 - DNA, 772 bp, Artificial Sequence
  chemically treated genomic DNA (Homo sapiens) CpG-island No: 20606
ctctttaaaccaaaaaccaaaaactactaaacgcgtaccctattatttaaaacgtacatctacacccactttactaaacaacatcaaacccaaacgaaaaacgaaaaaaaaaacgacgaatcccactcgtaacctcaaaacgacgcaaccacaacttcctaaaaaacgatctcgacaaaacgacaaaaaacatacgaaaaaaaaaacgaaaaaacgacacgtactctccgtactaaatccgccgaaccgaccgaataaccctcgccaactataaaaaaacgaaaaaatccgcgcccccgaaaactcgaataaacgccgaaacccgaaaacgaaaaacgactcacctaaaccccgatataattctcgaaaaaaaaaaacaccatactctaataaacgcaataaaaccgatcgtccaacgcttaataaaaacgaacgaacaaaaaaacgaaaaacaaccgccaaaccccccaaaccaacacgtaaataaacgccgtacccaaaaacacgacgctaaacaacaaataacgcataaaatacgtataaaacaccaaaaacaacaacatcttttcaactcgacgacaacgaactccgcctacgctccccgcccgcctcccgaacctcaatcgcgaccaacaaacgaccaatcaccgcccgaacccgaaccgccgcgcccgccacccgctcccaacctccgcccccaaccgcataaaccgcgccgccgcccgaaaccgaataaacgaatacgaaactacgtacgccgctcccgacgaca

SEQ ID NO: 20607 - DNA, 772 bp, Artificial Sequence
  chemically treated genomic DNA (Homo sapiens) CpG-island No: 20607
ttttttggattaaaggttagaaattgttaaacgcgtgttttattatttaaaacgtgtatttgtatttattttgttaagtagtattagatttaggcgaggggcggggaaaggggcggcgggttttattcgtagttttaggacgacgtagttatagttttttagagagcgatttcggtagaacggtaggaagtatgcggagaggaaggcggggaggcggtacgtgtttttcgtgttgggttcgtcgggtcggtcgggtgattttcgttagttgtgggggagcggagaggttcgcgttttcgggagttcgggtggacgtcgagattcgggagcgggaggcggtttatttggatttcggtgtaattttcgaagaagaagagtattatgttttggtagacgtagtagagtcggtcgtttagcgtttggtagaagcgggcgggtaggaaggcggagagtagtcgttagattttttaggttaatacgtaggtgggcgtcgtgtttaggagtacgacgttgggtagtaggtagcgtatggagtacgtgtggagtattagggatagtagtatttttttagttcggcggtagcgagtttcgtttgcgtttttcgttcgtttttcgggttttagtcgcggttagtaggcggttaattatcgttcgggttcgggtcgtcgcgttcgttattcgtttttagttttcgtttttagtcgtatgggtcgcgtcgtcgttcggggtcgggtaggcgagtgcggggttgcgtgcgtcgttttcggcggta

SEQ ID NO: 20608 - DNA, 772 bp, Artificial Sequence
  chemically treated genomic DNA (Homo sapiens) CpG-island No: 20608
taccgccgaaaacgacgcacgcaaccccgcactcgcctacccgaccccgaacgacgacgcgacccatacgactaaaaacgaaaactaaaaacgaataacgaacgcgacgacccgaacccgaacgataattaaccgcctactaaccgcgactaaaacccgaaaaacgaacgaaaaacgcaaacgaaactcgctaccgccgaactaaaaaaatactactatccctaatactccacacgtactccatacgctacctactacccaacgtcgtactcctaaacacgacgcccacctacgtattaacctaaaaaatctaacgactactctccgccttcctacccgcccgcttctaccaaacgctaaacgaccgactctactacgtctaccaaaacataatactcttcttcttcgaaaattacaccgaaatccaaataaaccgcctcccgctcccgaatctcgacgtccacccgaactcccgaaaacgcgaacctctccgctcccccacaactaacgaaaatcacccgaccgacccgacgaacccaacacgaaaaacacgtaccgcctccccgccttcctctccgcatacttcctaccgttctaccgaaatcgctctctaaaaaactataactacgtcgtcctaaaactacgaataaaacccgccgcccctttccccgcccctcgcctaaatctaatactacttaacaaaataaatacaaatacacgttttaaataataaaacacgcgtttaacaatttctaacctttaatccaaaaaa

SEQ ID NO: 20609 - DNA, 1339 bp, Artificial Sequence
  chemically treated genomic DNA (Homo sapiens) CpG-island No: 20609
ttgttattcgattttcgttagggtttggtcggacggaaacgtttcgtcggttttattgtcgtttcgttatgtggcggagtcgagtagtttagcgtgttttttatttttagcgtttgcgaagtcggcggcggcgtcgggatttttcggcgcgcggaggaaggatatttgtgtggaggatcggtgtgtgcgcgcgcggttttaaagagggggtagcggagggttttttcgtatttcgttgtttaatttcgaaggtttcgttcgttgtaggttcgttttttattttttcgtcgttcgttttttttttcgcgcgggacgttgttcggagcgcggcggggcgggggtggaggacgagagagcggtcggaggcgtcggttcggtagcggtagcggtagcggacgcgtgtagtagattcgggagcgagcgcgagtcgggttgtcgggcgagagggcgaggtcgagtttcgcgagatcggaacgtcgggggcgggggcgagatagagggggagtcgcggggagcgcgcgggacgcggttcgaggtcgtgcgcgagtcggggtatcgggcggcggcggcggcggcgcgcgttatgtcgtttagtgaaatgaatcgtaggacgttggcgtttcgaggaggcgggttggttatcgttagcggcggcggttttacgaataataacgttggcggggaggttttagtttggttttcgtagttttagtcgagatagttttcgtcgatagcgtcgttcgcgttttagtcgtttaatgggcggggggtcgacgaggaagtggaattggagggtttggagttttaagatttggaggttttcgtcgggtcggtcgtcggcgtcgtcgaggaagttaaggagttgttgtttttttaagacgcgggcggttttatttcgtttggcggtggcgcggggggttttttgttagcggaaaggaatcgtcggattttggtttttcgaggcggcggcggcgggggtttcggtaataatggtagtagtcgcggtcgtttcgagatttcggtgtggtttttgaggtattttaatgggcgagggtcggcgattgtggatttggagttggacgcgttggaggggaaggagttgatataggacggcgcgtttttgagcgatagtatcgaggacgaggaggagggggcgagtttgggcgacggtagcggggcggaaggcggtagttgtagtagtagtaggcggtcgggcggcgatggcggggacgaagtggagggtagcggtgtgggagttggcgaaggagagattgtttagtatttttcgttcgcgcggtttaagtttttaatgtagaagttttaatgttttttttagatt

SEQ ID NO: 20610 - DNA, 1339 bp, Artificial Sequence
  chemically treated genomic DNA (Homo sapiens) CpG-island No: 20610
aatctaaaaaaaacattaaaacttctacattaaaaacttaaaccgcgcgaacgaaaaatactaaacaatctctccttcgccaactcccacaccgctaccctccacttcgtccccgccatcgccgcccgaccgcctactactactacaactaccgccttccgccccgctaccgtcgcccaaactcgccccctcctcctcgtcctcgatactatcgctcaaaaacgcgccgtcctatatcaactccttcccctccaacgcgtccaactccaaatccacaatcgccgaccctcgcccattaaaatacctcaaaaaccacaccgaaatctcgaaacgaccgcgactactaccattattaccgaaacccccgccgccgccgcctcgaaaaaccaaaatccgacgattcctttccgctaacaaaaaaccccccgcgccaccgccaaacgaaataaaaccgcccgcgtcttaaaaaaacaacaactccttaacttcctcgacgacgccgacgaccgacccgacgaaaacctccaaatcttaaaactccaaaccctccaattccacttcctcgtcgaccccccgcccattaaacgactaaaacgcgaacgacgctatcgacgaaaactatctcgactaaaactacgaaaaccaaactaaaacctccccgccaacgttattattcgtaaaaccgccgccgctaacgataaccaacccgcctcctcgaaacgccaacgtcctacgattcatttcactaaacgacataacgcgcgccgccgccgccgccgcccgataccccgactcgcgcacgacctcgaaccgcgtcccgcgcgctccccgcgactccccctctatctcgcccccgcccccgacgttccgatctcgcgaaactcgacctcgccctctcgcccgacaacccgactcgcgctcgctcccgaatctactacacgcgtccgctaccgctaccgctaccgaaccgacgcctccgaccgctctctcgtcctccacccccgccccgccgcgctccgaacaacgtcccgcgcgaaaaaaaaaacgaacgacgaaaaaataaaaaacgaacctacaacgaacgaaaccttcgaaattaaacaacgaaatacgaaaaaaccctccgctaccccctctttaaaaccgcgcgcgcacacaccgatcctccacacaaatatccttcctccgcgcgccgaaaaatcccgacgccgccgccgacttcgcaaacgctaaaaataaaaaacacgctaaactactcgactccgccacataacgaaacgacaataaaaccgacgaaacgtttccgtccgaccaaaccctaacgaaaatcgaataacaa

SEQ ID NO: 20611 - DNA, 1339 bp, Artificial Sequence
  chemically treated genomic DNA (Homo sapiens) CpG-island No: 20611
ggtttggaaggagtattggagtttttgtattagagatttgggtcgcgcgagcgggaagtgttggatagtttttttttcgttagtttttatatcgttgttttttatttcgttttcgttatcgtcgttcgatcgtttgttgttgttgtagttgtcgtttttcgtttcgttgtcgtcgtttaggttcgttttttttttttcgttttcggtgttgtcgtttagggacgcgtcgttttgtattaatttttttttttttagcgcgtttagttttagatttatagtcgtcggttttcgtttattgaaatgttttaagggttatatcgaggtttcggggcggtcgcggttattgttattgttgtcgagattttcgtcgtcgtcgtttcggaaggttagagttcgacggttttttttcgttagtagggggtttttcgcgttatcgttaagcgaggtggggtcgttcgcgttttgggggagtagtaattttttggttttttcggcggcgtcggcggtcggttcggcggaggtttttaggttttggggttttaggttttttaattttattttttcgtcggtttttcgtttattaggcggttgaagcgcgggcggcgttgtcggcgggggttgtttcggttggggttgcggaggttaagttgaggttttttcgttagcgttattgttcgtggagtcgtcgtcgttagcggtgattaattcgttttttcggaacgttagcgttttgcggtttattttattgaacgatatggcgcgcgtcgtcgtcgtcgtcgttcggtgtttcggttcgcgtacggtttcgggtcgcgtttcgcgcgtttttcgcggttttttttttgtttcgttttcgttttcggcgtttcggtttcgcggggttcggtttcgttttttcgttcggtagttcggttcgcgttcgttttcgggtttgttgtacgcgttcgttgtcgttgtcgttgtcgggtcgacgttttcgatcgttttttcgttttttattttcgtttcgtcgcgtttcgggtagcgtttcgcgcggagaagggggcgggcggcggagaggtgaggagcgagtttgtagcgagcgaggttttcgaagttgagtagcggagtgcggggagatttttcgttgttttttttttaaagtcgcgcgcgtatatatcgattttttatatagatatttttttttcgcgcgtcgaggagtttcgacgtcgtcgtcggtttcgtaggcgttgagggtgagaggtacgttaaattgttcggtttcgttatataacgaagcgataataaagtcggcggagcgttttcgttcgattaggttttggcggaggtcgaatggtaa

SEQ ID NO: 20612 - DNA, 1339 bp, Artificial Sequence
  chemically treated genomic DNA (Homo sapiens) CpG-island No: 20612
ttaccattcgacctccgccaaaacctaatcgaacgaaaacgctccgccgactttattatcgcttcgttatataacgaaaccgaacaatttaacgtacctctcaccctcaacgcctacgaaaccgacgacgacgtcgaaactcctcgacgcgcgaaaaaaaaatatctatataaaaaatcgatatatacgcgcgcgactttaaaaaaaaaacaacgaaaaatctccccgcactccgctactcaacttcgaaaacctcgctcgctacaaactcgctcctcacctctccgccgcccgcccccttctccgcgcgaaacgctacccgaaacgcgacgaaacgaaaataaaaaacgaaaaaacgatcgaaaacgtcgacccgacaacgacaacgacaacgaacgcgtacaacaaacccgaaaacgaacgcgaaccgaactaccgaacgaaaaaacgaaaccgaaccccgcgaaaccgaaacgccgaaaacgaaaacgaaacaaaaaaaaaaccgcgaaaaacgcgcgaaacgcgacccgaaaccgtacgcgaaccgaaacaccgaacgacgacgacgacgacgcgcgccatatcgttcaataaaataaaccgcaaaacgctaacgttccgaaaaaacgaattaatcaccgctaacgacgacgactccacgaacaataacgctaacgaaaaaacctcaacttaacctccgcaaccccaaccgaaacaacccccgccgacaacgccgcccgcgcttcaaccgcctaataaacgaaaaaccgacgaaaaaataaaattaaaaaacctaaaaccccaaaacctaaaaacctccgccgaaccgaccgccgacgccgccgaaaaaaccaaaaaattactactcccccaaaacgcgaacgaccccacctcgcttaacgataacgcgaaaaaccccctactaacgaaaaaaaaccgtcgaactctaaccttccgaaacgacgacgacgaaaatctcgacaacaataacaataaccgcgaccgccccgaaacctcgatataacccttaaaacatttcaataaacgaaaaccgacgactataaatctaaaactaaacgcgctaaaaaaaaaaaaattaatacaaaacgacgcgtccctaaacgacaacaccgaaaacgaaaaaaaaaaaacgaacctaaacgacgacaacgaaacgaaaaacgacaactacaacaacaacaaacgatcgaacgacgataacgaaaacgaaataaaaaacaacgatataaaaactaacgaaaaaaaaactatccaacacttcccgctcgcgcgacccaaatctctaatacaaaaactccaatactccttccaaacc

SEQ ID NO: 20613 - DNA, 1012 bp, Artificial Sequence
  chemically treated genomic DNA (Homo sapiens) CpG-island No: 20613
cgatacgtagatatataagttcgttcgtcgttttatttttattttcgcgtcgcgttcgcgggttttgcgttttatagcggcgcgggggaggcgggggttagcgacgcggtcgcggggagttgatgtttttttcgacgttcggatttcgatacgtagataagattaataaagtatcgtcgttttcgagataaaatatgttataggtttcgattagggattttacgacgcgtggttgttcggggcgtagggttgcgcggacgggttgggggaagggggtggggaagggtttcgcggggtggtttttcggttcgggagtttcgttttcgtcgggatgcggtgttgtagggatttttacgttgattttggagttttcgttgtatagagttatcggggttagggtcggagtcgcggcggtgacggcgatagtacgagacggggcgggagggtgtcggaagggtcggcgtcgcgggttgaggttgagaaggaggtttggtcgaggagtagtcggtagcggagaggagttagtcgttagaaaagcgtcgaatggagtaatagtagcggagcgcgggttttagcgtcgcgggagagaagattagtagcgcgtacgttgttttcgttttttgttttcgtttcggtcggttattgggaggagttagagttcgttcggtttggtagtcgagttttagatatttttcgtagtcgtcgttaaatcggtcggttttcgagaggaggggttcgcggcgttcggtttcgtttttagttcggttttcgtcggtaaagtcggtcgggtttttcgcggttcgtttttgggaggaggagttcgcggtatttatcggtttcgttttttttgttttcgtatcgaggagttcgtttcgggaggaggggtttgtggcgtcggttaggagaaaaatcgaagtcgaattcgagttagtttgttgttgtcggatttgtttgttattttggatgatttcgggaggttggcggtatcgaagaggttttttgagagttgggt

SEQ ID NO: 20614 - DNA, 1012 bp, Artificial Sequence
  chemically treated genomic DNA (Homo sapiens) CpG-island No: 20614
acccaactctcaaaaaacctcttcgataccgccaacctcccgaaatcatccaaaataacaaacaaatccgacaacaacaaactaactcgaattcgacttcgatttttctcctaaccgacgccacaaacccctcctcccgaaacgaactcctcgatacgaaaacaaaaaaaacgaaaccgataaataccgcgaactcctcctcccaaaaacgaaccgcgaaaaacccgaccgactttaccgacgaaaaccgaactaaaaacgaaaccgaacgccgcgaacccctcctctcgaaaaccgaccgatttaacgacgactacgaaaaatatctaaaactcgactaccaaaccgaacgaactctaactcctcccaataaccgaccgaaacgaaaacaaaaaacgaaaacaacgtacgcgctactaatcttctctcccgcgacgctaaaacccgcgctccgctactattactccattcgacgcttttctaacgactaactcctctccgctaccgactactcctcgaccaaacctccttctcaacctcaacccgcgacgccgacccttccgacaccctcccgccccgtctcgtactatcgccgtcaccgccgcgactccgaccctaaccccgataactctatacaacgaaaactccaaaatcaacgtaaaaatccctacaacaccgcatcccgacgaaaacgaaactcccgaaccgaaaaaccaccccgcgaaacccttccccacccccttcccccaacccgtccgcgcaaccctacgccccgaacaaccacgcgtcgtaaaatccctaatcgaaacctataacatattttatctcgaaaacgacgatactttattaatcttatctacgtatcgaaatccgaacgtcgaaaaaaacatcaactccccgcgaccgcgtcgctaacccccgcctcccccgcgccgctataaaacgcaaaacccgcgaacgcgacgcgaaaataaaaataaaacgacgaacgaacttatatatctacgtatcg

SEQ ID NO: 20615 - DNA, 1012 bp, Artificial Sequence
  chemically treated genomic DNA (Homo sapiens) CpG-island No: 20615
gtttagtttttaggaggttttttcggtgtcgttagtttttcgaagttatttaaggtagtaggtaaattcggtagtagtaaattagttcggattcggtttcggttttttttttggtcggcgttataggttttttttttcggggcgggtttttcggtgcgagggtaggaggggcggagtcggtggatgtcgcgggtttttttttttaagggcgggtcgcgggagattcggtcggttttgtcggcggggatcgggttgggggcggggtcgggcgtcgcgagttttttttttcgagggtcggtcggtttggcggcggttgcggagggtatttgaggttcggttgttaagtcgaacgggttttggttttttttagtggtcggtcggggcggaagtaggaggcgggggtagcgtgcgcgttgttggttttttttttcgcggcgttggggttcgcgtttcgttgttgttgttttattcggcgtttttttggcggttggttttttttcgttgtcggttgtttttcgattaggttttttttttaattttagttcgcggcgtcgattttttcggtattttttcgtttcgtttcgtattgtcgtcgttatcgtcgcggtttcggttttggtttcgatggttttgtgtaacggagattttaaggttagcgtgggggtttttgtagtatcgtatttcggcggaggcgaggttttcggatcggggagttatttcgcgaggtttttttttattttttttttttagttcgttcgcgtagttttgcgtttcgggtagttacgcgtcgtagagtttttggtcggggtttgtggtatgttttatttcgggagcggcgatgttttgttgattttgtttgcgtgtcgaggttcgggcgtcggggagggtattagtttttcgcggtcgcgtcgttggttttcgtttttttcgcgtcgttgtggggcgtagagttcgcgagcgcggcgcgagggtgggggtagggcggcgagcgggtttgtgtgtttgcgtgtcg

SEQ ID NO: 20616 - DNA, 1012 bp, Artificial Sequence
  chemically treated genomic DNA (Homo sapiens) CpG-island No: 20616
cgacacgcaaacacacaaacccgctcgccgccctacccccaccctcgcgccgcgctcgcgaactctacgccccacaacgacgcgaaaaaaacgaaaaccaacgacgcgaccgcgaaaaactaataccctccccgacgcccgaacctcgacacgcaaacaaaatcaacaaaacatcgccgctcccgaaataaaacataccacaaaccccgaccaaaaactctacgacgcgtaactacccgaaacgcaaaactacgcgaacgaactaaaaaaaaaaaataaaaaaaaacctcgcgaaataactccccgatccgaaaacctcgcctccgccgaaatacgatactacaaaaacccccacgctaaccttaaaatctccgttacacaaaaccatcgaaaccaaaaccgaaaccgcgacgataacgacgacaatacgaaacgaaacgaaaaaataccgaaaaaatcgacgccgcgaactaaaattaaaaaaaaaacctaatcgaaaaacaaccgacaacgaaaaaaaaccaaccgccaaaaaaacgccgaataaaacaacaacaacgaaacgcgaaccccaacgccgcgaaaaaaaaaaccaacaacgcgcacgctacccccgcctcctacttccgccccgaccgaccactaaaaaaaaccaaaacccgttcgacttaacaaccgaacctcaaataccctccgcaaccgccgccaaaccgaccgaccctcgaaaaaaaaaactcgcgacgcccgaccccgcccccaacccgatccccgccgacaaaaccgaccgaatctcccgcgacccgcccttaaaaaaaaaaacccgcgacatccaccgactccgcccctcctaccctcgcaccgaaaaacccgccccgaaaaaaaaaacctataacgccgaccaaaaaaaaaaccgaaaccgaatccgaactaatttactactaccgaatttacctactaccttaaataacttcgaaaaactaacgacaccgaaaaaacctcctaaaaactaaac

SEQ ID NO: 20617 - DNA, 502 bp, Artificial Sequence
  chemically treated genomic DNA (Homo sapiens) CpG-island No: 20617
cgtataggcgaggagacgatcgatgggggcggatagtcggacgtacggttgcgttatttatttttagcgattagggttttacgtttttaagcgcggagttgggggaggggtcggttagttgtaaggtcgcggggtcgggaagggtcgggaggaggcgtcggggcggtcggggtttttagggagcggttgagtgggggagtcgcgcgtagtatttgggtttggggcgggcgttcggggagcgcggggtgtcgttaagggggtcgtacgattcgttcgcggtgagcgtaaggttcgcgtgttttagtttttttcggtggggattttttttatttggaaaatatacgggttatggagggggtggtggttaatcgtcgtacggggaaatcggtagataggttttgatcgagttttttattttagttataggtggtaggtgtcgggcgttacgattttattgtgtagggcgtacgtttttttttcgtttttttatattttagcggtt

SEQ ID NO: 20618 - DNA, 502 bp, Artificial Sequence
  chemically treated genomic DNA (Homo sapiens) CpG-island No: 20618
aaccgctaaaatataaaaaaacgaaaaaaaaacgtacgccctacacaataaaatcgtaacgcccgacacctaccacctataactaaaataaaaaactcgatcaaaacctatctaccgatttccccgtacgacgattaaccaccaccccctccataacccgtatattttccaaataaaaaaaatccccaccgaaaaaaactaaaacacgcgaaccttacgctcaccgcgaacgaatcgtacgacccccttaacgacaccccgcgctccccgaacgcccgccccaaacccaaatactacgcgcgactcccccactcaaccgctccctaaaaaccccgaccgccccgacgcctcctcccgacccttcccgaccccgcgaccttacaactaaccgacccctcccccaactccgcgcttaaaaacgtaaaaccctaatcgctaaaaataaataacgcaaccgtacgtccgactatccgcccccatcgatcgtctcctcgcctatacg

SEQ ID NO: 20619 - DNA, 502 bp, Artificial Sequence
  chemically treated genomic DNA (Homo sapiens) CpG-island No: 20619
ggtcgttggggtgtgggagggcggggagagagcgtgcgttttgtatagtgaggtcgtggcgttcggtatttgttatttgtgattgggatgaagggttcgattagaatttgtttgtcggttttttcgtgcgacgattaattattattttttttataattcgtgtgttttttaggtgaggaaaatttttatcgaggagagttggggtacgcgggttttgcgtttatcgcgggcgggtcgtgcggtttttttggcgatatttcgcgtttttcgggcgttcgttttaggtttagatgttgcgcgcggtttttttatttagtcgttttttgggagtttcggtcgtttcggcgttttttttcggtttttttcggtttcgcggttttgtagttggtcgattttttttttagtttcgcgtttagggacgtggggttttggtcgttgagggtgagtgacgtagtcgtgcgttcggttgttcgtttttatcggtcgttttttcgtttgtgcg

SEQ ID NO: 20620 - DNA, 502 bp, Artificial Sequence
  chemically treated genomic DNA (Homo sapiens) CpG-island No: 20620
cgcacaaacgaaaaaacgaccgataaaaacgaacaaccgaacgcacgactacgtcactcaccctcaacgaccaaaaccccacgtccctaaacgcgaaactaaaaaaaaaatcgaccaactacaaaaccgcgaaaccgaaaaaaaccgaaaaaaaacgccgaaacgaccgaaactcccaaaaaacgactaaataaaaaaaccgcgcgcaacatctaaacctaaaacgaacgcccgaaaaacgcgaaatatcgccaaaaaaaccgcacgacccgcccgcgataaacgcaaaacccgcgtaccccaactctcctcgataaaaattttcctcacctaaaaaacacacgaattataaaaaaaataataattaatcgtcgcacgaaaaaaccgacaaacaaattctaatcgaacccttcatcccaatcacaaataacaaataccgaacgccacgacctcactatacaaaacgcacgctctctccccgccctcccacaccccaacgacc

SEQ ID NO: 20621 - DNA, 595 bp, Artificial Sequence
  chemically treated genomic DNA (Homo sapiens) CpG-island No: 20621
tttttttcgatcgtatttttattaatcgtattttttttcgattatatttttattaattgaatttttttcgattatatttttattaattgtatttttttcgatcgtatttttattaatcgtattttttttcgatcgtatttttattaattgtattttttttcgattatatttttattaattgtatttttttcgattatatttttattaattgtattttttttcgattatatttttattaattgtatttttttcgattatatttttattaattgtatttttttcgattatatttttattaattgtatttttttttgatcgtatttttattaattgtatttttttcgattatatttttattaattgtattttttttcgattatatttttattaattgaattttttttcgattatatttttattaattgtatttttttcgattatatttttattaattgtatttttttttgatcgtatttttattaattgtatttttttcgattatatttttattaattgtattttttttcgatcgtatttttattaattgtatttttttttgattatatttttattaattgtatttttttttgattat

SEQ ID NO: 20622 - DNA, 595 bp, Artificial Sequence
  chemically treated genomic DNA (Homo sapiens) CpG-island No: 20622
ataatcaaaaaaaaatacaattaataaaaatataatcaaaaaaaaatacaattaataaaaatacgatcgaaaaaaaatacaattaataaaaatataatcgaaaaaaatacaattaataaaaatacgatcaaaaaaaaatacaattaataaaaatataatcgaaaaaaatacaattaataaaaatataatcgaaaaaaaattcaattaataaaaatataatcgaaaaaaaatacaattaataaaaatataatcgaaaaaaatacaattaataaaaatacgatcaaaaaaaaatacaattaataaaaatataatcgaaaaaaatacaattaataaaaatataatcgaaaaaaatacaattaataaaaatataatcgaaaaaaaatacaattaataaaaatataatcgaaaaaaatacaattaataaaaatataatcgaaaaaaaatacaattaataaaaatacgatcgaaaaaaaatacgattaataaaaatacgatcgaaaaaaatacaattaataaaaatataatcgaaaaaaattcaattaataaaaatataatcgaaaaaaaatacgattaataaaaatacgatcgaaaaaaa

SEQ ID NO: 20623 - DNA, 595 bp, Artificial Sequence
  chemically treated genomic DNA (Homo sapiens) CpG-island No: 20623
gtggttaggaggggatgtagttagtagggatgtgattaggaggggatgtagttagtagggatgcggtcgggaggggatgtagttagtagggatgtggtcgggagggatgtagttagtagggatgcggttaggaggggatgtagttagtagggatgtggtcgggagggatgtagttagtagggatgtggtcgggaggggatttagttagtagggatgtggtcgggaggggatgtagttagtagggatgtggtcgggagggatgtagttagtagggatgcggttaggaggggatgtagttagtaaggatgtggtcgggagggatgtagttagtagggatgtggtcgggagggatgtagttagtagggatgtggtcgggaggggatgtagttagtagggatgtggtcgggagggatgtagttagtagggatgtggtcgggaggggatgtagttagtaggggtgcggtcgggaggggatgcggttagtagggatgcggtcgggagggatgtagttagtagggatgtggtcgggagggatttagttagtagggatgtggtcgggaggggatgcggttagtagggatgcggtcgggagggg

SEQ ID NO: 20624 - DNA, 595 bp, Artificial Sequence
  chemically treated genomic DNA (Homo sapiens) CpG-island No: 20624
cccctcccgaccgcatccctactaaccgcatcccctcccgaccacatccctactaactaaatccctcccgaccacatccctactaactacatccctcccgaccgcatccctactaaccgcatcccctcccgaccgcacccctactaactacatcccctcccgaccacatccctactaactacatccctcccgaccacatccctactaactacatcccctcccgaccacatccctactaactacatccctcccgaccacatccctactaactacatccctcccgaccacatccttactaactacatcccctcctaaccgcatccctactaactacatccctcccgaccacatccctactaactacatcccctcccgaccacatccctactaactaaatcccctcccgaccacatccctactaactacatccctcccgaccacatccctactaactacatcccctcctaaccgcatccctactaactacatccctcccgaccacatccctactaactacatcccctcccgaccgcatccctactaactacatcccctcctaatcacatccctactaactacatcccctcctaaccac

SEQ ID NO: 20625 - DNA, 748 bp, Artificial Sequence
  chemically treated genomic DNA (Homo sapiens) CpG-island No: 20625
tcgagcgttcggttagatatacgtggaattttttgtattagagtttaatttgggaatttaagtttcggtagcgcgttgttttttacgaacggggttgacgattttcgtagttatttattcgttatggttgcgtttttatgggcggtttttagtagcgttagtatttgtagcgtttttaggagtagcgcggtttaagtatttcgcgcgtcgagttttattgtttcgagggtaggatgcggtagtttcgtgggtttttagtcgaggtggcggcggcgagagcggtttttttgcgtagtcggcgtcggtttcgtttttttttcggtcgcgtacgttttttttttcgtcgtttgtttttcgaatgattaaatagggcgtaggagcggggtttggagggggcgtcgcgtgcgtagtcggggcggcggggtcgggttgggtggcgcgggggcgggttcggggttttgggcgtggcgattcggttcgcggtttttttcgtaggcgcgcgtttgggaattttagaaatcgcgagtcgtttttttttttttcggaaatggtagttttgttgttttggatgaaggcgagcgtcgttgtttttttgaatgttgagtacgttggtttcgcggtgttcggaaggaagtttttgaagagtagttttgcgggtagggaggggataggggtgcgtgcgatttagagtgagagggaggagttgtagggtaaaggcgggaggagggggagattttggagaggaatt

SEQ ID NO: 20626 - DNA, 748 bp, Artificial Sequence
  chemically treated genomic DNA (Homo sapiens) CpG-island No: 20626
aattcctctccaaaatctccccctcctcccgcctttaccctacaactcctccctctcactctaaatcgcacgcacccctatcccctccctacccgcaaaactactcttcaaaaacttccttccgaacaccgcgaaaccaacgtactcaacattcaaaaaaacaacgacgctcgccttcatccaaaacaacaaaactaccatttccgaaaaaaaaaaaaacgactcgcgatttctaaaattcccaaacgcgcgcctacgaaaaaaaccgcgaaccgaatcgccacgcccaaaaccccgaacccgcccccgcgccacccaacccgaccccgccgccccgactacgcacgcgacgccccctccaaaccccgctcctacgccctatttaatcattcgaaaaacaaacgacgaaaaaaaaaacgtacgcgaccgaaaaaaaaacgaaaccgacgccgactacgcaaaaaaaccgctctcgccgccgccacctcgactaaaaacccacgaaactaccgcatcctaccctcgaaacaataaaactcgacgcgcgaaatacttaaaccgcgctactcctaaaaacgctacaaatactaacgctactaaaaaccgcccataaaaacgcaaccataacgaataaataactacgaaaatcgtcaaccccgttcgtaaaaaacaacgcgctaccgaaacttaaattcccaaattaaactctaatacaaaaaattccacgtatatctaaccgaacgctcga

SEQ ID NO: 20627 - DNA, 748 bp, Artificial Sequence
  chemically treated genomic DNA (Homo sapiens) CpG-island No: 20627
agtttttttttagaattttttttttttttcgtttttgttttgtaattttttttttttattttgagtcgtacgtatttttgttttttttttgttcgtaaaattattttttaaaggttttttttcgggtatcgcgaagttagcgtgtttagtatttagggaggtagcggcgttcgtttttatttaggataataaaattgttattttcgaagagaaaggaaacggttcgcggtttttggggtttttaagcgcgcgtttgcgagggaggtcgcgagtcgagtcgttacgtttagaatttcgagttcgttttcgcgttatttagttcggtttcgtcgtttcggttgcgtacgcgacgttttttttaggtttcgtttttgcgttttatttggttattcggggggtaagcggcgggaggggaaacgtgcgcggtcgaaggggaagcggagtcggcgtcggttgcgtagaggagtcgttttcgtcgtcgttatttcggttgggagtttacgaggttgtcgtattttgttttcggaataatgggattcggcgcgcgaggtgtttgggtcgcgttgtttttggggacgttgtaggtgttagcgttgttgggggtcgtttatgaaagcgtagttatggcgggtaagtggttgcgggggtcgttagtttcgttcgtgggaggtagcgcgttgtcgaggtttgggtttttaagttgggttttggtatagaaagttttacgtgtgtttggtcgaacgttcgg

SEQ ID NO: 20628 - DNA, 748 bp, Artificial Sequence
  chemically treated genomic DNA (Homo sapiens) CpG-island No: 20628
ccgaacgttcgaccaaacacacgtaaaactttctataccaaaacccaacttaaaaacccaaacctcgacaacgcgctacctcccacgaacgaaactaacgacccccgcaaccacttacccgccataactacgctttcataaacgacccccaacaacgctaacacctacaacgtccccaaaaacaacgcgacccaaacacctcgcgcgccgaatcccattattccgaaaacaaaatacgacaacctcgtaaactcccaaccgaaataacgacgacgaaaacgactcctctacgcaaccgacgccgactccgcttccccttcgaccgcgcacgtttcccctcccgccgcttaccccccgaataaccaaataaaacgcaaaaacgaaacctaaaaaaaacgtcgcgtacgcaaccgaaacgacgaaaccgaactaaataacgcgaaaacgaactcgaaattctaaacgtaacgactcgactcgcgacctccctcgcaaacgcgcgcttaaaaaccccaaaaaccgcgaaccgtttcctttctcttcgaaaataacaattttattatcctaaataaaaacgaacgccgctacctccctaaatactaaacacgctaacttcgcgatacccgaaaaaaaacctttaaaaaataattttacgaacaaaaaaaaaacaaaaatacgtacgactcaaaataaaaaaaaaaaattacaaaacaaaaacgaaaaaaaaaaaaaattctaaaaaaaaact

SEQ ID NO: 20629 - DNA, 560 bp, Artificial Sequence
  chemically treated genomic DNA (Homo sapiens) CpG-island No: 20629
tttatagggtttcgcgagcgtcggacggacggattataattttcgataggtagcgcggttggcggggcggttcgtcgcggtgtttataggattttagggcgagtgcgggttgtttcgcgcggcgttcgtaggatttcggcggttatttatgtcgaggtgagttcgcgggagtcgtcgtcgtcgtcgtttcgttttagttgtcgtttcgcgcggtttcgtcgtcggttaggatgttggaggaagcgggcgaggtgttggagaatatgttgaaggcgttttgtttgtcgttcggttttatcgtttttttgttcgttgtgttgttgttggtggcgtcgtcgttgtttgtcgtcgacgtcgcgtacgagtttatcgtgtatcgtatgtagtagtacgatttgtagggttagttttacggtgcgtgttttcggtttattttcggggtttttcgggtttttcggttacgttatttcggttcggcgatttttaggtcgatttttagtttcggtttgggttgttcgatttatgtttaggttttaggcgaggtagagttttgtcgtttt

SEQ ID NO: 20630 - DNA, 560 bp, Artificial Sequence
  chemically treated genomic DNA (Homo sapiens) CpG-island No: 20630
aaaacgacaaaactctacctcgcctaaaacctaaacataaatcgaacaacccaaaccgaaactaaaaatcgacctaaaaatcgccgaaccgaaataacgtaaccgaaaaacccgaaaaaccccgaaaataaaccgaaaacacgcaccgtaaaactaaccctacaaatcgtactactacatacgatacacgataaactcgtacgcgacgtcgacgacaaacaacgacgacgccaccaacaacaacacaacgaacaaaaaaacgataaaaccgaacgacaaacaaaacgccttcaacatattctccaacacctcgcccgcttcctccaacatcctaaccgacgacgaaaccgcgcgaaacgacaactaaaacgaaacgacgacgacgacgactcccgcgaactcacctcgacataaataaccgccgaaatcctacgaacgccgcgcgaaacaacccgcactcgccctaaaatcctataaacaccgcgacgaaccgccccgccaaccgcgctacctatcgaaaattataatccgtccgtccgacgctcgcgaaaccctataaa

SEQ ID NO: 20631 - DNA, 560 bp, Artificial Sequence
  chemically treated genomic DNA (Homo sapiens) CpG-island No: 20631
agggcggtagggttttgtttcgtttggggtttgagtatgggtcgggtagtttaggtcggagttagggatcggtttggggatcgtcgggtcggagtggcgtggtcggggagttcggggagtttcgagggtgggtcggggatacgtatcgtagggttggttttgtaggtcgtattgttgtatgcggtatacggtgaattcgtgcgcggcgtcggcggtaggtagcggcggcgttattagtagtagtatagcgggtaggaagacgatgaagtcgagcggtagataagacgtttttagtatgttttttagtatttcgttcgttttttttagtattttggtcggcggcggggtcgcgcggggcggtagttgggacgggacggcggcggcggcggttttcgcggatttatttcggtatgggtagtcgtcggggttttgcgggcgtcgcgcggggtagttcgtattcgttttgaggttttgtgggtatcgcggcgaatcgtttcgttagtcgcgttgtttgtcgggaattgtagttcgttcgttcggcgttcgcggagttttgtggg

SEQ ID NO: 20632 - DNA, 560 bp, Artificial Sequence
  chemically treated genomic DNA (Homo sapiens) CpG-island No: 20632
cccacaaaactccgcgaacgccgaacgaacgaactacaattcccgacaaacaacgcgactaacgaaacgattcgccgcgatacccacaaaacctcaaaacgaatacgaactaccccgcgcgacgcccgcaaaaccccgacgactacccataccgaaataaatccgcgaaaaccgccgccgccgccgtcccgtcccaactaccgccccgcgcgaccccgccgccgaccaaaatactaaaaaaaacgaacgaaatactaaaaaacatactaaaaacgtcttatctaccgctcgacttcatcgtcttcctacccgctatactactactaataacgccgccgctacctaccgccgacgccgcgcacgaattcaccgtataccgcatacaacaatacgacctacaaaaccaaccctacgatacgtatccccgacccaccctcgaaactccccgaactccccgaccacgccactccgacccgacgatccccaaaccgatccctaactccgacctaaactacccgacccatactcaaaccccaaacgaaacaaaaccctaccgccct

SEQ ID NO: 20633 - DNA, 532 bp, Artificial Sequence
  chemically treated genomic DNA (Homo sapiens) CpG-island No: 20633
tgacgttagcggattgacgtattattaatgtggtgacgtcgttttcgttgttagggcgatagttgacgtacggttgggtttttgacggcgttaatgtcggggttggttattggggggtcgagagttttcgggttcgggtcgttttagtttttattttttttttcgcgggggttttttcggttcggggatttcgtagaaaaaattgggagtttttagagttggtcgcgtgcggcgcgtggttcgagtcgggggtcggaggaagcgtttttttcgagttgttgggtttttaagttttaaattcgaaatagtttcgatgtgcgggggtcgggcgtagagagacggcggtttgggtatagatgggggacgtataggtagaggcgcgtggagatagatagggacgtgtggaaatagaaatagatagatagggatatagacgtcgttttcgaagacgggtgcgttttgtagttatcgatttttgtttgaaatgtttgggggagggagaggttggtttattttattttggtatttaggt

SEQ ID NO: 20634 - DNA, 532 bp, Artificial Sequence
  chemically treated genomic DNA (Homo sapiens) CpG-island No: 20634
acctaaataccaaaataaaataaaccaacctctccctcccccaaacatttcaaacaaaaatcgataactacaaaacgcacccgtcttcgaaaacgacgtctatatccctatctatctatttctatttccacacgtccctatctatctccacgcgcctctacctatacgtcccccatctatacccaaaccgccgtctctctacgcccgacccccgcacatcgaaactatttcgaatttaaaacttaaaaacccaacaactcgaaaaaaacgcttcctccgacccccgactcgaaccacgcgccgcacgcgaccaactctaaaaactcccaattttttctacgaaatccccgaaccgaaaaaacccccgcgaaaaaaaaaataaaaactaaaacgacccgaacccgaaaactctcgaccccccaataaccaaccccgacattaacgccgtcaaaaacccaaccgtacgtcaactatcgccctaacaacgaaaacgacgtcaccacattaataatacgtcaatccgctaacgtca

SEQ ID NO: 20635 - DNA, 532 bp, Artificial Sequence
  chemically treated genomic DNA (Homo sapiens) CpG-island No: 20635
gtttgggtgttaaggtaaagtaagttagttttttttttttttaagtattttagataaggatcggtggttgtagagcgtattcgttttcgggaacggcgtttgtgtttttgtttgtttgtttttatttttatacgtttttgtttgtttttacgcgtttttgtttgtgcgttttttatttgtgtttaagtcgtcgtttttttgcgttcggttttcgtatatcggagttatttcgggtttaaggtttaaaagtttaatagttcggaggagacgtttttttcggttttcggttcggattacgcgtcgtacgcggttagttttgggagtttttagttttttttgcgggattttcgagtcggggaagttttcgcgggaggaagggtgggggttggggcgattcgggttcggaggttttcggttttttagtggttaatttcggtattgacgtcgttaggagtttagtcgtgcgttagttgtcgttttggtaacgggggcgacgttattatattggtggtgcgttagttcgttgacgtta

SEQ ID NO: 20636 - DNA, 532 bp, Artificial Sequence
  chemically treated genomic DNA (Homo sapiens) CpG-island No: 20636
taacgtcaacgaactaacgcaccaccaatataataacgtcgcccccgttaccaaaacgacaactaacgcacgactaaactcctaacgacgtcaataccgaaattaaccactaaaaaaccgaaaacctccgaacccgaatcgccccaacccccacccttcctcccgcgaaaacttccccgactcgaaaatcccgcaaaaaaaactaaaaactcccaaaactaaccgcgtacgacgcgtaatccgaaccgaaaaccgaaaaaaacgtctcctccgaactattaaacttttaaaccttaaacccgaaataactccgatatacgaaaaccgaacgcaaaaaaacgacgacttaaacacaaataaaaaacgcacaaacaaaaacgcgtaaaaacaaacaaaaacgtataaaaataaaaacaaacaaacaaaaacacaaacgccgttcccgaaaacgaatacgctctacaaccaccgatccttatctaaaatacttaaaaaaaaaaaaaactaacttactttaccttaacacccaaac

SEQ ID NO: 20637 - DNA, 846 bp, Artificial Sequence
  chemically treated genomic DNA (Homo sapiens) CpG-island No: 20637
tcgaatcgagattacgttttcgtaggtggaggtttcgtttcgcggtatgatcggaagtgcgcggggtttttaagatggcgttcgaaattcggaagtgagcggcggtagttgcgaggttcggagaaataggcgtcgcgggtttcgcgttcggtcggattcgggttcgaggtgaggttttggttgcgattttcgtttcggttttatcgcgatttttgtttggttcgatttcgtttgtgggttcggcgtttttcgcggatttttgcgttcggggttgggggttttgggggtcgtggggcgggggcgagcgcggcgggattttcgtttttcgtcgcgatttttttcgatttcgtttttcgtcgttaacgttgatttcgcgttgtttcgcgattatcgtcgtgaattttgatttgttttttcgtttttcggcgattttttgtcgtgaattttaattttattttttacgataatttttttaatttttttttttcgttttttcgggtgattttttgtatcgcgtagtttggtgattttcgatttttcgttttttggtaatttttgatttcgtatttatcggtgttttcgagttttttggtgatttcgtattcgttttttttcggtattttggtttttttttttggggattttcgattttatgcgtttcgtgatttcgatttttttttgggagtgattttcggtttttttcgtcgtttcgatttttgattttaggtttttcgggcgttcgtgttttttttttttttttgttttcggttttaggatttttgttttttcggtttcgtagcgtagttttgtttttttttttttttttgtttttcgtttttttcgttt

SEQ ID NO: 20638 - DNA, 846 bp, Artificial Sequence
  chemically treated genomic DNA (Homo sapiens) CpG-island No: 20638
aaacgaaaaaaacgaaaaacaaaaaaaaaaaaaaaaacaaaactacgctacgaaaccgaaaaaacaaaaatcctaaaaccgaaaacaaaaaaaaaaaaaaaacacgaacgcccgaaaaacctaaaatcaaaaatcgaaacgacgaaaaaaaccgaaaatcactcccaaaaaaaaatcgaaatcacgaaacgcataaaatcgaaaatccccaaaaaaaaaaaccaaaataccgaaaaaaaacgaatacgaaatcaccaaaaaactcgaaaacaccgataaatacgaaatcaaaaattaccaaaaaacgaaaaatcgaaaatcaccaaactacgcgatacaaaaaatcacccgaaaaaacgaaaaaaaaaaattaaaaaaattatcgtaaaaaataaaattaaaattcacgacaaaaaatcgccgaaaaacgaaaaaacaaatcaaaattcacgacgataatcgcgaaacaacgcgaaatcaacgttaacgacgaaaaacgaaatcgaaaaaaatcgcgacgaaaaacgaaaatcccgccgcgctcgcccccgccccacgacccccaaaacccccaaccccgaacgcaaaaatccgcgaaaaacgccgaacccacaaacgaaatcgaaccaaacaaaaatcgcgataaaaccgaaacgaaaatcgcaaccaaaacctcacctcgaacccgaatccgaccgaacgcgaaacccgcgacgcctatttctccgaacctcgcaactaccgccgctcacttccgaatttcgaacgccatcttaaaaaccccgcgcacttccgatcataccgcgaaacgaaacctccacctacgaaaacgtaatctcgattcga

SEQ ID NO: 20639 - DNA, 846 bp, Artificial Sequence
  chemically treated genomic DNA (Homo sapiens) CpG-island No: 20639
gagcgggaggggcggggagtaaggggagggagggagatagggttgcgttgcggggtcgagaaggtaagggttttgggatcggggataaggaggaggaaggggtacgaacgttcgaggagtttggagttaggaatcggggcggcgggagagatcgggggttatttttaggaaggggtcgaggttacgaggcgtatggagtcgagagtttttaaaagggaaggttaggatatcgaggaaaagcgggtgcggggttattaaggggttcgggggtatcgatgagtgcggggttaagggttattagaaaacgaaaggtcgggggttattaagttgcgcggtatagggagttattcggaagagcgggaaggaaaggttgggagggttgtcgtggaaggtagggttaaggtttacggtagggggtcgtcggggggcgggggggtaggttaaggtttacggcggtggtcgcggggtagcgcggggttaacgttggcggcgaagggcggggtcggaaggggtcgcggcggagggcgggggtttcgtcgcgttcgttttcgttttacggtttttagaatttttagtttcgggcgtaggggttcgcggggagcgtcggatttataagcggggtcgggttaggtaggggtcgcggtggagtcggggcgggggtcgtaattagagttttatttcgggttcgggttcggtcgggcgcggagttcgcggcgtttgttttttcgagtttcgtagttgtcgtcgtttattttcgggtttcgggcgttattttgggggtttcgcgtattttcggttatgtcgcggggcggggtttttatttgcgggggcgtggtttcggttcgg

SEQ ID NO: 20640 - DNA, 846 bp, Artificial Sequence
  chemically treated genomic DNA (Homo sapiens) CpG-island No: 20640
ccgaaccgaaaccacgcccccgcaaataaaaaccccgccccgcgacataaccgaaaatacgcgaaacccccaaaataacgcccgaaacccgaaaataaacgacgacaactacgaaactcgaaaaaacaaacgccgcgaactccgcgcccgaccgaacccgaacccgaaataaaactctaattacgacccccgccccgactccaccgcgacccctacctaacccgaccccgcttataaatccgacgctccccgcgaacccctacgcccgaaactaaaaattctaaaaaccgtaaaacgaaaacgaacgcgacgaaacccccgccctccgccgcgaccccttccgaccccgcccttcgccgccaacgttaaccccgcgctaccccgcgaccaccgccgtaaaccttaacctacccccccgccccccgacgaccccctaccgtaaaccttaaccctaccttccacgacaaccctcccaacctttccttcccgctcttccgaataactccctataccgcgcaacttaataacccccgacctttcgttttctaataacccttaaccccgcactcatcgatacccccgaaccccttaataaccccgcacccgcttttcctcgatatcctaaccttcccttttaaaaactctcgactccatacgcctcgtaacctcgaccccttcctaaaaataacccccgatctctcccgccgccccgattcctaactccaaactcctcgaacgttcgtaccccttcctcctccttatccccgatcccaaaacccttaccttctcgaccccgcaacgcaaccctatctccctccctccccttactccccgcccctcccgctc

SEQ ID NO: 20641 - DNA, 500 bp, Artificial Sequence
  chemically treated genomic DNA (Homo sapiens) CpG-island No: 20641
ttcggttatcgtcggcgtcgagcggggtttcgagcgtagtagtagcgtcggacgcggcgtaaagttcggtcggtagggttcgtaggtcggagaacggagcgggtcgggcgggtaggggttggtgattaaagtagcgggagacggttttcgaggtattaagttggcggtttagttgtttcgtcgcggttatttgtttcgcgttttcggttttaatcgatattaaatattcggagttcggaaatggatcggggtcgtttagtacggagggagagaggagatagaaaggcgggcgggtcggttgggggagggggagttgtaggtttgtaatcgtaattgcgagtggttggcgagcgaagattagcgttcgttgtcgtttcgttgttgttttttttgtgtttagtgacgcgtcgtttgaggttggggtttcgttgtgttttcgttttcgggttttgttttttttttacgggagggtcgcgtttttaggtgggggttttgtattt

SEQ ID NO: 20642 - DNA, 500 bp, Artificial Sequence
  chemically treated genomic DNA (Homo sapiens) CpG-island No: 20642
aaatacaaaacccccacctaaaaacgcgaccctcccgtaaaaaaaaaacaaaacccgaaaacgaaaacacaacgaaaccccaacctcaaacgacgcgtcactaaacacaaaaaaaacaacaacgaaacgacaacgaacgctaatcttcgctcgccaaccactcgcaattacgattacaaacctacaactccccctcccccaaccgacccgcccgcctttctatctcctctctccctccgtactaaacgaccccgatccatttccgaactccgaatatttaatatcgattaaaaccgaaaacgcgaaacaaataaccgcgacgaaacaactaaaccgccaacttaatacctcgaaaaccgtctcccgctactttaatcaccaacccctacccgcccgacccgctccgttctccgacctacgaaccctaccgaccgaactttacgccgcgtccgacgctactactacgctcgaaaccccgctcgacgccgacgataaccgaa

SEQ ID NO: 20643 - DNA, 500 bp, Artificial Sequence
  chemically treated genomic DNA (Homo sapiens) CpG-island No: 20643
ggatataaggtttttatttaaagacgcgattttttcgtaggaggggggtagggttcgggggcgggagtatagcggggttttagttttaggcggcgcgttattgagtataaaggagataatagcgaggcggtagcgggcgttgattttcgttcgttagttattcgtaattgcggttatagatttgtagtttttttttttttagtcggttcgttcgtttttttgtttttttttttttttcgtattggacggtttcggtttattttcgggtttcggatatttggtatcgattggggtcggggacgcggagtaggtggtcgcggcggggtagttgggtcgttagtttggtgtttcggggatcgtttttcgttgttttggttattagtttttgttcgttcgattcgtttcgtttttcggtttgcgagttttgtcggtcggattttgcgtcgcgttcggcgttgttgttgcgttcggggtttcgttcggcgtcggcggtgatcggg

SEQ ID NO: 20644 - DNA, 500 bp, Artificial Sequence
  chemically treated genomic DNA (Homo sapiens) CpG-island No: 20644
cccgatcaccgccgacgccgaacgaaaccccgaacgcaacaacaacgccgaacgcgacgcaaaatccgaccgacaaaactcgcaaaccgaaaaacgaaacgaatcgaacgaacaaaaactaataaccaaaacaacgaaaaacgatccccgaaacaccaaactaacgacccaactaccccgccgcgaccacctactccgcgtccccgaccccaatcgataccaaatatccgaaacccgaaaataaaccgaaaccgtccaatacgaaaaaaaaaaaaaaacaaaaaaacgaacgaaccgactaaaaaaaaaaaaactacaaatctataaccgcaattacgaataactaacgaacgaaaatcaacgcccgctaccgcctcgctattatctcctttatactcaataacgcgccgcctaaaactaaaaccccgctatactcccgcccccgaaccctacccccctcctacgaaaaaatcgcgtctttaaataaaaaccttatatcc

SEQ ID NO: 20645 - DNA, 601 bp, Artificial Sequence
  chemically treated genomic DNA (Homo sapiens) CpG-island No: 20645
cgttcggtaggattggtcgcgattaattcgcgttcgtcggtttttattacggtttaattttcgtttttgttcgcggatttcgtgggttgtcgagtttttttttatttttatttattagttaaagtgttaagcggggtgcgtcgcggttttttgggtcgtttagagcgttttggtacgttcgaggcgttcgtttcgtttcggttcgcgcgttttcggaagtggtcgcggcgggatatagcgcgggatatagcgcggatttgcggtatttgttcggtcggcggtcgttgaggcgttcggggacgtaggggtagggcgtaaggtttggggcgttgattagttttcggggatgatatcgcgataacgcgtacgtacggttttgttcggtcgcggcgttttttcgatttaggtcggagttgtttcgggtgcgggttttggggatcggtcgcgggcgttttcggttttttttgaatttcgtagattttttttttttttttcgaagcgcggcgattttcggtaaatttttttttgggagattcgttcggtgttaagcggatttaagagattgataggagtcggagggggtagtagagggggatttatt

SEQ ID NO: 20646 - DNA, 601 bp, Artificial Sequence
  chemically treated genomic DNA (Homo sapiens) CpG-island No: 20646
aataaatccccctctactaccccctccgactcctatcaatctcttaaatccgcttaacaccgaacgaatctcccaaaaaaaaatttaccgaaaatcgccgcgcttcgaaaaaaaaaaaaaaaatctacgaaattcaaaaaaaaccgaaaacgcccgcgaccgatccccaaaacccgcacccgaaacaactccgacctaaatcgaaaaaacgccgcgaccgaacaaaaccgtacgtacgcgttatcgcgatatcatccccgaaaactaatcaacgccccaaaccttacgccctacccctacgtccccgaacgcctcaacgaccgccgaccgaacaaataccgcaaatccgcgctatatcccgcgctatatcccgccgcgaccacttccgaaaacgcgcgaaccgaaacgaaacgaacgcctcgaacgtaccaaaacgctctaaacgacccaaaaaaccgcgacgcaccccgcttaacactttaactaataaataaaaataaaaaaaaactcgacaacccacgaaatccgcgaacaaaaacgaaaattaaaccgtaataaaaaccgacgaacgcgaattaatcgcgaccaatcctaccgaacg

SEQ ID NO: 20647 - DNA, 601 bp, Artificial Sequence
  chemically treated genomic DNA (Homo sapiens) CpG-island No: 20647
ggtggatttttttttgttgtttttttcggtttttgttagttttttgggttcgtttggtatcgggcgggttttttaaaagaaagtttgtcgggagtcgtcgcgtttcggaaaggaaggggagggtttgcggagtttagaggaagtcggggacgttcgcggtcggtttttagggttcgtattcgggatagtttcggtttaggtcggggaggcgtcgcggtcgggtagggtcgtgcgtgcgcgttgtcgcgatgttattttcggggattggttagcgttttaggttttgcgttttgtttttgcgttttcgagcgttttagcggtcgtcggtcgggtaagtgtcgtaggttcgcgttgtgtttcgcgttgtgtttcgtcgcggttattttcgaaagcgcgcgggtcggagcgagacgggcgtttcgagcgtgttaagacgttttgggcggtttagggagtcgcggcgtatttcgtttgatattttggttggtggatggaggtggggaggaattcggtagtttacgggattcgcgggtaggggcggaggttagatcgtggtgagggtcgacgggcgcgggttagtcgcggttaattttgtcgggcg

SEQ ID NO: 20648 - DNA, 601 bp, Artificial Sequence
  chemically treated genomic DNA (Homo sapiens) CpG-island No: 20648
cgcccgacaaaattaaccgcgactaacccgcgcccgtcgaccctcaccacgatctaacctccgcccctacccgcgaatcccgtaaactaccgaattcctccccacctccatccaccaaccaaaatatcaaacgaaatacgccgcgactccctaaaccgcccaaaacgtcttaacacgctcgaaacgcccgtctcgctccgacccgcgcgctttcgaaaataaccgcgacgaaacacaacgcgaaacacaacgcgaacctacgacacttacccgaccgacgaccgctaaaacgctcgaaaacgcaaaaacaaaacgcaaaacctaaaacgctaaccaatccccgaaaataacatcgcgacaacgcgcacgcacgaccctacccgaccgcgacgcctccccgacctaaaccgaaactatcccgaatacgaaccctaaaaaccgaccgcgaacgtccccgacttcctctaaactccgcaaaccctccccttcctttccgaaacgcgacgactcccgacaaactttcttttaaaaaacccgcccgataccaaacgaacccaaaaaactaacaaaaaccgaaaaaaacaacaaaaaaaaatccacc

SEQ ID NO: 20649 - DNA, 575 bp, Artificial Sequence
  chemically treated genomic DNA (Homo sapiens) CpG-island No: 20649
gcggtggggtagggcgtattgcgagaagagtatttcgcgtatgcgtatattatcgagcgaacgcgtcgtgttcgggaaggtaggagaaagaggcggagttttttgttaacgatatttttaatttttgttaacgcgtaggcgtattttttgaagttgaaggttagtatagataaagggttttagaatcgcgtaggcgtaattgtgttttggttcgttaagatgtcgtttttaaagtataagtcgtcgagtttgcgtattttgtttgagattttcgatttagtcgaatataatatattttcggaaattcggcgggcgtaagtcgagcggttggttataagagtttagttgaaacgagagtatttgttttagtataacgattttaatcgtcgagggtttatcgtgagtgtggggttttttaggcgggaatagggttcgagttttgggagagatcgagagagattacgtaaagggtcggttatcgttttcgattagtattttagacgtaggtttttttttaggtttagttaatttattatttttttatttttgttagagtttggttttcgagaggatcg

SEQ ID NO: 20650 - DNA, 575 bp, Artificial Sequence
  chemically treated genomic DNA (Homo sapiens) CpG-island No: 20650
cgatcctctcgaaaaccaaactctaacaaaaataaaaaaataataaattaactaaacctaaaaaaaaacctacgtctaaaatactaatcgaaaacgataaccgaccctttacgtaatctctctcgatctctcccaaaactcgaaccctattcccgcctaaaaaaccccacactcacgataaaccctcgacgattaaaatcgttatactaaaacaaatactctcgtttcaactaaactcttataaccaaccgctcgacttacgcccgccgaatttccgaaaatatattatattcgactaaatcgaaaatctcaaacaaaatacgcaaactcgacgacttatactttaaaaacgacatcttaacgaaccaaaacacaattacgcctacgcgattctaaaaccctttatctatactaaccttcaacttcaaaaaatacgcctacgcgttaacaaaaattaaaaatatcgttaacaaaaaactccgcctctttctcctaccttcccgaacacgacgcgttcgctcgataatatacgcatacgcgaaatactcttctcgcaatacgccctaccccaccgc

SEQ ID NO: 20651 - DNA, 575 bp, Artificial Sequence
  chemically treated genomic DNA (Homo sapiens) CpG-island No: 20651
cggttttttcgagggttaagttttggtaaaggtaaaagggtagtgagttggttaggtttggaagaggatttgcgtttgagatattgatcgggagcggtggtcgattttttgcgtggtttttttcggttttttttaggattcgggttttattttcgtttgggaggttttatatttacgatgagttttcggcggttgggatcgttgtattgaagtaggtattttcgttttagttgggtttttatggttaatcgttcggtttgcgttcgtcgggttttcggagatatgttgtattcggttgggtcgagggttttaggtagagtgcgtaggttcgacggtttatattttgggaacgatattttggcgaattagggtataattgcgtttgcgcgattttgaggttttttgtttatgttgatttttagttttaggaagtgcgtttgcgcgttagtagaggttggggatgtcgttaataaggagtttcgttttttttttttattttttcgaatacggcgcgttcgttcggtgatatgcgtatgcgcgaagtgtttttttcgtagtgcgttttgttttatcgt

SEQ ID NO: 20652 - DNA, 575 bp, Artificial Sequence
  chemically treated genomic DNA (Homo sapiens) CpG-island No: 20652
acgataaaacaaaacgcactacgaaaaaaacacttcgcgcatacgcatatcaccgaacgaacgcgccgtattcgaaaaaataaaaaaaaaaaacgaaactccttattaacgacatccccaacctctactaacgcgcaaacgcacttcctaaaactaaaaatcaacataaacaaaaaacctcaaaatcgcgcaaacgcaattataccctaattcgccaaaatatcgttcccaaaatataaaccgtcgaacctacgcactctacctaaaaccctcgacccaaccgaatacaacatatctccgaaaacccgacgaacgcaaaccgaacgattaaccataaaaacccaactaaaacgaaaatacctacttcaatacaacgatcccaaccgccgaaaactcatcgtaaatataaaacctcccaaacgaaaataaaacccgaatcctaaaaaaaaccgaaaaaaaccacgcaaaaaatcgaccaccgctcccgatcaatatctcaaacgcaaatcctcttccaaacctaaccaactcactacccttttacctttaccaaaacttaaccctcgaaaaaaccg

SEQ ID NO: 20653 - DNA, 670 bp, Artificial Sequence
  chemically treated genomic DNA (Homo sapiens) CpG-island No: 20653
aggacgcgcgtttattcgtttagcgcgtagatttaagaggtttcggggatcgagttcggatttttcggtttttcgtttatttcggcgcggatttaggcgatcgttattagcgcgagcgcgagcgcgagttagcgtttttatatttgcggaagagagaagagagcgagtttgaaggcgtcgggtttcgcgtcgatttgggaaatttgttcgggtttcgtaggttcgtttcggtcgtttaagtattttcggtcgttcgaagagttcggttttcgcgtcgtgcgttttgcgtttatcgtggtttggtttaggttttttgggggcgcggggtaggacggcggtagcgagttgtaagcgtaggtgggagtttcgtcgatcgttagtttcggaggaaatgcgattttttttcgtcgttttttaagattttttttttttcgtttgtttgtttttttagtttttttttattttttttttttttttgttgtagcggttttcgcggttttcgtttttttttttttcgatttttgtttcggggagttcgcgggagttttggcgtcgtcgaattttttttttcgtacggtttttcgttcggcgttttttcgggtttttttggacgtggagcggaggtagagggggtgtttcgtgggtttttgttataaaggggtagggggaa

SEQ ID NO: 20654 - DNA, 670 bp, Artificial Sequence
  chemically treated genomic DNA (Homo sapiens) CpG-island No: 20654
ttccccctacccctttataacaaaaacccacgaaacaccccctctacctccgctccacgtccaaaaaaacccgaaaaaacgccgaacgaaaaaccgtacgaaaaaaaaaattcgacgacgccaaaactcccgcgaactccccgaaacaaaaatcgaaaaaaaaaaaaacgaaaaccgcgaaaaccgctacaacaaaaaaaaaaaaaaaataaaaaaaaactaaaaaaacaaacaaacgaaaaaaaaaaaatcttaaaaaacgacgaaaaaaaatcgcatttcctccgaaactaacgatcgacgaaactcccacctacgcttacaactcgctaccgccgtcctaccccgcgcccccaaaaaacctaaaccaaaccacgataaacgcaaaacgcacgacgcgaaaaccgaactcttcgaacgaccgaaaatacttaaacgaccgaaacgaacctacgaaacccgaacaaatttcccaaatcgacgcgaaacccgacgccttcaaactcgctctcttctctcttccgcaaatataaaaacgctaactcgcgctcgcgctcgcgctaataacgatcgcctaaatccgcgccgaaataaacgaaaaaccgaaaaatccgaactcgatccccgaaacctcttaaatctacgcgctaaacgaataaacgcgcgtcct

SEQ ID NO: 20655 - DNA, 670 bp, Artificial Sequence
  chemically treated genomic DNA (Homo sapiens) CpG-island No: 20655
ttttttttatttttttgtggtagggatttacgggatattttttttgttttcgttttacgtttaggggggttcgaaggggcgtcggacgaaggatcgtgcggagagaggggttcggcggcgttaggattttcgcgggtttttcggagtaggggtcggaaggagggggagcgggagtcgcgggggtcgttgtagtagaagggggaggagaatggggaggagttgggggggtaggtaggcggggaaggagaggttttaaggggcggcgaggggaggtcgtatttttttcgaggttggcgatcggcggagtttttatttgcgtttatagttcgttgtcgtcgttttgtttcgcgtttttaggagatttggattagattacggtgagcgtagggcgtacggcgcggaggtcggatttttcgggcggtcgggggtgtttgggcggtcggagcgagtttgcgggattcgagtaagttttttaggtcggcgcggggttcggcgtttttagattcgtttttttttttttttcgtagatgtggaaacgttggttcgcgttcgcgttcgcgttggtggcggtcgtttgggttcgcgtcgaggtaggcgaggggtcgaggagttcgaattcggttttcggggttttttgggtttgcgcgttgggcgggtgggcgcgcgtttt

SEQ ID NO: 20656 - DNA, 670 bp, Artificial Sequence
  chemically treated genomic DNA (Homo sapiens) CpG-island No: 20656
aaaacgcgcgcccacccgcccaacgcgcaaacccaaaaaaccccgaaaaccgaattcgaactcctcgacccctcgcctacctcgacgcgaacccaaacgaccgccaccaacgcgaacgcgaacgcgaaccaacgtttccacatctacgaaaaaaaaaaaaaaacgaatctaaaaacgccgaaccccgcgccgacctaaaaaacttactcgaatcccgcaaactcgctccgaccgcccaaacacccccgaccgcccgaaaaatccgacctccgcgccgtacgccctacgctcaccgtaatctaatccaaatctcctaaaaacgcgaaacaaaacgacgacaacgaactataaacgcaaataaaaactccgccgatcgccaacctcgaaaaaaatacgacctcccctcgccgccccttaaaacctctccttccccgcctacctacccccccaactcctccccattctcctcccccttctactacaacgacccccgcgactcccgctccccctccttccgacccctactccgaaaaacccgcgaaaatcctaacgccgccgaacccctctctccgcacgatccttcgtccgacgccccttcgaacccccctaaacgtaaaacgaaaacaaaaaaaatatcccgtaaatccctaccacaaaaaaataaaaaaaa

SEQ ID NO: 20657 - DNA, 512 bp, Artificial Sequence
  chemically treated genomic DNA (Homo sapiens) CpG-island No: 20657
gtcgttcgttagacgagttttcggggttcgtttttagttttgagttgcgttttttagttttggggttatagcgttagcgttattttgttaggttttcggatatcgttcgtttggtgcgtcgtcggttagttttttgttcgcgcggggtcgttcgtcgcgggtttagggtagattatgcgttcgttaagttcgttgttcgttcgttggttatgcgtgttggtaggtcgttttcgtttgggtttttggggttcggcggtgagtgttcgttcgttcgtttagagtttcggttagttttgggggttgcggagggcgggggaggtgggggatggcgggagtcgggtcgtttgtgcgcgtgtttgtgtaagaggaataggggatattaagtatttcgattcgtttttttttatcgttttagatcgaatttagacgcgagggttgggatattggtcgtgtttagttttttttagcgtagttcggagtaggtatagtattagtggaggggtagcggggaa

SEQ ID NO: 20658 - DNA, 512 bp, Artificial Sequence
  chemically treated genomic DNA (Homo sapiens) CpG-island No: 20658
ttccccgctacccctccactaatactatacctactccgaactacgctaaaaaaaactaaacacgaccaatatcccaaccctcgcgtctaaattcgatctaaaacgataaaaaaaaacgaatcgaaatacttaatatcccctattcctcttacacaaacacgcgcacaaacgacccgactcccgccatcccccacctcccccgccctccgcaacccccaaaactaaccgaaactctaaacgaacgaacgaacactcaccgccgaaccccaaaaacccaaacgaaaacgacctaccaacacgcataaccaacgaacgaacaacgaacttaacgaacgcataatctaccctaaacccgcgacgaacgaccccgcgcgaacaaaaaactaaccgacgacgcaccaaacgaacgatatccgaaaacctaacaaaataacgctaacgctataaccccaaaactaaaaaacgcaactcaaaactaaaaacgaaccccgaaaactcgtctaacgaacgac

SEQ ID NO: 20659 - DNA, 512 bp, Artificial Sequence
  chemically treated genomic DNA (Homo sapiens) CpG-island No: 20659
tttttcgttgtttttttattgatgttgtgtttgtttcgggttgcgttgggagggattgggtacgattaatattttagttttcgcgtttaggttcggtttggagcggtgggaggaggcgagtcgagatgtttgatgttttttattttttttatatagatacgcgtatagacggttcggttttcgttattttttatttttttcgtttttcgtaatttttaaggttggtcgggattttgggcggacgggcgaatatttatcgtcgggttttaagggtttaggcgagggcggtttgttagtacgtatagttagcgggcgggtagcggatttggcgggcgtatggtttgttttgagttcgcggcgggcggtttcgcgcgggtaaagagttggtcggcggcgtattaggcgggcgatgttcgggagtttgatagagtggcgttggcgttgtggttttagagttaagaggcgtagtttagggttgggggcgggtttcgggggttcgtttgacgggcggt

SEQ ID NO: 20660 - DNA, 512 bp, Artificial Sequence
  chemically treated genomic DNA (Homo sapiens) CpG-island No: 20660
accgcccgtcaaacgaacccccgaaacccgcccccaaccctaaactacgcctcttaactctaaaaccacaacgccaacgccactctatcaaactcccgaacatcgcccgcctaatacgccgccgaccaactctttacccgcgcgaaaccgcccgccgcgaactcaaaacaaaccatacgcccgccaaatccgctacccgcccgctaactatacgtactaacaaaccgccctcgcctaaacccttaaaacccgacgataaatattcgcccgtccgcccaaaatcccgaccaaccttaaaaattacgaaaaacgaaaaaaataaaaaataacgaaaaccgaaccgtctatacgcgtatctatataaaaaaaataaaaaacatcaaacatctcgactcgcctcctcccaccgctccaaaccgaacctaaacgcgaaaactaaaatattaatcgtacccaatccctcccaacgcaacccgaaacaaacacaacatcaataaaaaaacaacgaaaaa

SEQ ID NO: 20661 - DNA, 691 bp, Artificial Sequence
  chemically treated genomic DNA (Homo sapiens) CpG-island No: 20661
tcgttcgttttacgatttcggttcggcgttttttttttcggaatttttatttagtgttcggttttcgtttcgtttcgcgcggttttcggttttagtttcgcgcgtttcgacgtttcgtttgcgtcgcgggttcgagtagtggacggggggcggttcgttcggttttttcgtattcgtttttcgttcgggtcgaggcgtcgcggtcgcgcgttttttttggaggaggaggaggaaggaggcgggaggaggagttgtcgagaggagaaggcgagcgcggtagtcgcgtcggcgttgggcgaggaagcggagtcgggtcgttttcgggtaagcgttcggggagttcgggcgggaggtaggggtagggtttcgtcgttcgttttcgggtcgttcgcggttcgggatacggttggttttcgtttcggagtgtagggggcggattcggcgcgggtcgggttagggaggtcgtcgggcgcggggttgtagcgacgggtttgggttagcgcgaggttttgcgtcgtttcggcgggtgcgcgggcgggggttagggtcggggaacgggggtcggggttagtttcgggagcggggacgcggaaatcgggaagtcggggtcggggcgcggcggtttttgaagggtcgaggtttgcgcggtcgcggacggtttttttcgatttttcggttttttcggtcgcgg

SEQ ID NO: 20662 - DNA, 691 bp, Artificial Sequence
  chemically treated genomic DNA (Homo sapiens) CpG-island No: 20662
ccgcgaccgaaaaaaccgaaaaatcgaaaaaaaccgtccgcgaccgcgcaaacctcgacccttcaaaaaccgccgcgccccgaccccgacttcccgatttccgcgtccccgctcccgaaactaaccccgacccccgttccccgaccctaacccccgcccgcgcacccgccgaaacgacgcaaaacctcgcgctaacccaaacccgtcgctacaaccccgcgcccgacgacctccctaacccgacccgcgccgaatccgccccctacactccgaaacgaaaaccaaccgtatcccgaaccgcgaacgacccgaaaacgaacgacgaaaccctacccctacctcccgcccgaactccccgaacgcttacccgaaaacgacccgactccgcttcctcgcccaacgccgacgcgactaccgcgctcgccttctcctctcgacaactcctcctcccgcctccttcctcctcctcctccaaaaaaaacgcgcgaccgcgacgcctcgacccgaacgaaaaacgaatacgaaaaaaccgaacgaaccgccccccgtccactactcgaacccgcgacgcaaacgaaacgtcgaaacgcgcgaaactaaaaccgaaaaccgcgcgaaacgaaacgaaaaccgaacactaaataaaaattccgaaaaaaaaaacgccgaaccgaaatcgtaaaacgaacga

SEQ ID NO: 20663 - DNA, 691 bp, Artificial Sequence
  chemically treated genomic DNA (Homo sapiens) CpG-island No: 20663
tcgcggtcgaagaggtcgaggggtcgagaagagtcgttcgcggtcgcgtaggtttcggttttttaggggtcgtcgcgtttcggtttcggtttttcggttttcgcgttttcgttttcgggattggtttcggttttcgtttttcggttttggttttcgttcgcgtattcgtcgagacggcgtagggtttcgcgttgatttagattcgtcgttgtagtttcgcgttcggcggtttttttggttcggttcgcgtcggattcgttttttgtatttcgaggcgaaaattagtcgtgtttcggatcgcgggcgattcggaggcggacggcgaagttttgtttttgtttttcgttcgagtttttcggacgtttattcggaggcggttcggtttcgttttttcgtttagcgtcggcgcgattgtcgcgttcgtttttttttttcggtaattttttttttcgtttttttttttttttttttttaggaggggcgcgcggtcgcggcgtttcggttcgagcggggagcgggtgcggaggagtcgagcgggtcgtttttcgtttattattcgggttcgcggcgtaggcggggcgtcggggcgcgcggggttgaggtcgggggtcgcgcggggcggggcgggggtcgggtattaagtgggggtttcgaggggaggggcgtcgggtcggggtcgtggggcggacgg

SEQ ID NO: 20664 - DNA, 691 bp, Artificial Sequence
  chemically treated genomic DNA (Homo sapiens) CpG-island No: 20664
ccgtccgccccacgaccccgacccgacgcccctcccctcgaaacccccacttaatacccgacccccgccccgccccgcgcgacccccgacctcaaccccgcgcgccccgacgccccgcctacgccgcgaacccgaataataaacgaaaaacgacccgctcgactcctccgcacccgctccccgctcgaaccgaaacgccgcgaccgcgcgcccctcctaaaaaaaaaaaaaaaaaaaaacgaaaaaaaaaattaccgaaaaaaaaaaacgaacgcgacaatcgcgccgacgctaaacgaaaaaacgaaaccgaaccgcctccgaataaacgtccgaaaaactcgaacgaaaaacaaaaacaaaacttcgccgtccgcctccgaatcgcccgcgatccgaaacacgactaattttcgcctcgaaatacaaaaaacgaatccgacgcgaaccgaaccaaaaaaaccgccgaacgcgaaactacaacgacgaatctaaatcaacgcgaaaccctacgccgtctcgacgaatacgcgaacgaaaaccaaaaccgaaaaacgaaaaccgaaaccaatcccgaaaacgaaaacgcgaaaaccgaaaaaccgaaaccgaaacgcgacgacccctaaaaaaccgaaacctacgcgaccgcgaacgactcttctcgacccctcgacctcttcgaccgcga

SEQ ID NO: 20665 - DNA, 1647 bp, Artificial Sequence
  chemically treated genomic DNA (Homo sapiens) CpG-island No: 20665
gagcgttgggggcgtcgggatgatttttaggatttcgattcgtttttatcgcggcgcgagtaaggggcgggagggtttagtgttcgcgtcgggtttcggaatttacgcgtttttcgtcgcggttcgagatcgacgcggcggttttcgtaattcgtcgttttttttttaagttttcgagttagtttttgttattttttcggcgttttttgtttcgcgtcgtcgtcgggtgtttcgcgcgtcgggttcggtcgcggttggggtttcgaggagcggggtgaggggtaattcggcgtttagcgagcggagcggcggcgagcggagatgcgaagtgatttattcgttcggtaataatagaattgataagttgtagggaacgcgtcgttcgtaggttcgcgtttgcggtcgtcgtcgttcggacgttttcggcgggtttaggaggtcggaaagtatttttagtttatttaaggggcgtttttaaatagaaaatagaaatttcgataattagtttcgttttcggtcggcgtttttttttttaggttcggtttttttttatttttgttgttttgtttcggatttgtcgaataatgagtttggtttcgcggtcgaagtcgttcgatttttcgcgcgtttcggagtttgggcgtcggttcgagtcgggtatcgaacggggcgtataggtcgagcgcgtcgttagcgggtttgagcgttcgcgattcgagttttcgtttttatttcgttttttaatttggaggggatttcgggtttcgcgttgtataaaggggcgcggagttgaggcgggggacgggggcgtttttatttcggtagggacgcggcggcgtttcgtagtttttagtttcgtcgcgtcgttttattttcgttcgttagttcgtaattatttgtcgtttcgttttcgtatttaattatttcgattaaagtttattttggtcgggagaacgggtttgggtttttttttgtatcgtttagcggttcggtttattttgtttcgtacgagttttcgggtttgggagggggaggcggttttcgggtttggtcgtttttttttttcggggcgggttgtcggttttttcgaatagaatttgtgggtttttttaggcggatatttttttcgttgaggcggttttattatcgcgttcggttcgttttcggattttttcgcgtcgggaagagtcgcgggttaattttttttttttcgattcgtttcgtcgtttaggaagtggggtcggtagagggggcggggaggagttgtcggggattgggaggagtcgtatcgcggcgggtggataaagttcgcggtcgggtgaggcgggacggagttggggtcggtggggaggggtatgaggcgttcgtaggtatttcgagaagtaggtttcgatcgttcgtcgacgaagtttcgttcgggttttttgggagcggggtggtaggtatcgtggcgttttttcgcgttggttttgttggttttcggttttcgaagcggagcgacggagatatagttgtggaagtatttggattcgttgtttaggttttcgagtttttcggaattcgaggtcgtaggatattgaaggttgttattttcgagtaggttacgttggacgttattttaagttgggtttagaggttttcgtttag

SEQ ID NO: 20666 - DNA, 1647 bp, Artificial Sequence
  chemically treated genomic DNA (Homo sapiens) CpG-island No: 20666
ctaaacgaaaacctctaaacccaacttaaaataacgtccaacgtaacctactcgaaaataacaaccttcaatatcctacgacctcgaattccgaaaaactcgaaaacctaaacaacgaatccaaatacttccacaactatatctccgtcgctccgcttcgaaaaccgaaaaccaacaaaaccaacgcgaaaaaacgccacgatacctaccaccccgctcccaaaaaacccgaacgaaacttcgtcgacgaacgatcgaaacctacttctcgaaatacctacgaacgcctcatacccctccccaccgaccccaactccgtcccgcctcacccgaccgcgaactttatccacccgccgcgatacgactcctcccaatccccgacaactcctccccgccccctctaccgaccccacttcctaaacgacgaaacgaatcgaaaaaaaaaaaattaacccgcgactcttcccgacgcgaaaaaatccgaaaacgaaccgaacgcgataataaaaccgcctcaacgaaaaaaatatccgcctaaaaaaacccacaaattctattcgaaaaaaccgacaacccgccccgaaaaaaaaaaacgaccaaacccgaaaaccgcctccccctcccaaacccgaaaactcgtacgaaacaaaataaaccgaaccgctaaacgatacaaaaaaaaacccaaacccgttctcccgaccaaaataaactttaatcgaaataattaaatacgaaaacgaaacgacaaataattacgaactaacgaacgaaaataaaacgacgcgacgaaactaaaaactacgaaacgccgccgcgtccctaccgaaataaaaacgcccccgtcccccgcctcaactccgcgcccctttatacaacgcgaaacccgaaatcccctccaaattaaaaaacgaaataaaaacgaaaactcgaatcgcgaacgctcaaacccgctaacgacgcgctcgacctatacgccccgttcgatacccgactcgaaccgacgcccaaactccgaaacgcgcgaaaaatcgaacgacttcgaccgcgaaaccaaactcattattcgacaaatccgaaacaaaacaacaaaaataaaaaaaaaccgaacctaaaaaaaaaaacgccgaccgaaaacgaaactaattatcgaaatttctattttctatttaaaaacgccccttaaataaactaaaaatactttccgacctcctaaacccgccgaaaacgtccgaacgacgacgaccgcaaacgcgaacctacgaacgacgcgttccctacaacttatcaattctattattaccgaacgaataaatcacttcgcatctccgctcgccgccgctccgctcgctaaacgccgaattacccctcaccccgctcctcgaaaccccaaccgcgaccgaacccgacgcgcgaaacacccgacgacgacgcgaaacaaaaaacgccgaaaaaataacaaaaactaactcgaaaacttaaaaaaaaaacgacgaattacgaaaaccgccgcgtcgatctcgaaccgcgacgaaaaacgcgtaaattccgaaacccgacgcgaacactaaaccctcccgccccttactcgcgccgcgataaaaacgaatcgaaatcctaaaaatcatcccgacgcccccaacgctc

SEQ ID NO: 20667 - DNA, 1647 bp, Artificial Sequence
  chemically treated genomic DNA (Homo sapiens) CpG-island No: 20667
ttggacgggagtttttgggtttagtttagggtggcgtttagcgtgatttattcgggaatggtagtttttagtgttttgcggtttcgggtttcgggaagttcggggatttgggtagcggatttagatgtttttatagttgtgttttcgtcgtttcgtttcgggggtcgagaattagtaagattaacgcgaggaggcgttacggtatttgttatttcgtttttaggaggttcggacgaggtttcgtcggcgagcggtcggggtttgtttttcgaggtgtttgcgagcgttttatgtttttttttatcggttttaatttcgtttcgttttattcgatcgcgggttttgtttattcgtcgcggtgcggttttttttagttttcgatagttttttttcgttttttttgtcggttttattttttaggcggcggagcgggtcggggagggaagggttaattcgcggtttttttcggcgcggagggattcggaggcgagtcgagcgcggtggtgaggtcgttttagcgaaaaaaatgttcgtttgaagagatttataagttttattcggggggatcgatagttcgtttcgggaggaaggggcggttaggttcgaaagtcgttttttttttttagattcgagagttcgtgcggggtaaagtgaatcgagtcgttgggcggtgtaaggggaagtttaagttcgttttttcggttaaagtgaattttaatcggggtggttggatgcggagacggggcggtaggtaattgcgggttagcgagcgggagtggggcggcgcggcggggttgggggttgcggggcgtcgtcgcgtttttgtcggagtgggggcgttttcgtttttcgttttaatttcgcgtttttttgtatagcgcgaaattcggggttttttttaagttggggagcggagtgggggcggaggttcgagtcgcgggcgtttaggttcgttggcggcgcgttcggtttgtgcgtttcgttcggtgttcgattcgggtcggcgtttaggtttcggggcgcgcgggagatcgggcggtttcggtcgcggagttaggtttattgttcggtaggttcggggtagggtagtaaaagtgggaggaggtcgagtttggggaggaggacgtcggtcgagagcgagattagttgtcggggtttttgttttttgtttaaaaacgttttttggatgagttgggggtgtttttcgattttttgggttcgtcggggacgttcgggcggcggcggtcgtagacgcgggtttgcgagcggcgcgttttttgtaatttgttagttttattgttgtcgagcgagtgagttatttcgtattttcgttcgtcgtcgtttcgttcgttggacgtcgaattgttttttatttcgtttttcgagattttagtcgcggtcgggttcggcgcgcggagtattcggcggcggcgcggagtagggggcgtcgaggaggtggtagagattggttcggaaatttgggggagaggcggcgagttgcgggagtcgtcgcgtcgatttcgggtcgcggcgaggaacgcgtggatttcgggattcggcgcgggtattgagttttttcgttttttgttcgcgtcgcggtgggagcgagtcggggttttggaagttatttcggcgtttttagcgttt

SEQ ID NO: 20668 - DNA, 1647 bp, Artificial Sequence
  chemically treated genomic DNA (Homo sapiens) CpG-island No: 20668
aaacgctaaaaacgccgaaataacttccaaaaccccgactcgctcccaccgcgacgcgaacaaaaaacgaaaaaactcaatacccgcgccgaatcccgaaatccacgcgttcctcgccgcgacccgaaatcgacgcgacgactcccgcaactcgccgcctctcccccaaatttccgaaccaatctctaccacctcctcgacgccccctactccgcgccgccgccgaatactccgcgcgccgaacccgaccgcgactaaaatctcgaaaaacgaaataaaaaacaattcgacgtccaacgaacgaaacgacgacgaacgaaaatacgaaataactcactcgctcgacaacaataaaactaacaaattacaaaaaacgcgccgctcgcaaacccgcgtctacgaccgccgccgcccgaacgtccccgacgaacccaaaaaatcgaaaaacacccccaactcatccaaaaaacgtttttaaacaaaaaacaaaaaccccgacaactaatctcgctctcgaccgacgtcctcctccccaaactcgacctcctcccacttttactaccctaccccgaacctaccgaacaataaacctaactccgcgaccgaaaccgcccgatctcccgcgcgccccgaaacctaaacgccgacccgaatcgaacaccgaacgaaacgcacaaaccgaacgcgccgccaacgaacctaaacgcccgcgactcgaacctccgcccccactccgctccccaacttaaaaaaaaccccgaatttcgcgctatacaaaaaaacgcgaaattaaaacgaaaaacgaaaacgcccccactccgacaaaaacgcgacgacgccccgcaacccccaaccccgccgcgccgccccactcccgctcgctaacccgcaattacctaccgccccgtctccgcatccaaccaccccgattaaaattcactttaaccgaaaaaacgaacttaaacttccccttacaccgcccaacgactcgattcactttaccccgcacgaactctcgaatctaaaaaaaaaaaacgactttcgaacctaaccgccccttcctcccgaaacgaactatcgatccccccgaataaaacttataaatctcttcaaacgaacatttttttcgctaaaacgacctcaccaccgcgctcgactcgcctccgaatccctccgcgccgaaaaaaaccgcgaattaacccttccctccccgacccgctccgccgcctaaaaaataaaaccgacaaaaaaaacgaaaaaaaactatcgaaaactaaaaaaaaccgcaccgcgacgaataaacaaaacccgcgatcgaataaaacgaaacgaaattaaaaccgataaaaaaaaacataaaacgctcgcaaacacctcgaaaaacaaaccccgaccgctcgccgacgaaacctcgtccgaacctcctaaaaacgaaataacaaataccgtaacgcctcctcgcgttaatcttactaattctcgacccccgaaacgaaacgacgaaaacacaactataaaaacatctaaatccgctacccaaatccccgaacttcccgaaacccgaaaccgcaaaacactaaaaactaccattcccgaataaatcacgctaaacgccaccctaaactaaacccaaaaactcccgtccaa

SEQ ID NO: 20669 - DNA, 625 bp, Artificial Sequence
  chemically treated genomic DNA (Homo sapiens) CpG-island No: 20669
tttatttcggtagtttttagttttagacgttgcgtggagcggcggagtcggagggaagtaaaggatcgtttgcgttgttgttttcgtttcgcgcgttttgcgtttttcgtttttggcggtcgtttcgaagtttagtttttttgtttgtttcggagttgtttcgggttagtcgagaagagagcggtcggtaagtttgggcgcgcgtaggcggcgggtcgcgggtattgggcgtttcgttggggcggggggaggtggttatcgttttcggtttggcgtttcgcgcgtatttcggcgatggttttttcgtcgcggcgacggttgcgtttcggttttcgcggtttttcgttttttttttcgggatttttgttatttttgtgtcgcgtttttaatttagacgtggatagttttgtcgagtattttggtttcgagggaagttatttcggtttcgtcgtggattttttcgtgtttagcgcgttttcgtaagtggtcgtatttggaattggagtcggtttttttttttatcgcgcgtatttatttagcgtttttttattgggattgattttcgagagatttcggcgtttgtttgttttatttattttattttttagagtggtttatattttgg

SEQ ID NO: 20670 - DNA, 625 bp, Artificial Sequence
  chemically treated genomic DNA (Homo sapiens) CpG-island No: 20670
ccaaaatataaaccactctaaaaaataaaataaataaaacaaacaaacgccgaaatctctcgaaaatcaatcccaataaaaaaacgctaaataaatacgcgcgataaaaaaaaaaaccgactccaattccaaatacgaccacttacgaaaacgcgctaaacacgaaaaaatccacgacgaaaccgaaataacttccctcgaaaccaaaatactcgacaaaactatccacgtctaaattaaaaacgcgacacaaaaataacaaaaatcccgaaaaaaaaaacgaaaaaccgcgaaaaccgaaacgcaaccgtcgccgcgacgaaaaaaccatcgccgaaatacgcgcgaaacgccaaaccgaaaacgataaccacctccccccgccccaacgaaacgcccaatacccgcgacccgccgcctacgcgcgcccaaacttaccgaccgctctcttctcgactaacccgaaacaactccgaaacaaacaaaaaaactaaacttcgaaacgaccgccaaaaacgaaaaacgcaaaacgcgcgaaacgaaaacaacaacgcaaacgatcctttacttccctccgactccgccgctccacgcaacgtctaaaactaaaaactaccgaaataaa

SEQ ID NO: 20671 - DNA, 625 bp, Artificial Sequence
  chemically treated genomic DNA (Homo sapiens) CpG-island No: 20671
ttaggatataaattattttgagaggtaggatgggtgagatagatagacgtcgggatttttcggaaattaattttaatggagaaacgttgggtgggtgcgcgcggtgggggagggggtcggttttagttttaagtgcggttatttacgaagacgcgttgggtacgaagaaatttacggcgaagtcgaagtaatttttttcggggttagagtattcggtaggattgtttacgtttaggttgaaggcgcggtatagaggtagtaggagtttcgagagaagaagcgggaggtcgcggggatcgaggcgtagtcgtcgtcgcggcggaaaagttatcgtcgaagtgcgcgcgggacgttaagtcgggagcggtagttattttttttcgttttagcgaggcgtttagtgttcgcggttcgtcgtttgcgcgcgtttaaatttgtcggtcgtttttttttcggttagttcgggatagtttcggggtaggtaagagggttgagtttcggagcgatcgttagggacgaggggcgtagagcgcgcggggcggggatagtagcgtagacggttttttgttttttttcggtttcgtcgttttacgtagcgtttgaggttggggattgtcggggtgag

SEQ ID NO: 20672 - DNA, 625 bp, Artificial Sequence
  chemically treated genomic DNA (Homo sapiens) CpG-island No: 20672
ctcaccccgacaatccccaacctcaaacgctacgtaaaacgacgaaaccgaaaaaaaacaaaaaaccgtctacgctactatccccgccccgcgcgctctacgcccctcgtccctaacgatcgctccgaaactcaaccctcttacctaccccgaaactatcccgaactaaccgaaaaaaaaacgaccgacaaatttaaacgcgcgcaaacgacgaaccgcgaacactaaacgcctcgctaaaacgaaaaaaaataactaccgctcccgacttaacgtcccgcgcgcacttcgacgataacttttccgccgcgacgacgactacgcctcgatccccgcgacctcccgcttcttctctcgaaactcctactacctctataccgcgccttcaacctaaacgtaaacaatcctaccgaatactctaaccccgaaaaaaattacttcgacttcgccgtaaatttcttcgtacccaacgcgtcttcgtaaataaccgcacttaaaactaaaaccgaccccctcccccaccgcgcgcacccacccaacgtttctccattaaaattaatttccgaaaaatcccgacgtctatctatctcacccatcctacctctcaaaataatttatatcctaa

SEQ ID NO: 20673 - DNA, 792 bp, Artificial Sequence
  chemically treated genomic DNA (Homo sapiens) CpG-island No: 20673
tcgtttcgcgtttcgcgttttcgggtgcggattttgggcgttcgtcggttgcgcgttaggatttcgttattttaggcggtttttaaggtttacgcgtttttgtttcgttcggattttcgagtttagtcgtggcgtttatttgttttgttcgtagcgttagttgtacggtcgtttggaagtattttttttaggggtcggtcgttagcgtcgtttggttttcgtcgttcggttttatcgcggtttcgtcgggtttttttatttttagtttttttcggcgggatttcggtttttatcggatttcgtcgtttcgtcgttaggttttatattttttgtgtttgttttcgtagttttgtgtttagttcgtcgttcgttttatatttgcgttggcgggaagggtagttagcgggtcgcgggagtcgtgcgttttgtttttcgttttttatttttcgtttcgtttcgtgtcgagtttagtttagtttttcgtttcgtttttcgtttagttttttgttttcgcgttcggtttcgttttgtattttttatttcgtttttcgtagagttcggtttcgtttatttttttttttttttcgttttttgacgttttcggtttcgtttcgtattcgttgttgtttttggttttttttcgcgtcgtgttcggtttcgttttgtatcgtttttttcgttttcggttgcgtttcgtatttggtttcgtttttttgggttagttttgaatataaattagtgtcgagtttggttttttttcgtttcgcgttttatttttagtttcgtttttgt

SEQ ID NO: 20674 - DNA, 792 bp, Artificial Sequence
  chemically treated genomic DNA (Homo sapiens) CpG-island No: 20674
acaaaaacgaaactaaaaataaaacgcgaaacgaaaaaaaaccaaactcgacactaatttatattcaaaactaacccaaaaaaacgaaaccaaatacgaaacgcaaccgaaaacgaaaaaaacgatacaaaacgaaaccgaacacgacgcgaaaaaaaaccaaaaacaacaacgaatacgaaacgaaaccgaaaacgtcaaaaaacgaaaaaaaaaaaaaaataaacgaaaccgaactctacgaaaaacgaaataaaaaatacaaaacgaaaccgaacgcgaaaacaaaaaactaaacgaaaaacgaaacgaaaaactaaactaaactcgacacgaaacgaaacgaaaaataaaaaacgaaaaacaaaacgcacgactcccgcgacccgctaactacccttcccgccaacgcaaatataaaacgaacgacgaactaaacacaaaactacgaaaacaaacacaaaaaatataaaacctaacgacgaaacgacgaaatccgataaaaaccgaaatcccgccgaaaaaaactaaaaataaaaaaacccgacgaaaccgcgataaaaccgaacgacgaaaaccaaacgacgctaacgaccgacccctaaaaaaaatacttccaaacgaccgtacaactaacgctacgaacaaaacaaataaacgccacgactaaactcgaaaatccgaacgaaacaaaaacgcgtaaaccttaaaaaccgcctaaaataacgaaatcctaacgcgcaaccgacgaacgcccaaaatccgcacccgaaaacgcgaaacgcgaaacga

SEQ ID NO: 20675 - DNA, 792 bp, Artificial Sequence
  chemically treated genomic DNA (Homo sapiens) CpG-island No: 20675
ataggggcggggttggaggtaaagcgcggagcggagagggattaggttcggtattgatttgtgtttagggttagtttagaggggcggggttaggtacggggcgtagtcgggagcgggaggggcggtgtaggacggggtcgggtacggcgcgggaagaggttaggagtagtaacgggtgcggggcggggtcgggagcgttaaggggcggggaagaggggggaatgggcggggtcgagttttgcgaggggcgaggtggggaatgtagagcggggtcggacgcgggagtagggagttgggcggggagcggggcggggagttgggttgggttcggtacggggcggggcggagggtggggagcggaaagtaggacgtacggttttcgcggttcgttggttgtttttttcgttagcgtaggtgtgggacgggcggcggattaggtatagagttgcgggagtaggtatagggagtgtggagtttggcggcgggacggcgggattcggtgggagtcggagtttcgtcgaggggggttggaggtggaggggttcggcgaggtcgcgatgaagtcgagcggcgaggattaggcggcgttggcggtcggtttttgggaggagtgtttttaggcggtcgtgtagttggcgttgcgggtaggataggtgagcgttacggttgggttcggaagttcgggcggagtagaagcgcgtgggttttgggagtcgtttggagtggcggggttttggcgcgtagtcggcgggcgtttagggttcgtattcgagggcgcggggcgcggagcgg

SEQ ID NO: 20676 - DNA, 792 bp, Artificial Sequence
  chemically treated genomic DNA (Homo sapiens) CpG-island No: 20676
ccgctccgcgccccgcgccctcgaatacgaaccctaaacgcccgccgactacgcgccaaaaccccgccactccaaacgactcccaaaacccacgcgcttctactccgcccgaacttccgaacccaaccgtaacgctcacctatcctacccgcaacgccaactacacgaccgcctaaaaacactcctcccaaaaaccgaccgccaacgccgcctaatcctcgccgctcgacttcatcgcgacctcgccgaacccctccacctccaacccccctcgacgaaactccgactcccaccgaatcccgccgtcccgccgccaaactccacactccctatacctactcccgcaactctatacctaatccgccgcccgtcccacacctacgctaacgaaaaaaacaaccaacgaaccgcgaaaaccgtacgtcctactttccgctccccaccctccgccccgccccgtaccgaacccaacccaactccccgccccgctccccgcccaactccctactcccgcgtccgaccccgctctacattccccacctcgcccctcgcaaaactcgaccccgcccattcccccctcttccccgccccttaacgctcccgaccccgccccgcacccgttactactcctaacctcttcccgcgccgtacccgaccccgtcctacaccgcccctcccgctcccgactacgccccgtacctaaccccgcccctctaaactaaccctaaacacaaatcaataccgaacctaatccctctccgctccgcgctttacctccaaccccgcccctat

SEQ ID NO: 20677 - DNA, 857 bp, Artificial Sequence
  chemically treated genomic DNA (Homo sapiens) CpG-island No: 20677
gagggattcgggaattgtagtcggagtcggcgcgtatttagttaattttttgttttcgcggtagcgcgcgggtttgttattgaagtttcgtttcggcgattttaggcgggcggggaagatcgagttttttcggagtcgtttcgttcgttcggcgtcggagttttacggtcggtttgcggaagcgggtcgtttgaaggggttcggcgggtggttttcgggttttcgcggtttgtgatttttagagcggataatcgtagttggggtttcgtgcgtaattcggagtaaaggtcggaatttacgttcggcggtcgcgtttcggtttttagcgtttttcgcgaagtgtttggtaggttcggtagtttgagtgtcgcgttatagagttttttgggtagttatcgttgaagggcgggggacgcgggaaaggtattttggggatataggagagttgcgagggcgaagtacgggcgagttgtcgttagggtttaggaaaggttcgttgcggggcgtataggcgggtaggggaattcgcgtttcgcgtcgcgcgttcggttttttgacgttagggtcggtttttgagtatagttatcgcggcggtcgggggcggttattgtttttcgcgagttcgttttcgcgttttagaagtttttagagttcgcgttcgagttttaggttttggaggagttaggcgggtagttgatagtttcggagtcgttttcgggtttcgcgcgcggtggtagttaggtcgtgttttttcgtttttttttcgcgtcgcgttgttttttcgggatttattaggtttggttgcgtttttttttttttttttttcggagttttggaaagtgttttttagagatgtg

SEQ ID NO: 20678 - DNA, 857 bp, Artificial Sequence
  chemically treated genomic DNA (Homo sapiens) CpG-island No: 20678
cacatctctaaaaaacactttccaaaactccgaaaaaaaaaaaaaaaaaaacgcaaccaaacctaataaatcccgaaaaaacaacgcgacgcgaaaaaaaaacgaaaaaacacgacctaactaccaccgcgcgcgaaacccgaaaacgactccgaaactatcaactacccgcctaactcctccaaaacctaaaactcgaacgcgaactctaaaaacttctaaaacgcgaaaacgaactcgcgaaaaacaataaccgcccccgaccgccgcgataactatactcaaaaaccgaccctaacgtcaaaaaaccgaacgcgcgacgcgaaacgcgaattcccctacccgcctatacgccccgcaacgaacctttcctaaaccctaacgacaactcgcccgtacttcgccctcgcaactctcctatatccccaaaatacctttcccgcgtcccccgcccttcaacgataactacccaaaaaactctataacgcgacactcaaactaccgaacctaccaaacacttcgcgaaaaacgctaaaaaccgaaacgcgaccgccgaacgtaaattccgacctttactccgaattacgcacgaaaccccaactacgattatccgctctaaaaatcacaaaccgcgaaaacccgaaaaccacccgccgaaccccttcaaacgacccgcttccgcaaaccgaccgtaaaactccgacgccgaacgaacgaaacgactccgaaaaaactcgatcttccccgcccgcctaaaatcgccgaaacgaaacttcaataacaaacccgcgcgctaccgcgaaaacaaaaaattaactaaatacgcgccgactccgactacaattcccgaatccctc

SEQ ID NO: 20679 - DNA, 857 bp, Artificial Sequence
  chemically treated genomic DNA (Homo sapiens) CpG-island No: 20679
tatatttttggagggtattttttaaggtttcgggggaggagaggaaagaggcgtagttaggtttggtgggtttcggaggggtagcgcggcgcgggaggggaacggggaggtacggtttggttgttatcgcgcgcggaattcgggagcggtttcggggttgttagttgttcgtttggtttttttaaggtttggagttcggacgcgggttttgggggtttttggggcgcggaagcgggttcgcggggagtagtggtcgttttcggtcgtcgcggtggttgtgtttagaagtcggttttggcgttaggaggtcgggcgcgcggcgcggggcgcgagtttttttgttcgtttgtgcgtttcgtaacgggttttttttgggttttaacgatagttcgttcgtgtttcgttttcgtagtttttttgtgtttttaaaatgtttttttcgcgtttttcgttttttagcggtgattgtttaggggattttgtaacgcgatatttagattgtcgagtttgttaggtatttcgcggagggcgttaggggtcgggacgcggtcgtcgagcgtaggtttcggtttttatttcgagttgcgtacggagttttagttgcggttgttcgttttggggattataggtcgcggagattcgggagttattcgtcgggtttttttagacgattcgttttcgtaaatcggtcgtgggatttcggcgtcgggcggacgaagcggtttcgggaagattcggtttttttcgttcgtttgaggtcgtcggggcggggttttagtgataggttcgcgcgttatcgcggaaataggaagttggttgggtgcgcgtcggtttcggttgtagttttcgggtttttt

SEQ ID NO: 20680 - DNA, 857 bp, Artificial Sequence
  chemically treated genomic DNA (Homo sapiens) CpG-island No: 20680
aaaaaacccgaaaactacaaccgaaaccgacgcgcacccaaccaacttcctatttccgcgataacgcgcgaacctatcactaaaaccccgccccgacgacctcaaacgaacgaaaaaaaccgaatcttcccgaaaccgcttcgtccgcccgacgccgaaatcccacgaccgatttacgaaaacgaatcgtctaaaaaaacccgacgaataactcccgaatctccgcgacctataatccccaaaacgaacaaccgcaactaaaactccgtacgcaactcgaaataaaaaccgaaacctacgctcgacgaccgcgtcccgacccctaacgccctccgcgaaatacctaacaaactcgacaatctaaatatcgcgttacaaaatcccctaaacaatcaccgctaaaaaacgaaaaacgcgaaaaaaacattttaaaaacacaaaaaaactacgaaaacgaaacacgaacgaactatcgttaaaacccaaaaaaaacccgttacgaaacgcacaaacgaacaaaaaaactcgcgccccgcgccgcgcgcccgacctcctaacgccaaaaccgacttctaaacacaaccaccgcgacgaccgaaaacgaccactactccccgcgaacccgcttccgcgccccaaaaacccccaaaacccgcgtccgaactccaaaccttaaaaaaaccaaacgaacaactaacaaccccgaaaccgctcccgaattccgcgcgcgataacaaccaaaccgtacctccccgttcccctcccgcgccgcgctacccctccgaaacccaccaaacctaactacgcctctttcctctcctcccccgaaaccttaaaaaataccctccaaaaatata

SEQ ID NO: 20681 - DNA, 772 bp, Artificial Sequence
  chemically treated genomic DNA (Homo sapiens) CpG-island No: 20681
ttagattcgttttttagcgtatttgttttttttttttttttcgggttcgttaacgttttatttattcgcgagttaggttttagcgttttttcgttcgaacgtttaggtcgtcgggtcgtttgcgttcgtttgttttagttcgtgtcgtcgcgggtcgcgtttatttaggttttcgtttttgttcgtgtagtcgtttcgttcggtagtcgtcgtcgcgttttatattcgcggtcgttcggttcgggtttacgtgtcgttacgttagggagtttgggggttgtagttttgcgtcgtcgttcgcgaggcgcgttcggaatcgttggttcggaaatttcgaaacgttttgtatattggagtttgttttttttcgggtgttatttgaataatatgggttgaagtgatttcggcgtagcgtttcggtttttcgaggatcggaagtattcgaattggcggtcgggtgttcgagagtacgcggtttattcgcgttacgtcgagtgtaaatttttttttgtttcgtttgtacgttagtttttttcgcgtgcgggtattttttgggtttcgttgcgttttaatttttttttttttgcgtagggttttgtaatttttattatttcgtggttttgcgttgtgaggtttgggttgttgttttcgaggcgtacggagaattttaattgtttatcggcgtttaggttttttcgggttgacgtcgttgtattagttttgtagattttcgtgttaaagagagatgagcgaattttaaagtgaattattt

SEQ ID NO: 20682 - DNA, 772 bp, Artificial Sequence
  chemically treated genomic DNA (Homo sapiens) CpG-island No: 20682
aaataattcactttaaaattcgctcatctctctttaacacgaaaatctacaaaactaatacaacgacgtcaacccgaaaaaacctaaacgccgataaacaattaaaattctccgtacgcctcgaaaacaacaacccaaacctcacaacgcaaaaccacgaaataataaaaattacaaaaccctacgcaaaaaaaaaaaaattaaaacgcaacgaaacccaaaaaatacccgcacgcgaaaaaaactaacgtacaaacgaaacaaaaaaaaatttacactcgacgtaacgcgaataaaccgcgtactctcgaacacccgaccgccaattcgaatacttccgatcctcgaaaaaccgaaacgctacgccgaaatcacttcaacccatattattcaaataacacccgaaaaaaaacaaactccaatatacaaaacgtttcgaaatttccgaaccaacgattccgaacgcgcctcgcgaacgacgacgcaaaactacaacccccaaactccctaacgtaacgacacgtaaacccgaaccgaacgaccgcgaatataaaacgcgacgacgactaccgaacgaaacgactacacgaacaaaaacgaaaacctaaataaacgcgacccgcgacgacacgaactaaaacaaacgaacgcaaacgacccgacgacctaaacgttcgaacgaaaaaacgctaaaacctaactcgcgaataaataaaacgttaacgaacccgaaaaaaaaaaaaaaaacaaatacgctaaaaaacgaatctaa

SEQ ID NO: 20683 - DNA, 772 bp, Artificial Sequence
  chemically treated genomic DNA (Homo sapiens) CpG-island No: 20683
agataatttattttaaaattcgtttatttttttttaatacgagagtttgtagggttggtgtagcggcgttaattcgaagagatttgaacgtcgatgggtagttgggatttttcgtacgtttcggaaatagtagtttaaattttataacgtagaattacgagatagtggggattgtagagttttgcgtaagagaaggaaaattaagacgtagcggagtttaggaggtgttcgtacgcgggaaggattggcgtgtagacgaggtagggggaggtttgtattcggcgtggcgcgggtgagtcgcgtgttttcgggtattcggtcgttagttcggatgttttcgattttcggggagtcggggcgttgcgtcggagttattttagtttatgttgtttaggtgatattcggggaagagtagattttagtgtgtaaaacgtttcggggttttcgggttagcggtttcgggcgcgtttcgcgggcggcggcgtagaattataatttttaggttttttggcgtggcggtacgtgggttcgagtcgggcggtcgcggatataaagcgcggcggcggttgtcgggcggagcggttgtacggataagagcggaggtttgggtgagcgcggttcgcgacggtacgggttaggatagacggacgtagacggttcgacgatttgggcgttcgggcggaggggcgttggggtttgattcgcgggtgggtgagacgttgacggattcggaggaaagagggaaggtagatacgttgggaaacggatttgg

SEQ ID NO: 20684 - DNA, 772 bp, Artificial Sequence
  chemically treated genomic DNA (Homo sapiens) CpG-island No: 20684
ccaaatccgtttcccaacgtatctaccttccctctttcctccgaatccgtcaacgtctcacccacccgcgaatcaaaccccaacgcccctccgcccgaacgcccaaatcgtcgaaccgtctacgtccgtctatcctaacccgtaccgtcgcgaaccgcgctcacccaaacctccgctcttatccgtacaaccgctccgcccgacaaccgccgccgcgctttatatccgcgaccgcccgactcgaacccacgtaccgccacgccaaaaaacctaaaaattataattctacgccgccgcccgcgaaacgcgcccgaaaccgctaacccgaaaaccccgaaacgttttacacactaaaatctactcttccccgaatatcacctaaacaacataaactaaaataactccgacgcaacgccccgactccccgaaaatcgaaaacatccgaactaacgaccgaatacccgaaaacacgcgactcacccgcgccacgccgaatacaaacctccccctacctcgtctacacgccaatccttcccgcgtacgaacacctcctaaactccgctacgtcttaattttccttctcttacgcaaaactctacaatccccactatctcgtaattctacgttataaaatttaaactactatttccgaaacgtacgaaaaatcccaactacccatcgacgttcaaatctcttcgaattaacgccgctacaccaaccctacaaactctcgtattaaaaaaaaataaacgaattttaaaataaattatct

SEQ ID NO: 20685 - DNA, 514 bp, Artificial Sequence
  chemically treated genomic DNA (Homo sapiens) CpG-island No: 20685
ggtggggcggggttgcgttttttcgagagtatatcgagggcggcggcggttcgagtgattttttagagtttggtattaagtttagggtatcgttaaggtttgcggcggtttttgaagatgttcggtagtcggtaaagtttttttattcgtatatcgcgtttattattatggttattttgtaaaattcgtataagcgttttacgtttagcggtatttgcgtttttattagtggtcgttttttatattatcgtcgtaagtttttcgtttggtagaatagtattcgttataatttttcgttgaacgattgtttcgttaagatttttcgcgagtcgggttatttaggtaagggtaattattggagtttggatttcgttttttaggatatgttcgataatggtagtttttttcggcgtaggaagcgttttaagcgttattaattgatttcgggagtttatttgttttattttttttttttatttgttgcgtacgtcgttttgtataatttttatttagg

SEQ ID NO: 20686 - DNA, 514 bp, Artificial Sequence
  chemically treated genomic DNA (Homo sapiens) CpG-island No: 20686
cctaaataaaaattatacaaaacgacgtacgcaacaaataaaaaaaaaaaataaaacaaataaactcccgaaatcaattaataacgcttaaaacgcttcctacgccgaaaaaaactaccattatcgaacatatcctaaaaaacgaaatccaaactccaataattacccttacctaaataacccgactcgcgaaaaatcttaacgaaacaatcgttcaacgaaaaattataacgaatactattctaccaaacgaaaaacttacgacgataatataaaaaacgaccactaataaaaacgcaaataccgctaaacgtaaaacgcttatacgaattttacaaaataaccataataataaacgcgatatacgaataaaaaaactttaccgactaccgaacatcttcaaaaaccgccgcaaaccttaacgataccctaaacttaataccaaactctaaaaaatcactcgaaccgccgccgccctcgatatactctcgaaaaaacgcaaccccgccccacc

SEQ ID NO: 20687 - DNA, 514 bp, Artificial Sequence
  chemically treated genomic DNA (Homo sapiens) CpG-island No: 20687
tttgggtgggggttgtgtagggcggcgtgcgtagtaggtagagggaaggggtggggtaggtgggttttcggggttagttggtggcgtttgaaacgttttttacgtcggagaaagttgttattgtcgaatatgttttgggaggcggggtttaggttttagtagttgtttttgtttgggtggttcggttcgcgggggattttaacgaagtagtcgtttagcgagaggttgtggcggatgttgttttgttaggcggggaatttgcggcggtagtatgggaagcggttattaatgaaggcgtagatgtcgttgagcgtgaggcgtttgtgcgggttttgtaggatggttatggtgatgagcgcgatgtacgagtaggggggttttgtcggttgtcgggtatttttagaggtcgtcgtagattttggcggtgttttgaatttggtgttaaattttgaggggttattcgggtcgtcgtcgttttcgatgtgttttcggggaagcgtaatttcgttttatt

SEQ ID NO: 20688 - DNA, 514 bp, Artificial Sequence
  chemically treated genomic DNA (Homo sapiens) CpG-island No: 20688
aataaaacgaaattacgcttccccgaaaacacatcgaaaacgacgacgacccgaataacccctcaaaatttaacaccaaattcaaaacaccgccaaaatctacgacgacctctaaaaatacccgacaaccgacaaaacccccctactcgtacatcgcgctcatcaccataaccatcctacaaaacccgcacaaacgcctcacgctcaacgacatctacgccttcattaataaccgcttcccatactaccgccgcaaattccccgcctaacaaaacaacatccgccacaacctctcgctaaacgactacttcgttaaaatcccccgcgaaccgaaccacccaaacaaaaacaactactaaaacctaaaccccgcctcccaaaacatattcgacaataacaactttctccgacgtaaaaaacgtttcaaacgccaccaactaaccccgaaaacccacctaccccaccccttccctctacctactacgcacgccgccctacacaacccccacccaaa

SEQ ID NO: 20689 - DNA, 878 bp, Artificial Sequence
  chemically treated genomic DNA (Homo sapiens) CpG-island No: 20689
cgcgtcgtcgcggttttttgatttttattatagcggtttttttgtttttcgtcgtcgcggttttttgttttaagtattatttcggtttttttttcgtcgtcgcggttttttttttatcgcggttttttgtttttattcgtcgtttcgggtttatgttcgttacggtttttagttttttgtcgtcgcggttttttgttcgattcggttttttgttttttattttttttcgtcgtcgtcgcggttttttgttcgatttggttttttgtttattttcgttgtcgcggtttttttattttcgtcgtcgtggtttttttattttcgttgtcgcggtttttttattttcgtcgtcgtggtttttttattttcgttgtcgcggtttttttattttcgtcgtcgtggtttttttattttcgtcgtcgtggttttttgttatcgcggttttttgtttttttcgtcgtcgttacggttttttgttcgatttggttttttgttcgattcggttttttgtttttcgttgttacggttttttgtttttcgttgttacggttttttgtttttcgtcgtcgcggttttttgttcgatttggttttttgttcgattcggttttttgtttttcgttgttacggttttatgttttacgtagtcgcggtttttttattttcgtcgtcgtggtttttagtcgtcgcggttttttgtttttcgtcgtcgcgtttttttgttttttcgttatggcggttttgtgcgttttacgttttttcgtttcgtgtcgcggttatttgttcgcggcggttttttgtttttcgttttcgtggttttttgttttatggttatttttagaagcgtgagtggaatagagtgaagggaaagttgtttttttt

SEQ ID NO: 20690 - DNA, 878 bp, Artificial Sequence
  chemically treated genomic DNA (Homo sapiens) CpG-island No: 20690
aaaaaaaacaactttcccttcactctattccactcacgcttctaaaaataaccataaaacaaaaaaccacgaaaacgaaaaacaaaaaaccgccgcgaacaaataaccgcgacacgaaacgaaaaaacgtaaaacgcacaaaaccgccataacgaaaaaacaaaaaaacgcgacgacgaaaaacaaaaaaccgcgacgactaaaaaccacgacgacgaaaataaaaaaaccgcgactacgtaaaacataaaaccgtaacaacgaaaaacaaaaaaccgaatcgaacaaaaaaccaaatcgaacaaaaaaccgcgacgacgaaaaacaaaaaaccgtaacaacgaaaaacaaaaaaccgtaacaacgaaaaacaaaaaaccgaatcgaacaaaaaaccaaatcgaacaaaaaaccgtaacgacgacgaaaaaaacaaaaaaccgcgataacaaaaaaccacgacgacgaaaataaaaaaaccacgacgacgaaaataaaaaaaccgcgacaacgaaaataaaaaaaccacgacgacgaaaataaaaaaaccgcgacaacgaaaataaaaaaaccacgacgacgaaaataaaaaaaccgcgacaacgaaaataaacaaaaaaccaaatcgaacaaaaaaccgcgacgacgacgaaaaaaaataaaaaacaaaaaaccgaatcgaacaaaaaaccgcgacgacaaaaaactaaaaaccgtaacgaacataaacccgaaacgacgaataaaaacaaaaaaccgcgataaaaaaaaaaccgcgacgacgaaaaaaaaaccgaaataatacttaaaacaaaaaaccgcgacgacgaaaaacaaaaaaaccgctataataaaaatcaaaaaaccgcgacgacgcg

SEQ ID NO: 20691 - DNA, 878 bp, Artificial Sequence
  chemically treated genomic DNA (Homo sapiens) CpG-island No: 20691
gaagaaaatagttttttttttattttgttttatttacgtttttgaggatggttatggggtaaaaagttacgggggcggggggtaaaaagtcgtcgcgggtaaataatcgcggtacggggcgggggggcgtggggcgtataaagtcgttatagcgggggagtaaaaagacgcggcggcggggggtaaaaagtcgcggcgattaaaagttacggcggcgggggtgaaaaagtcgcggttgcgtggggtataaagtcgtggtagcgaggggtaaaaagtcgggtcgggtaaaaagttaggtcgggtaaaaagtcgcggcggcggggggtaaaaagtcgtggtagcgaggggtaaaaagtcgtggtagcgaggggtaaaaagtcgggtcgggtaaaaagttaggtcgggtagaaagtcgtggcggcggcggggggggtaaaaagtcgcggtgataaaaagttacggcggcgggggtgaaaaagttacggcggcgggggtgaaaaagtcgcggtagcgggggtgaaaaagttacggcggcgggggtgaaaaagtcgcggtagcgggggtgaaaaagttacggcggcgggggtgaaaaagtcgcggtagcgggggtgggtaaaaagttaggtcgggtaaaaagtcgcggcggcggcgggggggggtggggggtaaaaagtcgggtcgggtaaaaagtcgcggcggtagggaattaaaagtcgtggcgggtataaattcgaggcggcgggtgggggtaaaaaatcgcggtggggaaaaagtcgcggcggcgggggaaaagtcgaggtggtgtttggggtaaaaagtcgcggcggcgaagggtaaaagagtcgttgtgatgagggttaaaaagtcgcggcgacgcg

SEQ ID NO: 20692 - DNA, 878 bp, Artificial Sequence
  chemically treated genomic DNA (Homo sapiens) CpG-island No: 20692
cgcgtcgccgcgactttttaaccctcatcacaacgactcttttacccttcgccgccgcgactttttaccccaaacaccacctcgacttttcccccgccgccgcgactttttccccaccgcgattttttacccccacccgccgcctcgaatttatacccgccacgacttttaattccctaccgccgcgactttttacccgacccgactttttaccccccacccccccccgccgccgccgcgactttttacccgacctaactttttacccacccccgctaccgcgactttttcacccccgccgccgtaactttttcacccccgctaccgcgactttttcacccccgccgccgtaactttttcacccccgctaccgcgactttttcacccccgccgccgtaactttttcacccccgccgccgtaactttttatcaccgcgactttttaccccccccgccgccgccacgactttctacccgacctaactttttacccgacccgactttttacccctcgctaccacgactttttacccctcgctaccacgactttttaccccccgccgccgcgactttttacccgacctaactttttacccgacccgactttttacccctcgctaccacgactttataccccacgcaaccgcgactttttcacccccgccgccgtaacttttaatcgccgcgactttttaccccccgccgccgcgtctttttactcccccgctataacgactttatacgccccacgcccccccgccccgtaccgcgattatttacccgcgacgactttttaccccccgcccccgtaactttttaccccataaccatcctcaaaaacgtaaataaaacaaaataaaaaaaaaactattttcttc

SEQ ID NO: 20693 - DNA, 899 bp, Artificial Sequence
  chemically treated genomic DNA (Homo sapiens) CpG-island No: 20693
gcggtacgcgtgggtttagagtttgttttagcgaggtagtagttgttatgtcgatcgttggagcgtcggtcgcgttttttttgcgtatgcgtagcgagttttttttcgggttgtcgggagttttaggagcgttagggggtgcgtttgcgcgtcgttgttttagcgtattcgggttggagttcgttcgttttttttttcgttcggagtcgtcgaagcgtttcggtgcgttgtatcgtcggaggttgggtagttcgtagcgttgttcggcgttggattttattcggtaggcgtaggttatttatattcggttttgtgcggttgtttttcgtagtattgtacggtcgattttcgttcgtttattgttatcggtcgcgggattggttgggattggttcggtcgagggtattgtttttcggtgtattgttgttcgggcgtcgtagttcgtagtcgttagtttttttcggtcgtgtttttttttcgtggagtcggttgttcgtcggcgtttattgttcggcggtagcggcggagttaggtagtttcgcggcggtcgagcgcgttcgcgtatcgggttttttggttttttttatttagggtagttcgcgtttcggtgcgagggagcggtttttatcgagattcgttcggttcggcggtgcgatgagttttttcggtttcgggtagagcgtggaggtggaaatttttttgaacgatgtagagagtaggaagcgggtcgagtataagacggaggacgggaagaaggagaaatatttttttttttacgacggggagacggttttcgggaaggtgagttttgtttttaagaattttaataagcggttggagtattagggtattaagatcgagtttatcgggtagatcggtgagtcgattttcgggatttt

SEQ ID NO: 20694 - DNA, 899 bp, Artificial Sequence
  chemically treated genomic DNA (Homo sapiens) CpG-island No: 20694
aaaatcccgaaaatcgactcaccgatctacccgataaactcgatcttaataccctaatactccaaccgcttattaaaattcttaaaaacaaaactcaccttcccgaaaaccgtctccccgtcgtaaaaaaaaaaatatttctccttcttcccgtcctccgtcttatactcgacccgcttcctactctctacatcgttcaaaaaaatttccacctccacgctctacccgaaaccgaaaaaactcatcgcaccgccgaaccgaacgaatctcgataaaaaccgctccctcgcaccgaaacgcgaactaccctaaataaaaaaaaccaaaaaacccgatacgcgaacgcgctcgaccgccgcgaaactacctaactccgccgctaccgccgaacaataaacgccgacgaacaaccgactccacgaaaaaaaaacacgaccgaaaaaaactaacgactacgaactacgacgcccgaacaacaatacaccgaaaaacaataccctcgaccgaaccaatcccaaccaatcccgcgaccgataacaataaacgaacgaaaatcgaccgtacaatactacgaaaaacaaccgcacaaaaccgaatataaataacctacgcctaccgaataaaatccaacgccgaacaacgctacgaactacccaacctccgacgatacaacgcaccgaaacgcttcgacgactccgaacgaaaaaaaaaacgaacgaactccaacccgaatacgctaaaacaacgacgcgcaaacgcaccccctaacgctcctaaaactcccgacaacccgaaaaaaaactcgctacgcatacgcaaaaaaaacgcgaccgacgctccaacgatcgacataacaactactacctcgctaaaacaaactctaaacccacgcgtaccgc

SEQ ID NO: 20695 - DNA, 899 bp, Artificial Sequence
  chemically treated genomic DNA (Homo sapiens) CpG-island No: 20695
ggggtttcgggggtcgatttatcgatttgttcgatgaattcgattttgatgttttggtgttttagtcgtttgttggggtttttgagggtaaggtttattttttcggagatcgttttttcgtcgtagaagaggaaatattttttttttttttcgtttttcgttttgtgttcggttcgttttttattttttgtatcgtttagaaggatttttatttttacgttttgttcgaagtcgaagaagtttatcgtatcgtcgggtcgggcgggtttcggtaaggatcgttttttcgtatcggggcgcgggttgttttaggtaaagaaggttagagggttcgatgcgcgagcgcgttcggtcgtcgcggggttgtttggtttcgtcgttgtcgtcgggtagtgggcgtcgacggatagtcggttttacgggggaggggtacggtcgggggaggttggcggttgcgggttgcggcgttcgagtagtaatgtatcgaggagtagtgttttcggtcgagttagttttagttagtttcgcggtcggtggtagtgggcgggcgagggtcggtcgtgtaatgttgcggggggtagtcgtatagagtcgggtgtgggtggtttgcgtttgtcgggtggggtttagcgtcgagtagcgttgcgagttgtttagttttcggcggtgtaacgtatcgaggcgtttcggcggtttcgggcgggggagggggcgggcgagttttagttcggatgcgttggagtagcggcgcgtaggcgtattttttaacgtttttgggattttcggtagttcggaggagagttcgttgcgtatgcgtagggagagcgcggtcggcgttttagcggtcggtatggtagttgttatttcgttgggataggttttgggtttacgcgtgtcgt

SEQ ID NO: 20696 - DNA, 899 bp, Artificial Sequence
  chemically treated genomic DNA (Homo sapiens) CpG-island No: 20696
acgacacgcgtaaacccaaaacctatcccaacgaaataacaactaccataccgaccgctaaaacgccgaccgcgctctccctacgcatacgcaacgaactctcctccgaactaccgaaaatcccaaaaacgttaaaaaatacgcctacgcgccgctactccaacgcatccgaactaaaactcgcccgccccctcccccgcccgaaaccgccgaaacgcctcgatacgttacaccgccgaaaactaaacaactcgcaacgctactcgacgctaaaccccacccgacaaacgcaaaccacccacacccgactctatacgactaccccccgcaacattacacgaccgaccctcgcccgcccactaccaccgaccgcgaaactaactaaaactaactcgaccgaaaacactactcctcgatacattactactcgaacgccgcaacccgcaaccgccaacctcccccgaccgtacccctcccccgtaaaaccgactatccgtcgacgcccactacccgacgacaacgacgaaaccaaacaaccccgcgacgaccgaacgcgctcgcgcatcgaaccctctaaccttctttacctaaaacaacccgcgccccgatacgaaaaaacgatccttaccgaaacccgcccgacccgacgatacgataaacttcttcgacttcgaacaaaacgtaaaaataaaaatccttctaaacgatacaaaaaataaaaaacgaaccgaacacaaaacgaaaaacgaaaaaaaaaaaaaatatttcctcttctacgacgaaaaaacgatctccgaaaaaataaaccttaccctcaaaaaccccaacaaacgactaaaacaccaaaacatcaaaatcgaattcatcgaacaaatcgataaatcgacccccgaaacccc

SEQ ID NO: 20697 - DNA, 630 bp, Artificial Sequence
  chemically treated genomic DNA (Homo sapiens) CpG-island No: 20697
cgagcgtaacggaggtcgaaggcgtttagatttttagttgaacgcggagttgcggcggttatgttgtggagcggttgtcggcgtttcggggcgcgtttcggttgtttgttcggcggttttcgggttttcgtttagatcggttatcggagtttgattttttgtatcgatcgtaaggattttttggcgggtagtaggataggtgtttagaatttcggcggatatatgttcgcgaggggttgtagttttttcgttttatttagttatttcggcgttagtttttttttcggttagttattttttcggtttggttttttatttcggtcggttattttcggtttggttgtttttttcggtcggttattattattcgggtttttatttggttcgttatttttgttcgggttttttttcggtcggttattttcgtttcggttttttttcggtcggttattttcgtttcggttttttttcggtcggttatttttcgtaggttttttttcggtcggttattttttcgtaggttttttttcggttcgggtttttttgcggtcggttattttcggatgtttagagaagtgaagaaatttggggtttggttgttgttgggttggttggtttttaattataata

SEQ ID NO: 20698 - DNA, 630 bp, Artificial Sequence
  chemically treated genomic DNA (Homo sapiens) CpG-island No: 20698
tattataattaaaaaccaaccaacccaacaacaaccaaaccccaaatttcttcacttctctaaacatccgaaaataaccgaccgcaaaaaaacccgaaccgaaaaaaaacctacgaaaaaataaccgaccgaaaaaaaacctacgaaaaataaccgaccgaaaaaaaaccgaaacgaaaataaccgaccgaaaaaaaaccgaaacgaaaataaccgaccgaaaaaaaacccgaacaaaaataacgaaccaaataaaaacccgaataataataaccgaccgaaaaaaacaaccaaaccgaaaataaccgaccgaaataaaaaaccaaaccgaaaaaataactaaccgaaaaaaaaactaacgccgaaataactaaataaaacgaaaaaactacaacccctcgcgaacatatatccgccgaaattctaaacacctatcctactacccgccaaaaaatccttacgatcgatacaaaaaatcaaactccgataaccgatctaaacgaaaacccgaaaaccgccgaacaaacaaccgaaacgcgccccgaaacgccgacaaccgctccacaacataaccgccgcaactccgcgttcaactaaaaatctaaacgccttcgacctccgttacgctcg

SEQ ID NO: 20699 - DNA, 630 bp, Artificial Sequence
  chemically treated genomic DNA (Homo sapiens) CpG-island No: 20699
tgttatgattaaaaattaattaatttaataataattaagttttaagtttttttatttttttaagtattcgagggtgatcggtcgtaggaggattcgggtcggaggggaatttgcggggggatgatcggtcggaggggaatttgcggggggtgatcggtcggaggaggatcggggcgggggtgatcggtcggaggaggatcggggcgggggtgatcggtcggaggaggattcgggtaggggtgacgggttagatggggattcggatggtggtgatcgatcggagggggtagttaggtcgggggtgatcggtcggagtagggagttaggtcgggggggtgattggtcggaaggggagttgacgtcggggtgattggatggaacggggagattgtagtttttcgcggatatatgttcgtcggggttttggatatttgttttattgttcgttaggagatttttacggtcgatgtaggaggttaagtttcggtggtcggtttggacgaggattcggagatcgtcgggtaggtagtcgaggcgcgtttcgaaacgtcggtagtcgttttatagtatagtcgtcgtagtttcgcgtttagttaagagtttgaacgttttcgattttcgttgcgttcg

SEQ ID NO: 20700 - DNA, 630 bp, Artificial Sequence
  chemically treated genomic DNA (Homo sapiens) CpG-island No: 20700
cgaacgcaacgaaaatcgaaaacgttcaaactcttaactaaacgcgaaactacgacgactatactataaaacgactaccgacgtttcgaaacgcgcctcgactacctacccgacgatctccgaatcctcgtccaaaccgaccaccgaaacttaacctcctacatcgaccgtaaaaatctcctaacgaacaataaaacaaatatccaaaaccccgacgaacatatatccgcgaaaaactacaatctccccgttccatccaatcaccccgacgtcaactccccttccgaccaatcacccccccgacctaactccctactccgaccgatcacccccgacctaactaccccctccgatcgatcaccaccatccgaatccccatctaacccgtcacccctacccgaatcctcctccgaccgatcacccccgccccgatcctcctccgaccgatcacccccgccccgatcctcctccgaccgatcaccccccgcaaattcccctccgaccgatcatccccccgcaaattcccctccgacccgaatcctcctacgaccgatcaccctcgaatacttaaaaaaataaaaaaacttaaaacttaattattattaaattaattaatttttaatcataaca

SEQ ID NO: 20701 - DNA, 873 bp, Artificial Sequence
  chemically treated genomic DNA (Homo sapiens) CpG-island No: 20701
aaagcgttcgtcgcgttcgtatttgttgtgaagttgtgttcgggtcgttttcgtcgagggaacggtttttttaaggttttgcgttttaattttcgttcgtttgttaagaggtagtcgtgtcggggagttagagtttttcggggatttttttttgtttttcgtggttttttgtggaattttcgttttaggatttgtacgtcgtttttagtcgcgcgcgcggtacggagatcgttcgttgtgtttcgcgttgcgtttttttcgtttttttttcgcgtaggtttttttgtgttagtcggttgtcgatttaggttaggaagttcgaggtcggggcgttattttaagggttttttcgtttttttttcgagggtagagaggcgttcgcgttcggacgtattgcgggaatatttggagtttcggcggagttcggttgttttcgcgggagggagttcgacgcgtatttttgggattcggattcggcgttcgcgtttcgggacggatttttgtttcggttgtaggcgtagcgcgtagatttgagtttgtttcgcggaatcggggttcgagtttcggttcgagcgcggcgtcggggttagcggagaggggcggaagtcgtaagggattttcggcgtttcggtttggtcgcgatgaagttttcgtttttttttaggtgacggatcgtcgttgtcgtttcgggttgtttattatttcggcgcgtgttcgggagtttttatttttttcgggttttgtggtcggttacgcgttttaggtacgcgtcgcgtcgggtcgcgttattaagttcgttgtttttagtttttttcggtagattttttggttatttttattttgcggaggggtcgtttattagatgttagaaaa

SEQ ID NO: 20702 - DNA, 873 bp, Artificial Sequence
  chemically treated genomic DNA (Homo sapiens) CpG-island No: 20702
ttttctaacatctaataaacgacccctccgcaaaataaaaataaccaaaaaatctaccgaaaaaaactaaaaacaacgaacttaataacgcgacccgacgcgacgcgtacctaaaacgcgtaaccgaccacaaaacccgaaaaaaataaaaactcccgaacacgcgccgaaataataaacaacccgaaacgacaacgacgatccgtcacctaaaaaaaaacgaaaacttcatcgcgaccaaaccgaaacgccgaaaatcccttacgacttccgcccctctccgctaaccccgacgccgcgctcgaaccgaaactcgaaccccgattccgcgaaacaaactcaaatctacgcgctacgcctacaaccgaaacaaaaatccgtcccgaaacgcgaacgccgaatccgaatcccaaaaatacgcgtcgaactccctcccgcgaaaacaaccgaactccgccgaaactccaaatattcccgcaatacgtccgaacgcgaacgcctctctaccctcgaaaaaaaaacgaaaaaacccttaaaataacgccccgacctcgaacttcctaacctaaatcgacaaccgactaacacaaaaaaacctacgcgaaaaaaaaacgaaaaaaacgcaacgcgaaacacaacgaacgatctccgtaccgcgcgcgcgactaaaaacgacgtacaaatcctaaaacgaaaattccacaaaaaaccacgaaaaacaaaaaaaaatccccgaaaaactctaactccccgacacgactacctcttaacaaacgaacgaaaattaaaacgcaaaaccttaaaaaaaccgttccctcgacgaaaacgacccgaacacaacttcacaacaaatacgaacgcgacgaacgcttt

SEQ ID NO: 20703 - DNA, 873 bp, Artificial Sequence
  chemically treated genomic DNA (Homo sapiens) CpG-island No: 20703
ttttttggtatttggtgaacggttttttcgtagggtgggggtagttaggggatttgtcgaggaaagttggggatagcgggtttggtggcgcggttcggcgcggcgcgtgtttggggcgcgtggtcggttatagaattcggggagggtggaggttttcgggtacgcgtcggggtggtgggtagttcgggacggtagcggcgattcgttatttgaggaggggcggggattttatcgcggttaggtcgaggcgtcgagggttttttgcggttttcgttttttttcgttggtttcgacgtcgcgttcgggtcgggattcgagtttcggtttcgcggggtaggtttaggtttgcgcgttgcgtttgtagtcgaggtagaaattcgtttcgaggcgcgggcgtcgggttcgggttttaaggatgcgcgtcgggttttttttcgcggggatagtcgagtttcgtcggggttttaggtgttttcgtagtgcgttcgggcgcggacgtttttttgttttcggaggggaagcgggagggtttttggggtaacgtttcgatttcgggttttttaatttgggtcgatagtcggttggtatagggaggtttgcgcgggagaggggcggagagagcgtagcgcggggtatagcgggcggttttcgtgtcgcgcgcgcgattggaaacggcgtgtagattttaaaacgagggttttatagagggttacgaggggtaggagagagttttcggagaattttagtttttcgatacggttattttttggtaaacgagcgagaattggggcgtagagttttgggagggtcgttttttcggcgggagcggttcgagtatagttttatagtagatgcgggcgcggcgggcgtttt

SEQ ID NO: 20704 - DNA, 873 bp, Artificial Sequence
  chemically treated genomic DNA (Homo sapiens) CpG-island No: 20704
aaaacgcccgccgcgcccgcatctactataaaactatactcgaaccgctcccgccgaaaaaacgaccctcccaaaactctacgccccaattctcgctcgtttaccaaaaaataaccgtatcgaaaaactaaaattctccgaaaactctctcctacccctcgtaaccctctataaaaccctcgttttaaaatctacacgccgtttccaatcgcgcgcgcgacacgaaaaccgcccgctataccccgcgctacgctctctccgcccctctcccgcgcaaacctccctataccaaccgactatcgacccaaattaaaaaacccgaaatcgaaacgttaccccaaaaaccctcccgcttcccctccgaaaacaaaaaaacgtccgcgcccgaacgcactacgaaaacacctaaaaccccgacgaaactcgactatccccgcgaaaaaaaacccgacgcgcatccttaaaacccgaacccgacgcccgcgcctcgaaacgaatttctacctcgactacaaacgcaacgcgcaaacctaaacctaccccgcgaaaccgaaactcgaatcccgacccgaacgcgacgtcgaaaccaacgaaaaaaaacgaaaaccgcaaaaaaccctcgacgcctcgacctaaccgcgataaaatccccgcccctcctcaaataacgaatcgccgctaccgtcccgaactacccaccaccccgacgcgtacccgaaaacctccaccctccccgaattctataaccgaccacgcgccccaaacacgcgccgcgccgaaccgcgccaccaaacccgctatccccaactttcctcgacaaatcccctaactacccccaccctacgaaaaaaccgttcaccaaataccaaaaaa

SEQ ID NO: 20705 - DNA, 503 bp, Artificial Sequence
  chemically treated genomic DNA (Homo sapiens) CpG-island No: 20705
ggcggcggatttcgtttggtcgagtttaagtatcgcgtgtaggagagaagtatacgtatttttcgacggtttagtcgcggcgtacgggattggtgaggtgtagttatatcggcgattattagcgcgcggtcggtatcggtaggttttttacgcgtcggtttttacggcgagtcggggcggggtttggcgcggagtattgtgggaaaggcgtggaggacgttgtttggggagattcgttgcgggtttagcgggcgttgcggcggtggggtggagagggcggtgtaggtttaggttgacgtggcggtgtgcgcgggattcggtttcggtttcggttttaattcggagttgagggaattgttttggttaagtagttcgcgtttttttattaatgcggtcggcgtttgtcgcgggcggggagggtggatggcgaagttcgtttttttttgttttcgttgttagggtgacggggaaatttagagggtgggttttggggttgagttttt

SEQ ID NO: 20706 - DNA, 503 bp, Artificial Sequence
  chemically treated genomic DNA (Homo sapiens) CpG-island No: 20706
aaaaactcaaccccaaaacccaccctctaaatttccccgtcaccctaacaacgaaaacaaaaaaaaacgaacttcgccatccaccctccccgcccgcgacaaacgccgaccgcattaataaaaaaacgcgaactacttaaccaaaacaattccctcaactccgaattaaaaccgaaaccgaaaccgaatcccgcgcacaccgccacgtcaacctaaacctacaccgccctctccaccccaccgccgcaacgcccgctaaacccgcaacgaatctccccaaacaacgtcctccacgcctttcccacaatactccgcgccaaaccccgccccgactcgccgtaaaaaccgacgcgtaaaaaacctaccgataccgaccgcgcgctaataatcgccgatataactacacctcaccaatcccgtacgccgcgactaaaccgtcgaaaaatacgtatacttctctcctacacgcgatacttaaactcgaccaaacgaaatccgccgcc

SEQ ID NO: 20707 - DNA, 503 bp, Artificial Sequence
  chemically treated genomic DNA (Homo sapiens) CpG-island No: 20707
gggaatttaattttaaaatttattttttgggttttttcgttattttggtaacggaagtaggaagaggcgggtttcgttatttatttttttcgttcgcggtaggcgtcggtcgtattggtgagggggcgcgggttgtttggttagggtagtttttttagtttcgggttggagtcggagtcggagtcggatttcgcgtatatcgttacgttaatttaaatttatatcgttttttttattttatcgtcgtagcgttcgttgggttcgtagcgggtttttttaggtagcgttttttacgttttttttataatgtttcgcgttaggtttcgtttcggttcgtcgtggagatcggcgcgtgaggaatttatcggtatcggtcgcgcgttggtagtcgtcggtgtggttgtattttattaatttcgtgcgtcgcggttgggtcgtcggagagtgcgtgtgttttttttttgtacgcggtgtttgggttcggttaggcggggttcgtcgtt

SEQ ID NO: 20708 - DNA, 503 bp, Artificial Sequence
  chemically treated genomic DNA (Homo sapiens) CpG-island No: 20708
aacgacgaaccccgcctaaccgaacccaaacaccgcgtacaaaaaaaaaacacacgcactctccgacgacccaaccgcgacgcacgaaattaataaaatacaaccacaccgacgactaccaacgcgcgaccgataccgataaattcctcacgcgccgatctccacgacgaaccgaaacgaaacctaacgcgaaacattataaaaaaaacgtaaaaaacgctacctaaaaaaacccgctacgaacccaacgaacgctacgacgataaaataaaaaaaacgatataaatttaaattaacgtaacgatatacgcgaaatccgactccgactccgactccaacccgaaactaaaaaaactaccctaaccaaacaacccgcgccccctcaccaatacgaccgacgcctaccgcgaacgaaaaaaataaataacgaaacccgcctcttcctacttccgttaccaaaataacgaaaaaacccaaaaaataaattttaaaattaaattccc

SEQ ID NO: 20709 - DNA, 653 bp, Artificial Sequence
  chemically treated genomic DNA (Homo sapiens) CpG-island No: 20709
gtttgacggttcgcggttgggatcgaattcggattgcgagatatttttcgtttcgtaggcgttttttagtcgttgaggttcggttcggtttttatcgtcggagtttgataaagaaagtttttcggttcgagttttttacgtatttatcggcgtcgacgttggcggcgattcggtttttcgtcgtttttagttttttgcgggggtcggtttttgggtcggttcgggcgtcggcggcggttattgttttatatttacggggttcgggtcgcgttcgtttcgagttaacggttttattagttaggcgcgtgcgtcggtttcgcgcgttatgttttcgtcgtgttgcgcgtcgtcgcggcgatttttattgttttttaatcgcgtacgttttcgtaggtttatatacgaatcgcgtacgcgcgcgttcgacgcgtttcgtttttcgcgcgttcggtttcgggttttttgtagttggtcgttgtttttagtgttttatttattttcgtcggaatcgttcgattgggcgggtgagcgcgcggttttcgatttagtatcgtcgtttgtttttttgtagattatttttgattcgatttttcggttatttttttatattgttttttttattttttttacggcgcggggtttaggacgagggt

SEQ ID NO: 20710 - DNA, 653 bp, Artificial Sequence
  chemically treated genomic DNA (Homo sapiens) CpG-island No: 20710
accctcgtcctaaaccccgcgccgtaaaaaaaataaaaaaaacaatataaaaaaataaccgaaaaatcgaatcaaaaataatctacaaaaaaacaaacgacgatactaaatcgaaaaccgcgcgctcacccgcccaatcgaacgattccgacgaaaataaataaaacactaaaaacaacgaccaactacaaaaaacccgaaaccgaacgcgcgaaaaacgaaacgcgtcgaacgcgcgcgtacgcgattcgtatataaacctacgaaaacgtacgcgattaaaaaacaataaaaatcgccgcgacgacgcgcaacacgacgaaaacataacgcgcgaaaccgacgcacgcgcctaactaataaaaccgttaactcgaaacgaacgcgacccgaaccccgtaaatataaaacaataaccgccgccgacgcccgaaccgacccaaaaaccgacccccgcaaaaaactaaaaacgacgaaaaaccgaatcgccgccaacgtcgacgccgataaatacgtaaaaaactcgaaccgaaaaactttctttatcaaactccgacgataaaaaccgaaccgaacctcaacgactaaaaaacgcctacgaaacgaaaaatatctcgcaatccgaattcgatcccaaccgcgaaccgtcaaac

SEQ ID NO: 20711 - DNA, 653 bp, Artificial Sequence
  chemically treated genomic DNA (Homo sapiens) CpG-island No: 20711
attttcgttttaggtttcgcgtcgtgggggaagtgaaaggggtagtgtggggaaatggtcgagaggtcgggttaggggtggtttgtagagaggtaggcggcggtgttgagtcgggaatcgcgcgtttattcgtttagtcggacggtttcggcgggggtgggtgagatattgggaatagcggttagttgtagagggttcgaggtcgggcgcgcggggagcggggcgcgtcgaacgcgcgcgtgcgcggttcgtgtgtgggtttgcgggggcgtgcgcggttggggggtagtgagggtcgtcgcggcggcgcgtagtacggcgggaatatggcgcgcggaatcggcgtacgcgtttagttggtgggatcgttagttcgaggcggacgcggttcggatttcgtggatatggagtagtggtcgtcgtcggcgttcgagtcggtttaagggtcgattttcgtaaggagttgaaggcggcgggagatcgagtcgtcgttagcgtcggcgtcggtgagtgcgtgaggggttcgggtcgggagattttttttgttaaatttcggcggtgggagtcgggtcgggttttagcgattgaggagcgtttgcgaggcggagggtgtttcgtagttcgggttcgattttagtcgcgagtcgttaggt

SEQ ID NO: 20712 - DNA, 653 bp, Artificial Sequence
  chemically treated genomic DNA (Homo sapiens) CpG-island No: 20712
acctaacgactcgcgactaaaatcgaacccgaactacgaaacaccctccgcctcgcaaacgctcctcaatcgctaaaacccgacccgactcccaccgccgaaatttaacaaaaaaaatctcccgacccgaacccctcacgcactcaccgacgccgacgctaacgacgactcgatctcccgccgccttcaactccttacgaaaatcgacccttaaaccgactcgaacgccgacgacgaccactactccatatccacgaaatccgaaccgcgtccgcctcgaactaacgatcccaccaactaaacgcgtacgccgattccgcgcgccatattcccgccgtactacgcgccgccgcgacgaccctcactaccccccaaccgcgcacgcccccgcaaacccacacacgaaccgcgcacgcgcgcgttcgacgcgccccgctccccgcgcgcccgacctcgaaccctctacaactaaccgctattcccaatatctcacccacccccgccgaaaccgtccgactaaacgaataaacgcgcgattcccgactcaacaccgccgcctacctctctacaaaccacccctaacccgacctctcgaccatttccccacactacccctttcacttcccccacgacgcgaaacctaaaacgaaaat

SEQ ID NO: 20713 - DNA, 535 bp, Artificial Sequence
  chemically treated genomic DNA (Homo sapiens) CpG-island No: 20713
gtttttttcgtttatttggatgcggtattttacgtcggtggtgtttattttgttggcgatgttgacggtgtttttttagatgtcgtatagtagtttggtggtgtcgatgatttcggtcgtgaggggtttatggttgaagtcgacgcggagtttgaagttgaattatagtatgttgttgttgaagtcgtttattacgcgtattatttttttggcgaattcgaataggatttgtaggtgtttttgcgggtggttgtcgttttgggtttgcgcggtgtttagttttgacgtcgttatgtacgtggtttcgatggttttgattttttcgatgttgttgtagttcggtttgtttaggagttcgttaaagttttcgatgagttcgttgaggattcggtagtattttttgtcgttttcgtagtttttttcgtagaattcgttgaagttgacgatgttggcgaagattattttttcgttgtcgtggtttttggagtaggtttgggatatttttagttgtttagttacgtggtaggggatgatg

SEQ ID NO: 20714 - DNA, 535 bp, Artificial Sequence
  chemically treated genomic DNA (Homo sapiens) CpG-island No: 20714
catcatcccctaccacgtaactaaacaactaaaaatatcccaaacctactccaaaaaccacgacaacgaaaaaataatcttcgccaacatcgtcaacttcaacgaattctacgaaaaaaactacgaaaacgacaaaaaatactaccgaatcctcaacgaactcatcgaaaactttaacgaactcctaaacaaaccgaactacaacaacatcgaaaaaatcaaaaccatcgaaaccacgtacataacgacgtcaaaactaaacaccgcgcaaacccaaaacgacaaccacccgcaaaaacacctacaaatcctattcgaattcgccaaaaaaataatacgcgtaataaacgacttcaacaacaacatactataattcaacttcaaactccgcgtcgacttcaaccataaacccctcacgaccgaaatcatcgacaccaccaaactactatacgacatctaaaaaaacaccgtcaacatcgccaacaaaataaacaccaccgacgtaaaataccgcatccaaataaacgaaaaaaac

SEQ ID NO: 20715 - DNA, 535 bp, Artificial Sequence
  chemically treated genomic DNA (Homo sapiens) CpG-island No: 20715
tattattttttattacgtggttgagtagttgaaggtgttttagatttattttaagaattacgatagcggaggggtgattttcgttagtatcgttaattttagcgagttttacgaggagaattacgagggcggtaaggagtgttatcgggtttttaacgagtttatcggggattttgacgagtttttaagtaagtcggattatagtagtatcgagaagattaagattatcggagttacgtatatggcggcgttagggttgaatatcgcgtaggtttaggacggtagttattcgtaggagtatttgtagattttgttcgagttcgttaaggagatgatgcgcgtggtggacgattttaataataatatgttgtggtttaattttaagtttcgcgtcggttttaattatgggttttttacggtcggggttatcggtattattaagttgttgtacgatatttggggagatatcgttaatatcgttagtaggatggatattatcggcgtggagtgtcgtatttaggtgagcgaagagagt

SEQ ID NO: 20716 - DNA, 535 bp, Artificial Sequence
  chemically treated genomic DNA (Homo sapiens) CpG-island No: 20716
actctcttcgctcacctaaatacgacactccacgccgataatatccatcctactaacgatattaacgatatctccccaaatatcgtacaacaacttaataataccgataaccccgaccgtaaaaaacccataattaaaaccgacgcgaaacttaaaattaaaccacaacatattattattaaaatcgtccaccacgcgcatcatctccttaacgaactcgaacaaaatctacaaatactcctacgaataactaccgtcctaaacctacgcgatattcaaccctaacgccgccatatacgtaactccgataatcttaatcttctcgatactactataatccgacttacttaaaaactcgtcaaaatccccgataaactcgttaaaaacccgataacactccttaccgccctcgtaattctcctcgtaaaactcgctaaaattaacgatactaacgaaaatcacccctccgctatcgtaattcttaaaataaatctaaaacaccttcaactactcaaccacgtaataaaaaataata

SEQ ID NO: 20717 - DNA, 1570 bp, Artificial Sequence
  chemically treated genomic DNA (Homo sapiens) CpG-island No: 20717
gaatgcggttttacgttaggtttggttttcgaattcgttaggcgcgcgcgtacggtagaagcgcgcgttttcgtttttcgcgagcgcgttttttattttttttcgtcgtacgcgtcgagtttcggcgttttcgttcgtttcgcgtttttatagttcgagcgtcgtttagttgattcgcgggcgttagacgcggcggtttttagttcgcgagcgtagttgcggttgcgagggttttttaggtcgatatttttttcgcgttttttttttattcggtcgggtttcggattcgtcgcgcgcgagttcgcggtcgtttttttcgcgtcgagcgaggaggtaggttgcggcggcgagaggcggttgcgcggttatgggcgcgttagtgtcgttttagggcgggcgtatagattatagtcggagcggtggtggtagttttcgtagaaagttttttcgggcggcggcggcggcggtttttggagtagcgcggtcgggatgagcgggagttgcgcggcgttcggttcgggttcgggttttttttcggtcgtttgtcgtttcgcgtattatttcgtgttgtgcgggatcgacgcggatagcgggttggagtttgacgagttggcgggtaaggttagggttgcggcggcgttgagtttttttaggggcgcgggggacgttgtggggacgcgcgggaggcggggtgtaggttttagataaagttagttttcggtggcgttttttcgtcgttttttggtcgaattggcgttcgggcgcgatttaatgatattgttatttatttcgcgtgcgggttttgcggttgcgtttatcggggttttcgtttttaggcgttgggttattaataataggcgcgggggtggttttaagggtacggatttcgtttggcgcgtcggttttttcgtttgtagtcgtattcggaggcggtcggtgagttatcgggcgcgtaggttgtttttcgatcgtcgtgtttgttttttattcgttagttattcggtttcggtcgcgaagtttcggtttcgtacgtgacgcggttttcgggttttttcgggagagggggagtcggatttagttcggttttcgtcggggtagcgttcgcggaggagtcggtggtcgtgcggagcgagcgcggggcggggatcggtcggattttgttttttgcgtcgtttgtcgttttgcggtgtcggttaagttattttttggaattttgtggatttggtcgcgtttgggagttggtagggatttttggacgttcgggatttagtatcgcgttttgttgatattgtttatattgttttcgagtttaaatttagttgggtgtatcgtgtgttagtgtttggttttttcggaggggtatcggttttttcgtttgatttatttgatggcgtagtgcggggttgtgttgggtaaacgacgtcgttaaaaggggtcgttaaagggcgatgggcgggggtagggtagcggagtgcgtagtgtcgagaggaggtcggggagaaataattgattttattttttacgtttgtttttttttgtttgttttcgcgggatttgaattttgatttgt

SEQ ID NO: 20718 - DNA, 1570 bp, Artificial Sequence
  chemically treated genomic DNA (Homo sapiens) CpG-island No: 20718
acaaatcaaaattcaaatcccgcgaaaacaaacaaaaaaaaacaaacgtaaaaaataaaatcaattatttctccccgacctcctctcgacactacgcactccgctaccctacccccgcccatcgccctttaacgaccccttttaacgacgtcgtttacccaacacaaccccgcactacgccatcaaataaatcaaacgaaaaaaccgatacccctccgaaaaaaccaaacactaacacacgatacacccaactaaatttaaactcgaaaacaatataaacaatatcaacaaaacgcgatactaaatcccgaacgtccaaaaatccctaccaactcccaaacgcgaccaaatccacaaaattccaaaaaataacttaaccgacaccgcaaaacgacaaacgacgcaaaaaacaaaatccgaccgatccccgccccgcgctcgctccgcacgaccaccgactcctccgcgaacgctaccccgacgaaaaccgaactaaatccgactccccctctcccgaaaaaacccgaaaaccgcgtcacgtacgaaaccgaaacttcgcgaccgaaaccgaataactaacgaataaaaaacaaacacgacgatcgaaaaacaacctacgcgcccgataactcaccgaccgcctccgaatacgactacaaacgaaaaaaccgacgcgccaaacgaaatccgtacccttaaaaccacccccgcgcctattattaataacccaacgcctaaaaacgaaaaccccgataaacgcaaccgcaaaacccgcacgcgaaataaataacaatatcattaaatcgcgcccgaacgccaattcgaccaaaaaacgacgaaaaaacgccaccgaaaactaactttatctaaaacctacaccccgcctcccgcgcgtccccacaacgtcccccgcgcccctaaaaaaactcaacgccgccgcaaccctaaccttacccgccaactcgtcaaactccaacccgctatccgcgtcgatcccgcacaacacgaaataatacgcgaaacgacaaacgaccgaaaaaaaacccgaacccgaaccgaacgccgcgcaactcccgctcatcccgaccgcgctactccaaaaaccgccgccgccgccgcccgaaaaaactttctacgaaaactaccaccaccgctccgactataatctatacgcccgccctaaaacgacactaacgcgcccataaccgcgcaaccgcctctcgccgccgcaacctacctcctcgctcgacgcgaaaaaaacgaccgcgaactcgcgcgcgacgaatccgaaacccgaccgaataaaaaaaaaacgcgaaaaaaatatcgacctaaaaaaccctcgcaaccgcaactacgctcgcgaactaaaaaccgccgcgtctaacgcccgcgaatcaactaaacgacgctcgaactataaaaacgcgaaacgaacgaaaacgccgaaactcgacgcgtacgacgaaaaaaaataaaaaacgcgctcgcgaaaaacgaaaacgcgcgcttctaccgtacgcgcgcgcctaacgaattcgaaaaccaaacctaacgtaaaaccgcattc

SEQ ID NO: 20719 - DNA, 1570 bp, Artificial Sequence
  chemically treated genomic DNA (Homo sapiens) CpG-island No: 20719
ataaattaagatttagatttcgcggaggtaagtagaaaggaataggcgtgaaaaatgaaattagttgttttttttcggttttttttcgatattgcgtatttcgttgttttgttttcgtttatcgttttttagcggttttttttaacggcgtcgtttgtttagtatagtttcgtattgcgttattaaatgagttaagcggaaggatcggtattttttcgggaaaattaggtattaatatacggtgtatttaattgaatttaaattcgggaatagtgtaggtagtgttaataaagcgcggtgttgggtttcgagcgtttaaaggtttttgttagtttttagacgcggttaaatttataggattttaaaaggtgatttggtcggtatcgtagagcggtaggcggcgtagagggtagagttcgatcggttttcgtttcgcgttcgtttcgtacggttatcggttttttcgcggacgttatttcggcgggagtcgagttgagttcgattttttttttttcgaagaggttcgaaagtcgcgttacgtgcggggtcgaaatttcgcggtcggggtcgggtggttggcgggtgggaggtaggtacggcggtcggggggtagtttgcgcgttcggtgatttatcggtcgttttcgagtgcggttgtaggcgaaggggtcggcgcgttaggcggggttcgtgtttttggggttattttcgcgtttgttattaataatttagcgtttggaggcgaaagtttcggtgggcgtagtcgtaaagttcgtacgcggaataaataataatgttattaaatcgcgttcgagcgttagttcggttagaaagcggcgggagggcgttatcgggagttgattttgtttggagtttgtatttcgtttttcgcgcgtttttatagcgtttttcgcgtttttgagggggtttagcgtcgtcgtagttttggttttattcgttagttcgttaggttttagttcgttgttcgcgtcgatttcgtatagtacgaagtagtgcgcgaagcggtaggcggtcggggaggagttcgagttcgggtcgggcgtcgcgtagttttcgtttatttcggtcgcgttgttttaggggtcgtcgtcgtcgtcgttcgggaaggttttttgcggaggttgttattatcgtttcggttgtggtttgtgcgttcgttttagggcgatattggcgcgtttatggtcgcgtagtcgtttttcgtcgtcgtagtttgttttttcgttcggcgcgggggaagcggtcgcgggttcgcgcgcggcgggttcggagttcggtcgggtgggggaggggcgcggggggagtgtcggtttgagaggttttcgtagtcgtagttgcgttcgcgagttgagagtcgtcgcgtttggcgttcgcgggttagttgagcggcgttcgggttgtgggagcgcggggcgggcgggggcgtcggggttcggcgcgtgcgacggagaggggtggggggcgcgttcgcgagggacggaggcgcgcgtttttatcgtgcgcgcgcgtttagcgggttcggaggttaagtttggcgtggggtcgtattt

SEQ ID NO: 20720 - DNA, 1570 bp, Artificial Sequence
  chemically treated genomic DNA (Homo sapiens) CpG-island No: 20720
aaatacgaccccacgccaaacttaacctccgaacccgctaaacgcgcgcgcacgataaaaacgcgcgcctccgtccctcgcgaacgcgccccccacccctctccgtcgcacgcgccgaaccccgacgcccccgcccgccccgcgctcccacaacccgaacgccgctcaactaacccgcgaacgccaaacgcgacgactctcaactcgcgaacgcaactacgactacgaaaacctctcaaaccgacactccccccgcgcccctcccccacccgaccgaactccgaacccgccgcgcgcgaacccgcgaccgcttcccccgcgccgaacgaaaaaacaaactacgacgacgaaaaacgactacgcgaccataaacgcgccaatatcgccctaaaacgaacgcacaaaccacaaccgaaacgataataacaacctccgcaaaaaaccttcccgaacgacgacgacgacgacccctaaaacaacgcgaccgaaataaacgaaaactacgcgacgcccgacccgaactcgaactcctccccgaccgcctaccgcttcgcgcactacttcgtactatacgaaatcgacgcgaacaacgaactaaaacctaacgaactaacgaataaaaccaaaactacgacgacgctaaaccccctcaaaaacgcgaaaaacgctataaaaacgcgcgaaaaacgaaatacaaactccaaacaaaatcaactcccgataacgccctcccgccgctttctaaccgaactaacgctcgaacgcgatttaataacattattatttattccgcgtacgaactttacgactacgcccaccgaaactttcgcctccaaacgctaaattattaataacaaacgcgaaaataaccccaaaaacacgaaccccgcctaacgcgccgaccccttcgcctacaaccgcactcgaaaacgaccgataaatcaccgaacgcgcaaactaccccccgaccgccgtacctacctcccacccgccaaccacccgaccccgaccgcgaaatttcgaccccgcacgtaacgcgactttcgaacctcttcgaaaaaaaaaaaatcgaactcaactcgactcccgccgaaataacgtccgcgaaaaaaccgataaccgtacgaaacgaacgcgaaacgaaaaccgatcgaactctaccctctacgccgcctaccgctctacgataccgaccaaatcaccttttaaaatcctataaatttaaccgcgtctaaaaactaacaaaaacctttaaacgctcgaaacccaacaccgcgctttattaacactacctacactattcccgaatttaaattcaattaaatacaccgtatattaatacctaattttcccgaaaaaataccgatccttccgcttaactcatttaataacgcaatacgaaactatactaaacaaacgacgccgttaaaaaaaaccgctaaaaaacgataaacgaaaacaaaacaacgaaatacgcaatatcgaaaaaaaaccgaaaaaaaacaactaatttcatttttcacgcctattcctttctacttacctccgcgaaatctaaatcttaatttat

SEQ ID NO: 20721 - DNA, 705 bp, Artificial Sequence
  chemically treated genomic DNA (Homo sapiens) CpG-island No: 20721
gtttgtcgcgcgcgcgcgcgcgcgcgcgacgattgggtatttgttttggtttttgtatagattttttttcggggattttcgtttaggagtgaagtatagagacggatttttttcgggaaaatttttgcgcgcgtatatttatatatatagagagagatttggggataaatacgtcgcgagtttcggttgtttcgttaatttcgggcgcgggaagaaagcgggcgggtaggttagtaaagtttttatatattcgcgtttttatttttttaaattcgagttattttgagtatttgttttcgcgtgcgtaaaggttgaattcggaatttataatttgcggtcgttttttttttttttgtatttttaggttagttggaatgcgcgagtagatttttttataaggagtagttagtttttcgcggcgtacgcggcgggcgtcgcgggtagtagcggttggggatttattcggtacgtacgttcggggcgcgggtcgtagggataagagtgtggtcggggttttttcgtcgttagttttaggggcgagagacgcgttttttaattttttcgtagttggggtgaagttgtattagcggttttgtaagcgttgatcgttacgtcggcgaaagaagatttgtggggattattttcgtttttaggtttggtttatagttcgtatttttgggtgtttttaaatagtattttttttag

SEQ ID NO: 20722 - DNA, 705 bp, Artificial Sequence
  chemically treated genomic DNA (Homo sapiens) CpG-island No: 20722
ctaaaaaaaatactatttaaaaacacccaaaaatacgaactataaaccaaacctaaaaacgaaaataatccccacaaatcttctttcgccgacgtaacgatcaacgcttacaaaaccgctaatacaacttcaccccaactacgaaaaaattaaaaaacgcgtctctcgcccctaaaactaacgacgaaaaaaccccgaccacactcttatccctacgacccgcgccccgaacgtacgtaccgaataaatccccaaccgctactacccgcgacgcccgccgcgtacgccgcgaaaaactaactactccttataaaaaaatctactcgcgcattccaactaacctaaaaatacaaaaaaaaaaaaaacgaccgcaaattataaattccgaattcaacctttacgcacgcgaaaacaaatactcaaaataactcgaatttaaaaaaataaaaacgcgaatatataaaaactttactaacctacccgcccgctttcttcccgcgcccgaaattaacgaaacaaccgaaactcgcgacgtatttatccccaaatctctctctatatatataaatatacgcgcgcaaaaattttcccgaaaaaaatccgtctctatacttcactcctaaacgaaaatccccgaaaaaaaatctatacaaaaaccaaaacaaatacccaatcgtcgcgcgcgcgcgcgcgcgcgcgacaaac

SEQ ID NO: 20723 - DNA, 705 bp, Artificial Sequence
  chemically treated genomic DNA (Homo sapiens) CpG-island No: 20723
ttggggagagtgttgtttggggatatttaggggtacgagttgtaggttaggtttgagggcgagggtggtttttataaattttttttcgtcggcgtgacggttagcgtttgtaggatcgttagtgtaattttattttagttgcggggaagttggagagcgcgtttttcgtttttggggttggcggcggagaagtttcggttatatttttatttttgcggttcgcgtttcgggcgtgcgtgtcgggtgagtttttagtcgttattgttcgcggcgttcgtcgcgtgcgtcgcgggaaattgattgttttttgtgagggaatttgttcgcgtattttagttagtttaggaatgtaggggagggagaagcgatcgtaagttgtgaatttcgggtttagtttttgcgtacgcgagggtaggtgtttagggtggttcgggtttggaggggtagagacgcgggtgtgtgggagttttgttagtttgttcgttcgtttttttttcgcgttcgaaattagcgagatagtcggagttcgcggcgtgtttatttttaagtttttttttgtgtgtatgggtgtgcgcgcgtagagattttttcgaagggaattcgtttttgtgttttatttttgagcgagagttttcgagagggaatttgtgtagaggttagaataggtgtttagtcgtcgcgcgcgcgcgcgcgcgcgcgataagt

SEQ ID NO: 20724 - DNA, 705 bp, Artificial Sequence
  chemically treated genomic DNA (Homo sapiens) CpG-island No: 20724
acttatcgcgcgcgcgcgcgcgcgcgcgacgactaaacacctattctaacctctacacaaattccctctcgaaaactctcgctcaaaaataaaacacaaaaacgaattcccttcgaaaaaatctctacgcgcgcacacccatacacacaaaaaaaaacttaaaaataaacacgccgcgaactccgactatctcgctaatttcgaacgcgaaaaaaaaacgaacgaacaaactaacaaaactcccacacacccgcgtctctacccctccaaacccgaaccaccctaaacacctaccctcgcgtacgcaaaaactaaacccgaaattcacaacttacgatcgcttctccctcccctacattcctaaactaactaaaatacgcgaacaaattccctcacaaaaaacaatcaatttcccgcgacgcacgcgacgaacgccgcgaacaataacgactaaaaactcacccgacacgcacgcccgaaacgcgaaccgcaaaaataaaaatataaccgaaacttctccgccgccaaccccaaaaacgaaaaacgcgctctccaacttccccgcaactaaaataaaattacactaacgatcctacaaacgctaaccgtcacgccgacgaaaaaaaatttataaaaaccaccctcgccctcaaacctaacctacaactcgtacccctaaatatccccaaacaacactctccccaa

SEQ ID NO: 20725 - DNA, 569 bp, Artificial Sequence
  chemically treated genomic DNA (Homo sapiens) CpG-island No: 20725
cggcgtttggttggatgcgggttcgagtcgcgtgtacgtattggagggagatggttagattgggtcgggaatttattttatagttaggcgtcggtcgcggttggatcggtcgagcggttcgggcggaggagtcgagcgggtagagacggtgggcggttttttaggtgattttagttttttaagatcgtcgtttcggtagtcggcgtttacgtgtttttttttttgtgatagggagcgttttcgggtttgcgggttttggcgggggcggtcgtgtttcgtttgcgagtgcgcgttcgtcgtgttcgatattgtttcgggggtcgcgcggttcgtcgttcgtcggttttacgaggaatagcgcggggcgcggggcgttgggcgcggacgtaggacgagaggatatttttgagtacgacgttttcgttaggcgtcgttacgggtattttgtgcgggttttcggtcgggtggcgagggcggcgtttagcgggtagttagggaattggtttaagagggtcggtcggttttgtcggtggagggcgttttttattcggtagcggggaggtgtttag

SEQ ID NO: 20726 - DNA, 569 bp, Artificial Sequence
  chemically treated genomic DNA (Homo sapiens) CpG-island No: 20726
ctaaacacctccccgctaccgaataaaaaacgccctccaccgacaaaaccgaccgaccctcttaaaccaattccctaactacccgctaaacgccgccctcgccacccgaccgaaaacccgcacaaaatacccgtaacgacgcctaacgaaaacgtcgtactcaaaaatatcctctcgtcctacgtccgcgcccaacgccccgcgccccgcgctattcctcgtaaaaccgacgaacgacgaaccgcgcgacccccgaaacaatatcgaacacgacgaacgcgcactcgcaaacgaaacacgaccgcccccgccaaaacccgcaaacccgaaaacgctccctatcacaaaaaaaaaaacacgtaaacgccgactaccgaaacgacgatcttaaaaaactaaaatcacctaaaaaaccgcccaccgtctctacccgctcgactcctccgcccgaaccgctcgaccgatccaaccgcgaccgacgcctaactataaaataaattcccgacccaatctaaccatctccctccaatacgtacacgcgactcgaacccgcatccaaccaaacgccg

SEQ ID NO: 20727 - DNA, 569 bp, Artificial Sequence
  chemically treated genomic DNA (Homo sapiens) CpG-island No: 20727
ttgggtattttttcgttatcgggtggggaacgttttttatcggtagggtcggtcgatttttttgggttagttttttagttgttcgttgggcgtcgttttcgttattcggtcgaggattcgtataaggtgttcgtggcggcgtttgacgggagcgtcgtgtttaggggtgttttttcgttttgcgttcgcgtttagcgtttcgcgtttcgcgttgtttttcgtgagatcggcgggcggcgagtcgcgcggttttcggggtagtgtcggatacggcgggcgcgtattcgtaggcggggtacggtcgttttcgttaggattcgtaggttcggaaacgttttttgttataaaggggggaatacgtgggcgtcggttgtcggggcggcgattttagggaattagggttatttggagagtcgtttatcgtttttgttcgttcgattttttcgttcgggtcgttcggtcggtttagtcgcggtcggcgtttggttgtgaggtggattttcggtttagtttgattatttttttttagtacgtatacgcggttcgaattcgtatttaattagacgtcg

SEQ ID NO: 20728 - DNA, 569 bp, Artificial Sequence
  chemically treated genomic DNA (Homo sapiens) CpG-island No: 20728
cgacgtctaattaaatacgaattcgaaccgcgtatacgtactaaaaaaaaataatcaaactaaaccgaaaatccacctcacaaccaaacgccgaccgcgactaaaccgaccgaacgacccgaacgaaaaaatcgaacgaacaaaaacgataaacgactctccaaataaccctaattccctaaaatcgccgccccgacaaccgacgcccacgtattcccccctttataacaaaaaacgtttccgaacctacgaatcctaacgaaaacgaccgtaccccgcctacgaatacgcgcccgccgtatccgacactaccccgaaaaccgcgcgactcgccgcccgccgatctcacgaaaaacaacgcgaaacgcgaaacgctaaacgcgaacgcaaaacgaaaaaacacccctaaacacgacgctcccgtcaaacgccgccacgaacaccttatacgaatcctcgaccgaataacgaaaacgacgcccaacgaacaactaaaaaactaacccaaaaaaatcgaccgaccctaccgataaaaaacgttccccacccgataacgaaaaaatacccaa

SEQ ID NO: 20729 - DNA, 596 bp, Artificial Sequence
  chemically treated genomic DNA (Homo sapiens) CpG-island No: 20729
aaaggcgggttttcgtgacgatttataaaagtttaggggtaagcggttcggataacggttagtttgaggagttgttgcgatagtttattatttttttcgagagtgattttcgttgttttaaggttttttagagcgaatttgtgcggttgtaggtatcggcgcgtcgagttttcggcgttcggaaggatcgagtttttttcgcggatttagtgtttcgtttttagtttttaattttagagtcgagtcgatagagagtagggaatcggtatggttaaagtcgcggcgatcggtatcgatttgggtattatttatttttgcgtgggggtgttttaatacggtaaggtggagattatcgttaacgattagggtaatcgtattatttttagttacgtggtttttacggatatcgagcggtttatcggggatgcggttaagaattaggtggcgttgaattcgtagaatatcgtgtttgacgcgaagcggttgatcggtcgtaagttcggcgattcggtggtgtagtcggatatgaagtattggtttttttaggtgattaacgacggagataagtttaaggtgtaggtgagttataaggggga

SEQ ID NO: 20730 - DNA, 596 bp, Artificial Sequence
  chemically treated genomic DNA (Homo sapiens) CpG-island No: 20730
tcccccttataactcacctacaccttaaacttatctccgtcgttaatcacctaaaaaaaccaatacttcatatccgactacaccaccgaatcgccgaacttacgaccgatcaaccgcttcgcgtcaaacacgatattctacgaattcaacgccacctaattcttaaccgcatccccgataaaccgctcgatatccgtaaaaaccacgtaactaaaaataatacgattaccctaatcgttaacgataatctccaccttaccgtattaaaacacccccacgcaaaaataaataatacccaaatcgataccgatcgccgcgactttaaccataccgattccctactctctatcgactcgactctaaaattaaaaactaaaaacgaaacactaaatccgcgaaaaaaactcgatccttccgaacgccgaaaactcgacgcgccgatacctacaaccgcacaaattcgctctaaaaaaccttaaaacaacgaaaatcactctcgaaaaaaataataaactatcgcaacaactcctcaaactaaccgttatccgaaccgcttacccctaaacttttataaatcgtcacgaaaacccgccttt

SEQ ID NO: 20731 - DNA, 596 bp, Artificial Sequence
  chemically treated genomic DNA (Homo sapiens) CpG-island No: 20731
ttttttttgtagtttatttgtattttgggtttgttttcgtcgttgattatttggaaaggttagtgttttatgttcgattgtattatcgggtcgtcgaatttgcggtcgattagtcgtttcgcgttaaatacggtgttttgcgggtttagcgttatttggtttttggtcgtattttcgatgagtcgttcggtgttcgtgaaggttacgtagttgggggtggtgcggttgttttggtcgttggcgatgatttttattttgtcgtgttggaatatttttacgtaggagtaggtggtgtttaggtcgatgtcgatcgtcgcggttttggttatgtcggttttttgttttttgtcggttcggttttgagattgggggttggaaacggaatattggattcgcgagaagagttcggttttttcggacgtcggaaattcgacgcgtcggtgtttgtagtcgtataggttcgttttgggaagttttgggataacgggagttattttcgaaaaaggtagtggattgtcgtagtagttttttaggttagtcgttattcggatcgtttgtttttgggtttttataagtcgttacggagattcgttttt

SEQ ID NO: 20732 - DNA, 596 bp, Artificial Sequence
  chemically treated genomic DNA (Homo sapiens) CpG-island No: 20732
aaaaacgaatctccgtaacgacttataaaaacccaaaaacaaacgatccgaataacgactaacctaaaaaactactacgacaatccactacctttttcgaaaataactcccgttatcccaaaacttcccaaaacgaacctatacgactacaaacaccgacgcgtcgaatttccgacgtccgaaaaaaccgaactcttctcgcgaatccaatattccgtttccaacccccaatctcaaaaccgaaccgacaaaaaacaaaaaaccgacataaccaaaaccgcgacgatcgacatcgacctaaacaccacctactcctacgtaaaaatattccaacacgacaaaataaaaatcatcgccaacgaccaaaacaaccgcaccacccccaactacgtaaccttcacgaacaccgaacgactcatcgaaaatacgaccaaaaaccaaataacgctaaacccgcaaaacaccgtatttaacgcgaaacgactaatcgaccgcaaattcgacgacccgataatacaatcgaacataaaacactaacctttccaaataatcaacgacgaaaacaaacccaaaatacaaataaactacaaaaaaaa

SEQ ID NO: 20733 - DNA, 584 bp, Artificial Sequence
  chemically treated genomic DNA (Homo sapiens) CpG-island No: 20733
tttacgacgatttataaaagtcgaggggcgcgcggttcggaaaacggttagtttgaggagttgttgcgagggttcgtttcgtttttcgagagtgattttcgcggttttaaggttttttagagcgaatttgtgcggttgtaggtatcggcgtgttgagtgttcggcgttttcgaaggattgagtttatgtcgcggatttcgttcgtcgtatttagtttttagttttagagcggagtttatagagtagggtatcggtatggttaaagtcgcgacgaacggtatcgatttgggtattatttattcgtgcgtgggggtgttttaatacggtaaggtggagattatcgttaacgattagggtagtcgtattatttttagttacgtggtttttacggatatcgagcggtttatcggggatgcggttaagaattaggtggcgttgaattcgtagaatatcgtgtttgacgcgaagcggttgatcggtcgtaagttcggcgattcggtggtgtagtcggatatgaagtattggtttttttaggtgattaacgacggagataagtttaaggtgtaggtgagttataaggggga

SEQ ID NO: 20734 - DNA, 584 bp, Artificial Sequence
  chemically treated genomic DNA (Homo sapiens) CpG-island No: 20734
tcccccttataactcacctacaccttaaacttatctccgtcgttaatcacctaaaaaaaccaatacttcatatccgactacaccaccgaatcgccgaacttacgaccgatcaaccgcttcgcgtcaaacacgatattctacgaattcaacgccacctaattcttaaccgcatccccgataaaccgctcgatatccgtaaaaaccacgtaactaaaaataatacgactaccctaatcgttaacgataatctccaccttaccgtattaaaacacccccacgcacgaataaataatacccaaatcgataccgttcgtcgcgactttaaccataccgataccctactctataaactccgctctaaaactaaaaactaaatacgacgaacgaaatccgcgacataaactcaatccttcgaaaacgccgaacactcaacacgccgatacctacaaccgcacaaattcgctctaaaaaaccttaaaaccgcgaaaatcactctcgaaaaacgaaacgaaccctcgcaacaactcctcaaactaaccgttttccgaaccgcgcgcccctcgacttttataaatcgtcgtaaa

SEQ ID NO: 20735 - DNA, 584 bp, Artificial Sequence
  chemically treated genomic DNA (Homo sapiens) CpG-island No: 20735
ttttttttgtagtttatttgtattttgggtttgttttcgtcgttgattatttggaaaggttagtgttttatgttcgattgtattatcgggtcgtcgaatttgcggtcgattagtcgtttcgcgttaaatacggtgttttgcgggtttagcgttatttggtttttggtcgtattttcgatgagtcgttcggtgttcgtgaaggttacgtagttgggggtggtgcggttgttttggtcgttggcgatgatttttattttgtcgtgttggaatatttttacgtacgagtaggtggtgtttaggtcgatgtcgttcgtcgcggttttggttatgtcggtgttttgttttgtgggtttcgttttgagattgggggttggatacggcggacgggattcgcgatatgagtttagtttttcgggaacgtcggatatttaatacgtcggtgtttgtagtcgtataggttcgttttggaaagttttgggatcgcgggagttattttcgaaagacgaagcggattttcgtagtagttttttaggttggtcgtttttcggatcgcgcgtttttcggtttttataagtcgtcgtgga

SEQ ID NO: 20736 - DNA, 584 bp, Artificial Sequence
  chemically treated genomic DNA (Homo sapiens) CpG-island No: 20736
tccacgacgacttataaaaaccgaaaaacgcgcgatccgaaaaacgaccaacctaaaaaactactacgaaaatccgcttcgtctttcgaaaataactcccgcgatcccaaaactttccaaaacgaacctatacgactacaaacaccgacgtattaaatatccgacgttcccgaaaaactaaactcatatcgcgaatcccgtccgccgtatccaacccccaatctcaaaacgaaacccacaaaacaaaacaccgacataaccaaaaccgcgacgaacgacatcgacctaaacaccacctactcgtacgtaaaaatattccaacacgacaaaataaaaatcatcgccaacgaccaaaacaaccgcaccacccccaactacgtaaccttcacgaacaccgaacgactcatcgaaaatacgaccaaaaaccaaataacgctaaacccgcaaaacaccgtatttaacgcgaaacgactaatcgaccgcaaattcgacgacccgataatacaatcgaacataaaacactaacctttccaaataatcaacgacgaaaacaaacccaaaatacaaataaactacaaaaaaaa

SEQ ID NO: 20737 - DNA, 543 bp, Artificial Sequence
  chemically treated genomic DNA (Homo sapiens) CpG-island No: 20737
gttttcgtagtttattagtaggttttttttattcgcgggcggtgtagtttcgtttcgtttttttaatcgcggtttcgttttttcgagggtgggggtcgtgttggttattagtcgggttggaggcgggggtcgggtttttattgggttcgtgcgttttgcgttcgtcgcggcggtgtcgagttcgttggttttcgattgttttttgcggcggtggcggtcgttgtttttttgttttcgggttcggggttgtaggggttagagcgagtgcgttttttgttcgcggatcgcggtagtttagagtaggtaatggggcgtttttggggagcgtttgtcggagtttagggttaggttcgggcggtggggtcggttttcgaagttgttttttgcgtcggcgatcgggtcgagcggtgtcgcggtttttcggagttttttgtcggtttttaggcgttttagtttgggagttcgcggcgggtattttgtgaggaggtgggggcggggtcggggtaggggcggggtcgtttcgggcgggattttgaggatttt

SEQ ID NO: 20738 - DNA, 543 bp, Artificial Sequence
  chemically treated genomic DNA (Homo sapiens) CpG-island No: 20738
aaaatcctcaaaatcccgcccgaaacgaccccgcccctaccccgaccccgcccccacctcctcacaaaatacccgccgcgaactcccaaactaaaacgcctaaaaaccgacaaaaaactccgaaaaaccgcgacaccgctcgacccgatcgccgacgcaaaaaacaacttcgaaaaccgaccccaccgcccgaacctaaccctaaactccgacaaacgctccccaaaaacgccccattacctactctaaactaccgcgatccgcgaacaaaaaacgcactcgctctaacccctacaaccccgaacccgaaaacaaaaaaacaacgaccgccaccgccgcaaaaaacaatcgaaaaccaacgaactcgacaccgccgcgacgaacgcaaaacgcacgaacccaataaaaacccgacccccgcctccaacccgactaataaccaacacgacccccaccctcgaaaaaacgaaaccgcgattaaaaaaacgaaacgaaactacaccgcccgcgaataaaaaaaacctactaataaactacgaaaac

SEQ ID NO: 20739 - DNA, 543 bp, Artificial Sequence
  chemically treated genomic DNA (Homo sapiens) CpG-island No: 20739
ggggtttttagggtttcgttcgaggcggtttcgtttttgtttcggtttcgtttttatttttttataaggtgttcgtcgcgggtttttaggttgaggcgtttagaggtcggtaggaggtttcggaggatcgcggtatcgttcggttcggtcgtcggcgtagggagtagtttcgggggtcgattttatcgttcgagtttagttttgggtttcgataggcgttttttagaggcgttttattatttgttttgggttgtcgcggttcgcgggtaggaggcgtattcgttttggtttttgtagtttcgggttcggaggtaaggaggtagcgatcgttatcgtcgtagaggataatcgggagttagcgggttcggtatcgtcgcggcgggcgtagaacgtacgagtttagtgggagttcggttttcgtttttagttcggttagtaattaatacggtttttattttcggaggggcgggatcgcggttggaggggcggggcggggttgtatcgttcgcgggtaagaggggtttgttgataggttgcgaaggt

SEQ ID NO: 20740 - DNA, 543 bp, Artificial Sequence
  chemically treated genomic DNA (Homo sapiens) CpG-island No: 20740
accttcgcaacctatcaacaaacccctcttacccgcgaacgatacaaccccgccccgcccctccaaccgcgatcccgcccctccgaaaataaaaaccgtattaattactaaccgaactaaaaacgaaaaccgaactcccactaaactcgtacgttctacgcccgccgcgacgataccgaacccgctaactcccgattatcctctacgacgataacgatcgctacctccttacctccgaacccgaaactacaaaaaccaaaacgaatacgcctcctacccgcgaaccgcgacaacccaaaacaaataataaaacgcctctaaaaaacgcctatcgaaacccaaaactaaactcgaacgataaaatcgacccccgaaactactccctacgccgacgaccgaaccgaacgataccgcgatcctccgaaacctcctaccgacctctaaacgcctcaacctaaaaacccgcgacgaacaccttataaaaaaataaaaacgaaaccgaaacaaaaacgaaaccgcctcgaacgaaaccctaaaaacccc

SEQ ID NO: 20741 - DNA, 632 bp, Artificial Sequence
  chemically treated genomic DNA (Homo sapiens) CpG-island No: 20741
ggtatttttttttttatatacgtacgttcgcgagtcgtttcgggtagcggtcgtgtttttcggcggggtttcgtcggcggtttttgatttcgttttagagttgtttttcggtagcgttattttttcgtgtttataaaagtattttttttttaatttatgaacggatttcgatttttgttttgttattatttatgcgtttcgtattcgaggtgtcgtttttatttatacgttttacggtttcgcgaaattcggttttttagttcgcgggacgcgttgtttgttaggcgggttcggcggtatttcgggggcgggaggggtcggtcgtagggtttttagtttggcgttcgcggggcgttcgtagcgaaggggtgggtgtcgttcgtgaacgtagtagggattagtttagttcgcgttcgtttttgggtttcggttatcgttttttcgttattttttcggtttttgcgtggatcggttcgtggcgggggttgttttgcgttttcgttttcgtagtagtcgcggatttttattaacgttgacgagttagtgtcgcgattcggggagagaagacggtattaggggttgaaggtatgtgtgtaagtggttcgagttattttttatgatatattagggtt

SEQ ID NO: 20742 - DNA, 632 bp, Artificial Sequence
  chemically treated genomic DNA (Homo sapiens) CpG-island No: 20742
aaccctaatatatcataaaaaataactcgaaccacttacacacataccttcaacccctaataccgtcttctctccccgaatcgcgacactaactcgtcaacgttaataaaaatccgcgactactacgaaaacgaaaacgcaaaacaacccccgccacgaaccgatccacgcaaaaaccgaaaaaataacgaaaaaacgataaccgaaacccaaaaacgaacgcgaactaaactaatccctactacgttcacgaacgacacccaccccttcgctacgaacgccccgcgaacgccaaactaaaaaccctacgaccgacccctcccgcccccgaaataccgccgaacccgcctaacaaacaacgcgtcccgcgaactaaaaaaccgaatttcgcgaaaccgtaaaacgtataaataaaaacgacacctcgaatacgaaacgcataaataataacaaaacaaaaatcgaaatccgttcataaattaaaaaaaaaatacttttataaacacgaaaaaataacgctaccgaaaaacaactctaaaacgaaatcaaaaaccgccgacgaaaccccgccgaaaaacacgaccgctacccgaaacgactcgcgaacgtacgtatataaaaaaaaaaatacc

SEQ ID NO: 20743 - DNA, 632 bp, Artificial Sequence
  chemically treated genomic DNA (Homo sapiens) CpG-island No: 20743
agttttggtatattatggagagtggttcgggttatttgtatatatgtttttagtttttggtatcgtttttttttttcgggtcgcgatattgattcgttaacgttaatgggggttcgcgattgttgcggggacgagggcgtagagtagttttcgttacgggtcggtttacgtaggggtcgagaaagtggcggagaggcggtggtcgaggtttaggggcgagcgcgggttgagttggtttttgttgcgtttacgagcgatatttattttttcgttgcggacgtttcgcgggcgttaggttgggggttttgcgatcgatttttttcgttttcgaggtatcgtcgggttcgtttggtaggtagcgcgtttcgcgagttggagggtcgagtttcgcggggtcgtggggcgtgtgggtgaaggcgatatttcggatgcgggacgtatgaatggtggtagagtaggggtcgggattcgtttatgggttgggagagagatgtttttgtgagtacgggaaagtagcgttgtcggagaatagttttgaggcgggattaaaagtcgtcggcgaagtttcgtcgaggaatacggtcgttgttcggggcggttcgcgagcgtgcgtgtgtggaggggaggatgtt

SEQ ID NO: 20744 - DNA, 632 bp, Artificial Sequence
  chemically treated genomic DNA (Homo sapiens) CpG-island No: 20744
aacatcctcccctccacacacgcacgctcgcgaaccgccccgaacaacgaccgtattcctcgacgaaacttcgccgacgacttttaatcccgcctcaaaactattctccgacaacgctactttcccgtactcacaaaaacatctctctcccaacccataaacgaatcccgacccctactctaccaccattcatacgtcccgcatccgaaatatcgccttcacccacacgccccacgaccccgcgaaactcgaccctccaactcgcgaaacgcgctacctaccaaacgaacccgacgatacctcgaaaacgaaaaaaatcgatcgcaaaacccccaacctaacgcccgcgaaacgtccgcaacgaaaaaataaatatcgctcgtaaacgcaacaaaaaccaactcaacccgcgctcgcccctaaacctcgaccaccgcctctccgccactttctcgacccctacgtaaaccgacccgtaacgaaaactactctacgccctcgtccccgcaacaatcgcgaacccccattaacgttaacgaatcaatatcgcgacccgaaaaaaaaaaacgataccaaaaactaaaaacatatatacaaataacccgaaccactctccataatataccaaaact

SEQ ID NO: 20745 - DNA, 525 bp, Artificial Sequence
  chemically treated genomic DNA (Homo sapiens) CpG-island No: 20745
attcgcgtcgagtttttttttatttcgatattataagggagaagagcggagtcgtcgtcgtcgtcgtcgttattatcgttatcgttatcgtcgcggttttcggagcgagcgagcgattttgtcgcgcggggagttttatcgggagtcgcgtttcgttagttcgttttaggtcgtcgtcgtcgtcgtcgtttatttattttgtcgcggcgcgttttcgttgtggtcgtgaggaatcgagtttagcgttgttaagttgtttgggtttggagcgtatcgtgttatagcgtttggtttcgggttcgggttgcgcgcggcggttagatatgataggttgaggtttttttgtttatattcggtcgtcgagggggcggtgcgtcgtttaattttttcgcgtcgggtcgttatcgtcgtttttcgttagtttcgcgtttagcgtttcggttcggtcgtcgttttattttttcgttttattttttcgtttcgttttatatacgcgggtcggggtttgtgagtagtcgtgttttt

SEQ ID NO: 20746 - DNA, 525 bp, Artificial Sequence
  chemically treated genomic DNA (Homo sapiens) CpG-island No: 20746
aaaaacacgactactcacaaaccccgacccgcgtatataaaacgaaacgaaaaaataaaacgaaaaaataaaacgacgaccgaaccgaaacgctaaacgcgaaactaacgaaaaacgacgataacgacccgacgcgaaaaaattaaacgacgcaccgccccctcgacgaccgaatataaacaaaaaaacctcaacctatcatatctaaccgccgcgcgcaacccgaacccgaaaccaaacgctataacacgatacgctccaaacccaaacaacttaacaacgctaaactcgattcctcacgaccacaacgaaaacgcgccgcgacaaaataaataaacgacgacgacgacgacgacctaaaacgaactaacgaaacgcgactcccgataaaactccccgcgcgacaaaatcgctcgctcgctccgaaaaccgcgacgataacgataacgataataacgacgacgacgacgacgactccgctcttctcccttataatatcgaaataaaaaaaaactcgacgcgaat

SEQ ID NO: 20747 - DNA, 525 bp, Artificial Sequence
  chemically treated genomic DNA (Homo sapiens) CpG-island No: 20747
gggggtacggttgtttataggtttcggttcgcgtgtgtggagcggggcgagggggtgaggcgagggggtgaggcggcggtcgagtcggggcgttgggcgcggggttggcgggaggcggcggtggcggttcggcgcgaaggggttaagcggcgtatcgttttttcggcggtcgggtgtaaatagaggagttttagtttattatgtttggtcgtcgcgcgtagttcgagttcggagttaggcgttgtaatacgatacgttttagatttaggtaatttggtagcgttgggttcggttttttacggttatagcgagggcgcgtcgcggtaaggtgggtgagcggcggcggcggcggcggtttggggcgggttggcggagcgcggttttcggtgaggtttttcgcgcggtagggtcgttcgttcgtttcggggatcgcggcggtggcggtggcggtggtggcggcggcggcggcggcggtttcgttttttttttttgtggtgtcggaatgggaggaggttcggcgcgggt

SEQ ID NO: 20748 - DNA, 525 bp, Artificial Sequence
  chemically treated genomic DNA (Homo sapiens) CpG-island No: 20748
acccgcgccgaacctcctcccattccgacaccacaaaaaaaaaaaacgaaaccgccgccgccgccgccgccaccaccgccaccgccaccgccgcgatccccgaaacgaacgaacgaccctaccgcgcgaaaaacctcaccgaaaaccgcgctccgccaacccgccccaaaccgccgccgccgccgccgctcacccaccttaccgcgacgcgccctcgctataaccgtaaaaaaccgaacccaacgctaccaaattacctaaatctaaaacgtatcgtattacaacgcctaactccgaactcgaactacgcgcgacgaccaaacataataaactaaaactcctctatttacacccgaccgccgaaaaaacgatacgccgcttaaccccttcgcgccgaaccgccaccgccgcctcccgccaaccccgcgcccaacgccccgactcgaccgccgcctcaccccctcgcctcaccccctcgccccgctccacacacgcgaaccgaaacctataaacaaccgtaccccc

SEQ ID NO: 20749 - DNA, 796 bp, Artificial Sequence
  chemically treated genomic DNA (Homo sapiens) CpG-island No: 20749
gaatcgtcgtttttttagattcgcgtgtatagcgcggcgcgtttattgagtcggtttaggttcgtaggaggcgttgttattgcgaggtcgaaacgagtgtttcggaaaacgtcggttcggttaggcgttttgtcgttattcgttgatcgattggtatattagtttatgtaatttagcgttaaagatcggtagtttggggaatgatatttacggggggaattcgaattttattttcgcgacgcggggacgttaacgtgcgacgttttgtcggttcgtttttttttgtttatttattggttaattgttttagagtacgggcgagagcgcggtatatagggtaaaggtagagtttatcgttttagcgagtttaaaatttgcggtgtttcggtagtcgcggaattcgggttttgcgcggtagtttgggttgtcgtcgggggtggtattttcggtaggaacgtcgtttcggggtatcgtagacggcgcgcgcggttttttacgcgttttatacgttttgtacgtcgtcgtttgagttttaaggcgtaggatttcgtgcggcgggattcgtttattttcgaggttagttaatggacgcggagcgcgggaagtcgggggcggggtttagttttttttttgtagtcgagtaacgtagtaggtttcgcggttttgcgttcgcgttcgttttattaggagcggtttgggattgggggagtatattttttaaatagaaggtttgtgaggtttaaggtgttcggtacgcgttgttgtttttgcgggagtttttttgttttttttaaga

SEQ ID NO: 20750 - DNA, 796 bp, Artificial Sequence
  chemically treated genomic DNA (Homo sapiens) CpG-island No: 20750
tcttaaaaaaaacaaaaaaactcccgcaaaaacaacaacgcgtaccgaacaccttaaacctcacaaaccttctatttaaaaaatatactcccccaatcccaaaccgctcctaataaaacgaacgcgaacgcaaaaccgcgaaacctactacgttactcgactacaaaaaaaaaactaaaccccgcccccgacttcccgcgctccgcgtccattaactaacctcgaaaataaacgaatcccgccgcacgaaatcctacgccttaaaactcaaacgacgacgtacaaaacgtataaaacgcgtaaaaaaccgcgcgcgccgtctacgataccccgaaacgacgttcctaccgaaaataccacccccgacgacaacccaaactaccgcgcaaaacccgaattccgcgactaccgaaacaccgcaaattttaaactcgctaaaacgataaactctacctttaccctatataccgcgctctcgcccgtactctaaaacaattaaccaataaataaacaaaaaaaaacgaaccgacaaaacgtcgcacgttaacgtccccgcgtcgcgaaaataaaattcgaattccccccgtaaatatcattccccaaactaccgatctttaacgctaaattacataaactaatataccaatcgatcaacgaataacgacaaaacgcctaaccgaaccgacgttttccgaaacactcgtttcgacctcgcaataacaacgcctcctacgaacctaaaccgactcaataaacgcgccgcgctatacacgcgaatctaaaaaaacgacgattc

SEQ ID NO: 20751 - DNA, 796 bp, Artificial Sequence
  chemically treated genomic DNA (Homo sapiens) CpG-island No: 20751
ttttaaaaaggatagaaagattttcgtaaaagtagtagcgcgtgtcgaatattttaggttttatagattttttatttgaggaatgtgtttttttaattttagatcgtttttggtggggcgggcgcgagcgtaggatcgcggagtttgttgcgttgttcggttgtaggggaggagttgggtttcgttttcggtttttcgcgtttcgcgtttattggttggtttcgggggtgggcgggtttcgtcgtacggagttttgcgttttgaggtttaagcggcggcgtgtaaggcgtgtgaggcgcgtagagagtcgcgcgcgtcgtttgcgatgtttcgggacggcgtttttgtcgggaatattattttcggcggtagtttaggttgtcgcgtagagttcggatttcgcgattgtcggggtatcgtaggttttggattcgttgaagcggtgagttttgtttttgttttatatgtcgcgttttcgttcgtgttttggggtagttggttagtgggtgggtaggaaggggcgggtcggtagggcgtcgtacgttggcgttttcgcgtcgcgggaatggggttcggatttttttcgtgaatgttattttttaggttatcggtttttagcgttaagttgtatgggttggtgtgttagtcggttagcgaatagcggtagaacgtttggtcgggtcggcgtttttcgggatattcgtttcggtttcgtagtggtagcgttttttgcgagtttagatcggtttagtggacgcgtcgcgttgtgtacgcgggtttggggagacggcggttt

SEQ ID NO: 20752 - DNA, 796 bp, Artificial Sequence
  chemically treated genomic DNA (Homo sapiens) CpG-island No: 20752
aaaccgccgtctccccaaacccgcgtacacaacgcgacgcgtccactaaaccgatctaaactcgcaaaaaacgctaccactacgaaaccgaaacgaatatcccgaaaaacgccgacccgaccaaacgttctaccgctattcgctaaccgactaacacaccaacccatacaacttaacgctaaaaaccgataacctaaaaaataacattcacgaaaaaaatccgaaccccattcccgcgacgcgaaaacgccaacgtacgacgccctaccgacccgccccttcctacccacccactaaccaactaccccaaaacacgaacgaaaacgcgacatataaaacaaaaacaaaactcaccgcttcaacgaatccaaaacctacgataccccgacaatcgcgaaatccgaactctacgcgacaacctaaactaccgccgaaaataatattcccgacaaaaacgccgtcccgaaacatcgcaaacgacgcgcgcgactctctacgcgcctcacacgccttacacgccgccgcttaaacctcaaaacgcaaaactccgtacgacgaaacccgcccacccccgaaaccaaccaataaacgcgaaacgcgaaaaaccgaaaacgaaacccaactcctcccctacaaccgaacaacgcaacaaactccgcgatcctacgctcgcgcccgccccaccaaaaacgatctaaaattaaaaaaacacattcctcaaataaaaaatctataaaacctaaaatattcgacacgcgctactacttttacgaaaatctttctatcctttttaaaa

SEQ ID NO: 20753 - DNA, 1207 bp, Artificial Sequence
  chemically treated genomic DNA (Homo sapiens) CpG-island No: 20753
tcggttttttttttttatataggcgtttttggtatagtcggagttttttacggtttcggtaggggaggacgtgtagtttttggtcgattcgttggattcggatcgcgattcggtgtgtagtaattttaatagtaataacggtaagaacggtaaggataaggagaaggagaagtagcgtaaggagaaggataagacgcgcgtcgatttcgtggttaataagttgggtagttttagtaagacgttgggtattaagttgaagaaaaatatgggcggtttcggcggtttggtgtacggtaagatgggtcgcgttaatttcgttaatggtaagaacggggattcggtcgagcggggtaaggagaagaaggttaagtcgcgtaagggtagtaaggaggagtttggtgcgtcggttagtacgtcgtcgtcggaaaagattacgtcgtcgtttatagataaggtagcgggcgcgtcgtcggcggagaagggcggtgggtcgcggggcgacgtttggaagtatagtacggatgtgaagttgagttttaatattttgcgcgtcgttatgtagggggagcgtaagtttattttcgtcggtttgttgtttattagttatcggtattagttttacgaggagatgatcggttattatttgacgagcgcgtaggagcgttttagcgtcgagtaggagtagcggcgtcgcgacgtcgttattgcggtcgtcgttgtcgtcgtcgtcgtcgtcgttacggttaagcggtcgtcgcgtagatcggagacggagggcgtgtcggtttcggagcgcgttttttcgggtttatttacgtagttggtgtttaagtttaaggagcggtcgagtttcgggttcgcggtagggcgtgcggcgcgggcggcggcgggcggtacggttttttcggggggaggcgcgcggcgtgcgagcgttagcggattagtgtttggtcgtagtttttcggcgttagcgcgttagagcgttatttacgtgtaggcgtcgggcgcgcgggacgaggcgtgcgcgtcggtcgtgggggcgttgcggtcgtgcgttacgtattcgtagtagaatcgttcgttgtcgtcgtagagttatagttcggcgcgcgtcgtcgttttgcgtatcgttaatacggtcgagtcgttggcgcgcgcggtgttcggggttttatcgggcgcggcggggatcgcgggggcggtcgag

SEQ ID NO: 20754 - DNA, 1207 bp, Artificial Sequence
  chemically treated genomic DNA (Homo sapiens) CpG-island No: 20754
ctcgaccgcccccgcgatccccgccgcgcccgataaaaccccgaacaccgcgcgcgccaacgactcgaccgtattaacgatacgcaaaacgacgacgcgcgccgaactataactctacgacgacaacgaacgattctactacgaatacgtaacgcacgaccgcaacgcccccacgaccgacgcgcacgcctcgtcccgcgcgcccgacgcctacacgtaaataacgctctaacgcgctaacgccgaaaaactacgaccaaacactaatccgctaacgctcgcacgccgcgcgcctccccccgaaaaaaccgtaccgcccgccgccgcccgcgccgcacgccctaccgcgaacccgaaactcgaccgctccttaaacttaaacaccaactacgtaaataaacccgaaaaaacgcgctccgaaaccgacacgccctccgtctccgatctacgcgacgaccgcttaaccgtaacgacgacgacgacgacgacaacgacgaccgcaataacgacgtcgcgacgccgctactcctactcgacgctaaaacgctcctacgcgctcgtcaaataataaccgatcatctcctcgtaaaactaataccgataactaataaacaacaaaccgacgaaaataaacttacgctccccctacataacgacgcgcaaaatattaaaactcaacttcacatccgtactatacttccaaacgtcgccccgcgacccaccgcccttctccgccgacgacgcgcccgctaccttatctataaacgacgacgtaatcttttccgacgacgacgtactaaccgacgcaccaaactcctccttactacccttacgcgacttaaccttcttctccttaccccgctcgaccgaatccccgttcttaccattaacgaaattaacgcgacccatcttaccgtacaccaaaccgccgaaaccgcccatatttttcttcaacttaatacccaacgtcttactaaaactacccaacttattaaccacgaaatcgacgcgcgtcttatccttctccttacgctacttctccttctccttatccttaccgttcttaccgttattactattaaaattactacacaccgaatcgcgatccgaatccaacgaatcgaccaaaaactacacgtcctcccctaccgaaaccgtaaaaaactccgactataccaaaaacgcctatataaaaaaaaaaaaccga

SEQ ID NO: 20755 - DNA, 1207 bp, Artificial Sequence
  chemically treated genomic DNA (Homo sapiens) CpG-island No: 20755
ttcggtcgttttcgcggttttcgtcgcgttcggtagggtttcgggtatcgcgcgcgttagcgattcgatcgtgttgacggtgcgtagggcggcggcgcgcgtcgggttgtagttttgcgacgatagcgagcggttttgttgcgggtacgtggcgtacggtcgtagcgtttttacggtcggcgcgtacgtttcgtttcgcgcgttcgacgtttgtacgtggatgacgttttggcgcgttggcgtcggggggttgcggttaggtattggttcgttggcgttcgtacgtcgcgcgttttttttcggggaggtcgtgtcgttcgtcgtcgttcgcgtcgtacgttttgtcgcgggttcggggttcggtcgttttttgagtttgagtattagttgcgtgggtgggttcggagaggcgcgtttcgggatcggtacgtttttcgttttcggtttgcgcggcggtcgtttggtcgtggcggcggcggcggcggcggtagcggcggtcgtagtagcggcgtcgcggcgtcgttgtttttgttcggcgttgaagcgtttttgcgcgttcgttaggtagtagtcgattattttttcgtggaattggtgtcggtggttggtgagtagtaggtcggcgaagatgaatttgcgttttttttgtatggcggcgcgtaggatgttgaggtttagttttatattcgtgttgtatttttaggcgtcgtttcgcggtttatcgttttttttcgtcggcgacgcgttcgttgttttgtttgtgggcgacggcgtggtttttttcgacggcgacgtgttggtcgacgtattagatttttttttgttgtttttgcgcgatttggtttttttttttttgtttcgttcggtcgagttttcgtttttgttattggcggagttggcgcggtttattttgtcgtgtattaggtcgtcgaggtcgtttatgtttttttttagtttgatgtttagcgttttgttgaagttgtttagtttgttggttacggagtcggcgcgcgttttgtttttttttttgcgttgtttttttttttttttgtttttgtcgtttttgtcgttattgttgttagaattgttgtatatcgaatcgcggttcgagtttagcgagtcggttagggattgtacgtttttttttgtcgaggtcgtgggagatttcggttgtgttaggggcgtttgtgtggagagggagggtcgg

SEQ ID NO: 20756 - DNA, 1207 bp, Artificial Sequence
  chemically treated genomic DNA (Homo sapiens) CpG-island No: 20756
ccgaccctccctctccacacaaacgcccctaacacaaccgaaatctcccacgacctcgacaaaaaaaaacgtacaatccctaaccgactcgctaaactcgaaccgcgattcgatatacaacaattctaacaacaataacgacaaaaacgacaaaaacaaaaaaaaaaaaaaacaacgcaaaaaaaaaaacaaaacgcgcgccgactccgtaaccaacaaactaaacaacttcaacaaaacgctaaacatcaaactaaaaaaaaacataaacgacctcgacgacctaatacacgacaaaataaaccgcgccaactccgccaataacaaaaacgaaaactcgaccgaacgaaacaaaaaaaaaaaaaccaaatcgcgcaaaaacaacaaaaaaaaatctaatacgtcgaccaacacgtcgccgtcgaaaaaaaccacgccgtcgcccacaaacaaaacaacgaacgcgtcgccgacgaaaaaaaacgataaaccgcgaaacgacgcctaaaaatacaacacgaatataaaactaaacctcaacatcctacgcgccgccatacaaaaaaaacgcaaattcatcttcgccgacctactactcaccaaccaccgacaccaattccacgaaaaaataatcgactactacctaacgaacgcgcaaaaacgcttcaacgccgaacaaaaacaacgacgccgcgacgccgctactacgaccgccgctaccgccgccgccgccgccgccacgaccaaacgaccgccgcgcaaaccgaaaacgaaaaacgtaccgatcccgaaacgcgcctctccgaacccacccacgcaactaatactcaaactcaaaaaacgaccgaaccccgaacccgcgacaaaacgtacgacgcgaacgacgacgaacgacacgacctccccgaaaaaaaacgcgcgacgtacgaacgccaacgaaccaatacctaaccgcaaccccccgacgccaacgcgccaaaacgtcatccacgtacaaacgtcgaacgcgcgaaacgaaacgtacgcgccgaccgtaaaaacgctacgaccgtacgccacgtacccgcaacaaaaccgctcgctatcgtcgcaaaactacaacccgacgcgcgccgccgccctacgcaccgtcaacacgatcgaatcgctaacgcgcgcgatacccgaaaccctaccgaacgcgacgaaaaccgcgaaaacgaccgaa

SEQ ID NO: 20757 - DNA, 593 bp, Artificial Sequence
  chemically treated genomic DNA (Homo sapiens) CpG-island No: 20757
aagcggcgtcgttttttcgtttttttttatttttcgttttttttcgtcgcgtatttttcgcggcgttgggagagggcggagggggaggcggcgcgcggcgttagaggaggggggacgtagggggcggagcggagatagtattttcggagataatttttttttttgtcgtagaggagaggagcggtcggagcgagatatttcgtcgaggtatagtagtcggtaggatggcgatcgtggtggtggaagttatcgagtcggagtcgttcggtagtatcgttaattcggcggcgtttatttcgtttagtttgtcgtatcgtttttttgatagtaagttttatttgttggtggtcgtcggcgagatcgtgatcgaggagtatttgcggcgtgttatcggtaatatcgagttcggtaagtggtttcgcgtttttagagacgcgcgttgggagacgcgtaaatacgattttatttagggcgcgacggttattgcgtttttttcgcgcgtttcgtatttatgttttttttcgttattttttatatttggtttagattttttttgggttaattaagaataattcgaattattagatatgaga

SEQ ID NO: 20758 - DNA, 593 bp, Artificial Sequence
  chemically treated genomic DNA (Homo sapiens) CpG-island No: 20758
tctcatatctaataattcgaattattcttaattaacccaaaaaaaatctaaaccaaatataaaaaataacgaaaaaaaacataaatacgaaacgcgcgaaaaaaacgcaataaccgtcgcgccctaaataaaatcgtatttacgcgtctcccaacgcgcgtctctaaaaacgcgaaaccacttaccgaactcgatattaccgataacacgccgcaaatactcctcgatcacgatctcgccgacgaccaccaacaaataaaacttactatcaaaaaaacgatacgacaaactaaacgaaataaacgccgccgaattaacgatactaccgaacgactccgactcgataacttccaccaccacgatcgccatcctaccgactactatacctcgacgaaatatctcgctccgaccgctcctctcctctacgacaaaaaaaaaaattatctccgaaaatactatctccgctccgccccctacgtcccccctcctctaacgccgcgcgccgcctccccctccgccctctcccaacgccgcgaaaaatacgcgacgaaaaaaaacgaaaaataaaaaaaaacgaaaaaacgacgccgctt

SEQ ID NO: 20759 - DNA, 593 bp, Artificial Sequence
  chemically treated genomic DNA (Homo sapiens) CpG-island No: 20759
ttttatatttaataattcggattatttttaattagtttagaaagggtttggattaagtatgagaggtgacgaggagaggtatgggtgcggggcgcgcgggaggagcgtagtgatcgtcgcgttttgggtggggtcgtgtttgcgcgttttttagcgcgcgtttttgggggcgcggggttatttatcgagttcgatgttgtcgatggtacgtcgtaggtgtttttcggttacgatttcgtcgacgattattagtaagtagaatttgttgttaaggaagcggtgcgataggttaggcgaggtggacgtcgtcgggttggcgatgttgtcggacggtttcggttcggtggtttttattattacggtcgttattttgtcggttgttgtgtttcggcgaagtgtttcgtttcggtcgttttttttttttgcggtaggagaaaggattattttcgaaggtgttgttttcgtttcgttttttgcgtttttttttttttggcgtcgcgcgtcgttttttttttcgtttttttttagcgtcgcggagagtgcgcggcggagaggagcggggagtgagagagggcggggaggcggcgtcgttt

SEQ ID NO: 20760 - DNA, 593 bp, Artificial Sequence
  chemically treated genomic DNA (Homo sapiens) CpG-island No: 20760
aaacgacgccgcctccccgccctctctcactccccgctcctctccgccgcgcactctccgcgacgctaaaaaaaaacgaaaaaaaaaacgacgcgcgacgccaaaaaaaaaaaaacgcaaaaaacgaaacgaaaacaacaccttcgaaaataatcctttctcctaccgcaaaaaaaaaaaacgaccgaaacgaaacacttcgccgaaacacaacaaccgacaaaataacgaccgtaataataaaaaccaccgaaccgaaaccgtccgacaacatcgccaacccgacgacgtccacctcgcctaacctatcgcaccgcttccttaacaacaaattctacttactaataatcgtcgacgaaatcgtaaccgaaaaacacctacgacgtaccatcgacaacatcgaactcgataaataaccccgcgcccccaaaaacgcgcgctaaaaaacgcgcaaacacgaccccacccaaaacgcgacgatcactacgctcctcccgcgcgccccgcacccatacctctcctcgtcacctctcatacttaatccaaaccctttctaaactaattaaaaataatccgaattattaaatataaaa

SEQ ID NO: 20761 - DNA, 644 bp, Artificial Sequence
  chemically treated genomic DNA (Homo sapiens) CpG-island No: 20761
cggtaatcgtttacgttcgggggttaggtttgttttcgttcgcgttgattggagggtagcgaaagcgtcgtttagcgattggtaggtggtgttataaaggggcggggcgcggcggtagcggagcgttgtcggttagtgtttttcgtgaagttgttcgtcgggtcgttgggttttgtcgatttgtaggcgggcgagcgagttagcggataagattgcgggtgaggttgagttagcgagcggtcggtagggggggcgttcgggttgcgagtcgttgagtttagtcgcgttgtcgtcgtcggtcgtcgtggggtcggaatggcgtaaggtcggagtggcgcgggcgttcggcgttgggttgtcgggtagagttttgttttcgtttttcgttttgcggtttgacgtcggtcgttgttgttcggggatcggagcggcgggtcgtttttgtttaggatatacgttttggcgtttgtttttttgggcgtgacgttagttttaacgggtacgcggttttttcgacgggtgttgattttcgagtcgttgttgttacgcggattgttgttttttagatttaggtcggtgggtttggggagttcggattggttttggaggagtaacggttgcgtaggtgattcggtggttttaag

SEQ ID NO: 20762 - DNA, 644 bp, Artificial Sequence
  chemically treated genomic DNA (Homo sapiens) CpG-island No: 20762
cttaaaaccaccgaatcacctacgcaaccgttactcctccaaaaccaatccgaactccccaaacccaccgacctaaatctaaaaaacaacaatccgcgtaacaacaacgactcgaaaatcaacacccgtcgaaaaaaccgcgtacccgttaaaactaacgtcacgcccaaaaaaacaaacgccaaaacgtatatcctaaacaaaaacgacccgccgctccgatccccgaacaacaacgaccgacgtcaaaccgcaaaacgaaaaacgaaaacaaaactctacccgacaacccaacgccgaacgcccgcgccactccgaccttacgccattccgaccccacgacgaccgacgacgacaacgcgactaaactcaacgactcgcaacccgaacgccccccctaccgaccgctcgctaactcaacctcacccgcaatcttatccgctaactcgctcgcccgcctacaaatcgacaaaacccaacgacccgacgaacaacttcacgaaaaacactaaccgacaacgctccgctaccgccgcgccccgcccctttataacaccacctaccaatcgctaaacgacgctttcgctaccctccaatcaacgcgaacgaaaacaaacctaacccccgaacgtaaacgattaccg

SEQ ID NO: 20763 - DNA, 644 bp, Artificial Sequence
  chemically treated genomic DNA (Homo sapiens) CpG-island No: 20763
tttgaggttatcgagttatttgcgtagtcgttgtttttttaagattaattcgggttttttagatttatcggtttgaatttggaggatagtagttcgcgtgataatagcgattcggagattagtattcgtcgggaaagtcgcgtattcgttgaagttggcgttacgtttaaaggaataaacgttagagcgtgtgttttgggtaaaggcggttcgtcgtttcggttttcgggtagtagcggtcggcgttaggtcgtaaggcgaggggcggggataggattttattcggtagtttagcgtcgagcgttcgcgttatttcggttttgcgttatttcggttttacgacggtcggcggcggtagcgcggttgggtttagcggttcgtagttcgggcgttttttttgtcggtcgttcgttagtttagttttattcgtagttttgttcgttggttcgttcgttcgtttataggtcgatagggtttaacgattcggcgagtaattttacggaaggtattggtcgataacgtttcgttgtcgtcgcgtttcgtttttttgtgatattatttattaatcgttggacggcgttttcgttgttttttaattagcgcgggcgggggtaggtttggttttcggacgtgggcggttgtcg

SEQ ID NO: 20764 - DNA, 644 bp, Artificial Sequence
  chemically treated genomic DNA (Homo sapiens) CpG-island No: 20764
cgacaaccgcccacgtccgaaaaccaaacctacccccgcccgcgctaattaaaaaacaacgaaaacgccgtccaacgattaataaataatatcacaaaaaaacgaaacgcgacgacaacgaaacgttatcgaccaataccttccgtaaaattactcgccgaatcgttaaaccctatcgacctataaacgaacgaacgaaccaacgaacaaaactacgaataaaactaaactaacgaacgaccgacaaaaaaaacgcccgaactacgaaccgctaaacccaaccgcgctaccgccgccgaccgtcgtaaaaccgaaataacgcaaaaccgaaataacgcgaacgctcgacgctaaactaccgaataaaatcctatccccgcccctcgccttacgacctaacgccgaccgctactacccgaaaaccgaaacgacgaaccgcctttacccaaaacacacgctctaacgtttattcctttaaacgtaacgccaacttcaacgaatacgcgactttcccgacgaatactaatctccgaatcgctattatcacgcgaactactatcctccaaattcaaaccgataaatctaaaaaacccgaattaatcttaaaaaaacaacgactacgcaaataactcgataacctcaaa

SEQ ID NO: 20765 - DNA, 565 bp, Artificial Sequence
  chemically treated genomic DNA (Homo sapiens) CpG-island No: 20765
tcggtcgcggtttatatttatttttttcgggtagataggcgcggtagtcgttgtttacggtcgcgagggtttagaggagttggtagaggttcgcggttcggagttttagggtgtagggcgggcgggtttttcgagagtgtcggggagcggagagcggggagcgttagttggcgtttcgggtaagtagttggggttacgcggggtagatggatcgattttagggcgcgcggggtagtcggagtgattttaggaagggcgtaggggtcgttgggacgatttcgggatgtgggagcgcgtgttaggggggattcgcgtgtaggcgatagcgagcgggattcgggtggttgtagggtcgggagtgcgggcgttcgatttaggaaggaggggagttgaggttgaagttggggttggtttaggttgagtagaagcgggcgggtaggggcggggttggtttggcgggcgtacggcgtggcgtttacgtggtcgtttttaggtggttattatagcgtttgtagtcgtttagcgggttttttggtttcggcgttggtttttagttttaggtgta

SEQ ID NO: 20766 - DNA, 565 bp, Artificial Sequence
  chemically treated genomic DNA (Homo sapiens) CpG-island No: 20766
tacacctaaaactaaaaaccaacgccgaaaccaaaaaacccgctaaacgactacaaacgctataataaccacctaaaaacgaccacgtaaacgccacgccgtacgcccgccaaaccaaccccgcccctacccgcccgcttctactcaacctaaaccaaccccaacttcaacctcaactcccctccttcctaaatcgaacgcccgcactcccgaccctacaaccacccgaatcccgctcgctatcgcctacacgcgaatcccccctaacacgcgctcccacatcccgaaatcgtcccaacgacccctacgcccttcctaaaatcactccgactaccccgcgcgccctaaaatcgatccatctaccccgcgtaaccccaactacttacccgaaacgccaactaacgctccccgctctccgctccccgacactctcgaaaaacccgcccgccctacaccctaaaactccgaaccgcgaacctctaccaactcctctaaaccctcgcgaccgtaaacaacgactaccgcgcctatctacccgaaaaaaataaatataaaccgcgaccga

SEQ ID NO: 20767 - DNA, 565 bp, Artificial Sequence
  chemically treated genomic DNA (Homo sapiens) CpG-island No: 20767
tgtatttggggttgggagttagcgtcggagttaggaggttcgttaggcggttgtaggcgttgtgatggttatttgggggcggttacgtgagcgttacgtcgtgcgttcgttaggttagtttcgtttttgttcgttcgtttttgtttaatttagattagttttagttttagttttagttttttttttttttggatcgagcgttcgtattttcggttttgtagttattcgagtttcgttcgttgtcgtttgtacgcgagttttttttggtacgcgtttttatatttcgggatcgttttaacggtttttgcgttttttttgggattatttcgattgtttcgcgcgttttgggatcggtttatttatttcgcgtggttttagttgtttgttcggagcgttagttagcgtttttcgtttttcgtttttcggtattttcggggggttcgttcgttttgtattttggagtttcgggtcgcgagtttttgttaatttttttggattttcgcggtcgtgggtagcggttgtcgcgtttgtttgttcgagggaggtaggtgtggatcgcggtcgg

SEQ ID NO: 20768 - DNA, 565 bp, Artificial Sequence
  chemically treated genomic DNA (Homo sapiens) CpG-island No: 20768
ccgaccgcgatccacacctacctccctcgaacaaacaaacgcgacaaccgctacccacgaccgcgaaaatccaaaaaaattaacaaaaactcgcgacccgaaactccaaaatacaaaacgaacgaaccccccgaaaataccgaaaaacgaaaaacgaaaaacgctaactaacgctccgaacaaacaactaaaaccacgcgaaataaataaaccgatcccaaaacgcgcgaaacaatcgaaataatcccaaaaaaaacgcaaaaaccgttaaaacgatcccgaaatataaaaacgcgtaccaaaaaaaactcgcgtacaaacgacaacgaacgaaactcgaataactacaaaaccgaaaatacgaacgctcgatccaaaaaaaaaaaaaactaaaactaaaactaaaactaatctaaattaaacaaaaacgaacgaacaaaaacgaaactaacctaacgaacgcacgacgtaacgctcacgtaaccgcccccaaataaccatcacaacgcctacaaccgcctaacgaacctcctaactccgacgctaactcccaaccccaaataca

SEQ ID NO: 20769 - DNA, 631 bp, Artificial Sequence
  chemically treated genomic DNA (Homo sapiens) CpG-island No: 20769
cggcgcgtagtttttgttttcggtgttagttttagtgcgtcgggtatacgcgcgtttcgtaattttttttttatttttttttcgttgtttaattttcgttagtcgcggtcgttgtatcgttagagagttgtaagagggaggtagtaaggtgcggtcgttagtagtgatattatgtgatcggtacggtttattgatacgtagttttggttaaagagcgggcgtataggaggggaggagatcgcgcgcgggacggggaggaatggtttgttcgcgttaaattattataagttatggttgcggaagggttacgcgttttttagtaggagaatgatttcgattcgtgatttttagcgtcggtgtatgtcgatgtaagtgcgaggtcggcgagtagagtgtgagtgggggttggtggtgaggggagattttgatgtaatcggttcggaaaggaggagagttaggcgagcgcggattggggcggttacgttatttcgttagaaggtcgttaggagttttcgttttttattttttttcgaaattcgttaggttacgttaagttttttgtttaatttttattgacgggggttatattttttcggttttcgtagttagattttgatataaaggatattaa

SEQ ID NO: 20770 - DNA, 631 bp, Artificial Sequence
  chemically treated genomic DNA (Homo sapiens) CpG-island No: 20770
ttaatatcctttatatcaaaatctaactacgaaaaccgaaaaaatataacccccgtcaataaaaattaaacaaaaaacttaacgtaacctaacgaatttcgaaaaaaaataaaaaacgaaaactcctaacgaccttctaacgaaataacgtaaccgccccaatccgcgctcgcctaactctcctcctttccgaaccgattacatcaaaatctcccctcaccaccaacccccactcacactctactcgccgacctcgcacttacatcgacatacaccgacgctaaaaatcacgaatcgaaatcattctcctactaaaaaacgcgtaacccttccgcaaccataacttataataatttaacgcgaacaaaccattcctccccgtcccgcgcgcgatctcctcccctcctatacgcccgctctttaaccaaaactacgtatcaataaaccgtaccgatcacataatatcactactaacgaccgcaccttactacctccctcttacaactctctaacgatacaacgaccgcgactaacgaaaattaaacaacgaaaaaaaaataaaaaaaaaattacgaaacgcgcgtatacccgacgcactaaaactaacaccgaaaacaaaaactacgcgccg

SEQ ID NO: 20771 - DNA, 631 bp, Artificial Sequence
  chemically treated genomic DNA (Homo sapiens) CpG-island No: 20771
ttgatgttttttgtgttaaggtttggttgcggaggtcgggaaaatgtggttttcgttagtaagggttgggtagggagtttggcgtggtttggcggatttcggaggaaggtgaagggcggaggtttttggcgattttttggcggagtggcgtggtcgttttagttcgcgttcgtttggtttttttttttttcgggtcgattgtattagaatttttttttattattaatttttatttatattttgttcgtcggtttcgtatttatatcgatatgtatcggcgttgagggttacgaatcggagttatttttttattgggggacgcgtggttttttcgtaattatggtttgtgatggtttaacgcggataggttattttttttcgtttcgcgcgcggttttttttttttttgtgcgttcgttttttaattaaagttgcgtgttagtgagtcgtgtcggttatatggtgttattgttggcggtcgtattttgttgttttttttttgtagttttttgacgatgtagcgatcgcggttggcggagattgagtaacggggaaagggtgagggaggggttgcggggcgcgcgtgtgttcggcgtattgaagttggtatcgggagtagaggttgcgcgtcg

SEQ ID NO: 20772 - DNA, 631 bp, Artificial Sequence
  chemically treated genomic DNA (Homo sapiens) CpG-island No: 20772
cgacgcgcaacctctactcccgataccaacttcaatacgccgaacacacgcgcgccccgcaacccctccctcaccctttccccgttactcaatctccgccaaccgcgatcgctacatcgtcaaaaaactacaaaaaaaaaacaacaaaatacgaccgccaacaataacaccatataaccgacacgactcactaacacgcaactttaattaaaaaacgaacgcacaaaaaaaaaaaaaaccgcgcgcgaaacgaaaaaaaataacctatccgcgttaaaccatcacaaaccataattacgaaaaaaccacgcgtcccccaataaaaaaataactccgattcgtaaccctcaacgccgatacatatcgatataaatacgaaaccgacgaacaaaatataaataaaaattaataataaaaaaaaattctaatacaatcgacccgaaaaaaaaaaaaaccaaacgaacgcgaactaaaacgaccacgccactccgccaaaaaatcgccaaaaacctccgcccttcaccttcctccgaaatccgccaaaccacgccaaactccctacccaacccttactaacgaaaaccacattttcccgacctccgcaaccaaaccttaacacaaaaaacatcaa

SEQ ID NO: 20773 - DNA, 768 bp, Artificial Sequence
  chemically treated genomic DNA (Homo sapiens) CpG-island No: 20773
tacggttcgattcgttcgaattttttttcggggttagcgtcgcgttgcgtcgttcggttgatttagttcgggcgggcgggcgggaggttttcgattgggcgggaaggtgcgggaaggttcgcggcggcggggtcggggaggtgtaaaaggatgaaaagttcgtggaagcggagttgagtagattcgagtcgggttggcggtagagaaatcgtagggagagttttattgttgagcgtttttcgacggcggagcggtagtagttttcgtggtttttagtattcgataagaagttttagttatgtaggttttacgggagttcgcggtgggtatcgatttgggtattatttattcgtgcgtgggcgtgttttagtagggtcgcgtggagattttggttaacgattagggtaatcggtattacgtttagttacgtggtttttatcgatatcgagcggttggtcggggacgcggttaagagttaggcggttttgaatttttataatatcgtgttcgatgttaagcggttgatcgggcgtaagttcgcggatattacggtgtagtcggatatgaagtattggtttttttaggtggtgagcgagggcggtaagtttaaggtgcgcgtatgttatcgcggggaggataagacgttttatttcgaggagatttcgtttatggtgttgagtaagatgaaagagacggcgcgagcgtattttggttaattcgtgaagtacgtattgattatcgggtttatttatgttaggtatttgtaat

SEQ ID NO: 20774 - DNA, 768 bp, Artificial Sequence
  chemically treated genomic DNA (Homo sapiens) CpG-island No: 20774
attacaaatacctaacataaataaacccgataatcaatacgtacttcacgaattaaccaaaatacgctcgcgccgtctctttcatcttactcaacaccataaacgaaatctcctcgaaataaaacgtcttatcctccccgcgataacatacgcgcaccttaaacttaccgccctcgctcaccacctaaaaaaaccaatacttcatatccgactacaccgtaatatccgcgaacttacgcccgatcaaccgcttaacatcgaacacgatattataaaaattcaaaaccgcctaactcttaaccgcgtccccgaccaaccgctcgatatcgataaaaaccacgtaactaaacgtaataccgattaccctaatcgttaaccaaaatctccacgcgaccctactaaaacacgcccacgcacgaataaataatacccaaatcgatacccaccgcgaactcccgtaaaacctacataactaaaacttcttatcgaatactaaaaaccacgaaaactactaccgctccgccgtcgaaaaacgctcaacaataaaactctccctacgatttctctaccgccaacccgactcgaatctactcaactccgcttccacgaacttttcatccttttacacctccccgaccccgccgccgcgaaccttcccgcaccttcccgcccaatcgaaaacctcccgcccgcccgcccgaactaaatcaaccgaacgacgcaacgcgacgctaaccccgaaaaaaaattcgaacgaatcgaaccgta

SEQ ID NO: 20775 - DNA, 768 bp, Artificial Sequence
  chemically treated genomic DNA (Homo sapiens) CpG-island No: 20775
gttgtaagtatttgatataggtgggttcggtgattaatgcgtgttttacgggttggttagggtacgttcgcgtcgttttttttattttgtttagtattatggacgagattttttcggggtagaacgttttgtttttttcgcggtagtatacgcgtattttgggtttgtcgttttcgtttattatttggaagggttagtgttttatgttcgattgtatcgtggtgttcgcgaatttgcgttcgattagtcgtttggtatcgaatacggtgttgtgggggtttagggtcgtttggtttttggtcgcgttttcgattagtcgttcggtgtcggtgaaggttacgtagttgggcgtggtgtcggttgttttggtcgttggttaggatttttacgcggttttgttgaaatacgtttacgtacgagtaggtggtgtttaggtcgatgtttatcgcgagttttcgtggggtttgtatggttgaagttttttgtcggatgttggaggttacggaggttgttgtcgtttcgtcgtcgaggggcgtttagtagtgaggttttttttgcggtttttttgtcgttagttcggttcggatttgtttagtttcgtttttacgggttttttatttttttgtattttttcgatttcgtcgtcgcgaattttttcgtattttttcgtttagtcgagagtttttcgttcgttcgttcgggttgagttagtcgggcggcgtagcgcggcgttgatttcgggagaaggttcgggcggatcgggtcgtg

SEQ ID NO: 20776 - DNA, 768 bp, Artificial Sequence
  chemically treated genomic DNA (Homo sapiens) CpG-island No: 20776
cacgacccgatccgcccgaaccttctcccgaaatcaacgccgcgctacgccgcccgactaactcaacccgaacgaacgaacgaaaaactctcgactaaacgaaaaaatacgaaaaaattcgcgacgacgaaatcgaaaaaatacaaaaaaataaaaaacccgtaaaaacgaaactaaacaaatccgaaccgaactaacgacaaaaaaaccgcaaaaaaaacctcactactaaacgcccctcgacgacgaaacgacaacaacctccgtaacctccaacatccgacaaaaaacttcaaccatacaaaccccacgaaaactcgcgataaacatcgacctaaacaccacctactcgtacgtaaacgtatttcaacaaaaccgcgtaaaaatcctaaccaacgaccaaaacaaccgacaccacgcccaactacgtaaccttcaccgacaccgaacgactaatcgaaaacgcgaccaaaaaccaaacgaccctaaacccccacaacaccgtattcgataccaaacgactaatcgaacgcaaattcgcgaacaccacgatacaatcgaacataaaacactaacccttccaaataataaacgaaaacgacaaacccaaaatacgcgtatactaccgcgaaaaaaacaaaacgttctaccccgaaaaaatctcgtccataatactaaacaaaataaaaaaaacgacgcgaacgtaccctaaccaacccgtaaaacacgcattaatcaccgaacccacctatatcaaatacttacaac

SEQ ID NO: 20777 - DNA, 650 bp, Artificial Sequence
  chemically treated genomic DNA (Homo sapiens) CpG-island No: 20777
agtgtgcgtttttagatcggagtaattatcggtgtcgttcgaattttagtaatcgtgtttaagggtgacgttaagattttgttggcgatagaggttcgtcgtatcgttgcgtacgttacgttttagttagttattttttttgtcgttacgggttagtcgggtaaaggtgtcgttattttgcggacgcgtcgtagttatatcggatgcgattatggcgtttttgtaggtttttagcgtttgcgttggatcgttcgtttgcgttttaaatttcgtattattacgtagtattatcgcgttttttatcgacggtggttgagattttgtttgcgggattaatttattaaacgttcgttgcgttgttgcggtatcgttaagttgcgtttgtgttagcgttacgcgtcgttgtgtgtttagcgaggcgttatcggtagcgggtagtttcgttagttggttacgtgtcgtcgttttgttatcggtagtaatatttattttcgttagattaagaatggcgtcggcgttagttggttttcgcgttaggatattttgatatgtagcgcgggcggcggtgtaattacgtcgttgttgcgtttagttagttagcgtgaggttaatacgcgtggaaggtggttgttggcgtagtatcgttttcg

SEQ ID NO: 20778 - DNA, 650 bp, Artificial Sequence
  chemically treated genomic DNA (Homo sapiens) CpG-island No: 20778
cgaaaacgatactacgccaacaaccaccttccacgcgtattaacctcacgctaactaactaaacgcaacaacgacgtaattacaccgccgcccgcgctacatatcaaaatatcctaacgcgaaaaccaactaacgccgacgccattcttaatctaacgaaaataaatattactaccgataacaaaacgacgacacgtaaccaactaacgaaactacccgctaccgataacgcctcgctaaacacacaacgacgcgtaacgctaacacaaacgcaacttaacgataccgcaacaacgcaacgaacgtttaataaattaatcccgcaaacaaaatctcaaccaccgtcgataaaaaacgcgataatactacgtaataatacgaaatttaaaacgcaaacgaacgatccaacgcaaacgctaaaaacctacaaaaacgccataatcgcatccgatataactacgacgcgtccgcaaaataacgacacctttacccgactaacccgtaacgacaaaaaaaataactaactaaaacgtaacgtacgcaacgatacgacgaacctctatcgccaacaaaatcttaacgtcacccttaaacacgattactaaaattcgaacgacaccgataattactccgatctaaaaacgcacact

SEQ ID NO: 20779 - DNA, 650 bp, Artificial Sequence
  chemically treated genomic DNA (Homo sapiens) CpG-island No: 20779
cgaaagcgatgttgcgttagtaattattttttacgcgtattgattttacgttggttgattgggcgtaataacgacgtgattatatcgtcgttcgcgttgtatattagaatgttttgacgcgggagttagttaacgtcgacgttatttttggtttgacggaagtggatattgttgtcggtgataaagcggcggtacgtagttagttggcgaaattgttcgttatcgataacgtttcgttgaatatatagcggcgcgtggcgttggtataggcgtagtttggcgatatcgtagtagcgtagcggacgtttaataagttgatttcgtaggtaaaattttagttatcgtcgatggaaagcgcgatggtgttgcgtgatggtgcgaagtttgaagcgtaggcgggcgatttaacgtaggcgttggaaatttataaagacgttatggtcgtattcggtgtgattacgacgcgttcgtaggataacgatatttttattcgattgattcgtaacgataagaaagatgattggttgaaacgtggcgtgcgtagcgatgcggcggatttttatcgttagtaggattttaacgttatttttgagtacgattattggggttcgagcggtatcggtggttatttcgatttgaaagcgtatatt

SEQ ID NO: 20780 - DNA, 650 bp, Artificial Sequence
  chemically treated genomic DNA (Homo sapiens) CpG-island No: 20780
aatatacgctttcaaatcgaaataaccaccgataccgctcgaaccccaataatcgtactcaaaaataacgttaaaatcctactaacgataaaaatccgccgcatcgctacgcacgccacgtttcaaccaatcatctttcttatcgttacgaatcaatcgaataaaaatatcgttatcctacgaacgcgtcgtaatcacaccgaatacgaccataacgtctttataaatttccaacgcctacgttaaatcgcccgcctacgcttcaaacttcgcaccatcacgcaacaccatcgcgctttccatcgacgataactaaaattttacctacgaaatcaacttattaaacgtccgctacgctactacgatatcgccaaactacgcctataccaacgccacgcgccgctatatattcaacgaaacgttatcgataacgaacaatttcgccaactaactacgtaccgccgctttatcaccgacaacaatatccacttccgtcaaaccaaaaataacgtcgacgttaactaactcccgcgtcaaaacattctaatatacaacgcgaacgacgatataatcacgtcgttattacgcccaatcaaccaacgtaaaatcaatacgcgtaaaaaataattactaacgcaacatcgctttcg

SEQ ID NO: 20781 - DNA, 645 bp, Artificial Sequence
  chemically treated genomic DNA (Homo sapiens) CpG-island No: 20781
cggagtagagtagcgcggtgttaaaatcgttgttcgttgtgtcgtttattattaggttgtgcgtttttttcgggttgttttgtgaagaggttgggttgagttgattttttacgttcgtttcgatattaaagttttgcggaatggtacgggtaataaagtttattacgtcgtttacgttttgcggttcgtaacgtatcgtattattatcgcgtattacgttaatggtatttatgttgtcgagcgaaacgggagttagtgaaagttgcggttgatcgtaaggggcgaaggggacggggatgtcgtttattaggacggtcgagcggttggcgaggcgcgggtttaggtttcggatgttaaagtttatcgttaggtcgtggttgtcggtgtcgttgtttttcggcgcgttgacgttagggatgcggttaagtattttacgtatggtggttgcgtcggttttggcgaaatttttacggcggattacgttacgcgcgttagtatgtttaatacgtcgtttttacgcgtattatttagttagtcgtcgattacggttagggtatttttttttttggtgcgggcgcgggttttagcgtttagttgttatttttttagcggttttattttggcgtcgttgtcgtttagcggttg

SEQ ID NO: 20782 - DNA, 645 bp, Artificial Sequence
  chemically treated genomic DNA (Homo sapiens) CpG-island No: 20782
caaccgctaaacgacaacgacgccaaaataaaaccgctaaaaaaataacaactaaacgctaaaacccgcgcccgcaccaaaaaaaaaaataccctaaccgtaatcgacgactaactaaataatacgcgtaaaaacgacgtattaaacatactaacgcgcgtaacgtaatccgccgtaaaaatttcgccaaaaccgacgcaaccaccatacgtaaaatacttaaccgcatccctaacgtcaacgcgccgaaaaacaacgacaccgacaaccacgacctaacgataaactttaacatccgaaacctaaacccgcgcctcgccaaccgctcgaccgtcctaataaacgacatccccgtccccttcgccccttacgatcaaccgcaactttcactaactcccgtttcgctcgacaacataaataccattaacgtaatacgcgataataatacgatacgttacgaaccgcaaaacgtaaacgacgtaataaactttattacccgtaccattccgcaaaactttaatatcgaaacgaacgtaaaaaatcaactcaacccaacctcttcacaaaacaacccgaaaaaaacgcacaacctaataataaacgacacaacgaacaacgattttaacaccgcgctactctactccg

SEQ ID NO: 20783 - DNA, 645 bp, Artificial Sequence
  chemically treated genomic DNA (Homo sapiens) CpG-island No: 20783
taatcgttggacggtagcgacgttaaggtaaaatcgttggggaaataatagttggacgttggagttcgcgttcgtattaaaaaagaagatgttttgatcgtggtcggcgattggttgggtgatgcgcgtgaaaacgacgtattgaatatgttggcgcgcgtgacgtgattcgtcgtgaggatttcgttaaaatcggcgtaattattatgcgtgaggtatttaatcgtatttttggcgttagcgcgtcggaaaataacggtatcggtagttacgatttggcgatgaattttggtattcggggtttgaattcgcgtttcgttagtcgttcgatcgttttgatggacggtattttcgtttttttcgttttttacggttagtcgtagtttttattggttttcgtttcgttcggtaatatggatgttattgacgtggtacgcggtggtggtgcggtgcgttacggatcgtagagcgtgggcggcgtggtgaattttgttattcgtgttatttcgtaggattttggtatcgaggcgggcgtggaaggttagtttagtttaatttttttataaaataattcgaaagagacgtataatttgatggtgggcggtatagcggataacggttttggtatcgcgttgttttatttcg

SEQ ID NO: 20784 - DNA, 645 bp, Artificial Sequence
  chemically treated genomic DNA (Homo sapiens) CpG-island No: 20784
cgaaataaaacaacgcgataccaaaaccgttatccgctataccgcccaccatcaaattatacgtctctttcgaattattttataaaaaaattaaactaaactaaccttccacgcccgcctcgataccaaaatcctacgaaataacacgaataacaaaattcaccacgccgcccacgctctacgatccgtaacgcaccgcaccaccaccgcgtaccacgtcaataacatccatattaccgaacgaaacgaaaaccaataaaaactacgactaaccgtaaaaaacgaaaaaaacgaaaataccgtccatcaaaacgatcgaacgactaacgaaacgcgaattcaaaccccgaataccaaaattcatcgccaaatcgtaactaccgataccgttattttccgacgcgctaacgccaaaaatacgattaaatacctcacgcataataattacgccgattttaacgaaatcctcacgacgaatcacgtcacgcgcgccaacatattcaatacgtcgttttcacgcgcatcacccaaccaatcgccgaccacgatcaaaacatcttcttttttaatacgaacgcgaactccaacgtccaactattatttccccaacgattttaccttaacgtcgctaccgtccaacgatta

SEQ ID NO: 20785 - DNA, 635 bp, Artificial Sequence
  chemically treated genomic DNA (Homo sapiens) CpG-island No: 20785
agacgcgttagcgtcgtattaggtaatcggttcgggcgttagatgttggatgcggcgtaatcgttttatttaatttacggggtggagtattttatagcggtgtaggtttgataagacgcgttagcgtcgtattaggtaatcggtttgggcgttagatgtcggatgcggcgtaatcgttttattcgatttacggggtggagtattttatagcggtgtaggtttgataagacgcgttagcgtcgtattaggtaatcggttcggacgttggatgtcggatgcggcgtaatcgttttatttaatttacggggtggagtattttatagcggtgtaggtttgataagacgcgttagcgtcgtattaggtaatcggtttgggcgttagatgtcggatgcggcgtaatcgttttattcgatttacggggtggagtattttatagcggtgtaggtttgataagacgcgttagcgtcgtattaggtaatcggttcgggcgttggatgtcggatgcggcgtgatcgttttgtttgatttacggggtgtcgtattatatagcggtgtaggtttgataagacgcgttagcgtcgtattaggtaatcggttcgggcgtgggatgtcggatgcggcgggatcgttttgtt

SEQ ID NO: 20786 - DNA, 635 bp, Artificial Sequence
  chemically treated genomic DNA (Homo sapiens) CpG-island No: 20786
aacaaaacgatcccgccgcatccgacatcccacgcccgaaccgattacctaatacgacgctaacgcgtcttatcaaacctacaccgctatataatacgacaccccgtaaatcaaacaaaacgatcacgccgcatccgacatccaacgcccgaaccgattacctaatacgacgctaacgcgtcttatcaaacctacaccgctataaaatactccaccccgtaaatcgaataaaacgattacgccgcatccgacatctaacgcccaaaccgattacctaatacgacgctaacgcgtcttatcaaacctacaccgctataaaatactccaccccgtaaattaaataaaacgattacgccgcatccgacatccaacgtccgaaccgattacctaatacgacgctaacgcgtcttatcaaacctacaccgctataaaatactccaccccgtaaatcgaataaaacgattacgccgcatccgacatctaacgcccaaaccgattacctaatacgacgctaacgcgtcttatcaaacctacaccgctataaaatactccaccccgtaaattaaataaaacgattacgccgcatccaacatctaacgcccgaaccgattacctaatacgacgctaacgcgtct

SEQ ID NO: 20787 - DNA, 635 bp, Artificial Sequence
  chemically treated genomic DNA (Homo sapiens) CpG-island No: 20787
gataaggcggtttcgtcgtattcgatattttacgttcgagtcggttgtttgatgcgacgttggcgcgttttattaggtttatatcgttgtgtagtgcggtatttcgtaggttagataaggcggttacgtcgtattcgatatttaacgttcgagtcggttgtttgatgcgacgttggcgcgttttattaggtttatatcgttgtgaagtgttttatttcgtaggtcggataaggcggttacgtcgtattcgatatttaacgtttaagtcggttgtttgatgcgacgttggcgcgttttattaggtttatatcgttgtgaagtgttttatttcgtaggttggataaggcggttacgtcgtattcgatatttaacgttcgagtcggttgtttgatgcgacgttggcgcgttttattaggtttatatcgttgtgaagtgttttatttcgtaggtcggataaggcggttacgtcgtattcgatatttaacgtttaagtcggttgtttgatgcgacgttggcgcgttttattaggtttatatcgttgtgaagtgttttatttcgtaggttggataaggcggttacgtcgtatttaatatttaacgttcgagtcggttgtttgatgcgacgttggcgcgttt

SEQ ID NO: 20788 - DNA, 635 bp, Artificial Sequence
  chemically treated genomic DNA (Homo sapiens) CpG-island No: 20788
aaacgcgccaacgtcgcatcaaacaaccgactcgaacgttaaatattaaatacgacgtaaccgccttatccaacctacgaaataaaacacttcacaacgatataaacctaataaaacgcgccaacgtcgcatcaaacaaccgacttaaacgttaaatatcgaatacgacgtaaccgccttatccgacctacgaaataaaacacttcacaacgatataaacctaataaaacgcgccaacgtcgcatcaaacaaccgactcgaacgttaaatatcgaatacgacgtaaccgccttatccaacctacgaaataaaacacttcacaacgatataaacctaataaaacgcgccaacgtcgcatcaaacaaccgacttaaacgttaaatatcgaatacgacgtaaccgccttatccgacctacgaaataaaacacttcacaacgatataaacctaataaaacgcgccaacgtcgcatcaaacaaccgactcgaacgttaaatatcgaatacgacgtaaccgccttatctaacctacgaaataccgcactacacaacgatataaacctaataaaacgcgccaacgtcgcatcaaacaaccgactcgaacgtaaaatatcgaatacgacgaaaccgccttatc

SEQ ID NO: 20789 - DNA, 1234 bp, Artificial Sequence
  chemically treated genomic DNA (Homo sapiens) CpG-island No: 20789
gagtattacggcgcgcggagttcggcggttttttcgaaaggttgtttttcgtagattcgtttcgtatagttttcggtcggcgggtttggttttcgagggttcgcgggaacggttttttttttttcgattttttttgatcgcgtttttagaggtcgttttttcgcgtttagagttttttcgtttttttttcggttcgttcgtcgcgtcgcgtttttagagattcgtttcggggcgggaaaggggttttttcgcgtttcggcggtagagggggacgtaggggtcggcggcggtgttcgatttttttttgtttcgcggttaggcgcgtatttattttttagtagtcgggtgatgaggttgtttacgtttagtttttcgttcgttattttgtcggtatagatttttttttttagtagcgggaataagggtttttcggcggcggaggttgcggcgacggttcggcgtttttttatttataagttacgcggcgtttcgatttcggttttaatttttttttttttcgggttttttttttatttttttttcgtcgggtagcgagagcgcgcgtatattcggaggtatttacggaaaataaataaataaataagagaggttttttcgaatagggtcgcgttagatttaggtcgttattttttttttttcggtatcgtttagtttcgtaaagtttattagcgtcgtcgacggttttattcgtagcgttatttatttcgtacgttttttgcgcgtcgtcgcgttacgtagtttttcgcgtaggcgcgcggtgcgtttttcgtcgaggtttttttcgacgtttgggtcgtcgcgtaatcgtattggagcggtttttttcgttgtcgttttcgcgtaggtgcgtcgttttttttttacgtttacggcgtcgagtttcgtcgcggtggcgtaggcgttagggaggtttttcggttttgtcgcgcggaggaagtttcggttacgtagagcgcgttggggtagggttgatttttttttttttttattttattggttttttttagacgtggtggttgcgttttttcggtttcgtttttcgttttttggttttattttttagatttgtaaatagtttttcgtgtttttttcgttagtcgggaaacgcgaattgtagcgtttgggattcgggtttgcgcgtgtggaaagtaaaaggggttattttgttggagttcgatattgtaaataaaggtttttattttcggcggtttta

SEQ ID NO: 20790 - DNA, 1234 bp, Artificial Sequence
  chemically treated genomic DNA (Homo sapiens) CpG-island No: 20790
taaaaccgccgaaaataaaaacctttatttacaatatcgaactccaacaaaataaccccttttactttccacacgcgcaaacccgaatcccaaacgctacaattcgcgtttcccgactaacgaaaaaaacacgaaaaactatttacaaatctaaaaaataaaaccaaaaaacgaaaaacgaaaccgaaaaaacgcaaccaccacgtctaaaaaaaaccaataaaataaaaaaaaaaaaaaatcaaccctaccccaacgcgctctacgtaaccgaaacttcctccgcgcgacaaaaccgaaaaacctccctaacgcctacgccaccgcgacgaaactcgacgccgtaaacgtaaaaaaaaaacgacgcacctacgcgaaaacgacaacgaaaaaaaccgctccaatacgattacgcgacgacccaaacgtcgaaaaaaacctcgacgaaaaacgcaccgcgcgcctacgcgaaaaactacgtaacgcgacgacgcgcaaaaaacgtacgaaataaataacgctacgaataaaaccgtcgacgacgctaataaactttacgaaactaaacgataccgaaaaaaaaaaaataacgacctaaatctaacgcgaccctattcgaaaaaacctctcttatttatttatttattttccgtaaatacctccgaatatacgcgcgctctcgctacccgacgaaaaaaaaataaaaaaaaaacccgaaaaaaaaaaaaattaaaaccgaaatcgaaacgccgcgtaacttataaataaaaaaacgccgaaccgtcgccgcaacctccgccgccgaaaaacccttattcccgctactaaaaaaaaaaatctataccgacaaaataacgaacgaaaaactaaacgtaaacaacctcatcacccgactactaaaaaataaatacgcgcctaaccgcgaaacaaaaaaaaatcgaacaccgccgccgacccctacgtccccctctaccgccgaaacgcgaaaaaacccctttcccgccccgaaacgaatctctaaaaacgcgacgcgacgaacgaaccgaaaaaaaaacgaaaaaactctaaacgcgaaaaaacgacctctaaaaacgcgatcaaaaaaaatcgaaaaaaaaaaaaccgttcccgcgaaccctcgaaaaccaaacccgccgaccgaaaactatacgaaacgaatctacgaaaaacaacctttcgaaaaaaccgccgaactccgcgcgccgtaatactc

SEQ ID NO: 20791 - DNA, 1234 bp, Artificial Sequence
  chemically treated genomic DNA (Homo sapiens) CpG-island No: 20791
tagaatcgtcggggataaagatttttatttgtaatgtcgaattttagtagagtaattttttttgttttttatacgcgtaaattcgggttttaaacgttgtagttcgcgtttttcggttaacggaagaaatacgaggaattgtttgtagatttaggggatgaagttaaaaaacggaaagcgaggtcgaaagggcgtaattattacgtttggaggaggttagtgaagtagagaaaggggaaggttagttttgttttagcgcgttttgcgtaatcgggatttttttcgcgcggtaaagtcggggaatttttttggcgtttgcgttatcgcggcgagattcggcgtcgtggacgtggagagagggcgacgtatttgcgcgaagacggtagcgggagaagtcgttttagtgcggttgcgcggcggtttaggcgtcgaggggagtttcggcggggagcgtatcgcgcgtttgcgcggagagttgcgtgacgcggcggcgcgtaagggacgtgcggagtgagtggcgttgcgggtggggtcgtcggcggcgttggtgagttttgcggagttgggcggtgtcgaggaggaggaggtggcggtttgggtttgacgcggttttgttcgagggggttttttttgtttatttatttatttttcgtgggtgttttcgagtgtgcgcgcgttttcgttattcggcggggagggggtggggggagggttcgggaaaagggggagttggagtcggggtcgaaacgtcgcgtgatttgtaggtgagagaacgtcgagtcgtcgtcgtagttttcgtcgtcgagaagtttttgttttcgttgttgggaaggagagtttgtgtcgataagatggcggacggggagttgaacgtggatagttttattattcggttgttggagggtgagtgcgcgtttggtcgcgggatagagggaggtcgggtatcgtcgtcgatttttgcgtttttttttgtcgtcggaacgcgaggggatttttttttcgtttcgagacgagtttttgggagcgcggcgcggcggacgaatcgaggagggggcgaggaggttttgggcgcgggggagcggtttttgggagcgcggttaggggagatcgggggagagggggtcgttttcgcggattttcgggggttaggttcgtcggtcgaaggttgtgcggagcgggtttgcgggagatagtttttcggaaaggtcgtcgggtttcgcgcgtcgtggtgttt

SEQ ID NO: 20792 - DNA, 1234 bp, Artificial Sequence
  chemically treated genomic DNA (Homo sapiens) CpG-island No: 20792
aaacaccacgacgcgcgaaacccgacgacctttccgaaaaactatctcccgcaaacccgctccgcacaaccttcgaccgacgaacctaacccccgaaaatccgcgaaaacgaccccctctcccccgatctcccctaaccgcgctcccaaaaaccgctcccccgcgcccaaaacctcctcgccccctcctcgattcgtccgccgcgccgcgctcccaaaaactcgtctcgaaacgaaaaaaaaatcccctcgcgttccgacgacaaaaaaaaacgcaaaaatcgacgacgatacccgacctccctctatcccgcgaccaaacgcgcactcaccctccaacaaccgaataataaaactatccacgttcaactccccgtccgccatcttatcgacacaaactctccttcccaacaacgaaaacaaaaacttctcgacgacgaaaactacgacgacgactcgacgttctctcacctacaaatcacgcgacgtttcgaccccgactccaactcccccttttcccgaaccctccccccaccccctccccgccgaataacgaaaacgcgcgcacactcgaaaacacccacgaaaaataaataaataaacaaaaaaaaccccctcgaacaaaaccgcgtcaaacccaaaccgccacctcctcctcctcgacaccgcccaactccgcaaaactcaccaacgccgccgacgaccccacccgcaacgccactcactccgcacgtcccttacgcgccgccgcgtcacgcaactctccgcgcaaacgcgcgatacgctccccgccgaaactcccctcgacgcctaaaccgccgcgcaaccgcactaaaacgacttctcccgctaccgtcttcgcgcaaatacgtcgccctctctccacgtccacgacgccgaatctcgccgcgataacgcaaacgccaaaaaaattccccgactttaccgcgcgaaaaaaatcccgattacgcaaaacgcgctaaaacaaaactaaccttcccctttctctacttcactaacctcctccaaacgtaataattacgccctttcgacctcgctttccgttttttaacttcatcccctaaatctacaaacaattcctcgtatttcttccgttaaccgaaaaacgcgaactacaacgtttaaaacccgaatttacgcgtataaaaaacaaaaaaaattactctactaaaattcgacattacaaataaaaatctttatccccgacgattcta

SEQ ID NO: 20793 - DNA, 677 bp, Artificial Sequence
  chemically treated genomic DNA (Homo sapiens) CpG-island No: 20793
gtagtcgcgcgtcgcgaatttcggtttatttgtaagtaaggcgggtcgggggtagagggcgtcgggttgtgcgggggaatcggttcgcgtttcgggattggggggcggtggaagagagagcgagcgggtatgcgtagtggggcggaggaggtggcgatggtcgggggaggcggggggattgttgtttatttgtagttgggttaatttcgcggcgtaggcggcggcggagcgcggggagttcgcggcgggtttagttgtcgtagtattatgttcgagttttttttcgggtagacgtcgcgcgtcgtcggggtttcggtaggggaggatgttagacgttcgggagaggttagggtagtagcggcggcggcggcgcgatggtggtgattatttttgttcgaggcggcggcggggatcgtatattttttcggcggcggggttgcgggttagcgtcggtcggggtcgcggcgttgttggtcggggtaagttgtttgtgttacggtcgttttttgtagggcgagttcgtgtacgacgacgtgtgggcgatcgtgaataatttcgacgtgcggttcggcgtttcgtttcgttggggtatttttattaacgatttttggggtaagggtatggtcgagaatattagttataagttttatcggtcgttttgcgtttttatttttaag

SEQ ID NO: 20794 - DNA, 677 bp, Artificial Sequence
  chemically treated genomic DNA (Homo sapiens) CpG-island No: 20794
cttaaaaataaaaacgcaaaacgaccgataaaacttataactaatattctcgaccatacccttaccccaaaaatcgttaataaaaataccccaacgaaacgaaacgccgaaccgcacgtcgaaattattcacgatcgcccacacgtcgtcgtacacgaactcgccctacaaaaaacgaccgtaacacaaacaacttaccccgaccaacaacgccgcgaccccgaccgacgctaacccgcaaccccgccgccgaaaaaatatacgatccccgccgccgcctcgaacaaaaataatcaccaccatcgcgccgccgccgccgctactaccctaacctctcccgaacgtctaacatcctcccctaccgaaaccccgacgacgcgcgacgtctacccgaaaaaaaactcgaacataatactacgacaactaaacccgccgcgaactccccgcgctccgccgccgcctacgccgcgaaattaacccaactacaaataaacaacaatccccccgcctcccccgaccatcgccacctcctccgccccactacgcatacccgctcgctctctcttccaccgccccccaatcccgaaacgcgaaccgattcccccgcacaacccgacgccctctacccccgacccgccttacttacaaataaaccgaaattcgcgacgcgcgactac

SEQ ID NO: 20795 - DNA, 677 bp, Artificial Sequence
  chemically treated genomic DNA (Homo sapiens) CpG-island No: 20795
tttgaaggtgaggacgtagagcggtcggtaggatttgtggttggtgttttcggttatgtttttgttttagaagtcgttggtgaagatgttttagcggagcggggcgtcgggtcgtacgtcggggttgtttacgatcgtttatacgtcgtcgtgtacgaattcgttttgtagggagcggtcgtagtataggtagtttgtttcggttagtagcgtcgcggtttcggtcggcgttagttcgtagtttcgtcgtcgggagggtgtgcggttttcgtcgtcgtttcgggtagaggtggttattattatcgcgtcgtcgtcgtcgttgttgttttggtttttttcgggcgtttggtatttttttttatcggggtttcggcggcgcgcggcgtttgttcggaggggggttcgggtatggtgttgcggtagttggattcgtcgcgagtttttcgcgtttcgtcgtcgtttgcgtcgcggagttggtttagttgtaaataaatagtagttttttcgtttttttcggttatcgttatttttttcgttttattgcgtatgttcgttcgtttttttttttatcgttttttaatttcgggacgcgggtcggttttttcgtatagttcggcgttttttgttttcggttcgttttgtttgtaggtggatcggggttcgcggcgcgcggttgt

SEQ ID NO: 20796 - DNA, 677 bp, Artificial Sequence
  chemically treated genomic DNA (Homo sapiens) CpG-island No: 20796
acaaccgcgcgccgcgaaccccgatccacctacaaacaaaacgaaccgaaaacaaaaaacgccgaactatacgaaaaaaccgacccgcgtcccgaaattaaaaaacgataaaaaaaaaaacgaacgaacatacgcaataaaacgaaaaaaataacgataaccgaaaaaaacgaaaaaactactatttatttacaactaaaccaactccgcgacgcaaacgacgacgaaacgcgaaaaactcgcgacgaatccaactaccgcaacaccatacccgaacccccctccgaacaaacgccgcgcgccgccgaaaccccgataaaaaaaaataccaaacgcccgaaaaaaaccaaaacaacaacgacgacgacgacgcgataataataaccacctctacccgaaacgacgacgaaaaccgcacaccctcccgacgacgaaactacgaactaacgccgaccgaaaccgcgacgctactaaccgaaacaaactacctatactacgaccgctccctacaaaacgaattcgtacacgacgacgtataaacgatcgtaaacaaccccgacgtacgacccgacgccccgctccgctaaaacatcttcaccaacgacttctaaaacaaaaacataaccgaaaacaccaaccacaaatcctaccgaccgctctacgtcctcaccttcaaa

SEQ ID NO: 20797 - DNA, 1569 bp, Artificial Sequence
  chemically treated genomic DNA (Homo sapiens) CpG-island No: 20797
tgcgtatttcgttgttttgttttcgtttatcgttttttagcggttttttttaacggcgtcgtttgtttagtatagtttcgtattgcgttattaaatgagttaagcggaaggatcggtattttttcgggaaaattaggtattaatatacggtgtatttaattgaatttaaattcgggaatagtgtaggtagtgttaataaagcgcggtgttgggtttcgagcgtttaaaggtttttgttagtttttagacgcggttaaatttataggattttaaaaggtgatttggtcggtatcgtagagcggtaggcggcgtagagggtagagttcgatcggttttcgtttcgcgttcgtttcgtacggttatcggttttttcgcggacgttatttcggcgggagtcgagttgagttcgatttttcgtttttcgaagaggttcgaaagtcgcgttacgtgcggggtcgaaatttcgcggtcggggtcgggtggttggcgggtgggaggtaggtacggcggtcggggggtagttcgcgcgttcggtgatttatcggtcgttttcgagtgcggttgtaagcgaaggggtcggcgcgttaggcggggttcgtgtttttggggttattttcgcgtttgttattaataatttagcgtttggaggcgaaagtttcggtgggcgtagtcgtaaagttcgtacgcggaataaataataatgttattaaatcgcgttcgagcgttagttcggttagaaagcggcgggagggcgttatcgggagttgattttgtttggagtttgtatttcgtttttcgcgcgtttttatagcgtttttcgcgtttttgagggggtttagcgtcgtcgtagttttggttttattcgttagttcgttaggttttagttcgttgttcgcgtcgatttcgtatagtacgaagtagtgcgcgaagcggtaggcggtcggggaggagttcgagttcgggtcgggcgtcgcgtagttttcgtttatttcggtcgcgttgttttaggggtcgtcgtcgtcgtcgttcgggaaggttttttgcggaggttgttattatcgtttcggttgtggtttgtgcgttcgttttagggcgatattggcgcgtttatggtcgcgtagtcgtttttcgtcgtcgtagtttgttttttcgttcggcgcgggggaagcggtcgcgggttcgcgcgcggcgggttcggagttcggtcgggtgggggaggggcgcggggggagtgtcggtttgagaggttttcgtagtcgtagttgcgttcgcgagttgagagtcgtcgcgtttggcgttcgcgggttagttgagcggcgttcgggttgtgggagcgcggggcgggcgggggcgtcggggttcggcgcgtgcgacggagaggggtggggggcgcgttcgcgagggacggaggcgcgcgtttttatcgtgcgcgcgcgtttagcgggttcggaggttaagtttggcgtggggtcgtattcgtgtttattggtttcggttgcggtatcgagggcgattttgtatatattttttttcgttttggttagtcgataagagggttagttttagtgt

SEQ ID NO: 20798 - DNA, 1569 bp, Artificial Sequence
  chemically treated genomic DNA (Homo sapiens) CpG-island No: 20798
acactaaaactaaccctcttatcgactaaccaaaacgaaaaaaaatatatacaaaatcgccctcgataccgcaaccgaaaccaataaacacgaatacgaccccacgccaaacttaacctccgaacccgctaaacgcgcgcgcacgataaaaacgcgcgcctccgtccctcgcgaacgcgccccccacccctctccgtcgcacgcgccgaaccccgacgcccccgcccgccccgcgctcccacaacccgaacgccgctcaactaacccgcgaacgccaaacgcgacgactctcaactcgcgaacgcaactacgactacgaaaacctctcaaaccgacactccccccgcgcccctcccccacccgaccgaactccgaacccgccgcgcgcgaacccgcgaccgcttcccccgcgccgaacgaaaaaacaaactacgacgacgaaaaacgactacgcgaccataaacgcgccaatatcgccctaaaacgaacgcacaaaccacaaccgaaacgataataacaacctccgcaaaaaaccttcccgaacgacgacgacgacgacccctaaaacaacgcgaccgaaataaacgaaaactacgcgacgcccgacccgaactcgaactcctccccgaccgcctaccgcttcgcgcactacttcgtactatacgaaatcgacgcgaacaacgaactaaaacctaacgaactaacgaataaaaccaaaactacgacgacgctaaaccccctcaaaaacgcgaaaaacgctataaaaacgcgcgaaaaacgaaatacaaactccaaacaaaatcaactcccgataacgccctcccgccgctttctaaccgaactaacgctcgaacgcgatttaataacattattatttattccgcgtacgaactttacgactacgcccaccgaaactttcgcctccaaacgctaaattattaataacaaacgcgaaaataaccccaaaaacacgaaccccgcctaacgcgccgaccccttcgcttacaaccgcactcgaaaacgaccgataaatcaccgaacgcgcgaactaccccccgaccgccgtacctacctcccacccgccaaccacccgaccccgaccgcgaaatttcgaccccgcacgtaacgcgactttcgaacctcttcgaaaaacgaaaaatcgaactcaactcgactcccgccgaaataacgtccgcgaaaaaaccgataaccgtacgaaacgaacgcgaaacgaaaaccgatcgaactctaccctctacgccgcctaccgctctacgataccgaccaaatcaccttttaaaatcctataaatttaaccgcgtctaaaaactaacaaaaacctttaaacgctcgaaacccaacaccgcgctttattaacactacctacactattcccgaatttaaattcaattaaatacaccgtatattaatacctaattttcccgaaaaaataccgatccttccgcttaactcatttaataacgcaatacgaaactatactaaacaaacgacgccgttaaaaaaaaccgctaaaaaacgataaacgaaaacaaaacaacgaaatacgca

SEQ ID NO: 20799 - DNA, 1569 bp, Artificial Sequence
  chemically treated genomic DNA (Homo sapiens) CpG-island No: 20799
atattgaggttagtttttttatcggttggttagggcgaggaggggtgtgtgtagggtcgttttcgatgtcgtagtcggggttagtgggtacgaatgcggttttacgttaggtttggttttcgaattcgttaggcgcgcgcgtacggtagaagcgcgcgttttcgtttttcgcgagcgcgttttttattttttttcgtcgtacgcgtcgagtttcggcgttttcgttcgtttcgcgtttttatagttcgagcgtcgtttagttgattcgcgggcgttagacgcggcggtttttagttcgcgagcgtagttgcggttgcgagggttttttaggtcgatatttttttcgcgttttttttttattcggtcgggtttcggattcgtcgcgcgcgagttcgcggtcgtttttttcgcgtcgagcgaggaggtaggttgcggcggcgagaggcggttgcgcggttatgggcgcgttagtgtcgttttagggcgggcgtatagattatagtcggagcggtggtggtagttttcgtagaaagttttttcgggcggcggcggcggcggtttttggagtagcgcggtcgggatgagcgggagttgcgcggcgttcggttcgggttcgggttttttttcggtcgtttgtcgtttcgcgtattatttcgtgttgtgcgggatcgacgcggatagcgggttggagtttgacgagttggcgggtaaggttagggttgcggcggcgttgagtttttttaggggcgcgggggacgttgtggggacgcgcgggaggcggggtgtaggttttagataaagttagttttcggtggcgttttttcgtcgttttttggtcgaattggcgttcgggcgcgatttaatgatattgttatttatttcgcgtgcgggttttgcggttgcgtttatcggggttttcgtttttaggcgttgggttattaataataggcgcgggggtggttttaagggtacggatttcgtttggcgcgtcggttttttcgtttgtagtcgtattcggaggcggtcggtgagttatcgggcgcgcgggttgtttttcgatcgtcgtgtttgttttttattcgttagttattcggtttcggtcgcgaagtttcggtttcgtacgtgacgcggttttcgggttttttcgggagacggggagtcggatttagttcggttttcgtcggggtagcgttcgcggaggagtcggtggtcgtgcggagcgagcgcggggcggggatcggtcggattttgttttttgcgtcgtttgtcgttttgcggtgtcggttaagttattttttggaattttgtggatttggtcgcgtttgggagttggtagggatttttggacgttcgggatttagtatcgcgttttgttgatattgtttatattgttttcgagtttaaatttagttgggtgtatcgtgtgttagtgtttggttttttcggaggggtatcggttttttcgtttgatttatttgatggcgtagtgcggggttgtgttgggtaaacgacgtcgttaaaaggggtcgttaaagggcgatgggcgggggtagggtagcggagtgcgta

SEQ ID NO: 20800 - DNA, 1569 bp, Artificial Sequence
  chemically treated genomic DNA (Homo sapiens) CpG-island No: 20800
tacgcactccgctaccctacccccgcccatcgccctttaacgaccccttttaacgacgtcgtttacccaacacaaccccgcactacgccatcaaataaatcaaacgaaaaaaccgatacccctccgaaaaaaccaaacactaacacacgatacacccaactaaatttaaactcgaaaacaatataaacaatatcaacaaaacgcgatactaaatcccgaacgtccaaaaatccctaccaactcccaaacgcgaccaaatccacaaaattccaaaaaataacttaaccgacaccgcaaaacgacaaacgacgcaaaaaacaaaatccgaccgatccccgccccgcgctcgctccgcacgaccaccgactcctccgcgaacgctaccccgacgaaaaccgaactaaatccgactccccgtctcccgaaaaaacccgaaaaccgcgtcacgtacgaaaccgaaacttcgcgaccgaaaccgaataactaacgaataaaaaacaaacacgacgatcgaaaaacaacccgcgcgcccgataactcaccgaccgcctccgaatacgactacaaacgaaaaaaccgacgcgccaaacgaaatccgtacccttaaaaccacccccgcgcctattattaataacccaacgcctaaaaacgaaaaccccgataaacgcaaccgcaaaacccgcacgcgaaataaataacaatatcattaaatcgcgcccgaacgccaattcgaccaaaaaacgacgaaaaaacgccaccgaaaactaactttatctaaaacctacaccccgcctcccgcgcgtccccacaacgtcccccgcgcccctaaaaaaactcaacgccgccgcaaccctaaccttacccgccaactcgtcaaactccaacccgctatccgcgtcgatcccgcacaacacgaaataatacgcgaaacgacaaacgaccgaaaaaaaacccgaacccgaaccgaacgccgcgcaactcccgctcatcccgaccgcgctactccaaaaaccgccgccgccgccgcccgaaaaaactttctacgaaaactaccaccaccgctccgactataatctatacgcccgccctaaaacgacactaacgcgcccataaccgcgcaaccgcctctcgccgccgcaacctacctcctcgctcgacgcgaaaaaaacgaccgcgaactcgcgcgcgacgaatccgaaacccgaccgaataaaaaaaaaacgcgaaaaaaatatcgacctaaaaaaccctcgcaaccgcaactacgctcgcgaactaaaaaccgccgcgtctaacgcccgcgaatcaactaaacgacgctcgaactataaaaacgcgaaacgaacgaaaacgccgaaactcgacgcgtacgacgaaaaaaaataaaaaacgcgctcgcgaaaaacgaaaacgcgcgcttctaccgtacgcgcgcgcctaacgaattcgaaaaccaaacctaacgtaaaaccgcattcgtacccactaaccccgactacgacatcgaaaacgaccctacacacacccctcctcgccctaaccaaccgataaaaaaactaacctcaatat

SEQ ID NO: 20801 - DNA, 891 bp, Artificial Sequence
  chemically treated genomic DNA (Homo sapiens) CpG-island No: 20801
  misc_feature (587)..(587): n is either a, c, g or t
  misc_feature (622)..(622): n is either a, c, g or t
  misc_feature (691)..(691): n is either a, c, g or t
  misc_feature (781)..(781): n is either a, c, g or t
gtcgtggacgggttgttattcgagtttattttatgtttcgagattgttagcggtttgcgcggtgcgtcggttatatttgtaaatttcgagatgtttttatttttgtgagggttagttacgttgttttttaatttcgtcgagttgttgtttttttttattcgtcgtatttttgtataatatattttttaatgcgtttatatgggttatatttttttattttttcgtatggggtacgcgttgcgtggcgttttttagtttttgttttttatttcgggtttcgtttttttcgttgtattgtttatcgtgtgaataatattgttcgttgtttacgtgttcgtttttttacgatttttcggtgttcggttagttgtaggttagtggtgcgatttgcggtgggtagttggtttgatttttattgcgttttttttcgtttgtgtcgtggcgtcggatgcgtcgggttttttacgttaggtataaaattgtgtgtaaattcgtgtattgatgtgtatgtttaatttttacggttcggtttatttgtgtttttttcgcgtttattataattgcgttttgtcgttcgtcgtgttttnttgcgtcgttttcgcgtttatacgtcgtatttcgngtgttttttatgttttttttttttcgtgtttttatattttttttatatttttatttcgtcggatgtttntgttgtcgtgatcggttgtcgtgtagtttttaacgcgtgttgtttttattgtttttttttcgttttttgttcgtagtcgttttttttttnttttttttttatcggtattgggcgcgggattacgcgtcgtgtttcgttttatttttttcgtttgtgttttttttcgttttagttatttttgtgttttcgtgttttgtgtt

SEQ ID NO: 20802 - DNA, 891 bp, Artificial Sequence
  chemically treated genomic DNA (Homo sapiens) CpG-island No: 20802
  misc_feature (111)..(111): n is either a, c, g or t
  misc_feature (201)..(201): n is either a, c, g or t
  misc_feature (270)..(270): n is either a, c, g or t
  misc_feature (305)..(305): n is either a, c, g or t
aacacaaaacacgaaaacacaaaaataactaaaacgaaaaaaaacacaaacgaaaaaaataaaacgaaacacgacgcgtaatcccgcgcccaataccgataaaaaaaaaanaaaaaaaaaacgactacgaacaaaaaacgaaaaaaaaacaataaaaacaacacgcgttaaaaactacacgacaaccgatcacgacaacanaaacatccgacgaaataaaaatataaaaaaaatataaaaacacgaaaaaaaaaaaacataaaaaacacncgaaatacgacgtataaacgcgaaaacgacgcaanaaaacacgacgaacgacaaaacgcaattataataaacgcgaaaaaaacacaaataaaccgaaccgtaaaaattaaacatacacatcaatacacgaatttacacacaattttatacctaacgtaaaaaacccgacgcatccgacgccacgacacaaacgaaaaaaaacgcaataaaaatcaaaccaactacccaccgcaaatcgcaccactaacctacaactaaccgaacaccgaaaaatcgtaaaaaaacgaacacgtaaacaacgaacaatattattcacacgataaacaatacaacgaaaaaaacgaaacccgaaataaaaaacaaaaactaaaaaacgccacgcaacgcgtaccccatacgaaaaaataaaaaaatataacccatataaacgcattaaaaaatatattatacaaaaatacgacgaataaaaaaaaacaacaactcgacgaaattaaaaaacaacgtaactaaccctcacaaaaataaaaacatctcgaaatttacaaatataaccgacgcaccgcgcaaaccgctaacaatctcgaaacataaaataaactcgaataacaacccgtccacgac

SEQ ID NO: 20803 - DNA, 891 bp, Artificial Sequence
  chemically treated genomic DNA (Homo sapiens) CpG-island No: 20803
  misc_feature (111)..(111): n is either a, c, g or t
  misc_feature (201)..(201): n is either a, c, g or t
  misc_feature (270)..(270): n is either a, c, g or t
  misc_feature (305)..(305): n is either a, c, g or t
aatataagatacgggaatatagagatggttgaaacgggaagagatatagacgagaggggtaggacgaaatacgacgcgtagtttcgcgtttaatgtcgatgaaggaagagnaggaaaagagcggttgcgggtaaggaacggaaagggagtagtggagataatacgcgttggagattatacggtaatcggttacgataatanggatattcggcgaggtgagggtgtggaagaggtgtgggggtacggaagaaagggagtatgagaagtatncggggtgcgacgtgtgggcgcgaagacggcgtagnagagtacggcgagcgataagacgtaattgtggtgggcgcggggagggtataggtgaatcgaatcgtaagggttaagtatatatattagtgtacgggtttgtatataattttatatttaacgtaaggggttcgacgtattcggcgttacgatataagcggaggagggcgtagtgaggattaggttaattgtttatcgtagatcgtattattaatttgtaattaatcggatatcgggagatcgtggaggaacgggtacgtaaataacgagtaatgttatttatacggtagatagtgtaacggagaaggcgggattcggggtggggagtaaaagttgaggagcgttacgtaacgcgtattttatacgggaaagtgggaggatataatttatgtgagcgtattgggagatatgttatgtaggagtgcggcgggtaaggagggatagtaattcgacggggttgaaaaataacgtgattaatttttataggaatgagagtatttcggagtttgtaagtgtgatcggcgtatcgcgtaagtcgttaatagtttcggggtatgaaatggattcgggtaatagttcgtttacggt

SEQ ID NO: 20804 - DNA, 891 bp, Artificial Sequence
  chemically treated genomic DNA (Homo sapiens) CpG-island No: 20804
  misc_feature (587)..(587): n is either a, c, g or t
  misc_feature (622)..(622): n is either a, c, g or t
  misc_feature (691)..(691): n is either a, c, g or t
  misc_feature (781)..(781): n is either a, c, g or t
accgtaaacgaactattacccgaatccatttcataccccgaaactattaacgacttacgcgatacgccgatcacacttacaaactccgaaatactctcattcctataaaaattaatcacgttatttttcaaccccgtcgaattactatccctccttacccgccgcactcctacataacatatctcccaatacgctcacataaattatatcctcccactttcccgtataaaatacgcgttacgtaacgctcctcaacttttactccccaccccgaatcccgccttctccgttacactatctaccgtataaataacattactcgttatttacgtacccgttcctccacgatctcccgatatccgattaattacaaattaataatacgatctacgataaacaattaacctaatcctcactacgccctcctccgcttatatcgtaacgccgaatacgtcgaaccccttacgttaaatataaaattatatacaaacccgtacactaatatatatacttaacccttacgattcgattcacctataccctccccgcgcccaccacaattacgtcttatcgctcgccgtactctnctacgccgtcttcgcgcccacacgtcgcaccccgnatacttctcatactccctttcttccgtacccccacacctcttccacaccctcacctcgccgaatatccntattatcgtaaccgattaccgtataatctccaacgcgtattatctccactactccctttccgttccttacccgcaaccgctcttttcctnctcttccttcatcgacattaaacgcgaaactacgcgtcgtatttcgtcctacccctctcgtctatatctcttcccgtttcaaccatctctatattcccgtatcttatatt

SEQ ID NO: 20805 - DNA, 599 bp, Artificial Sequence
  chemically treated genomic DNA (Homo sapiens) CpG-island No: 20805
ttttcgcgcgtttatagtcgagtatatcgtttttagtttcgtttcgtattatttcgggaatcgggcgagcgtacgtttcgatattaagttatcgatagtatattttcgattaaaaatcgtatcgtaagtttattgaatcgaagtaatcgaaacgcgcgtagtattatttatttcggcgcgatttttcggcgtaggagaggacgggcgagcgttcgtttcggagacgcggaattttcgtattcgagcgaaggaattagcgattagtaagcgcgttcgattcgatatattaatcgttttttatgtcgtcgcgaattcgcgtttttttttttttacgttttcgcgtttcgtttaacgatatcggttatgtttaaacgtttcgatcggttcgtggttcgtttttttgcgttgttttattcgtcgtcgtttattttttatttcgcgtttattcggtcgagtttagcgaatttttatttatcgtatttcgcgttcgggtatcgacggaacgcggaagttatttttaaacgagttttataatatagacgatatcgtatttattttcgattcgcgttcgagtcgagttttttagtataagtataata

SEQ ID NO: 20806 - DNA, 599 bp, Artificial Sequence
  chemically treated genomic DNA (Homo sapiens) CpG-island No: 20806
tattatacttatactaaaaaactcgactcgaacgcgaatcgaaaataaatacgatatcgtctatattataaaactcgtttaaaaataacttccgcgttccgtcgatacccgaacgcgaaatacgataaataaaaattcgctaaactcgaccgaataaacgcgaaataaaaaataaacgacgacgaataaaacaacgcaaaaaaacgaaccacgaaccgatcgaaacgtttaaacataaccgatatcgttaaacgaaacgcgaaaacgtaaaaaaaaaaaaacgcgaattcgcgacgacataaaaaacgattaatatatcgaatcgaacgcgcttactaatcgctaattccttcgctcgaatacgaaaattccgcgtctccgaaacgaacgctcgcccgtcctctcctacgccgaaaaatcgcgccgaaataaataatactacgcgcgtttcgattacttcgattcaataaacttacgatacgatttttaatcgaaaatatactatcgataacttaatatcgaaacgtacgctcgcccgattcccgaaataatacgaaacgaaactaaaaacgatatactcgactataaacgcgcgaaaa

SEQ ID NO: 20807 - DNA, 599 bp, Artificial Sequence
  chemically treated genomic DNA (Homo sapiens) CpG-island No: 20807
tgttgtgtttgtgttggggggttcgattcgaacgcgggtcgggggtggatacggtgtcgtttgtattatgggattcgtttgggggtggttttcgcgtttcgtcggtgttcgggcgcggagtacgatggataggggttcgttgggttcgatcggatggacgcgggataagggataggcggcgacgggtggaataacgtagagaagcgggttacgggtcgatcggggcgtttgggtatgatcggtgtcgttggacgggacgcgggggcgtggggggaaaggggcgcgggttcgcggcggtatggggggcggttggtgtatcggatcgagcgcgtttgttagtcgttgattttttcgttcgggtacgggggtttcgcgttttcggggcgggcgttcgttcgtttttttttgcgtcggagggtcgcgtcggggtgggtggtgttgcgcgcgtttcggttgtttcggtttagtgagtttgcggtacggtttttggtcgggggtgtgttatcggtgatttggtatcggggcgtgcgttcgttcggttttcggagtggtgcggggcggggttgggggcggtgtgttcggttatgggcgcgcgggga

SEQ ID NO: 20808 - DNA, 599 bp, Artificial Sequence
  chemically treated genomic DNA (Homo sapiens) CpG-island No: 20808
tccccgcgcgcccataaccgaacacaccgcccccaaccccgccccgcaccactccgaaaaccgaacgaacgcacgccccgataccaaatcaccgataacacacccccgaccaaaaaccgtaccgcaaactcactaaaccgaaacaaccgaaacgcgcgcaacaccacccaccccgacgcgaccctccgacgcaaaaaaaaacgaacgaacgcccgccccgaaaacgcgaaacccccgtacccgaacgaaaaaatcaacgactaacaaacgcgctcgatccgatacaccaaccgccccccataccgccgcgaacccgcgcccctttccccccacgcccccgcgtcccgtccaacgacaccgatcatacccaaacgccccgatcgacccgtaacccgcttctctacgttattccacccgtcgccgcctatcccttatcccgcgtccatccgatcgaacccaacgaacccctatccatcgtactccgcgcccgaacaccgacgaaacgcgaaaaccacccccaaacgaatcccataatacaaacgacaccgtatccacccccgacccgcgttcgaatcgaaccccccaacacaaacacaaca

SEQ ID NO: 20809 - DNA, 865 bp, Artificial Sequence
  chemically treated genomic DNA (Homo sapiens) CpG-island No: 20809
tagtgtgcggttttcggcgcgggtcggcgtttttttcgcgtcgttttttttttttttttttttttttcggtcgttttttgtcggtgggcggtatagggatgcgcgagtcggggtttttttttttgtttttggattcggtcgagattgcgtgttttcggcgagttttttttttttttttttttggggggttcgttcgggggtttattttttttttttttgcgggcgcgtgcggcggcgtaaaaaaagattaaaaaattcgcgtttttttttcgttttgtcgtttttttttttttttttttttttcgttcggttttttcgttcggtttcgttttttcgttttgtttttgcgtttttcggcgtgcgttcgcgggtttcgcggtcgttcgcgtttcggcggtggcgttcggttcgtcgttttgtgttcgtcgtttgtcgtttcgtcgttttcgtttcgtcgagtattttttcgttcgttttcgtttttttcgtttcggggtgtttcgtcgttcgtgcgtcgcggggcggcgcgtggttatttcggtcgcgttttcgtggtcggtgtttcggttgtttgttgcgtagttcgcgtcgagcgtttgttttgtgtttcgcgcgttcgtttttcggcgcgttttcgtttttttttttttcggcgtcgtttttttcgtcgtttcgttttttttttcgagaatattcgtttcgcgcgcgattcgcgcgttttttttttcgtcgttcgcgcgcgttttttcgcgcgtttcgttttgggtttttgattcggcgttgttttcgcggtgttttgttgtgtcgttcgtcgcggcgtatcgggtttttttcggggttttttcgtttcggcgtcgcgcgttcg

SEQ ID NO: 20810 - DNA, 865 bp, Artificial Sequence
  chemically treated genomic DNA (Homo sapiens) CpG-island No: 20810
cgaacgcgcgacgccgaaacgaaaaaaccccgaaaaaaacccgatacgccgcgacgaacgacacaacaaaacaccgcgaaaacaacgccgaatcaaaaacccaaaacgaaacgcgcgaaaaaacgcgcgcgaacgacgaaaaaaaaaacgcgcgaatcgcgcgcgaaacgaatattctcgaaaaaaaaaacgaaacgacgaaaaaaacgacgccgaaaaaaaaaaaaacgaaaacgcgccgaaaaacgaacgcgcgaaacacaaaacaaacgctcgacgcgaactacgcaacaaacaaccgaaacaccgaccacgaaaacgcgaccgaaataaccacgcgccgccccgcgacgcacgaacgacgaaacaccccgaaacgaaaaaaacgaaaacgaacgaaaaaatactcgacgaaacgaaaacgacgaaacgacaaacgacgaacacaaaacgacgaaccgaacgccaccgccgaaacgcgaacgaccgcgaaacccgcgaacgcacgccgaaaaacgcaaaaacaaaacgaaaaaacgaaaccgaacgaaaaaaccgaacgaaaaaaaaaaaaaaaaaaaaaaacgacaaaacgaaaaaaaaacgcgaattttttaatctttttttacgccgccgcacgcgcccgcaaaaaaaaaaaaaataaacccccgaacgaaccccccaaaaaaaaaaaaaaaaaaaactcgccgaaaacacgcaatctcgaccgaatccaaaaacaaaaaaaaaaaccccgactcgcgcatccctataccgcccaccgacaaaaaacgaccgaaaaaaaaaaaaaaaaaaaaaaaacgacgcgaaaaaaacgccgacccgcgccgaaaaccgcacacta

SEQ ID NO: 20811 - DNA, 865 bp, Artificial Sequence
  chemically treated genomic DNA (Homo sapiens) CpG-island No: 20811
cggacgcgcggcgtcgaaacgggggagtttcggaaggagttcgatacgtcgcggcggacggtatagtagagtatcgcgaggataacgtcggattagaggtttaaagcggagcgcgcgggggggcgcgcgcgagcggcggggagaggagcgcgcgggtcgcgcgcggggcgggtattttcggaggggggggcggggcggcggggggggcgacgtcgggaggggggggggcgggggcgcgtcggggggcgagcgcgcggggtatagggtaggcgttcggcgcgggttgcgtagtaagtagtcggggtatcggttacggaggcgcggtcgggatggttacgcgtcgtttcgcggcgtacgggcggcggggtatttcgggacggggggggcggaggcgagcgagggggtgttcgacgaagcgggggcggcggaacggtaggcgacgggtatagggcggcgggtcgggcgttatcgtcggggcgcgggcggtcgcgagattcgcggacgtacgtcggagagcgtaaaagtaagacgggggggcgaggtcgggcgaaggaatcgggcgggagaaagaaaagggggggggggcggtaggacgaggggagggcgcgggttttttgatttttttttgcgtcgtcgtacgcgttcgtagaaggaggggagataagttttcgggcgggttttttaagggagagaggggaggggattcgtcgggagtacgtaatttcggtcgggtttaaaggtaggggaaaaaatttcggttcgcgtatttttgtgtcgtttatcgataggaagcggtcgaaggaaggaaaaaagaaaggggagcggcgcggggggggcgtcgattcgcgtcgggggtcgtatatta

SEQ ID NO: 20812 - DNA, 865 bp, Artificial Sequence
  chemically treated genomic DNA (Homo sapiens) CpG-island No: 20812
taatatacgacccccgacgcgaatcgacgccccccccgcgccgctcccctttcttttttccttccttcgaccgcttcctatcgataaacgacacaaaaatacgcgaaccgaaattttttcccctacctttaaacccgaccgaaattacgtactcccgacgaatcccctcccctctctcccttaaaaaacccgcccgaaaacttatctcccctccttctacgaacgcgtacgacgacgcaaaaaaaaatcaaaaaacccgcgccctcccctcgtcctaccgcccccccccccttttctttctcccgcccgattccttcgcccgacctcgcccccccgtcttacttttacgctctccgacgtacgtccgcgaatctcgcgaccgcccgcgccccgacgataacgcccgacccgccgccctatacccgtcgcctaccgttccgccgcccccgcttcgtcgaacaccccctcgctcgcctccgccccccccgtcccgaaataccccgccgcccgtacgccgcgaaacgacgcgtaaccatcccgaccgcgcctccgtaaccgataccccgactacttactacgcaacccgcgccgaacgcctaccctataccccgcgcgctcgccccccgacgcgcccccgcccccccccctcccgacgtcgccccccccgccgccccgcccccccctccgaaaatacccgccccgcgcgcgacccgcgcgctcctctccccgccgctcgcgcgcgcccccccgcgcgctccgctttaaacctctaatccgacgttatcctcgcgatactctactataccgtccgccgcgacgtatcgaactccttccgaaactcccccgtttcgacgccgcgcgtccg

SEQ ID NO: 20813 - DNA, 1078 bp, Artificial Sequence
  chemically treated genomic DNA (Homo sapiens) CpG-island No: 20813
  misc_feature (120)..(120): n is either a, c, g or t
  misc_feature (249)..(249): n is either a, c, g or t
  misc_feature (285)..(285): n is either a, c, g or t
  misc_feature (299)..(299): n is either a, c, g or t
  misc_feature (693)..(693): n is either a, c, g or t
tggtgggcgatcgagttatcgtaaatttattaataaaaatataattgttacgtcgtcgcgtcgggcgacgcgcgcgggggtttaaaggcggcgcgttcgcggtacgcggggggcggtggnacgatgggatttcggcgttttcgcggtgttgttcggtttcgtcgggatatggtggtttaataacgttatattaggggtgttagcgttcgcgtttttatttaattaatatattaaacgttttttgttttnttttttttcgcgcggggggggtcgacgaggcggggnaaaagcggcgcgangttttagcgagaaaataacggggggggggggcggggtttttaaggatacgcgagaggggtagggggcgaggcggtatcgggggaaaaaaaaaaaaaaaaaattcgggcgggcggcgcgcgttaggaggtacgaaggcggcggggagaggtcggtgggcgcgcggggcgcgtacgtttcggtttcggaatacgtggtagcggcggcgatttgcgttaacggtacgggacgttttttcgtaggggagggtggaagtacgatttacgaatagcgcggcgcgagtcgcgcgggagggcgtcgtcgacgggcgcgggtttttacgcgaggagggaggattacggcggacgtttcgcgggggtggatcggggtgcgggggcggagtagggaacggagggnagggttcggggcggtcgcgtacgcgggacgcggtcgtagttgcgggggatttagcgttcggagggcgggggaggtcggcggaacggttacgataagagtcgcgtcgtcgatatttagtttagtgtaaggtcgtcgtcgggtgaaggttgttcgatcgtcgtttcgtcgacgggcgtttcgtggtcgatattttcggggaggagatcgggttaacgggtatattaagaggtgcgaggggttcgttcggcgtagcgattattagatagcgcgggcgcgagttaagtatcgcgtgggatatttgcgtcgtacgcgtatcgtttcgattgagaattagtcgttttatatcgaatattagcgcgtaaagtcgtcgggaggtgtgacgttg

SEQ ID NO: 20814 - DNA, 1078 bp, Artificial Sequence
  chemically treated genomic DNA (Homo sapiens) CpG-island No: 20814
  misc_feature (386)..(386): n is either a, c, g or t
  misc_feature (780)..(780): n is either a, c, g or t
  misc_feature (794)..(794): n is either a, c, g or t
  misc_feature (830)..(830): n is either a, c, g or t
  misc_feature (959)..(959): n is either a, c, g or t
caacgtcacacctcccgacgactttacgcgctaatattcgatataaaacgactaattctcaatcgaaacgatacgcgtacgacgcaaatatcccacgcgatacttaactcgcgcccgcgctatctaataatcgctacgccgaacgaacccctcgcacctcttaatatacccgttaacccgatctcctccccgaaaatatcgaccacgaaacgcccgtcgacgaaacgacgatcgaacaaccttcacccgacgacgaccttacactaaactaaatatcgacgacgcgactcttatcgtaaccgttccgccgacctcccccgccctccgaacgctaaatcccccgcaactacgaccgcgtcccgcgtacgcgaccgccccgaaccctnccctccgttccctactccgcccccgcaccccgatccacccccgcgaaacgtccgccgtaatcctccctcctcgcgtaaaaacccgcgcccgtcgacgacgccctcccgcgcgactcgcgccgcgctattcgtaaatcgtacttccaccctcccctacgaaaaaacgtcccgtaccgttaacgcaaatcgccgccgctaccacgtattccgaaaccgaaacgtacgcgccccgcgcgcccaccgacctctccccgccgccttcgtacctcctaacgcgcgccgcccgcccgaattttttttttttttttttcccccgataccgcctcgccccctacccctctcgcgtatccttaaaaaccccgccccccccccccgttattttctcgctaaaacntcgcgccgcttttnccccgcctcgtcgaccccccccgcgcgaaaaaaaanaaaacaaaaaacgtttaatatattaattaaataaaaacgcgaacgctaacacccctaatataacgttattaaaccaccatatcccgacgaaaccgaacaacaccgcgaaaacgccgaaatcccatcgtnccaccgccccccgcgtaccgcgaacgcgccgcctttaaacccccgcgcgcgtcgcccgacgcgacgacgtaacaattatatttttattaataaatttacgataactcgatcgcccacca

SEQ ID NO: 20815 - DNA, 1078 bp, Artificial Sequence
  chemically treated genomic DNA (Homo sapiens) CpG-island No: 20815
  misc_feature (386)..(386): n is either a, c, g or t
  misc_feature (780)..(780): n is either a, c, g or t
  misc_feature (794)..(794): n is either a, c, g or t
  misc_feature (830)..(830): n is either a, c, g or t
  misc_feature (959)..(959): n is either a, c, g or t
tagcgttatatttttcggcgattttgcgcgttggtgttcggtgtggggcggttggtttttaatcggagcggtgcgcgtgcggcgtaagtgttttacgcggtgtttggttcgcgttcgcgttgtttgatgatcgttgcgtcgggcggatttttcgtattttttggtgtgttcgttagttcggtttttttttcgggggtgtcgattacggggcgttcgtcggcgaggcggcggtcgagtagtttttattcggcggcggttttatattaggttaggtgtcggcggcgcggtttttgtcgtggtcgtttcgtcgatttttttcgtttttcgggcgttaggtttttcgtagttgcgatcgcgtttcgcgtacgcggtcgtttcgggttttntttttcgttttttgtttcgttttcgtatttcggtttattttcgcggggcgttcgtcgtagtttttttttttcgcgtgagggttcgcgttcgtcggcggcgttttttcgcgcggttcgcgtcgcgttattcgtgagtcgtgtttttatttttttttgcggaagggcgtttcgtgtcgttggcgtaggtcgtcgtcgttgttacgtgtttcggggtcggggcgtgcgcgtttcgcgcgtttatcggttttttttcgtcgttttcgtgttttttggcgcgcgtcgttcgttcgggttttttttttttttttttttttcggtgtcgtttcgttttttgtttttttcgcgtgtttttgggggtttcgtttttttttttcgttgttttttcgttggggtntcgcgtcgtttttntttcgtttcgtcggtttttttcgcgcgaaaaagagngaggtaaaaaacgtttggtgtgttggttgggtgggggcgcgaacgttgatatttttgatataacgttgttgggttattatgtttcggcgggatcgaatagtatcgcgggggcgtcggggttttatcgtnttatcgtttttcgcgtgtcgcgggcgcgtcgtttttgggttttcgcgcgcgtcgttcggcgcgacggcgtaataattgtgtttttattggtggatttgcggtggttcggtcgtttatta

SEQ ID NO: 20816 - DNA, 1078 bp, Artificial Sequence
  chemically treated genomic DNA (Homo sapiens) CpG-island No: 20816
  misc_feature (120)..(120): n is either a, c, g or t
  misc_feature (249)..(249): n is either a, c, g or t
  misc_feature (285)..(285): n is either a, c, g or t
  misc_feature (299)..(299): n is either a, c, g or t
  misc_feature (693)..(693): n is either a, c, g or t
taataaacgaccgaaccaccgcaaatccaccaataaaaacacaattattacgccgtcgcgccgaacgacgcgcgcgaaaacccaaaaacgacgcgcccgcgacacgcgaaaaacgataanacgataaaaccccgacgcccccgcgatactattcgatcccgccgaaacataataacccaacaacgttatatcaaaaatatcaacgttcgcgcccccacccaaccaacacaccaaacgttttttacctcnctctttttcgcgcgaaaaaaaccgacgaaacgaaanaaaaacgacgcganaccccaacgaaaaaacaacgaaaaaaaaaaacgaaacccccaaaaacacgcgaaaaaaacaaaaaacgaaacgacaccgaaaaaaaaaaaaaaaaaaaaaacccgaacgaacgacgcgcgccaaaaaacacgaaaacgacgaaaaaaaaccgataaacgcgcgaaacgcgcacgccccgaccccgaaacacgtaacaacgacgacgacctacgccaacgacacgaaacgcccttccgcaaaaaaaaataaaaacacgactcacgaataacgcgacgcgaaccgcgcgaaaaaacgccgccgacgaacgcgaaccctcacgcgaaaaaaaaaaactacgacgaacgccccgcgaaaataaaccgaaatacgaaaacgaaacaaaaaacgaaaaanaaaacccgaaacgaccgcgtacgcgaaacgcgatcgcaactacgaaaaacctaacgcccgaaaaacgaaaaaaatcgacgaaacgaccacgacaaaaaccgcgccgccgacacctaacctaatataaaaccgccgccgaataaaaactactcgaccgccgcctcgccgacgaacgccccgtaatcgacacccccgaaaaaaaaaccgaactaacgaacacaccaaaaaatacgaaaaatccgcccgacgcaacgatcatcaaacaacgcgaacgcgaaccaaacaccgcgtaaaacacttacgccgcacgcgcaccgctccgattaaaaaccaaccgccccacaccgaacaccaacgcgcaaaatcgccgaaaaatataacgcta

SEQ ID NO: 20817 - DNA, 862 bp, Artificial Sequence
  chemically treated genomic DNA (Homo sapiens) CpG-island No: 20817
atttcgcggttggttttttcgtttacgaagtgaaggttaagtatttcgtgcgtttcgaatttggcgaggcgtagtagtgagcgtagcgcgacgcgggttttggtttgtagcgcggtattgtgtttcgttttggtgaatattattagtaggtggtagtttatcggttcggtatcgtcgttttttaagtttttggttttcgcgtcgggggttggcgttacggagtttcgcgttagttttagcgcgggcggcgagggcgcggcgggagtttcggcgcgggttttttttagttttttggtggcgttggagaaggtttttcggtttgagtcgaggtagtagaaggcgtagacggttagcgtcgcggttagtagtagggcgtagtagtgggagcgtatagcgtttaggcgcgttatggttcgagcgtatgggagttcgtttcggaggaggtttatgcgttacgagatcgcggcgttagcggtgttagtaacgcgggagagttttcgggtattcggacgtcggcggttatttagtttcggcgttaggcggcggttatgaaaggggcggggtcgcgtcgtttggagttaatcgcgggcgtcggtgcgcggaggggcggggtcgggcgtgtcgaaatcgttgggttttaggttttaagggtattagaggaggggttagggtgggattcggcgttcggcgttgggagggggggatttcggattttagcgtgttgagggttggttcgttgtttcggttgagaaatggcgttttacgcggcgagttttagaggatatttaagttgagtgttgaagggaatggaggcgttcgaatagaggaatttaggttagttaaaagcgaagttggaggtatt

SEQ ID NO: 20818 - DNA, 862 bp, Artificial Sequence
  chemically treated genomic DNA (Homo sapiens) CpG-island No: 20818
aatacctccaacttcgcttttaactaacctaaattcctctattcgaacgcctccattcccttcaacactcaacttaaatatcctctaaaactcgccgcgtaaaacgccatttctcaaccgaaacaacgaaccaaccctcaacacgctaaaatccgaaatccccccctcccaacgccgaacgccgaatcccaccctaacccctcctctaatacccttaaaacctaaaacccaacgatttcgacacgcccgaccccgcccctccgcgcaccgacgcccgcgattaactccaaacgacgcgaccccgcccctttcataaccgccgcctaacgccgaaactaaataaccgccgacgtccgaatacccgaaaactctcccgcgttactaacaccgctaacgccgcgatctcgtaacgcataaacctcctccgaaacgaactcccatacgctcgaaccataacgcgcctaaacgctatacgctcccactactacgccctactactaaccgcgacgctaaccgtctacgccttctactacctcgactcaaaccgaaaaaccttctccaacgccaccaaaaaactaaaaaaaacccgcgccgaaactcccgccgcgccctcgccgcccgcgctaaaactaacgcgaaactccgtaacgccaacccccgacgcgaaaaccaaaaacttaaaaaacgacgataccgaaccgataaactaccacctactaataatattcaccaaaacgaaacacaataccgcgctacaaaccaaaacccgcgtcgcgctacgctcactactacgcctcgccaaattcgaaacgcacgaaatacttaaccttcacttcgtaaacgaaaaaaccaaccgcgaaat

SEQ ID NO: 20819 - DNA, 862 bp, Artificial Sequence
  chemically treated genomic DNA (Homo sapiens) CpG-island No: 20819
ggtgtttttagtttcgtttttggttaatttaagtttttttgttcgggcgtttttattttttttaatatttagtttggatattttttggggttcgtcgcgtagggcgttattttttagtcgggatagcgggttagtttttagtacgttggagttcggaattttttttttttaacgtcgggcgtcggattttattttaattttttttttaatatttttggaatttaggatttagcggtttcggtacgttcggtttcgttttttcgcgtatcggcgttcgcgattggttttaggcggcgcggtttcgttttttttatggtcgtcgtttggcgtcggggttaagtggtcgtcggcgttcgggtattcgagggttttttcgcgttgttggtatcgttggcgtcgcggtttcgtagcgtatgggtttttttcgaggcgggtttttatgcgttcgggttatggcgcgtttgggcgttgtgcgtttttattattgcgttttgttgttggtcgcggcgttggtcgtttgcgttttttattatttcggtttaggtcgggagattttttttagcgttattaagaggttgaaggaggttcgcgtcggggttttcgtcgcgttttcgtcgttcgcgttggagttagcgcggggtttcgtggcgttagttttcggcgcgaaggttaagagtttggagggcggcggtgtcgggtcggtggattattatttgttgatgatgtttattaaggcggagtataatgtcgcgttgtaggttaaggttcgcgtcgcgttgcgtttattgttgcgtttcgttaagttcgaggcgtacgaggtgtttaatttttatttcgtgagcgaggaggttagtcgcgaggt

SEQ ID NO: 20820 - DNA, 862 bp, Artificial Sequence
  chemically treated genomic DNA (Homo sapiens) CpG-island No: 20820
acctcgcgactaacctcctcgctcacgaaataaaaattaaacacctcgtacgcctcgaacttaacgaaacgcaacaataaacgcaacgcgacgcgaaccttaacctacaacgcgacattatactccgccttaataaacatcatcaacaaataataatccaccgacccgacaccgccgccctccaaactcttaaccttcgcgccgaaaactaacgccacgaaaccccgcgctaactccaacgcgaacgacgaaaacgcgacgaaaaccccgacgcgaacctccttcaacctcttaataacgctaaaaaaaatctcccgacctaaaccgaaataataaaaaacgcaaacgaccaacgccgcgaccaacaacaaaacgcaataataaaaacgcacaacgcccaaacgcgccataacccgaacgcataaaaacccgcctcgaaaaaaacccatacgctacgaaaccgcgacgccaacgataccaacaacgcgaaaaaaccctcgaatacccgaacgccgacgaccacttaaccccgacgccaaacgacgaccataaaaaaaacgaaaccgcgccgcctaaaaccaatcgcgaacgccgatacgcgaaaaaacgaaaccgaacgtaccgaaaccgctaaatcctaaattccaaaaatattaaaaaaaaaattaaaataaaatccgacgcccgacgttaaaaaaaaaaaattccgaactccaacgtactaaaaactaacccgctatcccgactaaaaaataacgccctacgcgacgaaccccaaaaaatatccaaactaaatattaaaaaaaataaaaacgcccgaacaaaaaaacttaaattaaccaaaaacgaaactaaaaacacc

SEQ ID NO: 20821 - DNA, 822 bp, Artificial Sequence
  chemically treated genomic DNA (Homo sapiens) CpG-island No: 20821
cgagtttttttcgtaattaaggacgtcgggttttaggttagcgttagggatagatttagtattagggcggttttcggagtcggtttttggcggtttcgggttttttgttaaattttttatcggcgttaggatatcgaggggttatttttattacgcggttttaatagatacgttttttatattggttgcggaggttcgtcgggtgtgacggggatcgggcggattggaaaggatgtggttggggtttcggggaggattaggtaggagcgacgggttttttacgtagttttttttcgatcgtgttgtcgtatcgttcgttttagcggttcggtttcgttttgtttaaagggtttattaaagtcggtttatcggcggtttaggaaggaaatgatcgttcgtcgtagtttcgtcgattgttttttagtttagtgttttcgaaattataagggcgggcggggttagaggaggaaaaaaaatatttcgcgggagttttaggtttgggggttgtagtcgcgcgtatttcgtcggtcgggggtcgggcgcgtagacgcggtgtagcggcgtttttaggcggtcgcgcggggtattgtattcggttcgtgtgtcggtttcgggcgggggagggatcgcgtcgcggaggaggggttagtttcgtttaacgttcgacgttcgcggttttttttttttagacggggggtttcgtgttgatcgtagtcgcggagttcgtagcgtatatttcggagtataggataaaatttgtgtttgtatcggagtttttattcggttttcgtaatattgatttttttgggtagtttcgggtat

SEQ ID NO: 20822 - DNA, 822 bp, Artificial Sequence
  chemically treated genomic DNA (Homo sapiens) CpG-island No: 20822
atacccgaaactacccaaaaaaatcaatattacgaaaaccgaataaaaactccgatacaaacacaaattttatcctatactccgaaatatacgctacgaactccgcgactacgatcaacacgaaaccccccgtctaaaaaaaaaaaaccgcgaacgtcgaacgttaaacgaaactaacccctcctccgcgacgcgatccctcccccgcccgaaaccgacacacgaaccgaatacaataccccgcgcgaccgcctaaaaacgccgctacaccgcgtctacgcgcccgacccccgaccgacgaaatacgcgcgactacaacccccaaacctaaaactcccgcgaaatattttttttcctcctctaaccccgcccgcccttataatttcgaaaacactaaactaaaaaacaatcgacgaaactacgacgaacgatcatttccttcctaaaccgccgataaaccgactttaataaaccctttaaacaaaacgaaaccgaaccgctaaaacgaacgatacgacaacacgatcgaaaaaaaactacgtaaaaaacccgtcgctcctacctaatcctccccgaaaccccaaccacatcctttccaatccgcccgatccccgtcacacccgacgaacctccgcaaccaatataaaaaacgtatctattaaaaccgcgtaataaaaataacccctcgatatcctaacgccgataaaaaatttaacaaaaaacccgaaaccgccaaaaaccgactccgaaaaccgccctaatactaaatctatccctaacgctaacctaaaacccgacgtccttaattacgaaaaaaactcg

SEQ ID NO: 20823 - DNA, 822 bp, Artificial Sequence
  chemically treated genomic DNA (Homo sapiens) CpG-island No: 20823
gtgttcgaggttgtttaggggggttagtgttgcgggagtcggatgggggtttcggtgtaggtataggttttgttttgtgtttcgggatgtgcgttgcgggtttcgcggttgcggttagtacggggtttttcgtttggagaggaggggtcgcgggcgtcgggcgttgggcggggttggtttttttttcgcggcgcggtttttttttcgttcggggtcgatatacgggtcgagtgtagtgtttcgcgcggtcgtttgggggcgtcgttgtatcgcgtttgcgcgttcgattttcggtcggcgaggtgcgcgcggttgtagtttttaagtttgaggttttcgcggggtgttttttttttttttttagtttcgttcgtttttgtggtttcgaaagtattgaattgaaaggtagtcggcggggttgcggcgggcggttattttttttttgggtcgtcggtaaatcggttttgatgagttttttggataaggcggggtcgagtcgttgggacgggcgatgcggtagtacggtcggagggaggttgcgtgggaggttcgtcgtttttgtttggtttttttcggggttttagttatattttttttagttcgttcggttttcgttatattcggcgggttttcgtagttagtgtgggaaacgtgtttgttggagtcgcgtggtgggggtggtttttcggtattttggcgtcggtggggaatttggtaaaagattcgaggtcgttagaggtcggtttcgggggtcgttttggtgttgggtttgtttttggcgttggtttggagttcggcgtttttaattgcgggagggattcg

SEQ ID NO: 20824 - DNA, 822 bp, Artificial Sequence
  chemically treated genomic DNA (Homo sapiens) CpG-island No: 20824
cgaatccctcccgcaattaaaaacgccgaactccaaaccaacgccaaaaacaaacccaacaccaaaacgacccccgaaaccgacctctaacgacctcgaatcttttaccaaattccccaccgacgccaaaataccgaaaaaccacccccaccacgcgactccaacaaacacgtttcccacactaactacgaaaacccgccgaatataacgaaaaccgaacgaactaaaaaaaatataactaaaaccccgaaaaaaaccaaacaaaaacgacgaacctcccacgcaacctccctccgaccgtactaccgcatcgcccgtcccaacgactcgaccccgccttatccaaaaaactcatcaaaaccgatttaccgacgacccaaaaaaaaaataaccgcccgccgcaaccccgccgactacctttcaattcaatactttcgaaaccacaaaaacgaacgaaactaaaaaaaaaaaaaaaacaccccgcgaaaacctcaaacttaaaaactacaaccgcgcgcacctcgccgaccgaaaatcgaacgcgcaaacgcgatacaacgacgcccccaaacgaccgcgcgaaacactacactcgacccgtatatcgaccccgaacgaaaaaaaaaccgcgccgcgaaaaaaaaaccaaccccgcccaacgcccgacgcccgcgacccctcctctccaaacgaaaaaccccgtactaaccgcaaccgcgaaacccgcaacgcacatcccgaaacacaaaacaaaacctatacctacaccgaaacccccatccgactcccgcaacactaacccccctaaacaacctcgaacac

SEQ ID NO: 20825 - DNA, 972 bp, Artificial Sequence
  chemically treated genomic DNA (Homo sapiens) CpG-island No: 20825
gcgtacgttaaatttatcggagtagtttaggaatcgtttgttttagcgtttcgggagataggcgcgtatgcgtaatttttttttttcgcggattagattgtgcgtagtcgtattgcggcggcgcgcgttaggtttcgttttcgtttcgttatatttcggtaggcgcgtttttttgcgcgtgttcgtttgttgagaaggcggaaaggaggggcgggggaggaaggttgagggaagagagggtattttcgggcgttagggtgtattgtgggaaggaggcggtagcgtttcgggcgggcgggaggtgtattagcggcggcggcggcggtaaattttttcggtcgtttatagtattgtggagtcgcgtttttagttcggtttcggatcgcggtattttttttggttttcgcggtttttagttcgttcgtttttttttcgcgcgtcggttttgtcgagtcggtcggtcggtttggttttttttttcggtttcgacgggcgggcggattgttttgaggaggcggggaggggagggttgggtcggtcggcgggcgggcgacgatgtcgaatttttgcgttgtttttaattgtacgcggaagagtacgtagttcgatttggttttttttaggttttcgcgggattttgttaggtaagcggcgggcgtagagcgggcggttcgggtttattttcgcggtgagcgttgttagtcgtcggtttttggcgggttttcgggttggttgagaggggcgtaggaggcgggcgtagcgtattgtcgtcgattttagcgttggatcgagatggggagtcggtttcgagtcgtgggcgggcgggcgttcggggatttcggagtacgtgcgttggtgggggttttgcgcggaggatattattttaaacgcgagggagttggggcggcgcgcggacgcgggatgttgtgggttttcgtcgtggtttatttgttgtgtgatttcgggggagtt

SEQ ID NO: 20826 - DNA, 972 bp, Artificial Sequence
  chemically treated genomic DNA (Homo sapiens) CpG-island No: 20826
aactcccccgaaatcacacaacaaataaaccacgacgaaaacccacaacatcccgcgtccgcgcgccgccccaactccctcgcgtttaaaataatatcctccgcgcaaaacccccaccaacgcacgtactccgaaatccccgaacgcccgcccgcccacgactcgaaaccgactccccatctcgatccaacgctaaaatcgacgacaatacgctacgcccgcctcctacgcccctctcaaccaacccgaaaacccgccaaaaaccgacgactaacaacgctcaccgcgaaaataaacccgaaccgcccgctctacgcccgccgcttacctaacaaaatcccgcgaaaacctaaaaaaaaccaaatcgaactacgtactcttccgcgtacaattaaaaacaacgcaaaaattcgacatcgtcgcccgcccgccgaccgacccaaccctcccctccccgcctcctcaaaacaatccgcccgcccgtcgaaaccgaaaaaaaaaaccaaaccgaccgaccgactcgacaaaaccgacgcgcgaaaaaaaaacgaacgaactaaaaaccgcgaaaaccaaaaaaaataccgcgatccgaaaccgaactaaaaacgcgactccacaatactataaacgaccgaaaaaatttaccgccgccgccgccgctaatacacctcccgcccgcccgaaacgctaccgcctccttcccacaatacaccctaacgcccgaaaataccctctcttccctcaaccttcctcccccgcccctcctttccgccttctcaacaaacgaacacgcgcaaaaaaacgcgcctaccgaaatataacgaaacgaaaacgaaacctaacgcgcgccgccgcaatacgactacgcacaatctaatccgcgaaaaaaaaaaattacgcatacgcgcctatctcccgaaacgctaaaacaaacgattcctaaactactccgataaatttaacgtacgc

SEQ ID NO: 20827 - DNA, 972 bp, Artificial Sequence
  chemically treated genomic DNA (Homo sapiens) CpG-island No: 20827
gattttttcgaggttatatagtaagtgagttacggcgagaatttatagtatttcgcgttcgcgcgtcgttttagttttttcgcgtttggggtggtgtttttcgcgtagagtttttattagcgtacgtgtttcgaggttttcggacgttcgttcgtttacggttcggggtcggttttttatttcggtttaacgttggggtcgacggtagtgcgttgcgttcgttttttgcgttttttttagttagttcgggagttcgttaggggtcggcggttggtagcgtttatcgcgaaggtgggttcgggtcgttcgttttgcgttcgtcgtttatttggtagggtttcgcgggaatttgaagaaggttaagtcggattgcgtgttttttcgcgtgtagttgggggtagcgtagaagttcggtatcgtcgttcgttcgtcggtcggtttagttttttttttttcgtttttttagggtagttcgttcgttcgtcggggtcggggaggggagttaggtcggtcggtcggttcggtagggtcgacgcgcgggggaggggcgggcgggttagaagtcgcgagggttaggaggggtgtcgcggttcgaggtcgggttggggacgcggttttatagtgttgtgagcggtcgggaggatttatcgtcgtcgtcgtcgttggtgtatttttcgttcgttcgagacgttgtcgttttttttttataatgtattttgacgttcgggggtgttttttttttttttagtttttttttttcgtttttttttttcgtttttttagtaggcgggtacgcgtaaggaagcgcgtttgtcggggtgtggcgaggcggaggcgggatttggcgcgcgtcgtcgtagtgcgattgcgtatagtttaattcgcggggagagagaattgcgtatgcgcgtttgtttttcgggacgttagagtaggcggtttttgggttgtttcggtaggtttggcgtgcgt

SEQ ID NO: 20828 - DNA, 972 bp, Artificial Sequence
  chemically treated genomic DNA (Homo sapiens) CpG-island No: 20828
acgcacgccaaacctaccgaaacaacccaaaaaccgcctactctaacgtcccgaaaaacaaacgcgcatacgcaattctctctccccgcgaattaaactatacgcaatcgcactacgacgacgcgcgccaaatcccgcctccgcctcgccacaccccgacaaacgcgcttccttacgcgtacccgcctactaaaaaaacgaaaaaaaaaaacgaaaaaaaaaaactaaaaaaaaaaaaaacacccccgaacgtcaaaatacattataaaaaaaaaacgacaacgtctcgaacgaacgaaaaatacaccaacgacgacgacgacgataaatcctcccgaccgctcacaacactataaaaccgcgtccccaacccgacctcgaaccgcgacacccctcctaaccctcgcgacttctaacccgcccgcccctcccccgcgcgtcgaccctaccgaaccgaccgaccgacctaactcccctccccgaccccgacgaacgaacgaactaccctaaaaaaacgaaaaaaaaaaaactaaaccgaccgacgaacgaacgacgataccgaacttctacgctacccccaactacacgcgaaaaaacacgcaatccgacttaaccttcttcaaattcccgcgaaaccctaccaaataaacgacgaacgcaaaacgaacgacccgaacccaccttcgcgataaacgctaccaaccgccgacccctaacgaactcccgaactaactaaaaaaaacgcaaaaaacgaacgcaacgcactaccgtcgaccccaacgttaaaccgaaataaaaaaccgaccccgaaccgtaaacgaacgaacgtccgaaaacctcgaaacacgtacgctaataaaaactctacgcgaaaaacaccaccccaaacgcgaaaaaactaaaacgacgcgcgaacgcgaaatactataaattctcgccgtaactcacttactatataacctcgaaaaaatc

SEQ ID NO: 20829 - DNA, 577 bp, Artificial Sequence
  chemically treated genomic DNA (Homo sapiens) CpG-island No: 20829
aagattttcgtgttttagttttttttgttttttatttttttcgtttatggttttcgtttttttaagtcgtttttcggaattttttgtcgggtcggcgggaagcgtggacggagcgggttttggtcgcgtttttttcggttaggtttggtttagttcgcgtagcgttcgcgtagttcgttagggggatttcggttcgtcgggcggtatttgaggagaaagcgttcgaggggcgtggagttagggttttgcggtgtttgtttcgggaatattgcgagtcggttggagttttttagtcgtttcggagaattgggggagtcgggtttttggttcggtaatcggtggtttcgcggtagttagaggcgggttttacgggtgggtgtgttcgttttcgtacgttagttttttagttcgggaagagcgtttgtaagcgggtattttgtttttaaagatgggttttgtttgcgggtgatttgggttttcgaagtgtaattttgtggtcgggacgcggatcggtcggtttgggtttttgtagagtagattttgtttgcgttttttaggaggagtgggtggtaggatt

SEQ ID NO: 20830 - DNA, 577 bp, Artificial Sequence
  chemically treated genomic DNA (Homo sapiens) CpG-island No: 20830
aatcctaccacccactcctcctaaaaaacgcaaacaaaatctactctacaaaaacccaaaccgaccgatccgcgtcccgaccacaaaattacacttcgaaaacccaaatcacccgcaaacaaaacccatctttaaaaacaaaatacccgcttacaaacgctcttcccgaactaaaaaactaacgtacgaaaacgaacacacccacccgtaaaacccgcctctaactaccgcgaaaccaccgattaccgaaccaaaaacccgactcccccaattctccgaaacgactaaaaaactccaaccgactcgcaatattcccgaaacaaacaccgcaaaaccctaactccacgcccctcgaacgctttctcctcaaataccgcccgacgaaccgaaatccccctaacgaactacgcgaacgctacgcgaactaaaccaaacctaaccgaaaaaaacgcgaccaaaacccgctccgtccacgcttcccgccgacccgacaaaaaattccgaaaaacgacttaaaaaaacgaaaaccataaacgaaaaaaataaaaaacaaaaaaaactaaaacacgaaaatctt

SEQ ID NO: 20831 - DNA, 577 bp, Artificial Sequence
  chemically treated genomic DNA (Homo sapiens) CpG-island No: 20831
agttttgttatttattttttttggaggacgtagataggatttgttttgtaggagtttaggtcggtcgattcgcgtttcggttataaagttgtatttcgagagtttaaattattcgtagataaaatttatttttgggaataaagtattcgtttgtaggcgtttttttcgggttggaaggttggcgtgcggaaacggatatatttattcgtggggttcgtttttagttatcgcgggattatcggttatcgagttagggattcggtttttttagtttttcggagcggttggggagttttagtcgattcgtagtattttcggagtaggtatcgtaggattttggttttacgtttttcggacgttttttttttagatgtcgttcggcgggtcggggtttttttggcgggttgcgcgggcgttgcgcgagttaaattaaatttggtcggaaaagacgcggttaaggttcgtttcgtttacgtttttcgtcggttcggtaaggggtttcggagaacggtttgggggggcgagaattatgggcgggggaaatggaagatagagggaattgaagtacgggggtttt

SEQ ID NO: 20832 - DNA, 577 bp, Artificial Sequence
  chemically treated genomic DNA (Homo sapiens) CpG-island No: 20832
aaaacccccgtacttcaattccctctatcttccatttcccccgcccataattctcgcccccccaaaccgttctccgaaaccccttaccgaaccgacgaaaaacgtaaacgaaacgaaccttaaccgcgtcttttccgaccaaatttaatttaactcgcgcaacgcccgcgcaacccgccaaaaaaaccccgacccgccgaacgacatctaaaaaaaaaacgtccgaaaaacgtaaaaccaaaatcctacgatacctactccgaaaatactacgaatcgactaaaactccccaaccgctccgaaaaactaaaaaaaccgaatccctaactcgataaccgataatcccgcgataactaaaaacgaaccccacgaataaatatatccgtttccgcacgccaaccttccaacccgaaaaaaacgcctacaaacgaatactttattcccaaaaataaattttatctacgaataatttaaactctcgaaatacaactttataaccgaaacgcgaatcgaccgacctaaactcctacaaaacaaatcctatctacgtcctccaaaaaaaataaataacaaaact

SEQ ID NO: 20833 - DNA, 609 bp, Artificial Sequence
  chemically treated genomic DNA (Homo sapiens) CpG-island No: 20833
cggggtcgtaggcgcgtagttacgtttttggaagttcgtttcggttttcgtttttaattcgttttttcggggttttatggcgtgaggtttggggttgggatttatttggagtcgagtagaaaattttttttttttcgttttcggttttttttgttttttttggacgcggtggcggcgtcgtttgagcggcgatttttttttttttgttcggtttgttgcgttcggtgtttttcgagggtaggcgcgtttggattttgcgttcggatggcggcggttttttgtgagtatcggtagcggcgtattttttgtttcgaggttttcggtgttttttcggcgcgggtataggggcgtttttatttttcgttcgtttgtattttttgttattcgttttttcgtttgatttattcgttcgcggtggtcgttcgagttttgggatggggagggagatcgcggttgttcgcggcggtcgagattttcgttgacgttttcgattttgtcgtttttttcgttcgtttttagaggcgttcgacgtttcgatagtttttggagtgagattaggattgagaatagggagaggcgattcgatttttagggttcggtgtttaggat

SEQ ID NO: 20834 - DNA, 609 bp, Artificial Sequence
  chemically treated genomic DNA (Homo sapiens) CpG-island No: 20834
atcctaaacaccgaaccctaaaaatcgaatcgcctctccctattctcaatcctaatctcactccaaaaactatcgaaacgtcgaacgcctctaaaaacgaacgaaaaaaacgacaaaatcgaaaacgtcaacgaaaatctcgaccgccgcgaacaaccgcgatctccctccccatcccaaaactcgaacgaccaccgcgaacgaataaatcaaacgaaaaaacgaataacaaaaaatacaaacgaacgaaaaataaaaacgcccctatacccgcgccgaaaaaacaccgaaaacctcgaaacaaaaaatacgccgctaccgatactcacaaaaaaccgccgccatccgaacgcaaaatccaaacgcgcctaccctcgaaaaacaccgaacgcaacaaaccgaacaaaaaaaaaaaaatcgccgctcaaacgacgccgccaccgcgtccaaaaaaaacaaaaaaaaccgaaaacgaaaaaaaaaaaattttctactcgactccaaataaatcccaaccccaaacctcacgccataaaaccccgaaaaaacgaattaaaaacgaaaaccgaaacgaacttccaaaaacgtaactacgcgcctacgaccccg

SEQ ID NO: 20835 - DNA, 609 bp, Artificial Sequence
  chemically treated genomic DNA (Homo sapiens) CpG-island No: 20835
gttttgagtatcgggttttgggggtcgggtcgtttttttttgtttttagttttggttttattttaggagttgtcgggacgtcgggcgtttttggaggcggacgaagaaggcggtagggtcgggggcgttagcgggaatttcggtcgtcgcgggtagtcgcggtttttttttttattttagggttcgggcggttatcgcgggcggatgagttaggcgagggggcgggtggtaaggggtgtaagcggacggagggtgggggcgtttttatgttcgcgtcgggggggtatcggaggtttcggggtaggggatgcgtcgttgtcggtgtttatagagggtcgtcgttattcgggcgtagagtttaggcgcgtttgttttcggagggtatcgggcgtagtaagtcgggtaggggagagggagtcgtcgtttaggcggcgtcgttatcgcgtttaagaaagataaaagggatcgggaacgggaggggaaaagttttttgttcggttttagatggattttagttttaaattttacgttataaagtttcgaagaggcgggttgggggcgggggtcggggcggatttttaggggcgtggttgcgcgtttgcgatttcg

SEQ ID NO: 20836 - DNA, 609 bp, Artificial Sequence
  chemically treated genomic DNA (Homo sapiens) CpG-island No: 20836
cgaaatcgcaaacgcgcaaccacgcccctaaaaatccgccccgacccccgcccccaacccgcctcttcgaaactttataacgtaaaatttaaaactaaaatccatctaaaaccgaacaaaaaacttttcccctcccgttcccgatcccttttatctttcttaaacgcgataacgacgccgcctaaacgacgactccctctcccctacccgacttactacgcccgataccctccgaaaacaaacgcgcctaaactctacgcccgaataacgacgaccctctataaacaccgacaacgacgcatcccctaccccgaaacctccgatacccccccgacgcgaacataaaaacgcccccaccctccgtccgcttacaccccttaccacccgccccctcgcctaactcatccgcccgcgataaccgcccgaaccctaaaataaaaaaaaaaaccgcgactacccgcgacgaccgaaattcccgctaacgcccccgaccctaccgccttcttcgtccgcctccaaaaacgcccgacgtcccgacaactcctaaaataaaaccaaaactaaaaacaaaaaaaaacgacccgacccccaaaacccgatactcaaaac

SEQ ID NO: 20837 - DNA, 632 bp, Artificial Sequence
  chemically treated genomic DNA (Homo sapiens) CpG-island No: 20837
gaaaagtcggtgttcgtttacgtagttttggcgcgtacgggttcggcgttcgtatttttgcgttacgcgggttcggggtgattagtaagtatttcgaaaagggacggggttggggagattatttaggagggttcgcggggtggcgtaggggttttcgggcgagttgatttttcggaatgtttggttgatggcgagaggtggatattagagattgggttcgttttgtaaaaagaaaaatgggtcgacggggcgtaggggatattaagagagttattcgttaaagtatttgtttttcgggttttcgttgatttttttttatcgttttcgtggggtgaggatacgcgtttttcgagcgtttgttttgagttggttttacgttcgtttcggagggaggtgagcgcggcgtcggcggggtcggtaggttggtgcgtcgcgttcgttttcgttgttttcgggtttttttttgtcgcggttgttagggggtttatagaggcgtttttttcgttgtcgcggcgttttttcggtcggtcgtttgggggcggtgtgcgtatttttattaaggggttcggggaggatagttgttttttattcgaattttaaggaaatttattcgtatttagtttttataagtt

SEQ ID NO: 20838 - DNA, 632 bp, Artificial Sequence
  chemically treated genomic DNA (Homo sapiens) CpG-island No: 20838
aacttataaaaactaaatacgaataaatttccttaaaattcgaataaaaaacaactatcctccccgaaccccttaataaaaatacgcacaccgcccccaaacgaccgaccgaaaaaacgccgcgacaacgaaaaaaacgcctctataaaccccctaacaaccgcgacaaaaaaaaacccgaaaacaacgaaaacgaacgcgacgcaccaacctaccgaccccgccgacgccgcgctcacctccctccgaaacgaacgtaaaaccaactcaaaacaaacgctcgaaaaacgcgtatcctcaccccacgaaaacgataaaaaaaaatcaacgaaaacccgaaaaacaaatactttaacgaataactctcttaatatcccctacgccccgtcgacccatttttctttttacaaaacgaacccaatctctaatatccacctctcgccatcaaccaaacattccgaaaaatcaactcgcccgaaaacccctacgccaccccgcgaaccctcctaaataatctccccaaccccgtcccttttcgaaatacttactaatcaccccgaacccgcgtaacgcaaaaatacgaacgccgaacccgtacgcgccaaaactacgtaaacgaacaccgacttttc

SEQ ID NO: 20839 - DNA, 632 bp, Artificial Sequence
  chemically treated genomic DNA (Homo sapiens) CpG-island No: 20839
ggtttgtggaaattggatacgagtaagtttttttaaaattcgagtagaaagtagttgtttttttcgggttttttgatgagaatacgtatatcgtttttaagcggtcggtcgagggagcgtcgcggtagcgggagaggcgtttttgtgggttttttggtagtcgcggtaggaaagggttcgaaggtagcgaaggcgaacgcggcgtattaatttgtcggtttcgtcgacgtcgcgtttattttttttcggggcgggcgtggggttagtttaggataggcgttcgggggacgcgtgtttttattttacggggacggtggaggagagttagcgagggttcgaggggtaggtattttaacgaatggtttttttggtgttttttgcgtttcgtcggtttatttttttttttataaaacgggtttagtttttagtatttatttttcgttattaattaggtatttcgggagattagttcgttcgaaagtttttgcgttatttcgcgggtttttttaggtggtttttttagtttcgttttttttcgggatgtttgttgattatttcgagttcgcgtggcgtaagagtacgagcgtcgagttcgtgcgcgttaaggttgcgtgggcgggtatcgatttttt

SEQ ID NO: 20840 - DNA, 632 bp, Artificial Sequence
  chemically treated genomic DNA (Homo sapiens) CpG-island No: 20840
aaaaaatcgatacccgcccacgcaaccttaacgcgcacgaactcgacgctcgtactcttacgccacgcgaactcgaaataatcaacaaacatcccgaaaaaaaacgaaactaaaaaaaccacctaaaaaaacccgcgaaataacgcaaaaactttcgaacgaactaatctcccgaaatacctaattaataacgaaaaataaatactaaaaactaaacccgttttataaaaaaaaaaataaaccgacgaaacgcaaaaaacaccaaaaaaaccattcgttaaaatacctacccctcgaaccctcgctaactctcctccaccgtccccgtaaaataaaaacacgcgtcccccgaacgcctatcctaaactaaccccacgcccgccccgaaaaaaaataaacgcgacgtcgacgaaaccgacaaattaatacgccgcgttcgccttcgctaccttcgaaccctttcctaccgcgactaccaaaaaacccacaaaaacgcctctcccgctaccgcgacgctccctcgaccgaccgcttaaaaacgatatacgtattctcatcaaaaaacccgaaaaaaacaactactttctactcgaattttaaaaaaacttactcgtatccaatttccacaaacc

SEQ ID NO: 20841 - DNA, 1390 bp, Artificial Sequence
  chemically treated genomic DNA (Homo sapiens) CpG-island No: 20841
cgtttgtacggagttatagaatatagcgttatcgttcgttcgagtttaggtattttttttttttttcggggtttgcgtcgtttgtacgttttttcgtagattttcgcggaaacgtgtatagtagggttttgaatagaatttaggttgttttgagtcgaatttttttcggttcggggttgatcgtgtttatttaagtcgtcgtttcgtttttcgtattttcgacgcggggttatttttttttatttttttttttatttaggcgtttttttcgatagcggagggatagttaaaaatttataattcggcggcgggattttgtcggttttagttgggcgatttgggcgtattcgtcggcgacgtagtttcgggttttagcgtatagaattcggtcgttcgtagtttttttcgttagttacgttttttgggttttttattggttaagtcgttcgcgttttcgcgtgattttattggtttgcgtcgggggtttagataaagggagtagtcgcggagggcggtgattgggcggggttgggggcgggtcgggcgggcgcgcgggtcgggcgggagtcgcgcgttggagaggcggggagtacggcgttgggggaggggcgcggtgtttcgggttcgggatcgggaggcgcgggtgtgcggcgaggttcgggtgttttttttcgtgggggcggggcggcgggggcggggcggttttacgtgggtggggttgggcgtttcggagggcggcggtcgcggggcgcggggcgttgggatttcgttcgttttttcgttttgtatttttttcgtttcggggtttttgttcggacggcggtcgtcgtcgtttcgtttttttcgagggtttcgcgttcgttttcgtagttcggtcgggaatttgggaattcggacgtagaaggacgcgttcgagttaggattcgtcgcggggtttttttggtgggtcgtggtcggggagaggacgcgggttttggcggtcgaagacggacgtagcgttcggaaaggcgagttaggttttcggtttttggcgttttttgtgagttggttcggcggggtgcgtcgtcggggagggagggattggtcgtggggcgagtagtcgggcggggagtggtttttgggggttttcgttagcggagggttcgcgaggtcgttttcggagcgtcgttaggtacgtgcgttttttttgtttttcgcgtttttagagcgtattttcggtagggaacgaataaaatttcggttggtgtgtaagagtttttcgttgtaaacgtgtttttttgcgggattcggggagtcgtcgaacgcggggtagatttcggtttaaagtgtttttgtagtttttattagggatttttttttatttttattttgggttcggagcgggtgttag

SEQ ID NO: 20842 - DNA, 1390 bp, Artificial Sequence
  chemically treated genomic DNA (Homo sapiens) CpG-island No: 20842
ctaacacccgctccgaacccaaaataaaaataaaaaaaaatccctaataaaaactacaaaaacactttaaaccgaaatctaccccgcgttcgacgactccccgaatcccgcaaaaaaacacgtttacaacgaaaaactcttacacaccaaccgaaattttattcgttccctaccgaaaatacgctctaaaaacgcgaaaaacaaaaaaaacgcacgtacctaacgacgctccgaaaacgacctcgcgaaccctccgctaacgaaaacccccaaaaaccactccccgcccgactactcgccccacgaccaatccctccctccccgacgacgcaccccgccgaaccaactcacaaaaaacgccaaaaaccgaaaacctaactcgcctttccgaacgctacgtccgtcttcgaccgccaaaacccgcgtcctctccccgaccacgacccaccaaaaaaaccccgcgacgaatcctaactcgaacgcgtccttctacgtccgaattcccaaattcccgaccgaactacgaaaacgaacgcgaaaccctcgaaaaaaacgaaacgacgacgaccgccgtccgaacaaaaaccccgaaacgaaaaaaatacaaaacgaaaaaacgaacgaaatcccaacgccccgcgccccgcgaccgccgccctccgaaacgcccaaccccacccacgtaaaaccgccccgcccccgccgccccgcccccacgaaaaaaaacacccgaacctcgccgcacacccgcgcctcccgatcccgaacccgaaacaccgcgcccctcccccaacgccgtactccccgcctctccaacgcgcgactcccgcccgacccgcgcgcccgcccgacccgcccccaaccccgcccaatcaccgccctccgcgactactccctttatctaaacccccgacgcaaaccaataaaatcacgcgaaaacgcgaacgacttaaccaataaaaaacccaaaaaacgtaactaacgaaaaaaactacgaacgaccgaattctatacgctaaaacccgaaactacgtcgccgacgaatacgcccaaatcgcccaactaaaaccgacaaaatcccgccgccgaattataaatttttaactatccctccgctatcgaaaaaaacgcctaaataaaaaaaaaaataaaaaaaaataaccccgcgtcgaaaatacgaaaaacgaaacgacgacttaaataaacacgatcaaccccgaaccgaaaaaaattcgactcaaaacaacctaaattctattcaaaaccctactatacacgtttccgcgaaaatctacgaaaaaacgtacaaacgacgcaaaccccgaaaaaaaaaaaaaatacctaaactcgaacgaacgataacgctatattctataactccgtacaaacg

SEQ ID NO: 20843 - DNA, 1390 bp, Artificial Sequence
  chemically treated genomic DNA (Homo sapiens) CpG-island No: 20843
ttggtattcgtttcgagtttaaggtgagggtggagaagggtttttggtggaagttgtaggaatattttgggtcggggtttatttcgcgttcggcggtttttcgaatttcgtagaaagatacgtttgtagcgaaaggtttttatatattagtcgggattttattcgttttttatcgagagtgcgttttgggagcgcgggaaataaggaaaacgtacgtatttggcggcgtttcgagggcggtttcgcgggtttttcgttggcgaaggtttttagaagttatttttcgttcggttgttcgttttacggttagttttttttttttcggcgacgtatttcgtcgagttagtttataggaagcgttaggagtcggagatttggttcgttttttcgggcgttgcgttcgttttcgatcgttagggttcgcgtttttttttcggttacggtttattagagggatttcgcggcgggttttggttcgggcgcgtttttttgcgttcgagtttttaggttttcggtcgagttgcggagacggacgcggagttttcggggaagacgaggcggcggcggtcgtcgttcgggtaggagtttcggggcgggaggggtgtagggcggaggagcgggcgggattttagcgtttcgcgtttcgcggtcgtcgtttttcggggcgtttagttttatttacgtggaatcgtttcgttttcgtcgtttcgtttttacgagggaaggtattcgagtttcgtcgtatattcgcgtttttcggtttcgggttcgaaatatcgcgttttttttttagcgtcgtgtttttcgtttttttagcgcgcggttttcgttcgattcgcgcgttcgttcgattcgtttttaatttcgtttaattatcgtttttcgcggttgttttttttgtttgagttttcggcgtaggttaatggaattacgcggaggcgcgggcggtttggttaatggaaggtttagggggcgtggttggcgggaggggttgcgggcggtcgggttttatgcgttgagattcgagattgcgtcgtcggcgggtgcgtttaggtcgtttagttagagtcggtaggatttcgtcgtcgggttgtgggtttttgattattttttcgttgtcgggagaagcgtttgagtggggagggaggtgggaggaggtggtttcgcgtcgggggtgcggggagcgggacggcggtttggatggatacggttagtttcgggtcggagagggttcggtttagagtagtttgggttttgtttagagttttattgtgtacgttttcgcgaggatttgcggagagacgtgtaggcgacgtaggtttcgggaaggaaggagggtatttgggttcggacgagcgataacgttgtgttttgtgatttcgtataaacg

SEQ ID NO: 20844 - DNA, 1390 bp, Artificial Sequence
  chemically treated genomic DNA (Homo sapiens) CpG-island No: 20844
cgtttatacgaaatcacaaaacacaacgttatcgctcgtccgaacccaaataccctccttccttcccgaaacctacgtcgcctacacgtctctccgcaaatcctcgcgaaaacgtacacaataaaactctaaacaaaacccaaactactctaaaccgaaccctctccgacccgaaactaaccgtatccatccaaaccgccgtcccgctccccgcacccccgacgcgaaaccacctcctcccacctccctccccactcaaacgcttctcccgacaacgaaaaaataatcaaaaacccacaacccgacgacgaaatcctaccgactctaactaaacgacctaaacgcacccgccgacgacgcaatctcgaatctcaacgcataaaacccgaccgcccgcaacccctcccgccaaccacgccccctaaaccttccattaaccaaaccgcccgcgcctccgcgtaattccattaacctacgccgaaaactcaaacaaaaaaaacaaccgcgaaaaacgataattaaacgaaattaaaaacgaatcgaacgaacgcgcgaatcgaacgaaaaccgcgcgctaaaaaaacgaaaaacacgacgctaaaaaaaaaacgcgatatttcgaacccgaaaccgaaaaacgcgaatatacgacgaaactcgaataccttccctcgtaaaaacgaaacgacgaaaacgaaacgattccacgtaaataaaactaaacgccccgaaaaacgacgaccgcgaaacgcgaaacgctaaaatcccgcccgctcctccgccctacacccctcccgccccgaaactcctacccgaacgacgaccgccgccgcctcgtcttccccgaaaactccgcgtccgtctccgcaactcgaccgaaaacctaaaaactcgaacgcaaaaaaacgcgcccgaaccaaaacccgccgcgaaatccctctaataaaccgtaaccgaaaaaaaaacgcgaaccctaacgatcgaaaacgaacgcaacgcccgaaaaaacgaaccaaatctccgactcctaacgcttcctataaactaactcgacgaaatacgtcgccgaaaaaaaaaaaactaaccgtaaaacgaacaaccgaacgaaaaataacttctaaaaaccttcgccaacgaaaaacccgcgaaaccgccctcgaaacgccgccaaatacgtacgttttccttatttcccgcgctcccaaaacgcactctcgataaaaaacgaataaaatcccgactaatatataaaaacctttcgctacaaacgtatctttctacgaaattcgaaaaaccgccgaacgcgaaataaaccccgacccaaaatattcctacaacttccaccaaaaacccttctccaccctcaccttaaactcgaaacgaataccaa

SEQ ID NO: 20845 - DNA, 1141 bp, Artificial Sequence
  chemically treated genomic DNA (Homo sapiens) CpG-island No: 20845
tggtttcgcggttttaaagcggtttaaggtcgtttgatgaaaggagataagttggggatcgtttttaggattttcgcgggtcgatcggggtagttcgggagtcgaggtgcggcggagagttcgcggattaaaggaatttggagagaaaggggaagcgggcggtcggtttcggtcggttttttttttcgtaggttacgtcgatttggggtggggggttgcgggtcgcgggcggggatttcgggatttttcgtttgtttgagtcggggtttacgtcggcgttcgtttcgggcggttcggttcggaggggagtttcggagagttcggggttcgtaggtaagtatcggcgtttcgcgggtcgggtcggggacgtaggataaggcgcggggtttatttcggttggttcgggagtggcggtcgcgcgggttcggttttcgttttcggcgtttttcggtttcggcggtcgggatttttcgcggtcgagtttttggttaggttttaggtcggcgttttcggaagcgacgtttggcgggtcgcggggtacgagggggagagtcgggaagcgtaaattttcgaagcgcgcggagattcgattagcgcgcggttatttattaggttgggggcgattgaattaggtttttgggcgcggtcgtcggttgggggtgtgtggcgtcgattttcgggtttttgtcgtggtttcgggaggttggagtagcgagtagcggttttagcgagtgtgtcgggaaagcgggtgttttcgggtttcggtttcgcgggtataggcggaggttgttcgtttttcgcgtatatcgaggacggtcggttcggtttcggagaaatggcgtttgagaaaggaggggaggggaaggttttcggattttgggtagggattcgtcgtcggggattcgcggagtttttcggggatggaggaggcgcgagttggaagcggcgcgcgagttcgagcgcggggttaatatcgtggggtttagttttttttggttcgggtaagtggacgcgtttcgaggtttcgggtttacgtagggcgtttttcgtagacggcgtattttttatttttttaaggaatcgagtttttattattgttttcgatgagtttgttttcggattaggaattttttttaagtta

SEQ ID NO: 20846 - DNA, 1141 bp, Artificial Sequence
  chemically treated genomic DNA (Homo sapiens) CpG-island No: 20846
taacttaaaaaaaattcctaatccgaaaacaaactcatcgaaaacaataataaaaactcgattccttaaaaaaataaaaaatacgccgtctacgaaaaacgccctacgtaaacccgaaacctcgaaacgcgtccacttacccgaaccaaaaaaaactaaaccccacgatattaaccccgcgctcgaactcgcgcgccgcttccaactcgcgcctcctccatccccgaaaaactccgcgaatccccgacgacgaatccctacccaaaatccgaaaaccttcccctcccctcctttctcaaacgccatttctccgaaaccgaaccgaccgtcctcgatatacgcgaaaaacgaacaacctccgcctatacccgcgaaaccgaaacccgaaaacacccgctttcccgacacactcgctaaaaccgctactcgctactccaacctcccgaaaccacgacaaaaacccgaaaatcgacgccacacacccccaaccgacgaccgcgcccaaaaacctaattcaatcgcccccaacctaataaataaccgcgcgctaatcgaatctccgcgcgcttcgaaaatttacgcttcccgactctccccctcgtaccccgcgacccgccaaacgtcgcttccgaaaacgccgacctaaaacctaaccaaaaactcgaccgcgaaaaatcccgaccgccgaaaccgaaaaacgccgaaaacgaaaaccgaacccgcgcgaccgccactcccgaaccaaccgaaataaaccccgcgccttatcctacgtccccgacccgacccgcgaaacgccgatacttacctacgaaccccgaactctccgaaactcccctccgaaccgaaccgcccgaaacgaacgccgacgtaaaccccgactcaaacaaacgaaaaatcccgaaatccccgcccgcgacccgcaaccccccaccccaaatcgacgtaacctacgaaaaaaaaaaccgaccgaaaccgaccgcccgcttcccctttctctccaaattcctttaatccgcgaactctccgccgcacctcgactcccgaactaccccgatcgacccgcgaaaatcctaaaaacgatccccaacttatctcctttcatcaaacgaccttaaaccgctttaaaaccgcgaaacca

SEQ ID NO: 20847 - DNA, 1141 bp, Artificial Sequence
  chemically treated genomic DNA (Homo sapiens) CpG-island No: 20847
taatttgaaaaaggtttttgattcggaaataggtttatcggaggtagtgatgggaattcggttttttaggagagtaggaaatgcgtcgtttgcgaggggcgttttgcgtggattcggggtttcggggcgcgtttatttattcgagttaggagagattgggttttacggtgttagtttcgcgttcgggttcgcgcgtcgtttttagttcgcgttttttttattttcggagggtttcgcgggttttcggcgacgggtttttgtttagggttcgggaattttttttttttttttttttttaagcgttattttttcggagtcgggtcggtcgttttcggtgtacgcgggaagcgggtagttttcgtttgtattcgcggggtcgggattcggaggtattcgttttttcgatatattcgttggggtcgttgttcgttgttttagtttttcgaggttacggtaagagttcgggggtcggcgttatatatttttagtcggcgatcgcgtttagggatttaatttaatcgtttttagtttaatgaatagtcgcgcgttaatcggattttcgcgcgtttcggggatttacgtttttcggttttttttttcgtgtttcgcggttcgttagacgtcgttttcgaaggcgtcggtttggggtttggttaggggttcggtcgcggggggtttcggtcgtcggagtcgggagacgtcggagacgggagtcgggttcgcgcgatcgttattttcgagttagtcggggtgggtttcgcgttttgttttgcgttttcggttcggttcgcggagcgtcggtgtttatttgcgagtttcgggtttttcggagttttttttcgggtcgagtcgttcgaagcgggcgtcggcgtaggtttcgatttaggtaggcgggaaatttcggagttttcgttcgcggttcgtagttttttattttaggtcggcgtggtttgcgggggggaaggtcggtcggggtcggtcgttcgttttttttttttttttagatttttttgattcgcgggtttttcgtcgtatttcggttttcgggttgtttcggtcggttcgcggggattttggaaacggtttttagtttatttttttttattaagcggttttgggtcgttttgaaatcgcggagtta

SEQ ID NO: 20848 - DNA, 1141 bp, Artificial Sequence
  chemically treated genomic DNA (Homo sapiens) CpG-island No: 20848
taactccgcgatttcaaaacgacccaaaaccgcttaataaaaaaaaataaactaaaaaccgtttccaaaatccccgcgaaccgaccgaaacaacccgaaaaccgaaatacgacgaaaaacccgcgaatcaaaaaaatctaaaaaaaaaaaaaaaacgaacgaccgaccccgaccgaccttcccccccgcaaaccacgccgacctaaaataaaaaactacgaaccgcgaacgaaaactccgaaatttcccgcctacctaaatcgaaacctacgccgacgcccgcttcgaacgactcgacccgaaaaaaaactccgaaaaacccgaaactcgcaaataaacaccgacgctccgcgaaccgaaccgaaaacgcaaaacaaaacgcgaaacccaccccgactaactcgaaaataacgatcgcgcgaacccgactcccgtctccgacgtctcccgactccgacgaccgaaaccccccgcgaccgaacccctaaccaaaccccaaaccgacgccttcgaaaacgacgtctaacgaaccgcgaaacacgaaaaaaaaaaccgaaaaacgtaaatccccgaaacgcgcgaaaatccgattaacgcgcgactattcattaaactaaaaacgattaaattaaatccctaaacgcgatcgccgactaaaaatatataacgccgacccccgaactcttaccgtaacctcgaaaaactaaaacaacgaacaacgaccccaacgaatatatcgaaaaaacgaatacctccgaatcccgaccccgcgaatacaaacgaaaactacccgcttcccgcgtacaccgaaaacgaccgacccgactccgaaaaaataacgcttaaaaaaaaaaaaaaaaaaaaaattcccgaaccctaaacaaaaacccgtcgccgaaaacccgcgaaaccctccgaaaataaaaaaaacgcgaactaaaaacgacgcgcgaacccgaacgcgaaactaacaccgtaaaacccaatctctcctaactcgaataaataaacgcgccccgaaaccccgaatccacgcaaaacgcccctcgcaaacgacgcatttcctactctcctaaaaaaccgaattcccatcactacctccgataaacctatttccgaatcaaaaacctttttcaaatta

SEQ ID NO: 20849 - DNA, 910 bp, Artificial Sequence
  chemically treated genomic DNA (Homo sapiens) CpG-island No: 20849
ttcgcgaggtcgcggcgtattttggtttttttttttcgttataatagtcgttttgttttcgtagaaagcgtttcgttgttttagtttcggaacgttttagggaggtgaatgtagaatgtagaaaagaggttttcgtggaatttagatttgtaggagggggcgggggagggtggcgaggcgcggaaaggttttaattttagtcggtttcggggttgttttttcgagattttcgggggagggtggttagggaagggtttttttaagtcgcggcgacgtagtttggggggttggcgggacgcgcggtttcgtttagcgtttaggtagttatcgcggtcggggtcgggaaatgaaattaaagtttttttgttttcgggagcggaggggtgggcgttttgtttcgttttcgaacgttttcgtttcgcgttcgtttcggtcgagtattgatttgtgtgcgaagttatgggtaacggcgacgggaagtattttttcggttggaagtgtgcggggggttgcgcggcgggtttagtcggggcgagacgcgcggcggtagcggcgttgcggtggtttaggttttcgcgtttcgatagtagatgcggcggcggcgtaaagtcgcggttatttatgtcgggtttcggtttcggttcgtcgtcgttttttcggagtagcgcggtcggggttcgggggcggttcggcgcgcgggcggcgtagaggcggcggcgttcggggttataggcggtggtggcggcggggtcggttagtacgcgggaggattgggtttttcggcgggcggtcgcgtatcgagttagcggtcgttgtgcgggtttatggtttgtggaggtaaaagtagaggagatacgggtgattggggggttcggttcgttcgggggttttcgtttcgttcgtttattta

SEQ ID NO: 20850 - DNA, 910 bp, Artificial Sequence
  chemically treated genomic DNA (Homo sapiens) CpG-island No: 20850
taaataaacgaacgaaacgaaaacccccgaacgaaccgaaccccccaatcacccgtatctcctctacttttacctccacaaaccataaacccgcacaacgaccgctaactcgatacgcgaccgcccgccgaaaaacccaatcctcccgcgtactaaccgaccccgccgccaccaccgcctataaccccgaacgccgccgcctctacgccgcccgcgcgccgaaccgcccccgaaccccgaccgcgctactccgaaaaaacgacgacgaaccgaaaccgaaacccgacataaataaccgcgactttacgccgccgccgcatctactatcgaaacgcgaaaacctaaaccaccgcaacgccgctaccgccgcgcgtctcgccccgactaaacccgccgcgcaaccccccgcacacttccaaccgaaaaaatacttcccgtcgccgttacccataacttcgcacacaaatcaatactcgaccgaaacgaacgcgaaacgaaaacgttcgaaaacgaaacaaaacgcccacccctccgctcccgaaaacaaaaaaactttaatttcatttcccgaccccgaccgcgataactacctaaacgctaaacgaaaccgcgcgtcccgccaaccccccaaactacgtcgccgcgacttaaaaaaacccttccctaaccaccctcccccgaaaatctcgaaaaaacaaccccgaaaccgactaaaattaaaacctttccgcgcctcgccaccctcccccgccccctcctacaaatctaaattccacgaaaacctcttttctacattctacattcacctccctaaaacgttccgaaactaaaacaacgaaacgctttctacgaaaacaaaacgactattataacgaaaaaaaaaaaccaaaatacgccgcgacctcgcgaa

SEQ ID NO: 20851 - DNA, 910 bp, Artificial Sequence
  chemically treated genomic DNA (Homo sapiens) CpG-island No: 20851
tgggtgagcgggcggggcggggattttcgggcgagtcgagttttttagttattcgtgttttttttgtttttgtttttatagattatggattcgtatagcggtcgttggttcggtgcgcggtcgttcgtcgagaagtttagttttttcgcgtgttgatcggtttcgtcgttattatcgtttgtgatttcggacgtcgtcgtttttgcgtcgttcgcgcgtcgagtcgttttcgggtttcggtcgcgttgtttcgaggaagcggcggcggatcggggtcggggttcggtatggatggtcgcgattttgcgtcgtcgtcgtatttgttgtcggagcgcgggagtttgggttatcgtagcgtcgttgtcgtcgcgcgtttcgtttcggttgggttcgtcgcgtagtttttcgtatatttttagtcgggaaagtatttttcgtcgtcgttgtttatggtttcgtatataggttagtgttcggtcggggcgggcgcgggacgggagcgttcgagagcggaatagggcgtttattttttcgttttcgggagtagagaagttttggttttatttttcggtttcggtcgcggtggttgtttgggcgttgagcggggtcgcgcgtttcgttagttttttaggttgcgtcgtcgcggtttagagaggtttttttttggttattttttttcgggggtttcggaggggtagtttcggagtcggttgaaattaaagttttttcgcgtttcgttattttttttcgtttttttttgtagatttaaattttacggaaattttttttttgtattttgtatttatttttttaagacgtttcggggttgggataacgaggcgttttttgcggaaataaaacggttgttgtggcggggggaggggattagggtacgtcgcggtttcgcgga

SEQ ID NO: 20852 - DNA, 910 bp, Artificial Sequence
  chemically treated genomic DNA (Homo sapiens) CpG-island No: 20852
tccgcgaaaccgcgacgtaccctaatcccctccccccgccacaacaaccgttttatttccgcaaaaaacgcctcgttatcccaaccccgaaacgtcttaaaaaaataaatacaaaatacaaaaaaaaaatttccgtaaaatttaaatctacaaaaaaaaacgaaaaaaaataacgaaacgcgaaaaaactttaatttcaaccgactccgaaactacccctccgaaacccccgaaaaaaaataaccaaaaaaaaacctctctaaaccgcgacgacgcaacctaaaaaactaacgaaacgcgcgaccccgctcaacgcccaaacaaccaccgcgaccgaaaccgaaaaataaaaccaaaacttctctactcccgaaaacgaaaaaataaacgccctattccgctctcgaacgctcccgtcccgcgcccgccccgaccgaacactaacctatatacgaaaccataaacaacgacgacgaaaaatactttcccgactaaaaatatacgaaaaactacgcgacgaacccaaccgaaacgaaacgcgcgacgacaacgacgctacgataacccaaactcccgcgctccgacaacaaatacgacgacgacgcaaaatcgcgaccatccataccgaaccccgaccccgatccgccgccgcttcctcgaaacaacgcgaccgaaacccgaaaacgactcgacgcgcgaacgacgcaaaaacgacgacgtccgaaatcacaaacgataataacgacgaaaccgatcaacacgcgaaaaaactaaacttctcgacgaacgaccgcgcaccgaaccaacgaccgctatacgaatccataatctataaaaacaaaaacaaaaaaaacacgaataactaaaaaactcgactcgcccgaaaatccccgccccgcccgctcaccca

SEQ ID NO: 20853 - DNA, 625 bp, Artificial Sequence
  chemically treated genomic DNA (Homo sapiens) CpG-island No: 20853
gtcgttcgtttttttttcgcgtgggtagggggtagtcgcgacgtcggtttagcgttttcgagtcgggaatcgtatagtattcggcgatggtttcgagtttcgcgcgttcgaagttacggcgtcgttcgttgggggtttcgggacggtagggacggttgggggtggcgcggatcgcgttttcgaggcgcgtagcgcgcgatcgaattacgcgtttcgttcgttgcggttttttaatagtttttcgcgtcgttttacgtggggtcgtacgggttggcggtttttttattcgattggtcgtcgtatagttaattagagagcggaggcgatagcggtcgcgtcgattggttgcggcgggtcggttcgggggagggggcgggattttttttgtttttttcgtattttcgggttcgcgcgattgtgagcgttttcgtttcggagtaggggttcgcgttgggggttcggagggcgggggcgcggttcgacgttttatttttagtttgtttattgtcgttagggtttagcgtttgaagcgcgggtttttcgttgggacgagcgtttttattttcgttttttagtttttttttttttgttttttttttgtgttttgggagttatggggaagttt

SEQ ID NO: 20854 - DNA, 625 bp, Artificial Sequence
  chemically treated genomic DNA (Homo sapiens) CpG-island No: 20854
aaacttccccataactcccaaaacacaaaaaaaaaacaaaaaaaaaaaaactaaaaaacgaaaataaaaacgctcgtcccaacgaaaaacccgcgcttcaaacgctaaaccctaacgacaataaacaaactaaaaataaaacgtcgaaccgcgcccccgccctccgaacccccaacgcgaacccctactccgaaacgaaaacgctcacaatcgcgcgaacccgaaaatacgaaaaaaacaaaaaaaatcccgccccctcccccgaaccgacccgccgcaaccaatcgacgcgaccgctatcgcctccgctctctaattaactatacgacgaccaatcgaataaaaaaaccgccaacccgtacgaccccacgtaaaacgacgcgaaaaactattaaaaaaccgcaacgaacgaaacgcgtaattcgatcgcgcgctacgcgcctcgaaaacgcgatccgcgccacccccaaccgtccctaccgtcccgaaacccccaacgaacgacgccgtaacttcgaacgcgcgaaactcgaaaccatcgccgaatactatacgattcccgactcgaaaacgctaaaccgacgtcgcgactaccccctacccacgcgaaaaaaaaacgaacgac

SEQ ID NO: 20855 - DNA, 625 bp, Artificial Sequence
  chemically treated genomic DNA (Homo sapiens) CpG-island No: 20855
gagtttttttataatttttaggatatagggagaagataaggggagggaaattgagggacggagatgaaagcgttcgttttagcgaaggattcgcgttttaggcgttgggttttggcggtagtgaataagttgggggtggggcgtcgggtcgcgttttcgtttttcggatttttagcgcggatttttgtttcggggcgggggcgtttatagtcgcgcgaattcggaggtgcggagagaataaaaggggtttcgttttttttttcgggtcggttcgtcgtagttaatcggcgcggtcgttatcgttttcgttttttgattggttgtgcggcggttaatcgggtgagggggtcgttagttcgtgcggttttacgtggggcggcgcgaggggttgttagaggatcgtagcgggcggggcgcgtggttcgatcgcgcgttacgcgtttcggggacgcggttcgcgttatttttagtcgtttttgtcgtttcgaggtttttagcgagcggcgtcgtggtttcgggcgcgcggggttcggggttatcgtcgggtgttgtgcggttttcggttcggaggcgttgggtcggcgtcgcggttgttttttgtttacgcgggagggaagcgagcggt

SEQ ID NO: 20856 - DNA, 625 bp, Artificial Sequence
  chemically treated genomic DNA (Homo sapiens) CpG-island No: 20856
accgctcgcttccctcccgcgtaaacaaaaaacaaccgcgacgccgacccaacgcctccgaaccgaaaaccgcacaacacccgacgataaccccgaaccccgcgcgcccgaaaccacgacgccgctcgctaaaaacctcgaaacgacaaaaacgactaaaaataacgcgaaccgcgtccccgaaacgcgtaacgcgcgatcgaaccacgcgccccgcccgctacgatcctctaacaacccctcgcgccgccccacgtaaaaccgcacgaactaacgaccccctcacccgattaaccgccgcacaaccaatcaaaaaacgaaaacgataacgaccgcgccgattaactacgacgaaccgacccgaaaaaaaaaacgaaaccccttttattctctccgcacctccgaattcgcgcgactataaacgcccccgccccgaaacaaaaatccgcgctaaaaatccgaaaaacgaaaacgcgacccgacgccccacccccaacttattcactaccgccaaaacccaacgcctaaaacgcgaatccttcgctaaaacgaacgctttcatctccgtccctcaatttccctccccttatcttctccctatatcctaaaaattataaaaaaactc

SEQ ID NO: 20857 - DNA, 1186 bp, Artificial Sequence
  chemically treated genomic DNA (Homo sapiens) CpG-island No: 20857
gttaggttgcgtttggcgcgagtcgcgcgggtggtatcgggcggatagtcggcgaagttcgggcgtcgttagcgtgcgtttagttttgggtgatttacgaacgaattttaatattcgtttttttattttgttttttttttcggaatagttttgggttggttttgttcggtcggttcgcggcgaggggaattggtcgggtcgtggtatttacggtcgttgttttgaggggtttttcgggtcgaagttaggggtcggggaggggaatggttatggcgagtttttcgggttttcgtttttaatttagaatttttttttttcggagaagtgggggtggaggagggggatcgagtaaggtcggcgtagcggggcgtttttatcgcgcgcgttcgggacggcgcgcggggttcgggttacggttcgtgtggcggggttcgcgggttggtttttttcgggcgcgggggttaggcgcgattttagtttttatgatttttttagggagcgggtgcggttgtttcgtagggagcgggttttgcggcgacggtcgagttattcgcgttttaaggcgcgtttggttttagttcggtttgtaggttttatcgcgttcgcgttttcggagacgacgtcggagggaggtagacgggttagagttttggttttcggtaggcgggcgaggagagagcgggtttttagatgtaaaagtaggaaataaagtaaatttgtagaagttttagattttggagcgcgttagttacgtttggggtcgcggtaagagggatcggcggttttagggttacgttttgttttttcgggagggagttttgtgtttttaggtttagtttttttcgaaatgttttcgttagcgatttttcgttcgttcggggttttttgttcgtcgttatttttcgttttatttttttttttagtttagttcgatttggcgttgcggcgtcgttttcgcggtttttcggcgcggttttttttggagttgggttgggagtgggtttcgggtttcggtattcggcgggtggcggcgtcgtcgttgcgggattgtgggatttttagttcgggtcgtgtggtcgttttttttcgttttattttttggtcgttttaggttttttaggttttcgaagttcggcgcgggtagacgcggaggcgcggcgcggttttttttcgggaggagagaata

SEQ ID NO: 20858 - DNA, 1186 bp, Artificial Sequence
  chemically treated genomic DNA (Homo sapiens) CpG-island No: 20858
tattctctcctcccgaaaaaaaaccgcgccgcgcctccgcgtctacccgcgccgaacttcgaaaacctaaaaaacctaaaacgaccaaaaaataaaacgaaaaaaaacgaccacacgacccgaactaaaaatcccacaatcccgcaacgacgacgccgccacccgccgaataccgaaacccgaaacccactcccaacccaactccaaaaaaaaccgcgccgaaaaaccgcgaaaacgacgccgcaacgccaaatcgaactaaactaaaaaaaaaaataaaacgaaaaataacgacgaacaaaaaaccccgaacgaacgaaaaatcgctaacgaaaacatttcgaaaaaaactaaacctaaaaacacaaaactccctcccgaaaaaacaaaacgtaaccctaaaaccgccgatccctcttaccgcgaccccaaacgtaactaacgcgctccaaaatctaaaacttctacaaatttactttatttcctacttttacatctaaaaacccgctctctcctcgcccgcctaccgaaaaccaaaactctaacccgtctacctccctccgacgtcgtctccgaaaacgcgaacgcgataaaacctacaaaccgaactaaaaccaaacgcgccttaaaacgcgaataactcgaccgtcgccgcaaaacccgctccctacgaaacaaccgcacccgctccctaaaaaaatcataaaaactaaaatcgcgcctaacccccgcgcccgaaaaaaaccaacccgcgaaccccgccacacgaaccgtaacccgaaccccgcgcgccgtcccgaacgcgcgcgataaaaacgccccgctacgccgaccttactcgatccccctcctccacccccacttctccgaaaaaaaaaaattctaaattaaaaacgaaaacccgaaaaactcgccataaccattcccctccccgacccctaacttcgacccgaaaaacccctcaaaacaacgaccgtaaataccacgacccgaccaattcccctcgccgcgaaccgaccgaacaaaaccaacccaaaactattccgaaaaaaaaaacaaaataaaaaaacgaatattaaaattcgttcgtaaatcacccaaaactaaacgcacgctaacgacgcccgaacttcgccgactatccgcccgataccacccgcgcgactcgcgccaaacgcaacctaac

SEQ ID NO: 20859 - DNA, 1186 bp, Artificial Sequence
  chemically treated genomic DNA (Homo sapiens) CpG-island No: 20859
tgtttttttttttcggggagaggtcgcgtcgcgttttcgcgtttgttcgcgtcgggtttcgggggtttggggagtttgaggcggttaggaagtggggcgaggaagggcggttatacggttcgagttgggagttttatagtttcgtagcggcgacgtcgttattcgtcgagtgtcgaggttcggggtttatttttagtttagttttaggagaggtcgcgtcggaggatcgcgaggacggcgtcgtagcgttaggtcgggttgagttaagggaggaaatggagcgaaaagtggcggcgggtagagggtttcgggcgggcggagaatcgttgacgagggtatttcggaaggaattgaatttaggagtatagggttttttttcgggaaggtagggcgtgattttggagtcgtcggttttttttgtcgcggttttaggcgtggttggcgcgttttaggatttggagtttttataagtttgttttgttttttgtttttgtatttaaaaattcgtttttttttcgttcgtttgtcggagattaggattttggttcgtttgttttttttcggcgtcgttttcgggagcgcgggcgcggtggggtttgtaggtcgggttgggattaggcgcgttttggggcgcgagtggttcggtcgtcgtcgtagaattcgttttttgcgaaatagtcgtattcgttttttgggagagttatgagaattggggtcgcgtttgattttcgcgttcgaagaaaattagttcgcggatttcgttatacgggtcgtgattcgagtttcgcgcgtcgtttcgaacgcgcgcggtgaaaacgtttcgttgcgtcggttttgttcggttttttttttttatttttattttttcggaaaaaaaaaattttgaattgggaacgaagattcgaaaaattcgttatgattattttttttttcggtttttagtttcggttcggaaggttttttagggtagcggtcgtgggtattacgattcggttagtttttttcgtcgcggatcgatcgggtagggttaatttaggattgtttcggggaggggagtagggtaggggagcgaatgttggggttcgttcgtgggttatttagaattgggcgtacgttggcggcgttcggatttcgtcgattgttcgttcggtgttattcgcgcggttcgcgttagacgtagtttggt

SEQ ID NO: 20860 - DNA, 1186 bp, Artificial Sequence
  chemically treated genomic DNA (Homo sapiens) CpG-island No: 20860
accaaactacgtctaacgcgaaccgcgcgaataacaccgaacgaacaatcgacgaaatccgaacgccgccaacgtacgcccaattctaaataacccacgaacgaaccccaacattcgctcccctaccctactcccctccccgaaacaatcctaaattaaccctacccgatcgatccgcgacgaaaaaaactaaccgaatcgtaatacccacgaccgctaccctaaaaaaccttccgaaccgaaactaaaaaccgaaaaaaaaaataatcataacgaatttttcgaatcttcgttcccaattcaaaattttttttttccgaaaaaataaaaataaaaaaaaaaaaccgaacaaaaccgacgcaacgaaacgttttcaccgcgcgcgttcgaaacgacgcgcgaaactcgaatcacgacccgtataacgaaatccgcgaactaattttcttcgaacgcgaaaatcaaacgcgaccccaattctcataactctcccaaaaaacgaatacgactatttcgcaaaaaacgaattctacgacgacgaccgaaccactcgcgccccaaaacgcgcctaatcccaacccgacctacaaaccccaccgcgcccgcgctcccgaaaacgacgccgaaaaaaaacaaacgaaccaaaatcctaatctccgacaaacgaacgaaaaaaaaacgaatttttaaatacaaaaacaaaaaacaaaacaaacttataaaaactccaaatcctaaaacgcgccaaccacgcctaaaaccgcgacaaaaaaaaccgacgactccaaaatcacgccctaccttcccgaaaaaaaaccctatactcctaaattcaattccttccgaaataccctcgtcaacgattctccgcccgcccgaaaccctctacccgccgccacttttcgctccatttcctcccttaactcaacccgacctaacgctacgacgccgtcctcgcgatcctccgacgcgacctctcctaaaactaaactaaaaataaaccccgaacctcgacactcgacgaataacgacgtcgccgctacgaaactataaaactcccaactcgaaccgtataaccgcccttcctcgccccacttcctaaccgcctcaaactccccaaacccccgaaacccgacgcgaacaaacgcgaaaacgcgacgcgacctctccccgaaaaaaaaaaaca

SEQ ID NO: 20861 - DNA, 732 bp, Artificial Sequence
  chemically treated genomic DNA (Homo sapiens) CpG-island No: 20861
gggttcgaaatatcgcgttttttttttagcgtcgtgtttttcgtttttttagcgcgcggttttcgttcgattcgcgcgttcgttcgattcgtttttaatttcgtttaattatcgtttttcgcggttgttttttttgtatgagttttcggcgtaggttaatggaattacgcggaggcgcgggcggtttggttaatggaaggtttagggggcgtggttggcgggaggggttgcgggcggtcgggttttatgcgttgagattcgagattgcgtcgtcggcgggtgcgtttaggtcgtttagttagagtcggtaggatttcgtcgtcgggttgtgggtttttgattattttttcgttgtcgggagaagcgtttgagtggggagggaggtgggaggaggtggtttttcgtcgggggtgcggggagcgggacggcggtttggatggatacggttagtttcgggtcggagagggttcggtttatagtagtttgggttttgtttagagttttattgtgtacgttttcgcgaggatttgcggagagacgtgtaggcgacgtacgtttcgggaaggaaggagggtatttgggttttgacgagcgataacgttgtgttttgtgatttcgtataaacggattttgtagtgtagggaaagcgttttacgtttttagttcgggtagggttcgtgggattggcgttcgttgttttaggtttatttcgaatggaggagtgatttttgt

SEQ ID NO: 20862 - DNA, 732 bp, Artificial Sequence
  chemically treated genomic DNA (Homo sapiens) CpG-island No: 20862
acaaaaatcactcctccattcgaaataaacctaaaacaacgaacgccaatcccacgaaccctacccgaactaaaaacgtaaaacgctttccctacactacaaaatccgtttatacgaaatcacaaaacacaacgttatcgctcgtcaaaacccaaataccctccttccttcccgaaacgtacgtcgcctacacgtctctccgcaaatcctcgcgaaaacgtacacaataaaactctaaacaaaacccaaactactataaaccgaaccctctccgacccgaaactaaccgtatccatccaaaccgccgtcccgctccccgcacccccgacgaaaaaccacctcctcccacctccctccccactcaaacgcttctcccgacaacgaaaaaataatcaaaaacccacaacccgacgacgaaatcctaccgactctaactaaacgacctaaacgcacccgccgacgacgcaatctcgaatctcaacgcataaaacccgaccgcccgcaacccctcccgccaaccacgccccctaaaccttccattaaccaaaccgcccgcgcctccgcgtaattccattaacctacgccgaaaactcatacaaaaaaaacaaccgcgaaaaacgataattaaacgaaattaaaaacgaatcgaacgaacgcgcgaatcgaacgaaaaccgcgcgctaaaaaaacgaaaaacacgacgctaaaaaaaaaacgcgatatttcgaaccc

SEQ ID NO: 20863 - DNA, 732 bp, Artificial Sequence
  chemically treated genomic DNA (Homo sapiens) CpG-island No: 20863
ataggggttatttttttattcggggtaagtttgggatagcggacgttaattttacgaattttgttcgggttgggggcgtgggacgttttttttgtattataggattcgtttgtacggagttatagaatatagcgttatcgttcgttagagtttaggtattttttttttttttcggggcgtgcgtcgtttgtacgttttttcgtagattttcgcggaaacgtgtatagtagggttttgaatagaatttaggttgttgtgagtcgaatttttttcggttcggggttgatcgtgtttatttaagtcgtcgtttcgtttttcgtattttcgacggggggttatttttttttatttttttttttatttaggcgtttttttcgatagcggagggatagttaaaaatttataattcggcggcgggattttgtcggttttagttgggcgatttgggcgtattcgtcggcgacgtagtttcgggttttagcgtatagaattcggtcgttcgtagtttttttcgttagttacgttttttgggttttttattggttaagtcgttcgcgttttcgcgtgattttattggtttgcgtcgggggtttatataaagggagtagtcgcggagggcggtgattgggcggggttgggggcgggtcgggcgggcgcgcgggtcgggcgggagtcgcgcgttggagaggcggggagtacggcgttgggggaggggcgcggtgtttcgggttt

SEQ ID NO: 20864 - DNA, 732 bp, Artificial Sequence
  chemically treated genomic DNA (Homo sapiens) CpG-island No: 20864
aaacccgaaacaccgcgcccctcccccaacgccgtactccccgcctctccaacgcgcgactcccgcccgacccgcgcgcccgcccgacccgcccccaaccccgcccaatcaccgccctccgcgactactccctttatataaacccccgacgcaaaccaataaaatcacgcgaaaacgcgaacgacttaaccaataaaaaacccaaaaaacgtaactaacgaaaaaaactacgaacgaccgaattctatacgctaaaacccgaaactacgtcgccgacgaatacgcccaaatcgcccaactaaaaccgacaaaatcccgccgccgaattataaatttttaactatccctccgctatcgaaaaaaacgcctaaataaaaaaaaaaataaaaaaaaataaccccccgtcgaaaatacgaaaaacgaaacgacgacttaaataaacacgatcaaccccgaaccgaaaaaaattcgactcacaacaacctaaattctattcaaaaccctactatacacgtttccgcgaaaatctacgaaaaaacgtacaaacgacgcacgccccgaaaaaaaaaaaaaatacctaaactctaacgaacgataacgctatattctataactccgtacaaacgaatcctataatacaaaaaaaacgtcccacgcccccaacccgaacaaaattcgtaaaattaacgtccgctatcccaaacttaccccgaataaaaaaataacccctat

SEQ ID NO: 20865 - DNA, 928 bp, Artificial Sequence
  chemically treated genomic DNA (Homo sapiens) CpG-island No: 20865
ttttttcggcgagatatttttaggaaggttttttcggggtggtcgtaacgttacggtaaagttatcggggaaagtaaaagggcggtttcgcgtatttttaataggatatagttagtttttaggttcggacgcgttcgagaggagggggaagggagtgttttcgtcgaatttcgagaaaggtcgcgggatttattttcggttttttttcgcgttcgtttaggttttatttttttcggttcgtataaagtttttcgagggcgggggtcggttaggggggagatcgttaggacgcggtcgggtcgggtttagtgattcgcgggcggtttcggtcgcgtaggttgtggtttttcgacgcgtttggagtgtttgttcgggaagggaaggacgcgagtttagcgttttcgtcgtttcgagttttcggttttgacggcgagagtatttcgagaaggttcggcgcgttttacgtagtttcgtttgtcgcgttcgaggtggcggttaattgcgtggagggtcgcgagttcgaggggcgtgtagacgtcgtcgggggcgcgggtgaatcgtttagtggtaggcgttttttcgcgtttcgtcgaggttttaattcgaggttttatatgagtttttttagttcgcgaatcgttttttttttcgggtatttgaggaaggcggttaaataatgcgggggcggattcgggggaggggggaggaaggcgggatgtcgagggagtgggggacggcgtcggtcgttttcgcgtttttcggttttttagcgtttcgttttttatcggggttatacgcgggcgcgtatttacgtttatttttttgttcggtgcgagaagatggtcgtttttgttttatataaaagttttttgttgcggttatataaaagcggttaagttttatttttttagtaggttttttggataaa

SEQ ID NO: 20866 - DNA, 928 bp, Artificial Sequence
  chemically treated genomic DNA (Homo sapiens) CpG-island No: 20866
tttatccaaaaaacctactaaaaaaataaaacttaaccgcttttatataaccgcaacaaaaaacttttatataaaacaaaaacgaccatcttctcgcaccgaacaaaaaaataaacgtaaatacgcgcccgcgtataaccccgataaaaaacgaaacgctaaaaaaccgaaaaacgcgaaaacgaccgacgccgtcccccactccctcgacatcccgccttcctcccccctcccccgaatccgcccccgcattatttaaccgccttcctcaaatacccgaaaaaaaaaacgattcgcgaactaaaaaaactcatataaaacctcgaattaaaacctcgacgaaacgcgaaaaaacgcctaccactaaacgattcacccgcgcccccgacgacgtctacacgcccctcgaactcgcgaccctccacgcaattaaccgccacctcgaacgcgacaaacgaaactacgtaaaacgcgccgaaccttctcgaaatactctcgccgtcaaaaccgaaaactcgaaacgacgaaaacgctaaactcgcgtccttcccttcccgaacaaacactccaaacgcgtcgaaaaaccacaacctacgcgaccgaaaccgcccgcgaatcactaaacccgacccgaccgcgtcctaacgatctcccccctaaccgacccccgccctcgaaaaactttatacgaaccgaaaaaaataaaacctaaacgaacgcgaaaaaaaaccgaaaataaatcccgcgacctttctcgaaattcgacgaaaacactcccttccccctcctctcgaacgcgtccgaacctaaaaactaactatatcctattaaaaatacgcgaaaccgcccttttactttccccgataactttaccgtaacgttacgaccaccccgaaaaaaccttcctaaaaatatctcgccgaaaaaa

SEQ ID NO: 20867 - DNA, 928 bp, Artificial Sequence
  chemically treated genomic DNA (Homo sapiens) CpG-island No: 20867
tttgtttaaagggtttattggaaaagtggggtttggtcgtttttgtgtgatcgtaataaagagtttttatatgaggtagaaacggttattttttcgtatcgggtaggagggtgggcgtgagtgcgcgttcgcgtgtggtttcgatgggaggcgaggcgttgggaggtcggggggcgcgggggcggtcggcgtcgttttttattttttcgatatttcgttttttttttttttttttcgggttcgttttcgtattgtttggtcgttttttttaggtgttcgggggaaaggacggttcgcgaattgggggaatttatgtgaggtttcgagttagggtttcggcggggcgcgaaggggcgtttgttattgagcgatttattcgcgttttcgacggcgtttgtacgtttttcgagttcgcggttttttacgtagttggtcgttatttcggacgcggtaggcgggattgcgtggggcgcgtcgagttttttcggggtgttttcgtcgttaaggtcgagggttcggggcggcgggaacgttgggttcgcgttttttttttttcggataggtattttagacgcgtcggggagttatagtttgcgcggtcggagtcgttcgcgggttattgggttcggttcggtcgcgttttgacggttttttttttggtcggttttcgttttcggaaggttttgtgcgagtcgggggaggtggggtttgggcgggcgcgggagggagtcggaggtgggtttcgcggtttttttcgggattcggcggggatattttttttttttttttttcgggcgcgttcgggtttgggaattggttgtgttttattggaagtgcgcggggtcgtttttttgtttttttcggtaattttgtcgtagcgttgcggttatttcgaggggatttttttgaaggtgtttcgtcggagagg

SEQ ID NO: 20868 - DNA, 928 bp, Artificial Sequence
  chemically treated genomic DNA (Homo sapiens) CpG-island No: 20868
cctctccgacgaaacaccttcaaaaaaatcccctcgaaataaccgcaacgctacgacaaaattaccgaaaaaaacaaaaaaacgaccccgcgcacttccaataaaacacaaccaattcccaaacccgaacgcgcccgaaaaaaaaaaaaaaaaaatatccccgccgaatcccgaaaaaaaccgcgaaacccacctccgactccctcccgcgcccgcccaaaccccacctcccccgactcgcacaaaaccttccgaaaacgaaaaccgaccaaaaaaaaaaccgtcaaaacgcgaccgaaccgaacccaataacccgcgaacgactccgaccgcgcaaactataactccccgacgcgtctaaaatacctatccgaaaaaaaaaaaacgcgaacccaacgttcccgccgccccgaaccctcgaccttaacgacgaaaacaccccgaaaaaactcgacgcgccccacgcaatcccgcctaccgcgtccgaaataacgaccaactacgtaaaaaaccgcgaactcgaaaaacgtacaaacgccgtcgaaaacgcgaataaatcgctcaataacaaacgccccttcgcgccccgccgaaaccctaactcgaaacctcacataaattcccccaattcgcgaaccgtcctttcccccgaacacctaaaaaaaacgaccaaacaatacgaaaacgaacccgaaaaaaaaaaaaaaaaaacgaaatatcgaaaaaataaaaaacgacgccgaccgcccccgcgccccccgacctcccaacgcctcgcctcccatcgaaaccacacgcgaacgcgcactcacgcccaccctcctacccgatacgaaaaaataaccgtttctacctcatataaaaactctttattacgatcacacaaaaacgaccaaaccccacttttccaataaaccctttaaacaaa

SEQ ID NO: 20869 - DNA, 754 bp, Artificial Sequence
  chemically treated genomic DNA (Homo sapiens) CpG-island No: 20869
  misc_feature (358)..(358): n is either a, c, g or t
  misc_feature (367)..(367): n is either a, c, g or t
  misc_feature (373)..(373): n is either a, c, g or t
  misc_feature (389)..(389): n is either a, c, g or t
  misc_feature (413)..(413): n is either a, c, g or t
  misc_feature (510)..(510): n is either a, c, g or t
cgtgttttttaagggtttttcggcgtcgcggtttagttcggcgttatttgtagttcggttcgtagtcgtttgtttttcgtgtttagtttggtttcgcggcggtttatggataataatttttggtttttgttgacgcgaaagatttcgtatttttttttgagtcgttcgtattcggtcgtcgcgtattttagttttggtatcgacgagttagtggatttgaagttggtttttagtagttcggtcgcgtttatttcggggggtagcgattcgggttcggtttttgttgtcgttttcgcgtttcggcggaacgagttgcgtagtaggcgggttttgggttttatttttatcgggatttcgnaggtttcgncggcgnttcgttcgtacgtggnttcgattatttttttcgtcgcggngtttacgagcgacgaggcgggtttttatggcgttcggtgtcgtttattattttagggagtattagttaggattgggtatacgggaatcgaaatcggnatcgggttgggggttaaaagaaatcggaatcgggacgggggtcggggttataggtaatacgggacggggaacgggggcggggtttaatcgggaaatggaattcgtggttcgcgaaaatttagagaatcggggtcgggaattatacgggggaatcggggcgggagattaacggggaaattcggggtttaaaggacggggggaaaacgcgggaattgtggttcgggggaaaaaaacgagagggggt

SEQ ID NO: 20870 - DNA, 754 bp, Artificial Sequence
  chemically treated genomic DNA (Homo sapiens) CpG-island No: 20870
  misc_feature (245)..(245): n is either a, c, g or t
  misc_feature (342)..(342): n is either a, c, g or t
  misc_feature (366)..(366): n is either a, c, g or t
  misc_feature (382)..(382): n is either a, c, g or t
  misc_feature (388)..(388): n is either a, c, g or t
  misc_feature (397)..(397): n is either a, c, g or t
accccctctcgtttttttcccccgaaccacaattcccgcgttttccccccgtcctttaaaccccgaatttccccgttaatctcccgccccgattcccccgtataattcccgaccccgattctctaaattttcgcgaaccacgaattccatttcccgattaaaccccgcccccgttccccgtcccgtattacctataaccccgacccccgtcccgattccgatttcttttaacccccaacccgatnccgatttcgattcccgtatacccaatcctaactaatactccctaaaataataaacgacaccgaacgccataaaaacccgcctcgtcgctcgtaaacnccgcgacgaaaaaaataatcgaanccacgtacgaacgaancgccgncgaaacctncgaaatcccgataaaaataaaacccaaaacccgcctactacgcaactcgttccgccgaaacgcgaaaacgacaacaaaaaccgaacccgaatcgctaccccccgaaataaacgcgaccgaactactaaaaaccaacttcaaatccactaactcgtcgataccaaaactaaaatacgcgacgaccgaatacgaacgactcaaaaaaaaatacgaaatctttcgcgtcaacaaaaaccaaaaattattatccataaaccgccgcgaaaccaaactaaacacgaaaaacaaacgactacgaaccgaactacaaataacgccgaactaaaccgcgacgccgaaaaacccttaaaaaacacg

SEQ ID NO: 20871 - DNA, 754 bp, Artificial Sequence
  chemically treated genomic DNA (Homo sapiens) CpG-island No: 20871
  misc_feature (245)..(245): n is either a, c, g or t
  misc_feature (342)..(342): n is either a, c, g or t
  misc_feature (366)..(366): n is either a, c, g or t
  misc_feature (382)..(382): n is either a, c, g or t
  misc_feature (388)..(388): n is either a, c, g or t
  misc_feature (397)..(397): n is either a, c, g or t
gttttttttcgtttttttttttcgggttataattttcgcgtttttttttcgttttttgggtttcgggttttttcgttggtttttcgtttcggttttttcgtgtggttttcggtttcgattttttgggttttcgcgggttacgggttttatttttcggttgggtttcgttttcgtttttcgtttcgtgttatttatggtttcggttttcgtttcggtttcggttttttttggtttttaattcggtntcggtttcggttttcgtgtgtttagttttggttggtattttttagggtagtaagcggtatcggacgttatgggggttcgtttcgtcgttcgtgagtntcgcggcgggggaagtgatcgagnttacgtacgggcgggncgtcgncgaggtttncgagatttcggtgaaggtgaagtttaaggttcgtttgttgcgtaattcgtttcgtcgaggcgcgggggcggtagtaggggtcgggttcgggtcgttgtttttcggggtgggcgcggtcgggttgttgggggttagttttaagtttattggttcgtcggtgttagagttggagtacgcggcggtcgagtacgagcggtttaggaaggagtacgagatttttcgcgttagtaagaattaggagttgttgtttatgggtcgtcgcgaggttaagttggatacggagaataagcggttgcgggtcgaattgtaggtaacgtcgggttgggtcgcgacgtcgggagatttttgggaagtacg

SEQ ID NO: 20872 - DNA, 754 bp, Artificial Sequence
  chemically treated genomic DNA (Homo sapiens) CpG-island No: 20872
  misc_feature (358)..(358): n is either a, c, g or t
  misc_feature (367)..(367): n is either a, c, g or t
  misc_feature (373)..(373): n is either a, c, g or t
  misc_feature (389)..(389): n is either a, c, g or t
  misc_feature (413)..(413): n is either a, c, g or t
  misc_feature (510)..(510): n is either a, c, g or t
cgtacttcccaaaaatctcccgacgtcgcgacccaacccgacgttacctacaattcgacccgcaaccgcttattctccgtatccaacttaacctcgcgacgacccataaacaacaactcctaattcttactaacgcgaaaaatctcgtactccttcctaaaccgctcgtactcgaccgccgcgtactccaactctaacaccgacgaaccaataaacttaaaactaacccccaacaacccgaccgcgcccaccccgaaaaacaacgacccgaacccgacccctactaccgcccccgcgcctcgacgaaacgaattacgcaacaaacgaaccttaaacttcaccttcaccgaaatctcgnaaacctcgncgacgncccgcccgtacgtaanctcgatcacttcccccgccgcganactcacgaacgacgaaacgaacccccataacgtccgataccgcttactaccctaaaaaataccaaccaaaactaaacacacgaaaaccgaaaccganaccgaattaaaaaccaaaaaaaaccgaaaccgaaacgaaaaccgaaaccataaataacacgaaacgaaaaacgaaaacgaaacccaaccgaaaaataaaacccgtaacccgcgaaaacccaaaaaatcgaaaccgaaaaccacacgaaaaaaccgaaacgaaaaaccaacgaaaaaacccgaaacccaaaaaacgaaaaaaaaacgcgaaaattataacccgaaaaaaaaaaacgaaaaaaaac

SEQ ID NO: 20873 - DNA, 540 bp, Artificial Sequence
  chemically treated genomic DNA (Homo sapiens) CpG-island No: 20873
tcgtcgggagtcggtttggcgcgtttcgtttaggtatttcgatcgtgggtagtttgcgttcgtttgggttttatcgtttcggttcggtagatatttgagcggtggttagggtaggttttcgtttttgtcgatgtttatgttttgggatatagcgacgatgtagtttagcgaattaattatgatagtagcgggaggattttcgagttcgttcgttatagtagaacgcgcggttaagtttggcgcgaaattgtggtcgtttcgttttttcgtttttatttgtgtaggcgaggtttcgttttttcgtttcggcgtacgtagggtcgcggcgtgttcgcgttcgtagacgtttgggaattgcggtcgcgggttcgcgtttttcgtcgggttttgtcgtcgggttgttatttttgttttgttatgtttcgtcggaagtttgcgtcgggcggtttcgttgtttttagtttagtttttgcgaggtaagcggttttgagtcgatttttttagtttacgggaagtttgaaatttatttttttttttata

SEQ ID NO: 20874 - DNA, 540 bp, Artificial Sequence
  chemically treated genomic DNA (Homo sapiens) CpG-island No: 20874
tataaaaaaaaaaataaatttcaaacttcccgtaaactaaaaaaatcgactcaaaaccgcttacctcgcaaaaactaaactaaaaacaacgaaaccgcccgacgcaaacttccgacgaaacataacaaaacaaaaataacaacccgacgacaaaacccgacgaaaaacgcgaacccgcgaccgcaattcccaaacgtctacgaacgcgaacacgccgcgaccctacgtacgccgaaacgaaaaaacgaaacctcgcctacacaaataaaaacgaaaaaacgaaacgaccacaatttcgcgccaaacttaaccgcgcgttctactataacgaacgaactcgaaaatcctcccgctactatcataattaattcgctaaactacatcgtcgctatatcccaaaacataaacatcgacaaaaacgaaaacctaccctaaccaccgctcaaatatctaccgaaccgaaacgataaaacccaaacgaacgcaaactacccacgatcgaaatacctaaacgaaacgcgccaaaccgactcccgacga

SEQ ID NO: 20875 - DNA, 540 bp, Artificial Sequence
  chemically treated genomic DNA (Homo sapiens) CpG-island No: 20875
tgtggaggaggaggtggattttaggtttttcgtagattggaagaatcggtttaaaatcgtttgtttcgtaggggttgagttggaggtagcgaggtcgttcgacgtaggttttcggcgagatatggtagggtaaggatggtagttcggcggtagggttcggcgaggagcgcgaattcgcggtcgtagtttttaggcgtttgcgggcgcgagtacgtcgcgattttgcgtgcgtcggggcgggggggcggggtttcgtttgtataaatagggacgagggggcggggcggttataatttcgcgttaaatttgatcgcgcgttttgttgtaacgagcgggttcggaggttttttcgttgttgttatggttggttcgttaaattgtatcgtcgttgtgttttagaatatgggtatcggtaagaacggggatttgttttggttatcgtttaggtatttgtcgggtcggggcgatgggatttaaacgggcgtaggttgtttacggtcggggtatttgggcgggacgcgttaggtcgattttcggcga

SEQ ID NO: 20876 - DNA, 540 bp, Artificial Sequence
  chemically treated genomic DNA (Homo sapiens) CpG-island No: 20876
tcgccgaaaatcgacctaacgcgtcccgcccaaataccccgaccgtaaacaacctacgcccgtttaaatcccatcgccccgacccgacaaatacctaaacgataaccaaaacaaatccccgttcttaccgatacccatattctaaaacacaacgacgatacaatttaacgaaccaaccataacaacaacgaaaaaacctccgaacccgctcgttacaacaaaacgcgcgatcaaatttaacgcgaaattataaccgccccgccccctcgtccctatttatacaaacgaaaccccgcccccccgccccgacgcacgcaaaatcgcgacgtactcgcgcccgcaaacgcctaaaaactacgaccgcgaattcgcgctcctcgccgaaccctaccgccgaactaccatccttaccctaccatatctcgccgaaaacctacgtcgaacgacctcgctacctccaactcaacccctacgaaacaaacgattttaaaccgattcttccaatctacgaaaaacctaaaatccacctcctcctccaca

SEQ ID NO: 20877 - DNA, 578 bp, Artificial Sequence
  chemically treated genomic DNA (Homo sapiens) CpG-island No: 20877
tggcgagcgtgtgggttttttgtgtgtgtatattcgggtgagcgtgtgggttttgtgtgtgtatattcgggtgagcgtgtgggttttttgtgtgtgtatattcgggtgagcgtgtgggttttgtgtgtgtatattcgggtgagcgtgtgggttttttgtgtgtgtatattcgggtgagcgtgtgggttttgtgtgtgtatattcgggtgagcgtgtgggttttttgtgtgtgtatattcgggtgagcgtgtgggttttgtgtgtgtatattcgggtgagcgtgtgggttttttgtgtgtgtgtatattttggcgagcgtgtgggttttttgtgtgtatattttggcgagcgtgtgggttttttgtgtgtgtatattcgggtgagcgtgtgggttttttgtgtgtgtgtatattttggcgagcgtgtgggttttgtgtgtgtatattcgggtgagcgtgtgggtgtgtttattttttatgtatcgtttagtcgttatacgggaaatgagttagggtgtgtgaagtgttcgtaggaatgtttggtcgtaaggtggatttaaattttgtttattttgtttt

SEQ ID NO: 20878 - DNA, 578 bp, Artificial Sequence
  chemically treated genomic DNA (Homo sapiens) CpG-island No: 20878
aaaacaaaataaacaaaatttaaatccaccttacgaccaaacattcctacgaacacttcacacaccctaactcatttcccgtataacgactaaacgatacataaaaaataaacacacccacacgctcacccgaatatacacacacaaaacccacacgctcgccaaaatatacacacacacaaaaaacccacacgctcacccgaatatacacacacaaaaaacccacacgctcgccaaaatatacacacaaaaaacccacacgctcgccaaaatatacacacacacaaaaaacccacacgctcacccgaatatacacacacaaaacccacacgctcacccgaatatacacacacaaaaaacccacacgctcacccgaatatacacacacaaaacccacacgctcacccgaatatacacacacaaaaaacccacacgctcacccgaatatacacacacaaaacccacacgctcacccgaatatacacacacaaaaaacccacacgctcacccgaatatacacacacaaaacccacacgctcacccgaatatacacacacaaaaaacccacacgctcgcca

SEQ ID NO: 20879 - DNA, 578 bp, Artificial Sequence
  chemically treated genomic DNA (Homo sapiens) CpG-island No: 20879
ggagtagaatgagtaaagtttgagtttattttgcggttaggtatttttacgggtattttatatattttagtttatttttcgtatggcgattggacgatgtatagagaatgaatatatttatacgtttattcgagtgtgtatatatagaatttatacgttcgttagagtgtgtatatatatagagaatttatacgtttattcgagtgtgtatatatagagaatttatacgttcgttagagtgtgtatatagagaatttatacgttcgttagagtgtgtatatatatagagaatttatacgtttattcgagtgtgtatatatagaatttatacgtttattcgagtgtgtatatatagagaatttatacgtttattcgagtgtgtatatatagaatttatacgtttattcgagtgtgtatatatagagaatttatacgtttattcgagtgtgtatatatagaatttatacgtttattcgagtgtgtatatatagagaatttatacgtttattcgagtgtgtatatatagaatttatacgtttattcgagtgtgtatatatagagaatttatacgttcgtta

SEQ ID NO: 20880 - DNA, 578 bp, Artificial Sequence
  chemically treated genomic DNA (Homo sapiens) CpG-island No: 20880
taacgaacgtataaattctctatatatacacactcgaataaacgtataaattctatatatacacactcgaataaacgtataaattctctatatatacacactcgaataaacgtataaattctatatatacacactcgaataaacgtataaattctctatatatacacactcgaataaacgtataaattctatatatacacactcgaataaacgtataaattctctatatatacacactcgaataaacgtataaattctatatatacacactcgaataaacgtataaattctctatatatatacacactctaacgaacgtataaattctctatatacacactctaacgaacgtataaattctctatatatacacactcgaataaacgtataaattctctatatatatacacactctaacgaacgtataaattctatatatacacactcgaataaacgtataaatatattcattctctatacatcgtccaatcgccatacgaaaaataaactaaaatatataaaatacccgtaaaaatacctaaccgcaaaataaactcaaactttactcattctactcc

SEQ ID NO: 20881 - DNA, 1524 bp, Artificial Sequence
  chemically treated genomic DNA (Homo sapiens) CpG-island No: 20881
  misc_feature (227)..(227): n is either a, c, g or t
  misc_feature (633)..(633): n is either a, c, g or t
  misc_feature (676)..(676): n is either a, c, g or t
  misc_feature (772)..(772): n is either a, c, g or t
  misc_feature (842)..(842): n is either a, c, g or t
  misc_feature (869)..(869): n is either a, c, g or t
  misc_feature (923)..(923): n is either a, c, g or t
  misc_feature (929)..(929): n is either a, c, g or t
  misc_feature (956)..(956): n is either a, c, g or t
  misc_feature (967)..(967): n is either a, c, g or t
  misc_feature (990)..(990): n is either a, c, g or t
  misc_feature (1013)..(1013): n is either a, c, g or t
  misc_feature (1023)..(1023): n is either a, c, g or t
  misc_feature (1035)..(1035): n is either a, c, g or t
  misc_feature (1087)..(1087): n is either a, c, g or t
  misc_feature (1089)..(1089): n is either a, c, g or t
  misc_feature (1101)..(1101): n is either a, c, g or t
  misc_feature (1103)..(1103): n is either a, c, g or t
  misc_feature (1142)..(1142): n is either a, c, g or t
  misc_feature (1185)..(1185): n is either a, c, g or t
  misc_feature (1189)..(1189): n is either a, c, g or t
  misc_feature (1198)..(1198): n is either a, c, g or t
  misc_feature (1229)..(1229): n is either a, c, g or t
  misc_feature (1241)..(1241): n is either a, c, g or t
  misc_feature (1248)..(1248): n is either a, c, g or t
  misc_feature (1254)..(1254): n is either a, c, g or t
  misc_feature (1299)..(1299): n is either a, c, g or t
  misc_feature (1318)..(1319): n is either a, c, g or t
  misc_feature (1322)..(1322): n is either a, c, g or t
  misc_feature (1325)..(1325): n is either a, c, g or t
  misc_feature (1327)..(1327): n is either a, c, g or t
  misc_feature (1331)..(1331): n is either a, c, g or t
  misc_feature (1338)..(1338): n is either a, c, g or t
  misc_feature (1356)..(1356): n is either a, c, g or t
  misc_feature (1394)..(1394): n is either a, c, g or t
  misc_feature (1437)..(1437): n is either a, c, g or t
  misc_feature (1447)..(1447): n is either a, c, g or t
ttcgtcgagtttttacgggtacgcgcggacgacgtaaaaggaataataaaacgaaggaagatcgttagagtatttttataacgcgtacgtatacgtacgcgtttcgatacgcgtttattatttttattttttttcgtcgttcgtatcgttcgagtcgtttgtggggcggtcgcgaggcggatcggagttggttggggcgtgtcggcgaggttgttcgatttcgcgtntacggttttttcggcggtcgtttttcgcggcggttttttattttttttttttcgtacgcggatcgttttattagtatttttattttcgttttacgtttttcgtcgtacggagttgcgacgttttttttcgtcgttcgttcgtcgttagtttttttttgttaattatattttatcggatacggtaaattttttttcgtatttatcgtttttaattttttcgtattcgtagatttttacgtttttatcgtatagtatatttcgtttcgtttttggtagttttttttttcgacgacgtgattagtattatatttcgttttataagtgagttttcgtcgtttttttttttttttttatatttcgtttcgttcgttgatttcgtaacgcgattcgtcgtattcgtcgttanagagtcgttttttttcgtgtgtatttattcgtttacggttaantttacgttttttttttgatagtaattcgttatttcgtattaaaacgtatttagatttacgatataagggagagttattttttacgcgattcggttntcgatcgtgacgttcgtcgtaagacgcgattcgttacgttacggttaatttatatttcgtatattattanttattttatagtcgtttttcgtcgcgnatcgtcgttcgtttatatggatcgcgtatagattacgacgtcgacgtcgcgtantatcgngtacgtatttttcgtttttcgtaattnatatttcgttntttattacgcgacgttcgttatntatacgcgtattgcggcgatgtngatatatagntcgatagatatncgttattatatttcgacgacgttcgtcgcgcgcgttattacgattaggtgtntnagaggtcgcgtntncgacgcgttcgaatattatcgcgatataacgtattatanacgcgtcgcgcgtcgttgttagattagtgtggtacgttatttncgtnatattttanttagtacgttaatatattcgcgtacgttatncgtttgacgttnttttttncgttantcgttgcgtttacgtattagtttcgtagagatcgatagtaggttntttgcgttcgcgtgacgannttncgntntcgnatagcgntcgttgcgagtttacgtnattcgtatatgtatatagtcgcgtttatacgcgttttngtagttttacgtttagttacgcgattttaagattcgacgtttntgagtttcgnagattacgaattattttacgtaatgatattatcgtagcgcgtgtttttcggtcgtttagtacgtcgtttcgtagcga

SEQ ID NO: 20882 - DNA, 1524 bp, Artificial Sequence
  chemically treated genomic DNA (Homo sapiens) CpG-island No: 20882
  misc_feature (78)..(78): n is either a, c, g or t
  misc_feature (88)..(88): n is either a, c, g or t
  misc_feature (131)..(131): n is either a, c, g or t
  misc_feature (169)..(169): n is either a, c, g or t
  misc_feature (187)..(187): n is either a, c, g or t
  misc_feature (194)..(194): n is either a, c, g or t
  misc_feature (198)..(198): n is either a, c, g or t
  misc_feature (200)..(200): n is either a, c, g or t
  misc_feature (203)..(203): n is either a, c, g or t
  misc_feature (206)..(207): n is either a, c, g or t
  misc_feature (226)..(226): n is either a, c, g or t
  misc_feature (271)..(271): n is either a, c, g or t
  misc_feature (277)..(277): n is either a, c, g or t
  misc_feature (284)..(284): n is either a, c, g or t
  misc_feature (296)..(296): n is either a, c, g or t
  misc_feature (327)..(327): n is either a, c, g or t
  misc_feature (336)..(336): n is either a, c, g or t
  misc_feature (340)..(340): n is either a, c, g or t
  misc_feature (383)..(383): n is either a, c, g or t
  misc_feature (422)..(422): n is either a, c, g or t
  misc_feature (424)..(424): n is either a, c, g or t
  misc_feature (436)..(436): n is either a, c, g or t
  misc_feature (438)..(438): n is either a, c, g or t
  misc_feature (490)..(490): n is either a, c, g or t
  misc_feature (502)..(502): n is either a, c, g or t
  misc_feature (512)..(512): n is either a, c, g or t
  misc_feature (535)..(535): n is either a, c, g or t
  misc_feature (558)..(558): n is either a, c, g or t
  misc_feature (569)..(569): n is either a, c, g or t
  misc_feature (596)..(596): n is either a, c, g or t
  misc_feature (602)..(602): n is either a, c, g or t
  misc_feature (656)..(656): n is either a, c, g or t
  misc_feature (683)..(683): n is either a, c, g or t
  misc_feature (753)..(753): n is either a, c, g or t
  misc_feature (849)..(849): n is either a, c, g or t
  misc_feature (892)..(892): n is either a, c, g or t
  misc_feature (1298)..(1298): n is either a, c, g or t
tcgctacgaaacgacgtactaaacgaccgaaaaacacgcgctacgataatatcattacgtaaaataattcgtaatctncgaaactcanaaacgtcgaatcttaaaatcgcgtaactaaacgtaaaactacnaaaacgcgtataaacgcgactatatacatatacgaatnacgtaaactcgcaacgancgctatncganancgnaanntcgtcacgcgaacgcaaanaacctactatcgatctctacgaaactaatacgtaaacgcaacgantaacgnaaaaaanaacgtcaaacgnataacgtacgcgaatatattaacgtactaantaaaatatnacgnaaataacgtaccacactaatctaacaacgacgcgcgacgcgtntataatacgttatatcgcgataatattcgaacgcgtcgnanacgcgacctctnanacacctaatcgtaataacgcgcgcgacgaacgtcgtcgaaatataataacgnatatctatcganctatatatcnacatcgccgcaatacgcgtatanataacgaacgtcgcgtaataaanaacgaaatatnaattacgaaaaacgaaaaatacgtacncgatantacgcgacgtcgacgtcgtaatctatacgcgatccatataaacgaacgacgatncgcgacgaaaaacgactataaaataantaataatatacgaaatataaattaaccgtaacgtaacgaatcgcgtcttacgacgaacgtcacgatcganaaccgaatcgcgtaaaaaataactctcccttatatcgtaaatctaaatacgttttaatacgaaataacgaattactatcaaaaaaaaaacgtaaanttaaccgtaaacgaataaatacacacgaaaaaaaacgactctntaacgacgaatacgacgaatcgcgttacgaaatcaacgaacgaaacgaaatataaaaaaaaaaaaaaaaacgacgaaaactcacttataaaacgaaatataatactaatcacgtcgtcgaaaaaaaaaactaccaaaaacgaaacgaaatatactatacgataaaaacgtaaaaatctacgaatacgaaaaaattaaaaacgataaatacgaaaaaaaatttaccgtatccgataaaatataattaacaaaaaaaaactaacgacgaacgaacgacgaaaaaaaacgtcgcaactccgtacgacgaaaaacgtaaaacgaaaataaaaatactaataaaacgatccgcgtacgaaaaaaaaaaaataaaaaaccgccgcgaaaaacgaccgccgaaaaaaccgtanacgcgaaatcgaacaacctcgccgacacgccccaaccaactccgatccgcctcgcgaccgccccacaaacgactcgaacgatacgaacgacgaaaaaaaataaaaataataaacgcgtatcgaaacgcgtacgtatacgtacgcgttataaaaatactctaacgatcttccttcgttttattattccttttacgtcgtccgcgcgtacccgtaaaaactcgacgaa

SEQ ID NO: 20883 - DNA, 1524 bp, Artificial Sequence
  chemically treated genomic DNA (Homo sapiens) CpG-island No: 20883
  misc_feature (78)..(78): n is either a, c, g or t
  misc_feature (88)..(88): n is either a, c, g or t
  misc_feature (131)..(131): n is either a, c, g or t
  misc_feature (169)..(169): n is either a, c, g or t
  misc_feature (187)..(187): n is either a, c, g or t
  misc_feature (194)..(194): n is either a, c, g or t
  misc_feature (198)..(198): n is either a, c, g or t
  misc_feature (200)..(200): n is either a, c, g or t
  misc_feature (203)..(203): n is either a, c, g or t
  misc_feature (206)..(207): n is either a, c, g or t
  misc_feature (226)..(226): n is either a, c, g or t
  misc_feature (271)..(271): n is either a, c, g or t
  misc_feature (277)..(277): n is either a, c, g or t
  misc_feature (284)..(284): n is either a, c, g or t
  misc_feature (296)..(296): n is either a, c, g or t
  misc_feature (327)..(327): n is either a, c, g or t
  misc_feature (336)..(336): n is either a, c, g or t
  misc_feature (340)..(340): n is either a, c, g or t
  misc_feature (383)..(383): n is either a, c, g or t
  misc_feature (422)..(422): n is either a, c, g or t
  misc_feature (424)..(424): n is either a, c, g or t
  misc_feature (436)..(436): n is either a, c, g or t
  misc_feature (438)..(438): n is either a, c, g or t
  misc_feature (490)..(490): n is either a, c, g or t
  misc_feature (502)..(502): n is either a, c, g or t
  misc_feature (512)..(512): n is either a, c, g or t
  misc_feature (535)..(535): n is either a, c, g or t
  misc_feature (558)..(558): n is either a, c, g or t
  misc_feature (569)..(569): n is either a, c, g or t
  misc_feature (596)..(596): n is either a, c, g or t
  misc_feature (602)..(602): n is either a, c, g or t
  misc_feature (656)..(656): n is either a, c, g or t
  misc_feature (683)..(683): n is either a, c, g or t
  misc_feature (753)..(753): n is either a, c, g or t
  misc_feature (849)..(849): n is either a, c, g or t
  misc_feature (892)..(892): n is either a, c, g or t
  misc_feature (1298)..(1298): n is either a, c, g or t
tcgttgcgaagcggcgtattggacggtcgggagatacgcgttgcggtggtgttattgcgtggggtagttcgtggtttncgagatttangggcgtcggattttgagatcgcgtggttgagcgtagagttatnagaacgcgtgtggacgcggttgtgtgtatgtgcgagtnacgtgaattcgtaacgancgttgtncganancgnaanntcgttacgcggacgtaganggtttattatcggtttttgcgggattggtacgtgagcgtaacgantgacgngagaagnggcgttagacgngtgacgtacgcgaatgtattggcgtgttgantggagtatngcgnggatgacgtgttatattagtttagtagcggcgcgcgacgcgtntatagtgcgttgtgtcgcggtgatgttcggacgcgtcgnanacgcgatttttnangtatttagtcgtggtgacgcgcgcggcgagcgtcgtcggggtgtgatgacgngtgtttgtcganttgtgtgttngtatcgtcgtagtgcgcgtgtgnatggcggacgtcgcgtggtgagnagcgaggtgtnggttgcgagagacgagggatgcgtgtncgatantgcgcggcgtcgacgtcgtgatttgtacgcggtttatataggcgggcgacgatncgcggcggagagcgattgtagagtgantgatagtgtgcgaggtgtggattggtcgtagcgtagcggatcgcgttttgcggcgagcgttacgatcggnggtcgagtcgcgtggagggtggtttttttttgtgtcgtgggtttgggtgcgttttgatgcggaatagcgggttgttattagggggggggcgtgagnttggtcgtggacgggtaggtgtatacggggaggggcgattttntggcggcgggtgcgacgggtcgcgttacggggttagcgggcgagacgagatgtggagagagggaggagggcggcgagggtttatttatagagcgggatgtaatgttggttacgtcgtcggggagggggattattaggagcggagcggggtgtgttatgcggtgggggcgtaggagtttacgggtgcgggagggttgggggcggtgggtgcggagggaggtttgtcgtgttcgatgaaatgtggttggtagagaggggttgacggcgggcgggcgacgaggaggagcgtcgtagtttcgtgcggcgaggggcgtggagcggaggtaggggtgttggtggggcggttcgcgtgcggaaaaaaaagaatggggggtcgtcgcggggggcggtcgtcggaggggtcgtgngcgcggggtcgggtagtttcgtcgatacgttttaattaatttcgattcgtttcgcggtcgttttataggcggttcggacggtgcgaacgacggggggggatgggaataataggcgcgtgtcggggcgcgtgcgtgtgcgtacgcgttatggggatgttttggcggttttttttcgttttgttattttttttgcgtcgttcgcgcgtgttcgtgggagttcggcggg

SEQ ID NO: 20884 - DNA, 1524 bp, Artificial Sequence
  chemically treated genomic DNA (Homo sapiens) CpG-island No: 20884
  misc_feature (227)..(227): n is either a, c, g or t
  misc_feature (633)..(633): n is either a, c, g or t
  misc_feature (676)..(676): n is either a, c, g or t
  misc_feature (772)..(772): n is either a, c, g or t
  misc_feature (842)..(842): n is either a, c, g or t
  misc_feature (869)..(869): n is either a, c, g or t
  misc_feature (923)..(923): n is either a, c, g or t
  misc_feature (929)..(929): n is either a, c, g or t
  misc_feature (956)..(956): n is either a, c, g or t
  misc_feature (967)..(967): n is either a, c, g or t
  misc_feature (990)..(990): n is either a, c, g or t
  misc_feature (1013)..(1013): n is either a, c, g or t
  misc_feature (1023)..(1023): n is either a, c, g or t
  misc_feature (1035)..(1035): n is either a, c, g or t
  misc_feature (1087)..(1087): n is either a, c, g or t
  misc_feature (1089)..(1089): n is either a, c, g or t
  misc_feature (1101)..(1101): n is either a, c, g or t
  misc_feature (1103)..(1103): n is either a, c, g or t
  misc_feature (1142)..(1142): n is either a, c, g or t
  misc_feature (1185)..(1185): n is either a, c, g or t
  misc_feature (1189)..(1189): n is either a, c, g or t
  misc_feature (1198)..(1198): n is either a, c, g or t
  misc_feature (1229)..(1229): n is either a, c, g or t
  misc_feature (1241)..(1241): n is either a, c, g or t
  misc_feature (1248)..(1248): n is either a, c, g or t
  misc_feature (1254)..(1254): n is either a, c, g or t
  misc_feature (1299)..(1299): n is either a, c, g or t
  misc_feature (1318)..(1319): n is either a, c, g or t
  misc_feature (1322)..(1322): n is either a, c, g or t
  misc_feature (1325)..(1325): n is either a, c, g or t
  misc_feature (1327)..(1327): n is either a, c, g or t
  misc_feature (1331)..(1331): n is either a, c, g or t
  misc_feature (1338)..(1338): n is either a, c, g or t
  misc_feature (1356)..(1356): n is either a, c, g or t
  misc_feature (1394)..(1394): n is either a, c, g or t
  misc_feature (1437)..(1437): n is either a, c, g or t
  misc_feature (1447)..(1447): n is either a, c, g or t
cccgccgaactcccacgaacacgcgcgaacgacgcaaaaaaaataacaaaacgaaaaaaaaccgccaaaacatccccataacgcgtacgcacacgcacgcgccccgacacgcgcctattattcccatccccccccgtcgttcgcaccgtccgaaccgcctataaaacgaccgcgaaacgaatcgaaattaattaaaacgtatcgacgaaactacccgaccccgcgcncacgacccctccgacgaccgccccccgcgacgaccccccattcttttttttccgcacgcgaaccgccccaccaacacccctacctccgctccacgcccctcgccgcacgaaactacgacgctcctcctcgtcgcccgcccgccgtcaacccctctctaccaaccacatttcatcgaacacgacaaacctccctccgcacccaccgcccccaaccctcccgcacccgtaaactcctacgcccccaccgcataacacaccccgctccgctcctaataatccccctccccgacgacgtaaccaacattacatcccgctctataaataaaccctcgccgccctcctccctctctccacatctcgtctcgcccgctaaccccgtaacgcgacccgtcgcacccgccgccanaaaatcgcccctccccgtatacacctacccgtccacgaccaanctcacgccccccccctaataacaacccgctattccgcatcaaaacgcacccaaacccacgacacaaaaaaaaaccaccctccacgcgactcgaccnccgatcgtaacgctcgccgcaaaacgcgatccgctacgctacgaccaatccacacctcgcacactatcantcactctacaatcgctctccgccgcgnatcgtcgcccgcctatataaaccgcgtacaaatcacgacgtcgacgccgcgcantatcgnacacgcatccctcgtctctcgcaaccnacacctcgctnctcaccacgcgacgtccgccatncacacgcgcactacgacgatacnaacacacaantcgacaaacacncgtcatcacaccccgacgacgctcgccgcgcgcgtcaccacgactaaatacntnaaaaatcgcgtntncgacgcgtccgaacatcaccgcgacacaacgcactatanacgcgtcgcgcgccgctactaaactaatataacacgtcatccncgcnatactccantcaacacgccaatacattcgcgtacgtcacncgtctaacgccncttctcncgtcantcgttacgctcacgtaccaatcccgcaaaaaccgataataaaccntctacgtccgcgtaacgannttncgntntcgnacaacgntcgttacgaattcacgtnactcgcacatacacacaaccgcgtccacacgcgttctnataactctacgctcaaccacgcgatctcaaaatccgacgcccntaaatctcgnaaaccacgaactaccccacgcaataacaccaccgcaacgcgtatctcccgaccgtccaatacgccgcttcgcaacga

SEQ ID NO: 20885 - DNA, 1070 bp, Artificial Sequence
  chemically treated genomic DNA (Homo sapiens) CpG-island No: 20885
  misc_feature (47)..(47): n is either a, c, g or t
  misc_feature (115)..(115): n is either a, c, g or t
  misc_feature (138)..(138): n is either a, c, g or t
  misc_feature (255)..(255): n is either a, c, g or t
  misc_feature (261)..(261): n is either a, c, g or t
  misc_feature (289)..(289): n is either a, c, g or t
  misc_feature (296)..(296): n is either a, c, g or t
  misc_feature (374)..(374): n is either a, c, g or t
  misc_feature (478)..(478): n is either a, c, g or t
  misc_feature (482)..(482): n is either a, c, g or t
  misc_feature (516)..(516): n is either a, c, g or t
  misc_feature (538)..(538): n is either a, c, g or t
  misc_feature (553)..(553): n is either a, c, g or t
  misc_feature (582)..(582): n is either a, c, g or t
  misc_feature (628)..(628): n is either a, c, g or t
  misc_feature (688)..(688): n is either a, c, g or t
  misc_feature (723)..(723): n is either a, c, g or t
  misc_feature (773)..(773): n is either a, c, g or t
  misc_feature (967)..(967): n is either a, c, g or t
  misc_feature (1013)..(1013): n is either a, c, g or t
  misc_feature (1046)..(1046): n is either a, c, g or t
  misc_feature (1053)..(1053): n is either a, c, g or t
  misc_feature (1069)..(1069): n is either a, c, g or t
gtcgattcgtaatacgcgggcggggcggggcggtcgttattaaaagnagtaaattagagacgagtattgatttcgtcgtttcgtcgttcgcgtcgtgtaaaaaagtttacgcgantaaaatttcgcgtcgcgcgtcgncgttgcgtcgtattacgtgttatcgtagtaggtcgcggtcgatcgtcgcgtttttttatggcgcgtaggtagggacgtcgacgattgttaggcgagtgttataagcgttagatagtngattanacgttattgtcgatcgtgatatagcgangttcgtnaatagtcgcgatgtgttttcgcggtagtaaatgagcgcgtatagagtgcgagagtatatcgattatttattatgttanacgcgcgcgtatcgtagcgagcgatcgttcgttatgttgttcgagatatatcgtttagatagtacgagagatcgtaagtacgaagacgatagagagattgagtnagtnatcgtcgtagatatgacgatacgcgcgagagaangattgatcgttagtagaacganatagaggtaggcgtncgagtgatagcgagatagttcgttagtantgcgattattcgtcgagtacgcgcgacggacgtcgcgttatcgttntagacgtacgtcgatagacgtagcgatgttgcgaggtggttcgtgcgacggagagcggtngttcggtcgatacgatcgtcgtttacgtttcgcgntcgagcgcgggatttcgttgatgggtagcggcgcgttgcgcgagcgatantaggtcgagcgtgcgttgtagtatagcggcggtgcggataagatttttatattaacgtcgttattcgcggtcgaacgtcgatggagaatagcgttcgataatatattggtagcgacgtatttattcgtagatgaaagcgaagtagttcgtagttcgttagttacgttcgtagatgcgtattcgtagtcgacganagtcgagttgtattagtcgtagtcgcgacgatggtagagatgaganatgagtcgggtgagtatatacgtcgtattatantagtaantaacgataatagttana

SEQ ID NO: 20886 - DNA, 1070 bp, Artificial Sequence
  chemically treated genomic DNA (Homo sapiens) CpG-island No: 20886
  misc_feature (2)..(2): n is either a, c, g or t
  misc_feature (18)..(18): n is either a, c, g or t
  misc_feature (25)..(25): n is either a, c, g or t
  misc_feature (58)..(58): n is either a, c, g or t
  misc_feature (104)..(104): n is either a, c, g or t
  misc_feature (298)..(298): n is either a, c, g or t
  misc_feature (348)..(348): n is either a, c, g or t
  misc_feature (383)..(383): n is either a, c, g or t
  misc_feature (443)..(443): n is either a, c, g or t
  misc_feature (489)..(489): n is either a, c, g or t
  misc_feature (518)..(518): n is either a, c, g or t
  misc_feature (533)..(533): n is either a, c, g or t
  misc_feature (555)..(555): n is either a, c, g or t
  misc_feature (589)..(589): n is either a, c, g or t
  misc_feature (593)..(593): n is either a, c, g or t
  misc_feature (697)..(697): n is either a, c, g or t
  misc_feature (775)..(775): n is either a, c, g or t
  misc_feature (782)..(782): n is either a, c, g or t
  misc_feature (810)..(810): n is either a, c, g or t
  misc_feature (816)..(816): n is either a, c, g or t
  misc_feature (933)..(933): n is either a, c, g or t
  misc_feature (956)..(956): n is either a, c, g or t
  misc_feature (1024)..(1024): n is either a, c, g or t
tntaactattatcgttanttactantataatacgacgtatatactcacccgactcatntctcatctctaccatcgtcgcgactacgactaatacaactcgactntcgtcgactacgaatacgcatctacgaacgtaactaacgaactacgaactacttcgctttcatctacgaataaatacgtcgctaccaatatattatcgaacgctattctccatcgacgttcgaccgcgaataacgacgttaatataaaaatcttatccgcaccgccgctatactacaacgcacgctcgacctantatcgctcgcgcaacgcgccgctacccatcaacgaaatcccgcgctcgancgcgaaacgtaaacgacgatcgtatcgaccgaacnaccgctctccgtcgcacgaaccacctcgcaacatcgctacgtctatcgacgtacgtctanaacgataacgcgacgtccgtcgcgcgtactcgacgaataatcgcantactaacgaactatctcgctatcactcgnacgcctacctctatntcgttctactaacgatcaatcnttctctcgcgcgtatcgtcatatctacgacgatnactnactcaatctctctatcgtcttcgtacttacgatctctcgtactatctaaacgatatatctcgaacaacataacgaacgatcgctcgctacgatacgcgcgcgtntaacataataaataatcgatatactctcgcactctatacgcgctcatttactaccgcgaaaacacatcgcgactattnacgaacntcgctatatcacgatcgacaataacgtntaatcnactatctaacgcttataacactcgcctaacaatcgtcgacgtccctacctacgcgccataaaaaaacgcgacgatcgaccgcgacctactacgataacacgtaatacgacgcaacgncgacgcgcgacgcgaaattttantcgcgtaaacttttttacacgacgcgaacgacgaaacgacgaaatcaatactcgtctctaatttactncttttaataacgaccgccccgccccgcccgcgtattacgaatcgac

SEQ ID NO: 20887 - DNA, 1070 bp, Artificial Sequence
  chemically treated genomic DNA (Homo sapiens) CpG-island No: 20887
  misc_feature (2)..(2): n is either a, c, g or t
  misc_feature (18)..(18): n is either a, c, g or t
  misc_feature (25)..(25): n is either a, c, g or t
  misc_feature (58)..(58): n is either a, c, g or t
  misc_feature (104)..(104): n is either a, c, g or t
  misc_feature (298)..(298): n is either a, c, g or t
  misc_feature (348)..(348): n is either a, c, g or t
  misc_feature (383)..(383): n is either a, c, g or t
  misc_feature (443)..(443): n is either a, c, g or t
  misc_feature (489)..(489): n is either a, c, g or t
  misc_feature (518)..(518): n is either a, c, g or t
  misc_feature (533)..(533): n is either a, c, g or t
  misc_feature (555)..(555): n is either a, c, g or t
  misc_feature (589)..(589): n is either a, c, g or t
  misc_feature (593)..(593): n is either a, c, g or t
  misc_feature (697)..(697): n is either a, c, g or t
  misc_feature (775)..(775): n is either a, c, g or t
  misc_feature (782)..(782): n is either a, c, g or t
  misc_feature (810)..(810): n is either a, c, g or t
  misc_feature (816)..(816): n is either a, c, g or t
  misc_feature (933)..(933): n is either a, c, g or t
  misc_feature (956)..(956): n is either a, c, g or t
  misc_feature (1024)..(1024): n is either a, c, g or t
tntagttgttgtcgttanttgttantatagtacggcgtgtgtgtttattcggtttatnttttatttttgttatcgtcgcggttgcgattggtatagttcgattntcgtcgattgcgggtgcgtatttacgagcgtggttgacgagttacggattgtttcgtttttatttgcgagtgagtgcgtcgttattagtgtgttatcggacgttgttttttatcgacgttcggtcgcgggtgacggcgttggtgtgagagttttgttcgtatcgtcgttgtgttgtagcgtacgttcggtttgntgtcgttcgcgtagcgcgtcgttgtttattagcgagatttcgcgttcgancgcggagcgtgagcgacggtcgtgtcggtcgaatnatcgtttttcgtcgtacggattatttcgtagtatcgttgcgtttatcggcgtgcgtttgngacgatggcgcggcgttcgtcgcgcgtgttcggcgaatagtcgtantattggcgagttatttcgttgttattcgngcgtttatttttgtntcgttttgttggcgattagttnttttttcgcgcgtatcgttatgtttgcggcggtngttngtttagtttttttgtcgttttcgtgtttgcgatttttcgtgttatttgagcgatgtgtttcgagtagtatggcgagcgatcgttcgttgcggtgcgcgcgcgtntgatatggtgggtagtcggtatgttttcgtattttgtgcgcgtttatttgttgtcgcggaggtatatcgcggttgttngcgagtntcgttgtgttacggtcgatagtggcgtntgattnattatttagcgtttatgatattcgtttgatagtcgtcggcgtttttgtttacgcgttatagaagggcgcggcggtcggtcgcggtttgttgcggtaatacgtggtgcgacgtagcgncggcgcgcggcgcggagttttgntcgcgtggatttttttgtacggcgcggacggcggggcgacgaggttagtgttcgtttttagtttgttntttttggtggcggtcgtttcgtttcgttcgcgtgttgcgggtcggt

SEQ ID NO: 20888 - DNA, 1070 bp, Artificial Sequence
  chemically treated genomic DNA (Homo sapiens) CpG-island No: 20888
  misc_feature (47)..(47): n is either a, c, g or t
  misc_feature (115)..(115): n is either a, c, g or t
  misc_feature (138)..(138): n is either a, c, g or t
  misc_feature (255)..(255): n is either a, c, g or t
  misc_feature (261)..(261): n is either a, c, g or t
  misc_feature (289)..(289): n is either a, c, g or t
  misc_feature (296)..(296): n is either a, c, g or t
  misc_feature (374)..(374): n is either a, c, g or t
  misc_feature (478)..(478): n is either a, c, g or t
  misc_feature (482)..(482): n is either a, c, g or t
  misc_feature (516)..(516): n is either a, c, g or t
  misc_feature (538)..(538): n is either a, c, g or t
  misc_feature (553)..(553): n is either a, c, g or t
  misc_feature (582)..(582): n is either a, c, g or t
  misc_feature (628)..(628): n is either a, c, g or t
  misc_feature (688)..(688): n is either a, c, g or t
  misc_feature (723)..(723): n is either a, c, g or t
  misc_feature (773)..(773): n is either a, c, g or t
  misc_feature (967)..(967): n is either a, c, g or t
  misc_feature (1013)..(1013): n is either a, c, g or t
  misc_feature (1046)..(1046): n is either a, c, g or t
  misc_feature (1053)..(1053): n is either a, c, g or t
  misc_feature (1069)..(1069): n is either a, c, g or t
accgacccgcaacacgcgaacgaaacgaaacgaccgccaccaaaaanaacaaactaaaaacgaacactaacctcgtcgccccgccgtccgcgccgtacaaaaaaatccacgcgancaaaactccgcgccgcgcgccgncgctacgtcgcaccacgtattaccgcaacaaaccgcgaccgaccgccgcgcccttctataacgcgtaaacaaaaacgccgacgactatcaaacgaatatcataaacgctaaataatnaatcanacgccactatcgaccgtaacacaacganactcgcnaacaaccgcgatatacctccgcgacaacaaataaacgcgcacaaaatacgaaaacataccgactacccaccatatcanacgcgcgcgcaccgcaacgaacgatcgctcgccatactactcgaaacacatcgctcaaataacacgaaaaatcgcaaacacgaaaacgacaaaaaaactaaacnaacnaccgccgcaaacataacgatacgcgcgaaaaaanaactaatcgccaacaaaacganacaaaaataaacgcncgaataacaacgaaataactcgccaatantacgactattcgccgaacacgcgcgacgaacgccgcgccatcgtcncaaacgcacgccgataaacgcaacgatactacgaaataatccgtacgacgaaaaacgatnattcgaccgacacgaccgtcgctcacgctccgcgntcgaacgcgaaatctcgctaataaacaacgacgcgctacgcgaacgacancaaaccgaacgtacgctacaacacaacgacgatacgaacaaaactctcacaccaacgccgtcacccgcgaccgaacgtcgataaaaaacaacgtccgataacacactaataacgacgcactcactcgcaaataaaaacgaaacaatccgtaactcgtcaaccacgctcgtaaatacgcacccgcaatcgacganaatcgaactataccaatcgcaaccgcgacgataacaaaaataaaanataaaccgaataaacacacacgccgtactatantaacaantaacgacaacaactana

SEQ ID NO: 20889 - DNA, 710 bp, Artificial Sequence
  chemically treated genomic DNA (Homo sapiens) CpG-island No: 20889
  misc_feature (204)..(204): n is either a, c, g or t
  misc_feature (240)..(240): n is either a, c, g or t
  misc_feature (370)..(370): n is either a, c, g or t
  misc_feature (373)..(373): n is either a, c, g or t
  misc_feature (561)..(561): n is either a, c, g or t
  misc_feature (591)..(591): n is either a, c, g or t
  misc_feature (663)..(663): n is either a, c, g or t
tcgttttttcgtttaacgagatacgcgcgtacgtcgtttaatatttaattcgatcgttatcggtattagtattttttttcgtcgtagtattattttcggttagatttaaataaagacgaagatatacgatatacgattcgacgacgtaataattattagataatagtaatacgcgttcggttcgacgtatataatttcgcgcgnatatagtatataattatatcgagacgtattcgtttntaacgatattacgtttgatatcgaaaattttattaagatataagaaatatcgaagagaattcgtcgcgtttttcgacgttttaaacgcgcgaaattcgtcggcggagttaggtataacgcgcgatacggntanatcgttacgacgttatattttataatcgatatgtaattatatattatagattttatgtcgaagcgacgcgtaagatcgattagttcggatcgcgtaaatcgcgcggttattagaataacgacgaatatcgtgtaatgtatcgtttttttgcgtttgtcgttttattattagagttaggagtaatagtngaacgagacgtagcgattagaggcgggttnatagataacgatatacgatacgtaagttagagcgttatatttataaagacgagtaagttagtattttaattntttcgagagtacggtttataaggtgtaattaatgagtatttagtatt

SEQ ID NO: 20890 - DNA, 710 bp, Artificial Sequence
  chemically treated genomic DNA (Homo sapiens) CpG-island No: 20890
  misc_feature (48)..(48): n is either a, c, g or t
  misc_feature (120)..(120): n is either a, c, g or t
  misc_feature (150)..(150): n is either a, c, g or t
  misc_feature (338)..(338): n is either a, c, g or t
  misc_feature (341)..(341): n is either a, c, g or t
  misc_feature (471)..(471): n is either a, c, g or t
  misc_feature (507)..(507): n is either a, c, g or t
aatactaaatactcattaattacaccttataaaccgtactctcgaaanaattaaaatactaacttactcgtctttataaatataacgctctaacttacgtatcgtatatcgttatctatnaacccgcctctaatcgctacgtctcgttcnactattactcctaactctaataataaaacgacaaacgcaaaaaaacgatacattacacgatattcgtcgttattctaataaccgcgcgatttacgcgatccgaactaatcgatcttacgcgtcgcttcgacataaaatctataatatataattacatatcgattataaaatataacgtcgtaacgatntanccgtatcgcgcgttatacctaactccgccgacgaatttcgcgcgtttaaaacgtcgaaaaacgcgacgaattctcttcgatatttcttatatcttaataaaattttcgatatcaaacgtaatatcgttanaaacgaatacgtctcgatataattatatactatatncgcgcgaaattatatacgtcgaaccgaacgcgtattactattatctaataattattacgtcgtcgaatcgtatatcgtatatcttcgtctttatttaaatctaaccgaaaataatactacgacgaaaaaaaatactaataccgataacgatcgaattaaatattaaacgacgtacgcgcgtatctcgttaaacgaaaaaacga

SEQ ID NO: 20891 - DNA, 710 bp, Artificial Sequence
  chemically treated genomic DNA (Homo sapiens) CpG-island No: 20891
  misc_feature (48)..(48): n is either a, c, g or t
  misc_feature (120)..(120): n is either a, c, g or t
  misc_feature (150)..(150): n is either a, c, g or t
  misc_feature (338)..(338): n is either a, c, g or t
  misc_feature (341)..(341): n is either a, c, g or t
  misc_feature (471)..(471): n is either a, c, g or t
  misc_feature (507)..(507): n is either a, c, g or t
ggtattgggtgtttattggttgtattttgtgggtcgtattttcgaggnggttggagtattagtttattcgtttttgtgggtgtggcgttttggtttgcgtgtcgtgtgtcgttatttatnggttcgtttttaatcgttgcgtttcgtttnattattgtttttggttttggtagtagagcggtaggcgtaggagggcggtatattgtacggtgttcgtcgttgttttggtgatcgcgcgatttgcgcggttcgggttagtcggttttgcgcgtcgtttcggtatgggatttgtggtatgtggttgtatgtcggttgtggggtgtggcgtcgtggcggtntgntcgtgtcgcgcgttgtgtttggtttcgtcggcggatttcgcgcgtttggggcgtcggggagcgcggcgagtttttttcggtgttttttgtgttttggtggggttttcggtgttaggcgtggtgtcgttgnagacgagtgcgtttcgatatggttgtgtgttgtgtncgcgcggggttgtgtgcgtcgggtcgggcgcgtgttgttgttgtttggtggttgttgcgtcgtcgagtcgtgtgtcgtgtgttttcgtttttgtttgggtttggtcgggggtggtgttgcggcgaggggggatgttggtgtcggtggcggtcgggttggatgttgggcgacgtgcgcgcgtgtttcgttgggcgggagggcgg

SEQ ID NO: 20892 - DNA, 710 bp, Artificial Sequence
  chemically treated genomic DNA (Homo sapiens) CpG-island No: 20892
  misc_feature (204)..(204): n is either a, c, g or t
  misc_feature (240)..(240): n is either a, c, g or t
  misc_feature (370)..(370): n is either a, c, g or t
  misc_feature (373)..(373): n is either a, c, g or t
  misc_feature (561)..(561): n is either a, c, g or t
  misc_feature (591)..(591): n is either a, c, g or t
  misc_feature (663)..(663): n is either a, c, g or t
ccgccctcccgcccaacgaaacacgcgcgcacgtcgcccaacatccaacccgaccgccaccgacaccaacatcccccctcgccgcaacaccacccccgaccaaacccaaacaaaaacgaaaacacacgacacacgactcgacgacgcaacaaccaccaaacaacaacaacacgcgcccgacccgacgcacacaaccccgcgcgnacacaacacacaaccatatcgaaacgcactcgtctncaacgacaccacgcctaacaccgaaaaccccaccaaaacacaaaaaacaccgaaaaaaactcgccgcgctccccgacgccccaaacgcgcgaaatccgccgacgaaaccaaacacaacgcgcgacacgancanaccgccacgacgccacaccccacaaccgacatacaaccacataccacaaatcccataccgaaacgacgcgcaaaaccgactaacccgaaccgcgcaaatcgcgcgatcaccaaaacaacgacgaacaccgtacaatataccgccctcctacgcctaccgctctactaccaaaaccaaaaacaataatnaaacgaaacgcaacgattaaaaacgaaccnataaataacgacacacgacacgcaaaccaaaacgccacacccacaaaaacgaataaactaatactccaaccncctcgaaaatacgacccacaaaatacaaccaataaacacccaatacc

SEQ ID NO: 20893 - DNA, 900 bp, Artificial Sequence
  chemically treated genomic DNA (Homo sapiens) CpG-island No: 20893
  misc_feature (249)..(249): n is either a, c, g or t
  misc_feature (363)..(363): n is either a, c, g or t
  misc_feature (366)..(366): n is either a, c, g or t
  misc_feature (414)..(414): n is either a, c, g or t
  misc_feature (512)..(512): n is either a, c, g or t
  misc_feature (648)..(648): n is either a, c, g or t
  misc_feature (838)..(838): n is either a, c, g or t
  misc_feature (846)..(846): n is either a, c, g or t
  misc_feature (849)..(849): n is either a, c, g or t
cgacgcgcgcgtagtcgttacgcgcgggtagtcggggaacgaaaaataagaaagggcgcgtacgcggcggcggcgtcggtagtcgcgcgacgacgattcgcggttattagcggagtcgagtcgttcgtaggcggcgaggagcggagaagtcgtcggacgcggcggaggagtcgggtcgtcgattcgtcgttatttagcgagaaacgacgtagacgtcgagagaagattacggaatacgtagcgaatagnagagtcgcgatcgtatcgtatcgtagtcgtattcgattcggagacgggagacgagttaaggagaagacgataagcgacgggaggcgtgagacgagcgcgggcggaagtcggganttngattcgcgtcgacgtagcggaagcggcgatcgaaggaaatcgaataantatgacgcgaaagacggagcgtaggcgtcgcggtcgtatattaagatacgcgaatattacggagcgcgagcgtagcgcgacgaaatatcggcggtatnataacgagagtaaggtatagagtagcgagtttattagtagagaacgggtaggtcgatatagggataggaaggaggggagacggtcgagtcgcgaatagatacgaagtagtagcgggggcgaagaggcgggaggtantagaggagggtagcgtcgttcgtagacgcgcggtcgatagggagtcgggatagcgtataaataagtcgcgcgcgagggaggcgagggagagggtagtattcgaggagacgaacggttatcgcgagcgggcgtcgcgcgacgagaaggcgagtacgggcggagtagtatttagtaagcggcgaggagcgtnggcgcgtngtnacggcgtcgcgtagacgagttagagaagcgatacgagatacgacggagtag

SEQ ID NO: 20894 - DNA, 900 bp, Artificial Sequence
  chemically treated genomic DNA (Homo sapiens) CpG-island No: 20894
  misc_feature (52)..(52): n is either a, c, g or t
  misc_feature (55)..(55): n is either a, c, g or t
  misc_feature (63)..(63): n is either a, c, g or t
  misc_feature (253)..(253): n is either a, c, g or t
  misc_feature (389)..(389): n is either a, c, g or t
  misc_feature (487)..(487): n is either a, c, g or t
  misc_feature (535)..(535): n is either a, c, g or t
  misc_feature (538)..(538): n is either a, c, g or t
  misc_feature (652)..(652): n is either a, c, g or t
ctactccgtcgtatctcgtatcgcttctctaactcgtctacgcgacgccgtnacnacgcgccnacgctcctcgccgcttactaaatactactccgcccgtactcgccttctcgtcgcgcgacgcccgctcgcgataaccgttcgtctcctcgaatactaccctctccctcgcctccctcgcgcgcgacttatttatacgctatcccgactccctatcgaccgcgcgtctacgaacgacgctaccctcctctantacctcccgcctcttcgcccccgctactacttcgtatctattcgcgactcgaccgtctcccctccttcctatccctatatcgacctacccgttctctactaataaactcgctactctataccttactctcgttatnataccgccgatatttcgtcgcgctacgctcgcgctccgtaatattcgcgtatcttaatatacgaccgcgacgcctacgctccgtctttcgcgtcatanttattcgatttccttcgatcgccgcttccgctacgtcgacgcgaatcnaantcccgacttccgcccgcgctcgtctcacgcctcccgtcgcttatcgtcttctccttaactcgtctcccgtctccgaatcgaatacgactacgatacgatacgatcgcgactctnctattcgctacgtattccgtaatcttctctcgacgtctacgtcgtttctcgctaaataacgacgaatcgacgacccgactcctccgccgcgtccgacgacttctccgctcctcgccgcctacgaacgactcgactccgctaataaccgcgaatcgtcgtcgcgcgactaccgacgccgccgccgcgtacgcgccctttcttatttttcgttccccgactacccgcgcgtaacgactacgcgcgcgtcg

SEQ ID NO: 20895 - DNA, 900 bp, Artificial Sequence
  chemically treated genomic DNA (Homo sapiens) CpG-island No: 20895
  misc_feature (52)..(52): n is either a, c, g or t
  misc_feature (55)..(55): n is either a, c, g or t
  misc_feature (63)..(63): n is either a, c, g or t
  misc_feature (253)..(253): n is either a, c, g or t
  misc_feature (389)..(389): n is either a, c, g or t
  misc_feature (487)..(487): n is either a, c, g or t
  misc_feature (535)..(535): n is either a, c, g or t
  misc_feature (538)..(538): n is either a, c, g or t
  misc_feature (652)..(652): n is either a, c, g or t
ttgtttcgtcgtgtttcgtgtcgtttttttggttcgtttgcgcggcgtcgtngtngcgcgttngcgtttttcgtcgtttgttgggtgttgtttcgttcgtgttcgttttttcgtcgcgcggcgttcgttcgcggtggtcgttcgttttttcgggtgttgttttttttttcgtttttttcgcgcgcggtttgtttgtgcgttgtttcggttttttgtcggtcgcgcgtttgcgagcggcgttgtttttttttgntgtttttcgttttttcgttttcgttgttgtttcgtgtttattcgcggttcggtcgtttttttttttttttgtttttgtgtcggtttgttcgttttttgttggtgggttcgttgttttatgttttgttttcgttgtngtgtcgtcggtgtttcgtcgcgttgcgttcgcgtttcgtagtgttcgcgtgttttagtgtgcggtcgcggcgtttgcgtttcgtttttcgcgttatgnttgttcggtttttttcggtcgtcgttttcgttgcgtcggcgcgggttnggntttcggttttcgttcgcgttcgttttacgtttttcgtcgtttgtcgttttttttttggttcgtttttcgttttcgggtcgggtgcggttgcggtgcggtgcggtcgcggttttnttgttcgttgcgtgtttcgtggttttttttcggcgtttgcgtcgtttttcgttgggtggcggcgggtcggcggttcggttttttcgtcgcgttcggcggttttttcgtttttcgtcgtttgcgggcggttcggtttcgttggtggtcgcgggtcgtcgtcgcgcggttgtcggcgtcgtcgtcgcgtgcgcgtttttttttgtttttcgtttttcggttgttcgcgcgtggcggttgcgcgcgcgtcg

SEQ ID NO: 20896 - DNA, 900 bp, Artificial Sequence
  chemically treated genomic DNA (Homo sapiens) CpG-island No: 20896
  misc_feature (249)..(249): n is either a, c, g or t
  misc_feature (363)..(363): n is either a, c, g or t
  misc_feature (366)..(366): n is either a, c, g or t
  misc_feature (414)..(414): n is either a, c, g or t
  misc_feature (512)..(512): n is either a, c, g or t
  misc_feature (648)..(648): n is either a, c, g or t
  misc_feature (838)..(838): n is either a, c, g or t
  misc_feature (846)..(846): n is either a, c, g or t
  misc_feature (849)..(849): n is either a, c, g or t
cgacgcgcgcgcaaccgccacgcgcgaacaaccgaaaaacgaaaaacaaaaaaaaacgcgcacgcgacgacgacgccgacaaccgcgcgacgacgacccgcgaccaccaacgaaaccgaaccgcccgcaaacgacgaaaaacgaaaaaaccgccgaacgcgacgaaaaaaccgaaccgccgacccgccgccacccaacgaaaaacgacgcaaacgccgaaaaaaaaccacgaaacacgcaacgaacaanaaaaccgcgaccgcaccgcaccgcaaccgcacccgacccgaaaacgaaaaacgaaccaaaaaaaaaacgacaaacgacgaaaaacgtaaaacgaacgcgaacgaaaaccgaaanccnaacccgcgccgacgcaacgaaaacgacgaccgaaaaaaaccgaacaancataacgcgaaaaacgaaacgcaaacgccgcgaccgcacactaaaacacgcgaacactacgaaacgcgaacgcaacgcgacgaaacaccgacgacacnacaacgaaaacaaaacataaaacaacgaacccaccaacaaaaaacgaacaaaccgacacaaaaacaaaaaaaaaaaaaaacgaccgaaccgcgaataaacacgaaacaacaacgaaaacgaaaaaacgaaaaacancaaaaaaaaacaacgccgctcgcaaacgcgcgaccgacaaaaaaccgaaacaacgcacaaacaaaccgcgcgcgaaaaaaacgaaaaaaaaaacaacacccgaaaaaacgaacgaccaccgcgaacgaacgccgcgcgacgaaaaaacgaacacgaacgaaacaacacccaacaaacgacgaaaaacgcnaacgcgcnacnacgacgccgcgcaaacgaaccaaaaaaacgacacgaaacacgacgaaacaa

SEQ ID NO: 20897 - DNA, 1296 bp, Artificial Sequence
  chemically treated genomic DNA (Homo sapiens) CpG-island No: 20897
  misc_feature (21)..(21): n is either a, c, g or t
  misc_feature (57)..(57): n is either a, c, g or t
  misc_feature (94)..(94): n is either a, c, g or t
  misc_feature (615)..(615): n is either a, c, g or t
  misc_feature (854)..(854): n is either a, c, g or t
  misc_feature (912)..(912): n is either a, c, g or t
  misc_feature (965)..(965): n is either a, c, g or t
  misc_feature (1163)..(1163): n is either a, c, g or t
  misc_feature (1207)..(1207): n is either a, c, g or t
gttttaaaataaaattatttnttcggttcgtatttttcgcgtttcgatcgagtcgtncgttcggtcggcgcgtcgtcgacgttcgttttttttngatagttttattttttatttttcgtgcgtcgtttcggtttaattaattaattcggcgtatcgggcgtacgcgttcggggagcgaaatttattttattatcgcgcgttatatacgagataacgtcgtcgggcgtagcggatcgtcgagcgggtagtcggcgcgataggtcggtaggttagtcgggttcgttttttaattatacgcgtatgcgttttcgttttttgaggtgggttttttcggaggggcggggtcgggggcggggttcgacgcgtcgttcgttttcgtcgtatcggggggcggtcgtttttcgcgtacgcgcgggcgtgcgtaagcgcgtttcgtttttcggttcgtataagaaaaaaaaaaagtttttttcgcgcgtcggggtcgcggatttcgtcgtttcgtcgggcgagggaattaacgttatcgagtacgtcgggtttcgcggttcgcgattttagtacgttacgcgtcgagcgtcgtaggtcgatcgggtttttattattcgatttcgnataaggtacgcgcgtttcgtcgtttttacgagtattgttagcgtatttacgttagttcggagtatcgcgtttaggcgtatcgtagattttataacgtacggttacgttaggcgttttgcgagtcgagattattatttattcgattatatcgtttataggcggatttaagcggcgatgcgcggcgcgggcgcgggtcggagcgcgtgtaggaggcgttcgattttagatagacgacgttntttagttttaggcggttgtaattcgatcgcgattttcgttcgtcgtcgcgttagcgtncggatcgagcgcgttttagtgtcggtgcgggcggtcgtgttgcgcgtcgcgtngtcggcgtggattcgatatcgattttttaggcgtatatgtagcgcgggtcgcgtagcggagatacgggattcgttcgagcgttttagttcgtattttcgttatttttatatcgtgcgcgcgatttagacgataagatacgttttatagtcgttagcggtacggaatcggcgtaggttacgttaaatacgcgtttacgncgtttcgatcgtattcgttcgcgcgcgcgtttcgtttttatagnataagagagtggtcggtgcggggcgtcggagaggcgttaaggaacgaggtatcgttaattcgcgttttaggacgcgttcgcggcgtaat

SEQ ID NO: 20898 - DNA, 1296 bp, Artificial Sequence
  chemically treated genomic DNA (Homo sapiens) CpG-island No: 20898
  misc_feature (90)..(90): n is either a, c, g or t
  misc_feature (134)..(134): n is either a, c, g or t
  misc_feature (332)..(332): n is either a, c, g or t
  misc_feature (385)..(385): n is either a, c, g or t
  misc_feature (443)..(443): n is either a, c, g or t
  misc_feature (682)..(682): n is either a, c, g or t
  misc_feature (1203)..(1203): n is either a, c, g or t
  misc_feature (1240)..(1240): n is either a, c, g or t
  misc_feature (1276)..(1276): n is either a, c, g or t
attacgccgcgaacgcgtcctaaaacgcgaattaacgatacctcgttccttaacgcctctccgacgccccgcaccgaccactctcttatnctataaaaacgaaacgcgcgcgcgaacgaatacgatcgaaacgncgtaaacgcgtatttaacgtaacctacgccgattccgtaccgctaacgactataaaacgtatcttatcgtctaaatcgcgcgcacgatataaaaataacgaaaatacgaactaaaacgctcgaacgaatcccgtatctccgctacgcgacccgcgctacatatacgcctaaaaaatcgatatcgaatccacgccgacnacgcgacgcgcaacacgaccgcccgcaccgacactaaaacgcgctcgatccgnacgctaacgcgacgacgaacgaaaatcgcgatcgaattacaaccgcctaaaactaaanaacgtcgtctatctaaaatcgaacgcctcctacacgcgctccgacccgcgcccgcgccgcgcatcgccgcttaaatccgcctataaacgatataatcgaataaataataatctcgactcgcaaaacgcctaacgtaaccgtacgttataaaatctacgatacgcctaaacgcgatactccgaactaacgtaaatacgctaacaatactcgtaaaaacgacgaaacgcgcgtaccttatncgaaatcgaataataaaaacccgatcgacctacgacgctcgacgcgtaacgtactaaaatcgcgaaccgcgaaacccgacgtactcgataacgttaattccctcgcccgacgaaacgacgaaatccgcgaccccgacgcgcgaaaaaaactttttttttttcttatacgaaccgaaaaacgaaacgcgcttacgcacgcccgcgcgtacgcgaaaaacgaccgccccccgatacgacgaaaacgaacgacgcgtcgaaccccgcccccgaccccgcccctccgaaaaaacccacctcaaaaaacgaaaacgcatacgcgtataattaaaaaacgaacccgactaacctaccgacctatcgcgccgactacccgctcgacgatccgctacgcccgacgacgttatctcgtatataacgcgcgataataaaataaatttcgctccccgaacgcgtacgcccgatacgccgaattaattaattaaaccgaaacgacgcacgaaaaataaaaaataaaactatcnaaaaaaaacgaacgtcgacgacgcgccgaccgaacgnacgactcgatcgaaacgcgaaaaatacgaaccgaanaaataattttattttaaaac

SEQ ID NO: 20899 - DNA, 1296 bp, Artificial Sequence
  chemically treated genomic DNA (Homo sapiens) CpG-island No: 20899
  misc_feature (90)..(90): n is either a, c, g or t
  misc_feature (134)..(134): n is either a, c, g or t
  misc_feature (332)..(332): n is either a, c, g or t
  misc_feature (385)..(385): n is either a, c, g or t
  misc_feature (443)..(443): n is either a, c, g or t
  misc_feature (682)..(682): n is either a, c, g or t
  misc_feature (1203)..(1203): n is either a, c, g or t
  misc_feature (1240)..(1240): n is either a, c, g or t
  misc_feature (1276)..(1276): n is either a, c, g or t
gttgcgtcgcgggcgcgttttggggcgcgaattagcgatgtttcgttttttggcgttttttcggcgtttcgtatcggttatttttttatnttatgggggcggggcgcgcgcgcgggcgggtgcggtcggggcgncgtgggcgcgtgtttggcgtggtttgcgtcggtttcgtgtcgttgacgattgtggggcgtgttttgtcgtttaggtcgcgcgtacggtgtaggaatggcgggggtgcgggttggagcgttcgggcggatttcgtattttcgttgcgcggttcgcgttgtatgtgcgtttaggaagtcggtgtcgggtttacgtcgatngcgcgacgcgtagtacggtcgttcgtatcggtattggagcgcgttcgattcgnacgttgacgcggcggcggacgggggtcgcggtcgagttgtagtcgtttggggttgggnagcgtcgtttgtttagagtcgggcgttttttgtacgcgtttcggttcgcgttcgcgtcgcgtatcgtcgtttgggttcgtttgtgggcggtgtggtcgggtgggtggtggtttcggttcgtagggcgtttggcgtggtcgtacgttgtggggtttgcggtgcgtttgggcgcggtgtttcgggttggcgtgggtgcgttggtagtgttcgtgagggcggcggggcgcgcgtgttttgtncggggtcgggtggtgggggttcggtcggtttgcggcgttcggcgcgtggcgtgttgggatcgcgggtcgcggggttcggcgtgttcggtggcgttagttttttcgttcggcggggcggcgggattcgcggtttcggcgcgcgggaggggtttttttttttttttgtgcgggtcggggggcggggcgcgtttacgtacgttcgcgcgtgcgcggggggcggtcgtttttcggtgcggcgggggcgggcggcgcgtcgggtttcgttttcggtttcgttttttcggagaagtttattttaaagggcgggggcgtatgcgcgtgtggttggggggcgggttcggttggtttgtcggtttatcgcgtcggttgttcgttcggcggttcgttgcgttcggcggcgttgtttcgtgtgtggcgcgcggtggtggggtgggtttcgtttttcgggcgcgtgcgttcggtgcgtcgggttggttggttgggtcggggcggcgtacgggggatggagggtggaattgttnggaaagggcgggcgtcggcggcgcgtcggtcgggcgngcggttcgatcggggcgcgaggagtgcgagtcgggngggtggttttgttttggggt

SEQ ID NO: 20900 - DNA, 1296 bp, Artificial Sequence
  chemically treated genomic DNA (Homo sapiens) CpG-island No: 20900
  misc_feature (21)..(21): n is either a, c, g or t
  misc_feature (57)..(57): n is either a, c, g or t
  misc_feature (94)..(94): n is either a, c, g or t
  misc_feature (615)..(615): n is either a, c, g or t
  misc_feature (854)..(854): n is either a, c, g or t
  misc_feature (912)..(912): n is either a, c, g or t
  misc_feature (965)..(965): n is either a, c, g or t
  misc_feature (1163)..(1163): n is either a, c, g or t
  misc_feature (1207)..(1207): n is either a, c, g or t
accccaaaacaaaaccacccncccgactcgcactcctcgcgccccgatcgaaccgcncgcccgaccgacgcgccgccgacgcccgccctttccnaacaattccaccctccatcccccgtacgccgccccgacccaaccaaccaacccgacgcaccgaacgcacgcgcccgaaaaacgaaacccaccccaccaccgcgcgccacacacgaaacaacgccgccgaacgcaacgaaccgccgaacgaacaaccgacgcgataaaccgacaaaccaaccgaacccgccccccaaccacacgcgcatacgcccccgccctttaaaataaacttctccgaaaaaacgaaaccgaaaacgaaacccgacgcgccgcccgcccccgccgcaccgaaaaacgaccgccccccgcgcacgcgcgaacgtacgtaaacgcgccccgccccccgacccgcacaaaaaaaaaaaaaaacccctcccgcgcgccgaaaccgcgaatcccgccgccccgccgaacgaaaaaactaacgccaccgaacacgccgaaccccgcgacccgcgatcccaacacgccacgcgccgaacgccgcaaaccgaccgaacccccaccacccgaccccgnacaaaacacgcgcgccccgccgccctcacgaacactaccaacgcacccacgccaacccgaaacaccgcgcccaaacgcaccgcaaaccccacaacgtacgaccacgccaaacgccctacgaaccgaaaccaccacccacccgaccacaccgcccacaaacgaacccaaacgacgatacgcgacgcgaacgcgaaccgaaacgcgtacaaaaaacgcccgactctaaacaaacgacgctncccaaccccaaacgactacaactcgaccgcgacccccgtccgccgccgcgtcaacgtncgaatcgaacgcgctccaataccgatacgaacgaccgtactacgcgtcgcgcnatcgacgtaaacccgacaccgacttcctaaacgcacatacaacgcgaaccgcgcaacgaaaatacgaaatccgcccgaacgctccaacccgcacccccgccattcctacaccgtacgcgcgacctaaacgacaaaacacgccccacaatcgtcaacgacacgaaaccgacgcaaaccacgccaaacacgcgcccacgncgccccgaccgcacccgcccgcgcgcgcgccccgcccccataanataaaaaaataaccgatacgaaacgccgaaaaaacgccaaaaaacgaaacatcgctaattcgcgccccaaaacgcgcccgcgacgcaac

SEQ ID NO: 20901 - DNA, 921 bp, Artificial Sequence
  chemically treated genomic DNA (Homo sapiens) CpG-island No: 20901
  misc_feature (576)..(576): n is either a, c, g or t
gatcgtcgcgtagtgtttagagagtcgcgttcgcgcgtttacgcgtcggttgtcgacgcggtattatcgagtttttttttttttttattttaaaatcgagatagggggaggggaggcgatcggacgtatattttaaatataataggggggggggggcgcgtcgtttaatttataatataataaatacgattaaatcggcgttcgaaaagaataaaaataaaaagtcgtcgtcgcgcggtcgatcggggagttagatataatcgcgattagacgttagcgttcggagagagtttacggcgcgaaatcgcggacgggatagcgttaggcgatacggagggtacggcgtcggcgaggtgcgcgtcggcggttagtagggtttagggacgggagagacgtacgatagcgcgtcgggaaacgatcggtataggtcggttcgcgtttagtacgcggtcgttcggaatatatagtacgcgatataagtgcgtagcggaggagcgggacggcggaggagggacgtagaagtatcgtaattaacgagagcgcggaagggacgagagagataagttaagggtagtngcggatagagcgaggagtttcgtcgttacgcggagggacgcgacgggcggcgaagggcgagggagggatcgttagggcggggagaggttgggagcggaattttacgtttcgcggcggtcgtcgcgacgttacgcgtgatatgtatcgtttatttcgcgttaaagagagcggtcgatagaagcgacgagtattataggggcggggcggagatgtagaggatgagagtaagtacgcgttcgcgcggcgtaatagttcggttagtcgtcgttgacgcgagagtattatttcgggaatagaggtttcggtacgggatttaggagttacgcgaaagaagagaagcgcgta

SEQ ID NO: 20902 - DNA, 921 bp, Artificial Sequence
  chemically treated genomic DNA (Homo sapiens) CpG-island No: 20902
  misc_feature (346)..(346): n is either a, c, g or t
tacgcgcttctcttctttcgcgtaactcctaaatcccgtaccgaaacctctattcccgaaataatactctcgcgtcaacgacgactaaccgaactattacgccgcgcgaacgcgtacttactctcatcctctacatctccgccccgcccctataatactcgtcgcttctatcgaccgctctctttaacgcgaaataaacgatacatatcacgcgtaacgtcgcgacgaccgccgcgaaacgtaaaattccgctcccaacctctccccgccctaacgatccctccctcgcccttcgccgcccgtcgcgtccctccgcgtaacgacgaaactcctcgctctatccgcnactacccttaacttatctctctcgtcccttccgcgctctcgttaattacgatacttctacgtccctcctccgccgtcccgctcctccgctacgcacttatatcgcgtactatatattccgaacgaccgcgtactaaacgcgaaccgacctataccgatcgtttcccgacgcgctatcgtacgtctctcccgtccctaaaccctactaaccgccgacgcgcacctcgccgacgccgtaccctccgtatcgcctaacgctatcccgtccgcgatttcgcgccgtaaactctctccgaacgctaacgtctaatcgcgattatatctaactccccgatcgaccgcgcgacgacgactttttatttttattcttttcgaacgccgatttaatcgtatttattatattataaattaaacgacgcgcccccccccccctattatatttaaaatatacgtccgatcgcctcccctccccctatctcgattttaaaataaaaaaaaaaaaaaactcgataataccgcgtcgacaaccgacgcgtaaacgcgcgaacgcgactctctaaacactacgcgacgatc

SEQ ID NO: 20903 - DNA, 921 bp, Artificial Sequence
  chemically treated genomic DNA (Homo sapiens) CpG-island No: 20903
  misc_feature (346)..(346): n is either a, c, g or t
tgcgcgttttttttttttcgcgtggtttttgggtttcgtgtcggggtttttgttttcggggtggtgttttcgcgttagcgacggttggtcgggttgttgcgtcgcgcgggcgcgtgtttgtttttattttttgtattttcgtttcgtttttatggtgttcgtcgtttttgtcgatcgttttttttggcgcggggtgggcggtgtatgttacgcgtggcgtcgcggcggtcgtcgcggggcgtgaggtttcgtttttagttttttttcgttttggcggtttttttttcgtttttcgtcgttcgtcgcgttttttcgcgtggcggcgaggtttttcgttttgttcgtngttgtttttggtttgtttttttcgtttttttcgcgttttcgttgattgcggtgtttttacgtttttttttcgtcgtttcgttttttcgttgcgtatttgtgtcgcgtgttgtgtgtttcgggcggtcgcgtgttgggcgcgggtcggtttgtgtcggtcgtttttcggcgcgttgtcgtacgtttttttcgtttttgggttttgttggtcgtcggcgcgtatttcgtcggcgtcgtgtttttcgtgtcgtttgacgttgtttcgttcgcgatttcgcgtcgtgggtttttttcgggcgttagcgtttggtcgcggttgtgtttaatttttcgatcggtcgcgcggcggcggttttttgtttttgtttttttcgagcgtcggtttggtcgtgtttgttgtattgtggattgggcggcgcgtttttttttttttgttgtgtttagggtgtgcgttcgatcgttttttttttttttgtttcggttttaaaataaaaaaaaaaaagggttcggtggtgtcgcgtcggtaatcggcgcgtgggcgcgcgggcgcggttttttgggtattgcgcggcgatt

SEQ ID NO: 20904 - DNA, 921 bp, Artificial Sequence
  chemically treated genomic DNA (Homo sapiens) CpG-island No: 20904
  misc_feature (576)..(576): n is either a, c, g or t
aatcgccgcgcaatacccaaaaaaccgcgcccgcgcgcccacgcgccgattaccgacgcgacaccaccgaacccttttttttttttattttaaaaccgaaacaaaaaaaaaaaaaacgatcgaacgcacaccctaaacacaacaaaaaaaaaaaaacgcgccgcccaatccacaatacaacaaacacgaccaaaccgacgctcgaaaaaaacaaaaacaaaaaaccgccgccgcgcgaccgatcgaaaaattaaacacaaccgcgaccaaacgctaacgcccgaaaaaaacccacgacgcgaaatcgcgaacgaaacaacgtcaaacgacacgaaaaacacgacgccgacgaaatacgcgccgacgaccaacaaaacccaaaaacgaaaaaaacgtacgacaacgcgccgaaaaacgaccgacacaaaccgacccgcgcccaacacgcgaccgcccgaaacacacaacacgcgacacaaatacgcaacgaaaaaacgaaacgacgaaaaaaaaacgtaaaaacaccgcaatcaacgaaaacgcgaaaaaaacgaaaaaaacaaaccaaaaacaacnacgaacaaaacgaaaaacctcgccgccacgcgaaaaaacgcgacgaacgacgaaaaacgaaaaaaaaaccgccaaaacgaaaaaaaactaaaaacgaaacctcacgccccgcgacgaccgccgcgacgccacgcgtaacatacaccgcccaccccgcgccaaaaaaaacgatcgacaaaaacgacgaacaccataaaaacgaaacgaaaatacaaaaaataaaaacaaacacgcgcccgcgcgacgcaacaacccgaccaaccgtcgctaacgcgaaaacaccaccccgaaaacaaaaaccccgacacgaaacccaaaaaccacgcgaaaaaaaaaaaacgcgca

SEQ ID NO: 20905 - DNA, 996 bp, Artificial Sequence
  chemically treated genomic DNA (Homo sapiens) CpG-island No: 20905
  misc_feature (105)..(105): n is either a, c, g or t
  misc_feature (243)..(243): n is either a, c, g or t
  misc_feature (771)..(771): n is either a, c, g or t
gagaggagcggtttcgagggggggataggggaaagttcgattataggttcgtaggcgtcggggcgggcggtttatagagcgcgcgttttttataaaaaatagtgngggtggcgagaggggaggtgttcgcgatatatcgtaacgtgcgcgtttaggttcgaagggtcgcgtaggtatattaaaagaaatggttttcgttacgtatttcgtttttttttttttttttttttttttttttcgttnaattttatttattatatttttattataaaaaaattaaaatacggggggcgcgcgtcgtttaattatatattttatattttattttcggtataagaaaaaaaaaaaaaaatatcgcggatttcgacgaattcgtcgcgcgtttttcgttcggcggttttaagatataaaaattttattcgatttaatttttcgataatattagatcggcgtttttacgtatatttattagttaatcgcgtttcgtttattagaatatcgcgagttagacgcggttatattagcggtcgtcgtttatcgagagattcgatttcgttcgacgataatttacgggcgtattcgttcgtcgttagattcgataaggattcgcgagttttaaaattcgttcgtcgatacgtttcgttttattagtagaggtatattatttaattttgatatataacgaatcgattcgaatttttagatattcgttttattttattaagtcgaagcgttaagtagttacgagcgaacgaataacgatttatgatntaattattttcggtttcgcgcgcgatcgttttagtcgaaacggtcggttttattcgtcgaacgtcgtttcgaagcgtcgaggaattttaagatatagtatacgtaggtttcgtaggatacgcgcgttttgattcgttcgtatagggtgcgcgcgcgtcgtttttatttttttcgaattcgttttttagcgttagatagttcgtaatcggcgttaattattagtat

SEQ ID NO: 20906 - DNA, 996 bp, Artificial Sequence
  chemically treated genomic DNA (Homo sapiens) CpG-island No: 20906
  misc_feature (226)..(226): n is either a, c, g or t
  misc_feature (754)..(754): n is either a, c, g or t
  misc_feature (892)..(892): n is either a, c, g or t
atactaataattaacgccgattacgaactatctaacgctaaaaaacgaattcgaaaaaaataaaaacgacgcgcgcgcaccctatacgaacgaatcaaaacgcgcgtatcctacgaaacctacgtatactatatcttaaaattcctcgacgcttcgaaacgacgttcgacgaataaaaccgaccgtttcgactaaaacgatcgcgcgcgaaaccgaaaataattanatcataaatcgttattcgttcgctcgtaactacttaacgcttcgacttaataaaataaaacgaatatctaaaaattcgaatcgattcgttatatatcaaaattaaataatatacctctactaataaaacgaaacgtatcgacgaacgaattttaaaactcgcgaatccttatcgaatctaacgacgaacgaatacgcccgtaaattatcgtcgaacgaaatcgaatctctcgataaacgacgaccgctaatataaccgcgtctaactcgcgatattctaataaacgaaacgcgattaactaataaatatacgtaaaaacgccgatctaatattatcgaaaaattaaatcgaataaaatttttatatcttaaaaccgccgaacgaaaaacgcgcgacgaattcgtcgaaatccgcgatatttttttttttttttcttataccgaaaataaaatataaaatatataattaaacgacgcgcgccccccgtattttaatttttttataataaaaatataataaataaaattnaacgaaaaaaaaaaaaaaaaaaaaaaaaaaaaacgaaatacgtaacgaaaaccatttcttttaatatacctacgcgacccttcgaacctaaacgcgcacgttacgatatatcgcgaacacctcccctctcgccacccncactattttttataaaaaacgcgcgctctataaaccgcccgccccgacgcctacgaacctataatcgaactttcccctatccccccctcgaaaccgctcctctc

SEQ ID NO: 20907 - DNA, 996 bp, Artificial Sequence
  chemically treated genomic DNA (Homo sapiens) CpG-island No: 20907
  misc_feature (226)..(226): n is either a, c, g or t
  misc_feature (754)..(754): n is either a, c, g or t
  misc_feature (892)..(892): n is either a, c, g or t
gtgttggtggttggcgtcggttacgggttatttggcgttggggggcgaattcgagggaggtaggggcggcgcgcgcgtattttgtgcggacgggttagggcgcgcgtgttttgcggggtttgcgtgtgttgtgttttggggtttttcggcgtttcggggcggcgttcggcgggtgaggtcggtcgtttcggttggggcggtcgcgcgcgaggtcggggatggttgngttatgggtcgttgttcgttcgttcgtggttgtttggcgtttcggtttggtggggtggggcgggtatttgggggttcgagtcgattcgttatgtgttagagttgggtggtgtgtttttattggtggggcggggcgtgtcggcgggcgggttttggggttcgcgggtttttgtcggatttggcggcgagcgggtgcgttcgtgggttgtcgtcgagcggggtcgggtttttcggtgggcggcggtcgttggtgtggtcgcgtttggttcgcggtgttttggtgggcggggcgcggttggttggtgggtgtgcgtgggggcgtcggtttggtgttgtcggaggattgggtcgggtggggtttttgtgttttggggtcgtcgggcggggggcgcgcggcgaattcgtcggggttcgcggtgttttttttttttttttttatatcggggatggggtgtggggtgtgtggttgggcggcgcgcgtttttcgtgttttggtttttttgtggtgggggtgtggtgggtggggttnggcggggagaaaaaaaagaggggggggggggggcggggtgcgtggcgggggttattttttttggtgtgtttgcgcgatttttcgggtttgggcgcgtacgttgcggtgtgtcgcgggtattttttttttcgttatttntattattttttgtggggggcgcgcgttttgtgggtcgttcgtttcggcgtttgcgagtttgtagtcgggtttttttttgtttttttttcggggtcgtttttttt

SEQ ID NO: 20908 - DNA, 996 bp, Artificial Sequence
  chemically treated genomic DNA (Homo sapiens) CpG-island No: 20908
  misc_feature (105)..(105): n is either a, c, g or t
  misc_feature (243)..(243): n is either a, c, g or t
  misc_feature (771)..(771): n is either a, c, g or t
aaaaaaaacgaccccgaaaaaaaaacaaaaaaaaacccgactacaaactcgcaaacgccgaaacgaacgacccacaaaacgcgcgccccccacaaaaaataatanaaataacgaaaaaaaaaatacccgcgacacaccgcaacgtacgcgcccaaacccgaaaaatcgcgcaaacacaccaaaaaaaataacccccgccacgcaccccgcccccccccccccctcttttttttctccccgccnaaccccacccaccacacccccaccacaaaaaaaccaaaacacgaaaaacgcgcgccgcccaaccacacaccccacaccccatccccgatataaaaaaaaaaaaaaaaaacaccgcgaaccccgacgaattcgccgcgcgccccccgcccgacgaccccaaaacacaaaaaccccacccgacccaatcctccgacaacaccaaaccgacgcccccacgcacacccaccaaccaaccgcgccccgcccaccaaaacaccgcgaaccaaacgcgaccacaccaacgaccgccgcccaccgaaaaacccgaccccgctcgacgacaacccacgaacgcacccgctcgccgccaaatccgacaaaaacccgcgaaccccaaaacccgcccgccgacacgccccgccccaccaataaaaacacaccacccaactctaacacataacgaatcgactcgaacccccaaatacccgccccaccccaccaaaccgaaacgccaaacaaccacgaacgaacgaacaacgacccataacncaaccatccccgacctcgcgcgcgaccgccccaaccgaaacgaccgacctcacccgccgaacgccgccccgaaacgccgaaaaaccccaaaacacaacacacgcaaaccccgcaaaacacgcgcgccctaacccgtccgcacaaaatacgcgcgcgccgcccctacctccctcgaattcgccccccaacgccaaataacccgtaaccgacgccaaccaccaacac

SEQ ID NO: 20909 - DNA, 542 bp, Artificial Sequence
  chemically treated genomic DNA (Homo sapiens) CpG-island No: 20909
  misc_feature (262)..(262): n is either a, c, g or t
  misc_feature (514)..(514): n is either a, c, g or t
atcgacgagtcgtcgtagcgataatagttaggagaatcgacggggagagaggaggaacgaaatagtagattttcgttcggttagaaggagcgattacgaagcgagaagttaataaagaaagttcggaagcgagaaaaattagcggatatagacgtattatagagacgttcggtatgtttttagcgcgtttatcgaagaacgcgagaagcgaacggaagaaaatcgttatacgatatttagttttataagacgtatcgtttancggtcggaaagagcgtgcgattcgagcgtagagcgatcgacgcggatcgaagagttcgagtcgtaaaataagatcgaaacggttagaaggagaataacgattagtcgtattacgtcgttaagtataatagagatataattcgatcgttaatatcgttttttagagatgattatagcgagataagagttatcgagtagcgtaatattacgattcgcgattaagagatcgttagcgaaatttatagcgttttanaacgacggtattagtttttacggaagat

SEQ ID NO: 20910 - DNA, 542 bp, Artificial Sequence
  chemically treated genomic DNA (Homo sapiens) CpG-island No: 20910
  misc_feature (29)..(29): n is either a, c, g or t
  misc_feature (281)..(281): n is either a, c, g or t
atcttccgtaaaaactaataccgtcgttntaaaacgctataaatttcgctaacgatctcttaatcgcgaatcgtaatattacgctactcgataactcttatctcgctataatcatctctaaaaaacgatattaacgatcgaattatatctctattatacttaacgacgtaatacgactaatcgttattctccttctaaccgtttcgatcttattttacgactcgaactcttcgatccgcgtcgatcgctctacgctcgaatcgcacgctctttccgaccgntaaacgatacgtcttataaaactaaatatcgtataacgattttcttccgttcgcttctcgcgttcttcgataaacgcgctaaaaacataccgaacgtctctataatacgtctatatccgctaatttttctcgcttccgaactttctttattaacttctcgcttcgtaatcgctccttctaaccgaacgaaaatctactatttcgttcctcctctctccccgtcgattctcctaactattatcgctacgacgactcgtcgat

SEQ ID NO: 20911 - DNA, 542 bp, Artificial Sequence
  chemically treated genomic DNA (Homo sapiens) CpG-island No: 20911
  misc_feature (29)..(29): n is either a, c, g or t
  misc_feature (281)..(281): n is either a, c, g or t
gtttttcgtaggggttggtgtcgtcgttntggggcgttgtgggtttcgttggcggttttttggtcgcgggtcgtggtgttgcgttgttcggtggtttttgtttcgttgtgattatttttggggggcggtgttggcggtcgggttgtgtttttgttgtgtttggcggcgtggtgcggttggtcgttgttttttttttggtcgtttcggttttgttttgcggttcgggtttttcggttcgcgtcggtcgttttacgttcgggtcgtacgtttttttcggtcgntgggcggtgcgttttgtggggttggatatcgtgtggcggttttttttcgttcgtttttcgcgtttttcggtgggcgcgttgggggtatgtcgggcgtttttgtggtgcgtttatgttcgttggtttttttcgttttcgggttttttttgttggtttttcgtttcgtggtcgttttttttggtcgggcgggggtttgttgtttcgtttttttttttttttcgtcggtttttttggttgttgtcgttgcggcggttcgtcggt

SEQ ID NO: 20912 - DNA, 542 bp, Artificial Sequence
  chemically treated genomic DNA (Homo sapiens) CpG-island No: 20912
  misc_feature (262)..(262): n is either a, c, g or t
  misc_feature (514)..(514): n is either a, c, g or t
accgacgaaccgccgcaacgacaacaaccaaaaaaaccgacgaaaaaaaaaaaaaaacgaaacaacaaacccccgcccgaccaaaaaaaacgaccacgaaacgaaaaaccaacaaaaaaaacccgaaaacgaaaaaaaccaacgaacataaacgcaccacaaaaacgcccgacatacccccaacgcgcccaccgaaaaacgcgaaaaacgaacgaaaaaaaaccgccacacgatatccaaccccacaaaacgcaccgcccancgaccgaaaaaaacgtacgacccgaacgtaaaacgaccgacgcgaaccgaaaaacccgaaccgcaaaacaaaaccgaaacgaccaaaaaaaaaacaacgaccaaccgcaccacgccgccaaacacaacaaaaacacaacccgaccgccaacaccgccccccaaaaataatcacaacgaaacaaaaaccaccgaacaacgcaacaccacgacccgcgaccaaaaaaccgccaacgaaacccacaacgccccanaacgacgacaccaacccctacgaaaaac

SEQ ID NO: 20913 - DNA, 754 bp, Artificial Sequence
  chemically treated genomic DNA (Homo sapiens) CpG-island No: 20913
  misc_feature (248)..(248): n is either a, c, g or t
  misc_feature (289)..(289): n is either a, c, g or t
  misc_feature (392)..(392): n is either a, c, g or t
ggtcggtttaaataatttacgtttaaaagcgggtcgtcggtcgcgtttcggtcgttcggggtattttcgtttatcgtattaaagtatatttcgttcggttcggtcgttacgcgtatcgcgcgttttttcgtatatagtattcgcgtttcgttatcggtcggggtacgcgttaattatcggattatttatcgtcgaacgggtcgcgtcgcgcggttcgcgtcgtatttttttacgtcgtagttacgttngggttttattaacgacgcgtacgcgcgttcgtcgggtcgtntttttcggagtcgcgtatttttcggtttcgcgttcgtttcgcgttttttattttcgttcgtttttcgttagtatcgtttatcgatcgttcgtcgtatattcgntttgggggttcgttttataggagtcgcgcgcgcgcgcggttatagttcgcgtacgggatatcgatttagtcgagttttattttaggcgggagggtcggcggcgttcgtttagcggttatcgtcgtttcgtttcgagtagggagggggcgagcgcggtcgttcgttttcgagatgagcgcgcgtcgttattatttcgataaggttcgtcgtcgtaattcgatcggtcggcgggagcgagggtacgtttcgtaagcgtcggagtcgcgttttagacggcgtatcgcggatcgtttaggtattcggtagggggttcggagattcgcgggtcgacgttcggagataagttcgtttcgtttcgtatt

SEQ ID NO: 20914 - DNA, 754 bp, Artificial Sequence
  chemically treated genomic DNA (Homo sapiens) CpG-island No: 20914
  misc_feature (363)..(363): n is either a, c, g or t
  misc_feature (466)..(466): n is either a, c, g or t
  misc_feature (507)..(507): n is either a, c, g or t
aatacgaaacgaaacgaacttatctccgaacgtcgacccgcgaatctccgaaccccctaccgaatacctaaacgatccgcgatacgccgtctaaaacgcgactccgacgcttacgaaacgtaccctcgctcccgccgaccgatcgaattacgacgacgaaccttatcgaaataataacgacgcgcgctcatctcgaaaacgaacgaccgcgctcgccccctccctactcgaaacgaaacgacgataaccgctaaacgaacgccgccgaccctcccgcctaaaataaaactcgactaaatcgatatcccgtacgcgaactataaccgcgcgcgcgcgcgactcctataaaacgaacccccaaancgaatatacgacgaacgatcgataaacgatactaacgaaaaacgaacgaaaataaaaaacgcgaaacgaacgcgaaaccgaaaaatacgcgactccgaaaaanacgacccgacgaacgcgcgtacgcgtcgttaataaaacccnaacgtaactacgacgtaaaaaaatacgacgcgaaccgcgcgacgcgacccgttcgacgataaataatccgataattaacgcgtaccccgaccgataacgaaacgcgaatactatatacgaaaaaacgcgcgatacgcgtaacgaccgaaccgaacgaaatatactttaatacgataaacgaaaataccccgaacgaccgaaacgcgaccgacgacccgcttttaaacgtaaattatttaaaccgacc

SEQ ID NO: 20915 - DNA, 754 bp, Artificial Sequence
  chemically treated genomic DNA (Homo sapiens) CpG-island No: 20915
  misc_feature (363)..(363): n is either a, c, g or t
  misc_feature (466)..(466): n is either a, c, g or t
  misc_feature (507)..(507): n is either a, c, g or t
ggtgcggggcggggcgggtttgttttcgggcgtcggttcgcgagttttcgggttttttgtcgggtgtttgggcggttcgcggtgcgtcgtttggagcgcggtttcggcgtttgcggggcgtgttttcgttttcgtcggtcggtcgggttgcggcggcgggttttgtcggggtggtggcggcgcgcgtttatttcgggggcgggcggtcgcgttcgttttttttttgttcggggcggggcggcggtggtcgttgggcgggcgtcgtcggttttttcgtttggggtggggttcgattgggtcggtgtttcgtgcgcgggttgtggtcgcgcgcgcgcgcggtttttgtggggcgggtttttaggncgggtgtgcggcgggcgatcggtgggcggtattggcggggggcgggcgggggtggggggcgcggggcgggcgcggggtcggggggtgcgcggtttcggggggnacggttcggcgggcgcgcgtgcgcgtcgttggtggggtttnggcgtggttgcggcgtgggggggtgcggcgcgggtcgcgcggcgcggttcgttcggcggtgggtggttcggtggttggcgcgtgtttcggtcggtggcggggcgcgggtgttgtgtgcgggggggcgcgcggtgcgcgtggcggtcgggtcgggcggggtgtgttttggtgcggtgggcgggggtgtttcgggcggtcggggcgcggtcggcggttcgtttttgggcgtgggttgtttgggtcggtt

SEQ ID NO: 20916 - DNA, 754 bp, Artificial Sequence
  chemically treated genomic DNA (Homo sapiens) CpG-island No: 20916
  misc_feature (248)..(248): n is either a, c, g or t
  misc_feature (289)..(289): n is either a, c, g or t
  misc_feature (392)..(392): n is either a, c, g or t
aaccgacccaaacaacccacgcccaaaaacgaaccgccgaccgcgccccgaccgcccgaaacacccccgcccaccgcaccaaaacacaccccgcccgacccgaccgccacgcgcaccgcgcgcccccccgcacacaacacccgcgccccgccaccgaccgaaacacgcgccaaccaccgaaccacccaccgccgaacgaaccgcgccgcgcgacccgcgccgcacccccccacgccgcaaccacgccnaaaccccaccaacgacgcgcacgcgcgcccgccgaaccgtnccccccgaaaccgcgcaccccccgaccccgcgcccgccccgcgccccccacccccgcccgccccccgccaataccgcccaccgatcgcccgccgcacacccgncctaaaaacccgccccacaaaaaccgcgcgcgcgcgcgaccacaacccgcgcacgaaacaccgacccaatcgaaccccaccccaaacgaaaaaaccgacgacgcccgcccaacgaccaccgccgccccgccccgaacaaaaaaaaaacgaacgcgaccgcccgcccccgaaataaacgcgcgccgccaccaccccgacaaaacccgccgccgcaacccgaccgaccgacgaaaacgaaaacacgccccgcaaacgccgaaaccgcgctccaaacgacgcaccgcgaaccgcccaaacacccgacaaaaaacccgaaaactcgcgaaccgacgcccgaaaacaaacccgccccgccccgcacc

SEQ ID NO: 20917 - DNA, 905 bp, Artificial Sequence
  chemically treated genomic DNA (Homo sapiens) CpG-island No: 20917
  misc_feature (608)..(608): n is either a, c, g or t
ttttttcgcgtcgggggagagttaatttcgcgatttagtttttttatcgttaatattttttattttacgattaatcgggagcgcgtcggggtttcggggcggtcggtttttttagtttcgttttttttttttttcgcgttatagttttcggcgtagattcgtttcggtcgtatatatatttcgcgggcgcgtttatacgcgcgcgcgttcgttttttttttattcgtcgcggttaaaaattttttttttcgacgaaaggttttttttatcgttttcgggttcgttttattttttcgcgatcgcggttcggttttatttcggttttttcgtcgatttttttcgttcgcgttttatcgttattcgtttcgacgggcgaaagtttataggtacgtttttttataagggagtttttatttttttcggttacgcgtcgcggcgtcgttaagaaaaagttcgcgagtacgttttacgttttcgttcgacgtcgtcggtcgtataggcgcgaggtagcgttcggagtgattacggttttaagagtatttttttttattatagtacgataattcgtttttcgggcgagtcgtcgcgcgtattcggagcgattttanttacgtcgacggagagggtttcgcgtatttagtcggttcgcgtcgcgcgggtagtaggtttcgttggcgcgtcggtatcggatcgtattcgcgattattttcggcggggttcgtttcgtttaggggtcgtttttttcgtcgtcgagtttttcgttttagttagcgggttcgcggtttttttttcgcgacgcgttacgtttcgtattcgttttaacgaattagatttcgatttcgatagtaggtcgttttttcgatataagaagttcgtaggcgtttttttttcgtttttcgtaggta

SEQ ID NO: 20918 - DNA, 905 bp, Artificial Sequence
  chemically treated genomic DNA (Homo sapiens) CpG-island No: 20918
  misc_feature (298)..(298): n is either a, c, g or t
tacctacgaaaaacgaaaaaaaaacgcctacgaacttcttatatcgaaaaaacgacctactatcgaaatcgaaatctaattcgttaaaacgaatacgaaacgtaacgcgtcgcgaaaaaaaaaccgcgaacccgctaactaaaacgaaaaactcgacgacgaaaaaaacgacccctaaacgaaacgaaccccgccgaaaataatcgcgaatacgatccgataccgacgcgccaacgaaacctactacccgcgcgacgcgaaccgactaaatacgcgaaaccctctccgtcgacgtaantaaaatcgctccgaatacgcgcgacgactcgcccgaaaaacgaattatcgtactataataaaaaaaaatactcttaaaaccgtaatcactccgaacgctacctcgcgcctatacgaccgacgacgtcgaacgaaaacgtaaaacgtactcgcgaactttttcttaacgacgccgcgacgcgtaaccgaaaaaaataaaaactcccttataaaaaaacgtacctataaactttcgcccgtcgaaacgaataacgataaaacgcgaacgaaaaaaatcgacgaaaaaaccgaaataaaaccgaaccgcgatcgcgaaaaaataaaacgaacccgaaaacgataaaaaaaacctttcgtcgaaaaaaaaaatttttaaccgcgacgaataaaaaaaaaacgaacgcgcgcgcgtataaacgcgcccgcgaaatatatatacgaccgaaacgaatctacgccgaaaactataacgcgaaaaaaaaaaaaaacgaaactaaaaaaaccgaccgccccgaaaccccgacgcgctcccgattaatcgtaaaataaaaaatattaacgataaaaaaactaaatcgcgaaattaactctcccccgacgcgaaaaaa

SEQ ID NO: 20919 - DNA, 905 bp, Artificial Sequence
  chemically treated genomic DNA (Homo sapiens) CpG-island No: 20919
  misc_feature (298)..(298): n is either a, c, g or t
tatttgcggggggcggggggggggcgtttgcgggttttttgtatcgggagggcggtttgttgtcggggtcggagtttggttcgttggggcgggtgcggggcgtggcgcgtcgcggggggggggtcgcgggttcgttggttggggcgggggattcggcgacggggggggcggtttttaggcggggcgggtttcgtcgggggtggtcgcgggtacggttcggtgtcggcgcgttagcggggtttgttgttcgcgcggcgcgggtcggttgggtgcgcggggtttttttcgtcggcgtggntggagtcgtttcgggtgcgcgcggcggttcgttcggggggcgggttgtcgtgttgtggtgggggggggtgtttttggggtcgtggttatttcgggcgttgtttcgcgtttgtgcggtcggcggcgtcgggcgggggcgtggggcgtgttcgcgggtttttttttggcggcgtcgcggcgcgtggtcgaggggggtgggagtttttttgtgggggggcgtgtttgtgagttttcgttcgtcggggcgggtggcggtggggcgcgggcggggggggtcggcgggggggtcggggtggggtcgggtcgcggtcgcgggggggtggggcgggttcgggggcggtggggggggtttttcgtcgggggggggggtttttggtcgcggcgggtgggggggaggcgggcgcgcgcgcgtgtgggcgcgttcgcggggtgtgtgtgcggtcggggcgggtttgcgtcgggggttgtggcgcgggaaaaaaaaggggcggggttgggggggtcggtcgtttcggggtttcggcgcgttttcggttggtcgtggggtggggggtgttggcggtgggggggttgggtcgcggggttggttttttttcggcgcggggggg

SEQ ID NO: 20920 - DNA, 905 bp, Artificial Sequence
  chemically treated genomic DNA (Homo sapiens) CpG-island No: 20920
  misc_feature (608)..(608): n is either a, c, g or t
cccccccgcgccgaaaaaaaaccaaccccgcgacccaacccccccaccgccaacaccccccaccccacgaccaaccgaaaacgcgccgaaaccccgaaacgaccgacccccccaaccccgccccttttttttcccgcgccacaacccccgacgcaaacccgccccgaccgcacacacaccccgcgaacgcgcccacacgcgcgcgcgcccgcctcccccccacccgccgcgaccaaaaacccccccccccgacgaaaaaccccccccaccgcccccgaacccgccccacccccccgcgaccgcgacccgaccccaccccgacccccccgccgaccccccccgcccgcgccccaccgccacccgccccgacgaacgaaaactcacaaacacgcccccccacaaaaaaactcccacccccctcgaccacgcgccgcgacgccgccaaaaaaaaacccgcgaacacgccccacgcccccgcccgacgccgccgaccgcacaaacgcgaaacaacgcccgaaataaccacgaccccaaaaacacccccccccaccacaacacgacaacccgccccccgaacgaaccgccgcgcgcacccgaaacgactccanccacgccgacgaaaaaaaccccgcgcacccaaccgacccgcgccgcgcgaacaacaaaccccgctaacgcgccgacaccgaaccgtacccgcgaccacccccgacgaaacccgccccgcctaaaaaccgccccccccgtcgccgaatcccccgccccaaccaacgaacccgcgaccccccccccgcgacgcgccacgccccgcacccgccccaacgaaccaaactccgaccccgacaacaaaccgccctcccgatacaaaaaacccgcaaacgccccccccccgccccccgcaaata

SEQ ID NO: 20921 - DNA, 576 bp, Artificial Sequence
  chemically treated genomic DNA (Homo sapiens) CpG-island No: 20921
  misc_feature (490)..(490): n is either a, c, g or t
aatatatcggttttcgttcgggcgtaaaaaaaagataaaaagtttcggttcgtcggtttcgcgtcggcgtttttacgttagagtattcgtttatagttttatttagcgcgcggggcggggcggttacgatacggcgcgtttcggcgcgttatagtaatataaggtttttcgcgtatcggagcgcggggatagggcgggggggcgcgggtttataggagacggataaagtatttcgagagagggtggattcgataagaggaaacgttaaatagaaaggtatttttcgtaacgcgatttaataaagaacgatacgcgagtcgagagcgaatataacgagataaggtatcgttaattacgtacgggcgcggtttattaatatttttacgttttcgtttttagatcggcgcgttgtagaggacgtattagagtatttcgaacgggacgagttgcgtcgggcggaagcgttcgcgataatacgcgacgcgtaatnacgtatagaggaaggttcggtaattttatagagggaaaaagtcgtagttttttaatagtttagggatttaggttacgtataagggt

SEQ ID NO: 20922 - DNA, 576 bp, Artificial Sequence
  chemically treated genomic DNA (Homo sapiens) CpG-island No: 20922
  misc_feature (87)..(87): n is either a, c, g or t
acccttatacgtaacctaaatccctaaactattaaaaaactacgactttttccctctataaaattaccgaaccttcctctatacgtnattacgcgtcgcgtattatcgcgaacgcttccgcccgacgcaactcgtcccgttcgaaatactctaatacgtcctctacaacgcgccgatctaaaaacgaaaacgtaaaaatattaataaaccgcgcccgtacgtaattaacgataccttatctcgttatattcgctctcgactcgcgtatcgttctttattaaatcgcgttacgaaaaatacctttctatttaacgtttcctcttatcgaatccaccctctctcgaaatactttatccgtctcctataaacccgcgcccccccgccctatccccgcgctccgatacgcgaaaaaccttatattactataacgcgccgaaacgcgccgtatcgtaaccgccccgccccgcgcgctaaataaaactataaacgaatactctaacgtaaaaacgccgacgcgaaaccgacgaaccgaaactttttatcttttttttacgcccgaacgaaaaccgatatatt

SEQ ID NO: 20923 - DNA, 576 bp, Artificial Sequence
  chemically treated genomic DNA (Homo sapiens) CpG-island No: 20923
  misc_feature (87)..(87): n is either a, c, g or t
atttttgtacgtggtttgggtttttgggttgttggggggttgcggttttttttttttgtggggttgtcgagtttttttttgtgcgtngttgcgcgtcgcgtgttgtcgcgggcgttttcgttcggcgtagttcgtttcgttcggggtgttttggtgcgttttttgtagcgcgtcggtttgggggcgggggcgtgggggtgttggtgggtcgcgttcgtgcgtggttggcggtgttttgtttcgttgtgttcgttttcggttcgcgtgtcgttttttgttgggtcgcgttgcggggggtgtttttttgtttggcgtttttttttgtcgggtttattttttttcggggtgttttgttcgttttttgtgggttcgcgttttttcgttttgttttcgcgtttcggtgcgcggggggttttgtgttgttgtggcgcgtcggggcgcgtcgtgtcgtggtcgtttcgtttcgcgcgttgggtggggttgtgggcgggtgttttggcgtgggggcgtcggcgcggggtcggcgggtcggggttttttgttttttttttgcgttcgggcgggggtcggtgtgtt

SEQ ID NO: 20924 - DNA, 576 bp, Artificial Sequence
  chemically treated genomic DNA (Homo sapiens) CpG-island No: 20924
  misc_feature (490)..(490): n is either a, c, g or t
aacacaccgacccccgcccgaacgcaaaaaaaaaacaaaaaaccccgacccgccgaccccgcgccgacgcccccacgccaaaacacccgcccacaaccccacccaacgcgcgaaacgaaacgaccacgacacgacgcgccccgacgcgccacaacaacacaaaaccccccgcgcaccgaaacgcgaaaacaaaacgaaaaaacgcgaacccacaaaaaacgaacaaaacaccccgaaaaaaaataaacccgacaaaaaaaaacgccaaacaaaaaaacaccccccgcaacgcgacccaacaaaaaacgacacgcgaaccgaaaacgaacacaacgaaacaaaacaccgccaaccacgcacgaacgcgacccaccaacacccccacgcccccgcccccaaaccgacgcgctacaaaaaacgcaccaaaacaccccgaacgaaacgaactacgccgaacgaaaacgcccgcgacaacacgcgacgcgcaacnacgcacaaaaaaaaactcgacaaccccacaaaaaaaaaaaaccgcaaccccccaacaacccaaaaacccaaaccacgtacaaaaat

SEQ ID NO: 20925 - DNA, 651 bp, Artificial Sequence
  chemically treated genomic DNA (Homo sapiens) CpG-island No: 20925
  misc_feature (40)..(40): n is either a, c, g or t
  misc_feature (354)..(354): n is either a, c, g or t
  misc_feature (600)..(600): n is either a, c, g or t
cgattagttagtatcgagatcgtaagatggagagataganacgtcgttcgcggtagaggtagaagggagatataacgcgatagagatcgtggcgagagagcggttagaataacgaacgtcgaaatatacgaatcgtattagaagaacgagtattttacgggaatcgtattcgtcgtaagggcgcgtaggcgtatacgacgtaaagtaataagcgagagagagaaaagagaagagagtagatttacgaggatcgagaacgtaaatagagaggtaacgttatatagcgatatatattttagagacgtttattttacgaagaacgtattcgtttttattatttcggtcgagaggagngaagcgacgatcgaacgatacgggatgttacgtacgttagacgcgaggcggaagggtcgggacgagaagaaaataagttacgcgtaagtcgtacgaagtatcgaatagcggcgagaattaaagtagaaaagaatacgagtacgaaaattagtaaacgcgacgtcgcgggtcgttttacgatatgagagtatataacgacgtaggcgacggcgataagtagagaagaagttataggagaggagacgntagaggtcgttcgtatggaagtcggacggaaggataatatataagacgagt

SEQ ID NO: 20926 - DNA, 651 bp, Artificial Sequence
  chemically treated genomic DNA (Homo sapiens) CpG-island No: 20926
  misc_feature (52)..(52): n is either a, c, g or t
  misc_feature (298)..(298): n is either a, c, g or t
  misc_feature (612)..(612): n is either a, c, g or t
actcgtcttatatattatccttccgtccgacttccatacgaacgacctctancgtctcctctcctataacttcttctctacttatcgccgtcgcctacgtcgttatatactctcatatcgtaaaacgacccgcgacgtcgcgtttactaattttcgtactcgtattcttttctactttaattctcgccgctattcgatacttcgtacgacttacgcgtaacttattttcttctcgtcccgacccttccgcctcgcgtctaacgtacgtaacatcccgtatcgttcgatcgtcgcttcnctcctctcgaccgaaataataaaaacgaatacgttcttcgtaaaataaacgtctctaaaatatatatcgctatataacgttacctctctatttacgttctcgatcctcgtaaatctactctcttctcttttctctctctcgcttattactttacgtcgtatacgcctacgcgcccttacgacgaatacgattcccgtaaaatactcgttcttctaatacgattcgtatatttcgacgttcgttattctaaccgctctctcgccacgatctctatcgcgttatatctcccttctacctctaccgcgaacgacgtntctatctctccatcttacgatctcgatactaactaatcg

SEQ ID NO: 20927 - DNA, 651 bp, Artificial Sequence
  chemically treated genomic DNA (Homo sapiens) CpG-island No: 20927
  misc_feature (52)..(52): n is either a, c, g or t
  misc_feature (298)..(298): n is either a, c, g or t
  misc_feature (612)..(612): n is either a, c, g or t
gttcgttttgtgtgttattttttcgttcggtttttatgcgggcgatttttgncgtttttttttttgtggttttttttttgtttgtcgtcgtcgtttacgtcgttgtgtatttttatgtcgtggggcggttcgcggcgtcgcgtttgttgattttcgtgttcgtgtttttttttgttttggttttcgtcgttgttcgatgtttcgtgcggtttgcgcgtagtttgtttttttttcgtttcgattttttcgtttcgcgtttagcgtgcgtggtatttcgtgtcgttcggtcgtcgttttntttttttcggtcggggtggtgggggcgggtgcgtttttcgtggggtgggcgtttttggggtgtgtgtcgttgtatggcgttgtttttttgtttgcgttttcggttttcgtgggtttgttttttttttttttttttttttcgtttgttgttttgcgtcgtgtgcgtttgcgcgtttttgcggcgggtgcggttttcgtggggtgttcgtttttttggtgcggttcgtgtgtttcggcgttcgttgttttgatcgttttttcgttacggtttttgtcgcgttgtgttttttttttatttttgtcgcgggcggcgtntttgtttttttattttgcgatttcggtgttggttggtcg

SEQ ID NO: 20928 - DNA, 651 bp, Artificial Sequence
  chemically treated genomic DNA (Homo sapiens) CpG-island No: 20928
  misc_feature (40)..(40): n is either a, c, g or t
  misc_feature (354)..(354): n is either a, c, g or t
  misc_feature (600)..(600): n is either a, c, g or t
cgaccaaccaacaccgaaatcgcaaaataaaaaaacaaanacgccgcccgcgacaaaaataaaaaaaaaacacaacgcgacaaaaaccgtaacgaaaaaacgatcaaaacaacgaacgccgaaacacacgaaccgcaccaaaaaaacgaacaccccacgaaaaccgcacccgccgcaaaaacgcgcaaacgcacacgacgcaaaacaacaaacgaaaaaaaaaaaaaaaaaaaaaacaaacccacgaaaaccgaaaacgcaaacaaaaaaacaacgccatacaacgacacacaccccaaaaacgcccaccccacgaaaaacgcacccgcccccaccaccccgaccgaaaaaaanaaaacgacgaccgaacgacacgaaataccacgcacgctaaacgcgaaacgaaaaaatcgaaacgaaaaaaaaacaaactacgcgcaaaccgcacgaaacatcgaacaacgacgaaaaccaaaacaaaaaaaaacacgaacacgaaaatcaacaaacgcgacgccgcgaaccgccccacgacataaaaatacacaacgacgtaaacgacgacgacaaacaaaaaaaaaaccacaaaaaaaaaaacgncaaaaatcgcccgcataaaaaccgaacgaaaaaataacacacaaaacgaac

SEQ ID NO: 20929 - DNA, 524 bp, Artificial Sequence
  chemically treated genomic DNA (Homo sapiens) CpG-island No: 20929
ttttttattttttaaatacgttttttttttcgtttattatatttattatcgtatttttatagtattatatttttttttttatcgacgttttttttatttattttttaaattcgcgtttttttatttttcgttaattatttatttatagtacgtttttttcgttttttataatcgtataattttgtattattttatataaattattacgttattttatttattatttttattattttatttttttttaattttttattcgtcgatttattattatcgttcgttttaattttattttcgtttcgatttatttatatcgttaagtttatattatttttattaaatttttttttatttttataattttatattattatattatcgtttcgattcgattatattaataattttttatataatttttttatttttttatatatatttattttttattttattttatcgttatatttatattatattatgtattatattatttttaaattaattttttatttttcgttttt

SEQ ID NO: 20930 - DNA, 524 bp, Artificial Sequence
  chemically treated genomic DNA (Homo sapiens) CpG-island No: 20930
aaaaacgaaaaataaaaaattaatttaaaaataatataatacataatataatataaatataacgataaaataaaataaaaaataaatatatataaaaaaataaaaaaattatataaaaaattattaatataatcgaatcgaaacgataatataataatataaaattataaaaataaaaaaaaatttaataaaaataatataaacttaacgatataaataaatcgaaacgaaaataaaattaaaacgaacgataataataaatcgacgaataaaaaattaaaaaaaaataaaataataaaaataataaataaaataacgtaataatttatataaaataatacaaaattatacgattataaaaaacgaaaaaaacgtactataaataaataattaacgaaaaataaaaaaacgcgaatttaaaaaataaataaaaaaaacgtcgataaaaaaaaaaatataatactataaaaatacgataataaatataataaacgaaaaaaaaaacgtatttaaaaaataaaaaa

SEQ ID NO: 20931 - DNA, 524 bp, Artificial Sequence
  chemically treated genomic DNA (Homo sapiens) CpG-island No: 20931
gggggcgagggatgggaggttagtttgggggtggtgtggtgtatagtgtggtgtgggtgtggcgatggggtggggtagggggtagatgtgtatgggggggtgggggggttgtgtggggggttgttggtgtgatcgggtcggggcggtggtgtggtggtatggagttgtgggggtgggggggggtttggtgggggtggtgtggatttggcgatgtgggtgggtcggggcggaggtggagttgaggcgggcggtggtagtgggtcggcgggtggggggttgggagggggtggggtggtaggggtgatggatgggatggcgtggtggtttgtgtggggtagtgtagggttgtgcggttatggggaacgaggggggcgtgttgtgagtgagtggttggcgggaggtgggggggcgcgggtttggggggtgggtggggggggcgtcgatgggagggggggtgtggtgttgtgggggtgcggtggtgagtgtggtgggcgggggggggggcgtgtttggggggtgggggg

SEQ ID NO: 20932 - DNA, 524 bp, Artificial Sequence
  chemically treated genomic DNA (Homo sapiens) CpG-island No: 20932
ccccccaccccccaaacacgcccccccccccgcccaccacactcaccaccgcacccccacaacaccacaccccccctcccatcgacgccccccccacccaccccccaaacccgcgcccccccacctcccgccaaccactcactcacaacacgcccccctcgttccccataaccgcacaaccctacactaccccacacaaaccaccacgccatcccatccatcacccctaccaccccaccccctcccaaccccccacccgccgacccactaccaccgcccgcctcaactccacctccgccccgacccacccacatcgccaaatccacaccacccccaccaaacccccccccacccccacaactccataccaccacaccaccgccccgacccgatcacaccaacaaccccccacacaacccccccacccccccatacacatctaccccctaccccaccccatcgccacacccacaccacactatacaccacaccacccccaaactaacctcccatccctcgccccc

SEQ ID NO: 20933 - DNA, 663 bp, Artificial Sequence
  chemically treated genomic DNA (Homo sapiens) CpG-island No: 20933
cgagcgcgcgcgggcgagcgtagggggcgcggcgcgggggaaaaaaaaaaaaagcgggggggttcgtcgtcggcgcgggtgcggaggcggggcggggcgtcggtcgttcgcgttacggcgggggcgacgggacgtaggcgggcgcgcgttcgggcgggggggacgagatcgtcgcggggcgggcggtcgtcggcggggtcgtcgtcgggcgggtggtcgaggagttacgacgcgcgtttcgttcggttcgtcgcgacgaggatataggcgcggcggttagcgcggacggggggggcggcgggaggagaaaggaggggaatagtcggggcgtagcgagggagggcgcggggtacgttcgggtcggcgcggaggtcgggaatcgggcgggggattagcggggcgtcgggcgttcgcgtcggtcgcgcgtcgcggcggcggcgcggcgcgtcggtttcggcgcggcgtttcgggcggggggggggcgggcgagtttaagggaacgtaaaagcggggagggggcgtcgtttcgaggggcgggcgcggtacgcgcgggcggcgacgggagaggggcggtcgttttcgaggcggcgggggcgtcgcggcgtagcgggggcgggggggggacgcgtcgtcgtcgggtatggagtcgtttttcggtatatt

SEQ ID NO: 20934 - DNA, 663 bp, Artificial Sequence
  chemically treated genomic DNA (Homo sapiens) CpG-island No: 20934
aatataccgaaaaacgactccatacccgacgacgacgcgtcccccccccgcccccgctacgccgcgacgcccccgccgcctcgaaaacgaccgcccctctcccgtcgccgcccgcgcgtaccgcgcccgcccctcgaaacgacgccccctccccgcttttacgttcccttaaactcgcccgccccccccccgcccgaaacgccgcgccgaaaccgacgcgccgcgccgccgccgcgacgcgcgaccgacgcgaacgcccgacgccccgctaatcccccgcccgattcccgacctccgcgccgacccgaacgtaccccgcgccctccctcgctacgccccgactattcccctcctttctcctcccgccgccccccccgtccgcgctaaccgccgcgcctatatcctcgtcgcgacgaaccgaacgaaacgcgcgtcgtaactcctcgaccacccgcccgacgacgaccccgccgacgaccgcccgccccgcgacgatctcgtcccccccgcccgaacgcgcgcccgcctacgtcccgtcgcccccgccgtaacgcgaacgaccgacgccccgccccgcctccgcacccgcgccgacgacgaacccccccgctttttttttttttcccccgcgccgcgccccctacgctcgcccgcgcgcgctcg

SEQ ID NO: 20935 - DNA, 663 bp, Artificial Sequence
  chemically treated genomic DNA (Homo sapiens) CpG-island No: 20935
ggtgtgtcggggagcgattttatattcggcggcggcgcgtttttttttcgttttcgttacgtcgcggcgttttcgtcgtttcgggggcggtcgtttttttttcgtcgtcgttcgcgcgtgtcgcgttcgtttttcggggcggcgtttttttttcgtttttgcgtttttttgggttcgttcgtttttttttcgttcggggcgtcgcgtcggggtcggcgcgtcgcgtcgtcgtcgcggcgcgcggtcggcgcgggcgttcggcgtttcgttggtttttcgttcggttttcggttttcgcgtcggttcgggcgtgtttcgcgttttttttcgttgcgtttcggttgtttttttttttttttttttcgtcgtttttttcgttcgcgttggtcgtcgcgtttgtgttttcgtcgcggcgggtcgggcggggcgcgcgtcgtggtttttcggttattcgttcggcggcggtttcgtcggcggtcgttcgtttcgcggcggtttcgtttttttcgttcgggcgcgcgttcgtttgcgtttcgtcgttttcgtcgtggcgcgggcggtcggcgtttcgtttcgttttcgtattcgcgtcggcggcgggttttttcgttttttttttttttttttcgcgtcgcgttttttgcgttcgttcgcgcgcgttcg

SEQ ID NO: 20936 - DNA, 663 bp, Artificial Sequence
  chemically treated genomic DNA (Homo sapiens) CpG-island No: 20936
cgaacgcgcgcgaacgaacgcaaaaaacgcgacgcgaaaaaaaaaaaaaaaaaacgaaaaaacccgccgccgacgcgaatacgaaaacgaaacgaaacgccgaccgcccgcgccacgacgaaaacgacgaaacgcaaacgaacgcgcgcccgaacgaaaaaaacgaaaccgccgcgaaacgaacgaccgccgacgaaaccgccgccgaacgaataaccgaaaaaccacgacgcgcgccccgcccgacccgccgcgacgaaaacacaaacgcgacgaccaacgcgaacgaaaaaaacgacgaaaaaaaaaaaaaaaaaaacaaccgaaacgcaacgaaaaaaaacgcgaaacacgcccgaaccgacgcgaaaaccgaaaaccgaacgaaaaaccaacgaaacgccgaacgcccgcgccgaccgcgcgccgcgacgacgacgcgacgcgccgaccccgacgcgacgccccgaacgaaaaaaaaacgaacgaacccaaaaaaacgcaaaaacgaaaaaaaaacgccgccccgaaaaacgaacgcgacacgcgcgaacgacgacgaaaaaaaaacgaccgcccccgaaacgacgaaaacgccgcgacgtaacgaaaacgaaaaaaaaacgcgccgccgccgaatataaaatcgctccccgacacacc

SEQ ID NO: 20937 - DNA, 599 bp, Artificial Sequence
  chemically treated genomic DNA (Homo sapiens) CpG-island No: 20937
gggggttgttcgggtcggtgaatcgatagggcgttaggattcggggcgcgttcggattcggggcgagaacgcgaggtcgggatcgcggtgaaaggttcgcggcggagagttcggtcgtcgttaggtaatcgttttgacgtaacgtagggggaaaaaaaaaagtttttttcgaaaggagtagcgtcgagaatttatcggagttcggggaggcgaggcgggagttttgagttgaggtcgggtagcgcggattcgcgtaggaggaggcggcggggatatcggcgagtttttagtagggtttttgggttttcggaaggtgggttcgcgtcggcggcggggatttttttagggattgggaggtgtggtcgcggcgggcggcgtagtttgggtaggggttgaggcgtcgtaggtttttagcgcgagtagtggttcggagtagttcgattttaaagttttttggaggggacgcgtttttatcgttttttcgggagaggtcgtttatgcgttttcgcgggttcgttgtttttttagaggagtcgggtagttagggttggattttattttttagttttttgttggtcgtgttcgggttcggattttgg

SEQ ID NO: 20938 - DNA, 599 bp, Artificial Sequence
  chemically treated genomic DNA (Homo sapiens) CpG-island No: 20938
ccaaaatccgaacccgaacacgaccaacaaaaaactaaaaaataaaatccaaccctaactacccgactcctctaaaaaaacaacgaacccgcgaaaacgcataaacgacctctcccgaaaaaacgataaaaacgcgtcccctccaaaaaactttaaaatcgaactactccgaaccactactcgcgctaaaaacctacgacgcctcaacccctacccaaactacgccgcccgccgcgaccacacctcccaatccctaaaaaaatccccgccgccgacgcgaacccaccttccgaaaacccaaaaaccctactaaaaactcgccgatatccccgccgcctcctcctacgcgaatccgcgctacccgacctcaactcaaaactcccgcctcgcctccccgaactccgataaattctcgacgctactcctttcgaaaaaaacttttttttttccccctacgttacgtcaaaacgattacctaacgacgaccgaactctccgccgcgaacctttcaccgcgatcccgacctcgcgttctcgccccgaatccgaacgcgccccgaatcctaacgccctatcgattcaccgacccgaacaaccccc

SEQ ID NO: 20939 - DNA, 599 bp, Artificial Sequence
  chemically treated genomic DNA (Homo sapiens) CpG-island No: 20939
ttagaattcgagttcggatacggttagtaaggagttaggagatgaagtttagttttggttgttcggtttttttgggagggtagcgaattcgcgggagcgtatgagcggtttttttcgggggggcggtaggagcgcgttttttttagggagttttgggatcgggttgtttcgggttattgttcgcgttggggatttgcgacgttttagtttttgtttagattgcgtcgttcgtcgcggttatattttttagtttttgggaaagttttcgtcgtcggcgcgaatttatttttcgggagtttaggggttttgttggggattcgtcggtgttttcgtcgtttttttttgcgcgggttcgcgttgttcggttttagtttagggttttcgtttcgttttttcgagtttcggtgaattttcggcgttgtttttttcggaaaggatttttttttttttttttgcgttgcgttagggcggttgtttggcgacggtcgagtttttcgtcgcgagttttttatcgcgatttcggtttcgcgttttcgtttcgggttcgagcgcgtttcgggttttagcgttttgtcggtttatcggttcgggtagttttt

SEQ ID NO: 20940 - DNA, 599 bp, Artificial Sequence
  chemically treated genomic DNA (Homo sapiens) CpG-island No: 20940
aaaaactacccgaaccgataaaccgacaaaacgctaaaacccgaaacgcgctcgaacccgaaacgaaaacgcgaaaccgaaatcgcgataaaaaactcgcgacgaaaaactcgaccgtcgccaaacaaccgccctaacgcaacgcaaaaaaaaaaaaaaaaatcctttccgaaaaaaacaacgccgaaaattcaccgaaactcgaaaaaacgaaacgaaaaccctaaactaaaaccgaacaacgcgaacccgcgcaaaaaaaaacgacgaaaacaccgacgaatccccaacaaaacccctaaactcccgaaaaataaattcgcgccgacgacgaaaactttcccaaaaactaaaaaatataaccgcgacgaacgacgcaatctaaacaaaaactaaaacgtcgcaaatccccaacgcgaacaataacccgaaacaacccgatcccaaaactccctaaaaaaaacgcgctcctaccgcccccccgaaaaaaaccgctcatacgctcccgcgaattcgctaccctcccaaaaaaaccgaacaaccaaaactaaacttcatctcctaactccttactaaccgtatccgaactcgaattctaa

SEQ ID NO: 20941 - DNA, 957 bp, Artificial Sequence
  chemically treated genomic DNA (Homo sapiens) CpG-island No: 20941
gtcgtaaaataaatacggtcgcgtcgttaatcgttagttcggaggaaataaaatagcgttgcgttgggggatttgggtaaaattagtttttttttttttcgttttttcgtcgcggttttttttttttcgcgttgttttcgttcgtttggtttagtttagtttagtttagcgtagtttcgcggtcgttaagtcgaggcgggtacggttttcgagtcgcggacgttagtttcgagtttttttttttcgtcgcgttttcgttaggtcgcgttttcgtcgggattatttcgggtaggagtcgcgtggcgaaggtttgcggtcgcggtataaagttgggggtcgcgaagatgaggttgttttcggcgtttttgaagttgagtcggatttcggtattgttggttttggcgttgtttttggtcgcggcgttggtttttttcgacgagattttggataaagtgtttaagttagagggttattgtagtcgtattttgcgcgtttagggtacgcggcgcgagggttatatcgagtttagttttcgcgtggagggcgatttcgatttttataagtcgggaattagttatcgcggtaagtggtcgttcggcgtggtattaggagagcgggattcggttttcggagggcgtcgatttcgcggtgtcggaggagggcgcgcggttttcgggcgcgtggcgcgggtgtagttcggtaagggtttttttgttttggttgttttcggtttttgtagtcgcgagttcggcgcggattataatttagcgtttcgggtcgtcgcgggggtcgtagttaggagaggtatttcgcgttttcgacgcgcggtttttaggcggaggatgtaattgagttacgcgttacgtcggtttgattgtaagggaggttcgtttttttttcggtcgtttgtaggagggaagtaaaattgtttttttttaaatcggtttggaggggatt

SEQ ID NO: 20942 - DNA, 957 bp, Artificial Sequence
  chemically treated genomic DNA (Homo sapiens) CpG-island No: 20942
aatcccctccaaaccgatttaaaaaaaaacaattttacttccctcctacaaacgaccgaaaaaaaaacgaacctcccttacaatcaaaccgacgtaacgcgtaactcaattacatcctccgcctaaaaaccgcgcgtcgaaaacgcgaaatacctctcctaactacgacccccgcgacgacccgaaacgctaaattataatccgcgccgaactcgcgactacaaaaaccgaaaacaaccaaaacaaaaaaacccttaccgaactacacccgcgccacgcgcccgaaaaccgcgcgccctcctccgacaccgcgaaatcgacgccctccgaaaaccgaatcccgctctcctaataccacgccgaacgaccacttaccgcgataactaattcccgacttataaaaatcgaaatcgccctccacgcgaaaactaaactcgatataaccctcgcgccgcgtaccctaaacgcgcaaaatacgactacaataaccctctaacttaaacactttatccaaaatctcgtcgaaaaaaaccaacgccgcgaccaaaaacaacgccaaaaccaacaataccgaaatccgactcaacttcaaaaacgccgaaaacaacctcatcttcgcgacccccaactttataccgcgaccgcaaaccttcgccacgcgactcctacccgaaataatcccgacgaaaacgcgacctaacgaaaacgcgacgaaaaaaaaaaactcgaaactaacgtccgcgactcgaaaaccgtacccgcctcgacttaacgaccgcgaaactacgctaaactaaactaaactaaaccaaacgaacgaaaacaacgcgaaaaaaaaaaaaccgcgacgaaaaaacgaaaaaaaaaaaaactaattttacccaaatcccccaacgcaacgctattttatttcctccgaactaacgattaacgacgcgaccgtatttattttacgac

SEQ ID NO: 20943 - DNA, 957 bp, Artificial Sequence
  chemically treated genomic DNA (Homo sapiens) CpG-island No: 20943
ggttttttttagatcgatttggagaaaggtagttttattttttttttgtagacggtcgggggagaagcgagttttttttgtagttaggtcggcgtgacgcgtggtttagttatatttttcgtttgggaatcgcgcgtcggaaacgcggggtgttttttttggttgcggttttcgcgacggttcgggacgttggattatgattcgcgtcgagttcgcgattgtaagggtcgagggtagttaggatagaagggtttttgtcgggttgtattcgcgttacgcgttcggagatcgcgcgttttttttcggtatcgcgaggtcggcgtttttcggggatcgggtttcgtttttttaatgttacgtcgggcggttatttatcgcggtagttggttttcggtttgtagaagtcggggtcgttttttacgcggaggttgaattcggtgtagttttcgcgtcgcgtgttttgggcgcgtaggatacggttgtagtagttttttgatttgggtattttgtttagggtttcgtcggagaaggttagcgtcgcggttaggggtagcgttagggttagtagtgtcggagttcggtttagttttaggggcgtcggggatagttttattttcgcggtttttaattttgtgtcgcggtcgtaggttttcgttacgcgatttttgttcgaagtggtttcgacgaaggcgcgatttggcggaggcgcggcggagagagggagttcggagttggcgttcgcgattcggagatcgtgttcgtttcggtttggcggtcgcggagttgcgttgagttgagttgagttgagttaagcgaacgagagtagcgcgaggaggggagggtcgcggcgaaggagcgggaggagggagggttgattttgtttagattttttagcgtagcgttgttttgtttttttcgaattggcgattagcggcgcggtcgtgtttattttgcgat

SEQ ID NO: 20944 - DNA, 957 bp, Artificial Sequence
  chemically treated genomic DNA (Homo sapiens) CpG-island No: 20944
atcgcaaaataaacacgaccgcgccgctaatcgccaattcgaaaaaaacaaaacaacgctacgctaaaaaatctaaacaaaatcaaccctccctcctcccgctccttcgccgcgaccctcccctcctcgcgctactctcgttcgcttaactcaactcaactcaactcaacgcaactccgcgaccgccaaaccgaaacgaacacgatctccgaatcgcgaacgccaactccgaactccctctctccgccgcgcctccgccaaatcgcgccttcgtcgaaaccacttcgaacaaaaatcgcgtaacgaaaacctacgaccgcgacacaaaattaaaaaccgcgaaaataaaactatccccgacgcccctaaaactaaaccgaactccgacactactaaccctaacgctacccctaaccgcgacgctaaccttctccgacgaaaccctaaacaaaatacccaaatcaaaaaactactacaaccgtatcctacgcgcccaaaacacgcgacgcgaaaactacaccgaattcaacctccgcgtaaaaaacgaccccgacttctacaaaccgaaaaccaactaccgcgataaataaccgcccgacgtaacattaaaaaaacgaaacccgatccccgaaaaacgccgacctcgcgataccgaaaaaaaacgcgcgatctccgaacgcgtaacgcgaatacaacccgacaaaaacccttctatcctaactaccctcgacccttacaatcgcgaactcgacgcgaatcataatccaacgtcccgaaccgtcgcgaaaaccgcaaccaaaaaaaacaccccgcgtttccgacgcgcgattcccaaacgaaaaatataactaaaccacgcgtcacgccgacctaactacaaaaaaaactcgcttctcccccgaccgtctacaaaaaaaaaataaaactacctttctccaaatcgatctaaaaaaaacc

SEQ ID NO: 20945 - DNA, 506 bp, Artificial Sequence
  chemically treated genomic DNA (Homo sapiens) CpG-island No: 20945
gtcggcgtttttttttcgttcgttttttacgatcgtttcggcggtttagtttttttcgaaggttgcggtcggggggcggggggtcgttttaggttcgtttttatttcggaaaggtttttatttcgaggaatttttttcgtttttttttttcgttttcgaataaataatcggggttgtaagtggtaggggcgtcggtcgggcgcggagaggtttttaggttttttttaggttttgcgttttcgtcgtttcgttttcgtcgcgcggggattaacggcgtttttttggtttttttttttattgttttttcgttacggcggagcgcgaggtaaacgttcgttcggcgttcgggggcgggggaggtgcgggtcgtggggaaatttagttaagttgaagtttttcgaggcgagtaaataaataaaagttttcgcgggcgtttggcggggtcgaggtcgaggggatcgggtcgtcggggcgggggcgcggtcgggtcgtgggttttttaggtt

SEQ ID NO: 20946 - DNA, 506 bp, Artificial Sequence
  chemically treated genomic DNA (Homo sapiens) CpG-island No: 20946
aacctaaaaaacccacgacccgaccgcgcccccgccccgacgacccgatcccctcgacctcgaccccgccaaacgcccgcgaaaacttttatttatttactcgcctcgaaaaacttcaacttaactaaatttccccacgacccgcacctcccccgcccccgaacgccgaacgaacgtttacctcgcgctccgccgtaacgaaaaaacaataaaaaaaaaaaccaaaaaaacgccgttaatccccgcgcgacgaaaacgaaacgacgaaaacgcaaaacctaaaaaaaacctaaaaacctctccgcgcccgaccgacgcccctaccacttacaaccccgattatttattcgaaaacgaaaaaaaaaaacgaaaaaaattcctcgaaataaaaacctttccgaaataaaaacgaacctaaaacgaccccccgccccccgaccgcaaccttcgaaaaaaactaaaccgccgaaacgatcgtaaaaaacgaacgaaaaaaaaacgccgac

SEQ ID NO: 20947 - DNA, 506 bp, Artificial Sequence
  chemically treated genomic DNA (Homo sapiens) CpG-island No: 20947
ggtttgggagatttacggttcggtcgcgttttcgtttcggcggttcggttttttcggtttcggtttcgttaggcgttcgcgggggtttttgtttgtttattcgtttcggggggttttaatttggttgagtttttttacgattcgtatttttttcgttttcgggcgtcgggcgagcgtttgtttcgcgtttcgtcgtggcgaggagataatgggagagaaaattagagaaacgtcgttagttttcgcgcggcgaggacggggcggcgggggcgtagggtttggagggaatttgggagttttttcgcgttcggtcggcgtttttgttatttgtagtttcggttgtttattcgggagcgggggaggggagcggggggagtttttcggagtgaaaattttttcgaagtgggagcgaatttggggcggtttttcgtttttcggtcgtagttttcggaggagattgggtcgtcgaggcggtcgtgagagacggacggagaggaagcgtcggt

SEQ ID NO: 20948 - DNA, 506 bp, Artificial Sequence
  chemically treated genomic DNA (Homo sapiens) CpG-island No: 20948
accgacgcttcctctccgtccgtctctcacgaccgcctcgacgacccaatctcctccgaaaactacgaccgaaaaacgaaaaaccgccccaaattcgctcccacttcgaaaaaattttcactccgaaaaactccccccgctcccctcccccgctcccgaataaacaaccgaaactacaaataacaaaaacgccgaccgaacgcgaaaaaactcccaaattccctccaaaccctacgcccccgccgccccgtcctcgccgcgcgaaaactaacgacgtttctctaattttctctcccattatctcctcgccacgacgaaacgcgaaacaaacgctcgcccgacgcccgaaaacgaaaaaaatacgaatcgtaaaaaaactcaaccaaattaaaaccccccgaaacgaataaacaaacaaaaacccccgcgaacgcctaacgaaaccgaaaccgaaaaaaccgaaccgccgaaacgaaaacgcgaccgaaccgtaaatctcccaaacc

SEQ ID NO: 20949 - DNA, 654 bp, Artificial Sequence
  chemically treated genomic DNA (Homo sapiens) CpG-island No: 20949
tcgttttcgtttttgtttttggtcgggtaaggcgatgttgtagaggttggcgatttttagtttttacgaattcgtacgtttttttattatttatcgcgttcgtttattgggtttcggggcggtcggcggtcgggtttttcgggtttcgcgtgtcgttcgagtcgtcgtcggagcgagggtttttgttttttggggagcggtttttagtcgtttcgaagtcgttttttttttttttcgtgagttagaaataaaggcgggggggcggggggagcgttcgagttgcggtttcgcgattcgttttttattttgaattcgtaacgttagcggttcgcggatggagttgcggggtgcggattgggtcgtttatagcgtatcgggtcgggggagcggtcgcgttgggtcgggcgggcgggtggcgggggtgcgttcggggattcgggtcgcgtgggcgtcgggatggagggcgttaaggggcggggagcgggcgtgcgtgtgtgtgcgagtgcgaatgcgagggaggtcggttttgagtgaaatcggagttataaagaaggggagagttcgggagcgggagggcgcgagggaggagcggcggcgtcggggtagtttcgacgttttttcgcggggaaggagttttcgcggtgtcgtcgaggt

SEQ ID NO: 20950 - DNA, 654 bp, Artificial Sequence
  chemically treated genomic DNA (Homo sapiens) CpG-island No: 20950
acctcgacgacaccgcgaaaactccttccccgcgaaaaaacgtcgaaactaccccgacgccgccgctcctccctcgcgccctcccgctcccgaactctccccttctttataactccgatttcactcaaaaccgacctccctcgcattcgcactcgcacacacacgcacgcccgctccccgccccttaacgccctccatcccgacgcccacgcgacccgaatccccgaacgcacccccgccacccgcccgcccgacccaacgcgaccgctcccccgacccgatacgctataaacgacccaatccgcaccccgcaactccatccgcgaaccgctaacgttacgaattcaaaataaaaaacgaatcgcgaaaccgcaactcgaacgctccccccgcccccccgcctttatttctaactcacgaaaaaaaaaaaaaacgacttcgaaacgactaaaaaccgctccccaaaaaacaaaaaccctcgctccgacgacgactcgaacgacacgcgaaacccgaaaaacccgaccgccgaccgccccgaaacccaataaacgaacgcgataaataataaaaaaacgtacgaattcgtaaaaactaaaaatcgccaacctctacaacatcgccttacccgaccaaaaacaaaaacgaaaacga

SEQ ID NO: 20951 - DNA, 654 bp, Artificial Sequence
  chemically treated genomic DNA (Homo sapiens) CpG-island No: 20951
gtttcggcggtatcgcgggggtttttttttcgcgggagggcgtcggagttgtttcggcgtcgtcgtttttttttcgcgttttttcgttttcggattttttttttttttgtagtttcggttttatttaaggtcggtttttttcgtattcgtattcgtatatatacgtacgttcgtttttcgttttttggcgttttttatttcggcgtttacgcggttcgggttttcgagcgtattttcgttattcgttcgttcggtttagcgcggtcgttttttcggttcggtgcgttgtgggcggtttagttcgtatttcgtagttttattcgcgggtcgttgacgttgcgagtttagaataaagggcgaatcgcggagtcgtagttcgggcgtttttttcgttttttcgtttttgtttttgatttacggagggggaagaaggcggtttcgaagcggttggagatcgttttttagggggtagggattttcgtttcggcggcggttcgggcgatacgcggagttcgagagattcggtcgtcggtcgtttcggggtttagtgggcgggcgcggtggataatggagagacgtgcggattcgtgaagattggagatcgttagtttttatagtatcgttttattcgattaaaaataaaaacgagagcgg

SEQ ID NO: 20952 - DNA, 654 bp, Artificial Sequence
  chemically treated genomic DNA (Homo sapiens) CpG-island No: 20952
ccgctctcgtttttatttttaatcgaataaaacgatactataaaaactaacgatctccaatcttcacgaatccgcacgtctctccattatccaccgcgcccgcccactaaaccccgaaacgaccgacgaccgaatctctcgaactccgcgtatcgcccgaaccgccgccgaaacgaaaatccctaccccctaaaaaacgatctccaaccgcttcgaaaccgccttcttccccctccgtaaatcaaaaacaaaaacgaaaaaacgaaaaaaacgcccgaactacgactccgcgattcgccctttattctaaactcgcaacgtcaacgacccgcgaataaaactacgaaatacgaactaaaccgcccacaacgcaccgaaccgaaaaaacgaccgcgctaaaccgaacgaacgaataacgaaaatacgctcgaaaacccgaaccgcgtaaacgccgaaataaaaaacgccaaaaaacgaaaaacgaacgtacgtatatatacgaatacgaatacgaaaaaaaccgaccttaaataaaaccgaaactacaaaaaaaaaaaaaatccgaaaacgaaaaaacgcgaaaaaaaaacgacgacgccgaaacaactccgacgccctcccgcgaaaaaaaaacccccgcgataccgccgaaac

SEQ ID NO: 20953 - DNA, 928 bp, Artificial Sequence
  chemically treated genomic DNA (Homo sapiens) CpG-island No: 20953
gtagttcgcgtagattcgcgtttcgtataggttcggtgggtaggtcgattttggtttcgagtttttttcgcgtttacgtttacgttaagattaatttgttgtcgggtcgtgtagtttaggttttcgatgtcgtgttcggcgtcggttttagtcgcgcgttcgcgcgttggcgatttagagattttggaagtttcgtttcggacgtttggtagcgttttcgttttgtatcgttgcgcgcgtagtttcgttttttttttcggttcgttttcggttcgttttcgtcgcggaagggcggttgcggcggttaatggcgagttttttaggataggacgcgggggttgcggagtaggaattcgtttcgtttatttttcgcgtagtttcgttttcgttacgttaattaatggcgcgcgtcgtcgggtacgtcggttgttgattggcggcgttcggtacgttcggggcgggtagtgcgcgacggcggcggcggcgcgggaggttcggagcgggagttcgggttcgcggacggtatggaggattacgagtaggagttgtgcggcgtcgaggatgatttttataattagttcgcggtcgagttggaggtgttggtagagttggaaggtggggcgcggttttcggtcgttggggaggagttgcgaaagtcgggatagtggcgatttcggggagggcgtgtcgggggtcgaaggggtttttacgtcgtcgttggcgggatttgttgtttcggggcggtcgttgataatttttttttttagtaggggcgtcgatttcgtcgtttttcggggtttttttgtttatcgcgggtcgattttcgcggacgttcgaggaggtttttgttagaggggacgcggtttttagtttcgttttagtcgtatttgtgggtagtagttagggcggcgttaggaagaggtaggtg

SEQ ID NO: 20954 - DNA, 928 bp, Artificial Sequence
  chemically treated genomic DNA (Homo sapiens) CpG-island No: 20954
cacctacctcttcctaacgccgccctaactactacccacaaatacgactaaaacgaaactaaaaaccgcgtcccctctaacaaaaacctcctcgaacgtccgcgaaaatcgacccgcgataaacaaaaaaaccccgaaaaacgacgaaatcgacgcccctactaaaaaaaaaaattatcaacgaccgccccgaaacaacaaatcccgccaacgacgacgtaaaaaccccttcgacccccgacacgccctccccgaaatcgccactatcccgactttcgcaactcctccccaacgaccgaaaaccgcgccccaccttccaactctaccaacacctccaactcgaccgcgaactaattataaaaatcatcctcgacgccgcacaactcctactcgtaatcctccataccgtccgcgaacccgaactcccgctccgaacctcccgcgccgccgccgccgtcgcgcactacccgccccgaacgtaccgaacgccgccaatcaacaaccgacgtacccgacgacgcgcgccattaattaacgtaacgaaaacgaaactacgcgaaaaataaacgaaacgaattcctactccgcaacccccgcgtcctatcctaaaaaactcgccattaaccgccgcaaccgcccttccgcgacgaaaacgaaccgaaaacgaaccgaaaaaaaaaacgaaactacgcgcgcaacgatacaaaacgaaaacgctaccaaacgtccgaaacgaaacttccaaaatctctaaatcgccaacgcgcgaacgcgcgactaaaaccgacgccgaacacgacatcgaaaacctaaactacacgacccgacaacaaattaatcttaacgtaaacgtaaacgcgaaaaaaactcgaaaccaaaatcgacctacccaccgaacctatacgaaacgcgaatctacgcgaactac

SEQ ID NO: 20955 - DNA, 928 bp, Artificial Sequence
  chemically treated genomic DNA (Homo sapiens) CpG-island No: 20955
tatttgtttttttttggcgtcgttttggttgttgtttatagatgcggttggggcgggattggaggtcgcgttttttttggtaagggttttttcgaacgttcgcgggggtcggttcgcggtgaatagggggatttcggagggcgacggagtcgacgtttttgttgggagaggagattgttagcggtcgtttcgagatagtagatttcgttagcggcgacgtggaggttttttcggttttcggtacgtttttttcgaggtcgttattgtttcggttttcgtagtttttttttaacggtcgggggtcgcgttttattttttagttttgttagtatttttagttcggtcgcgaattggttgtggaaattattttcgacgtcgtatagtttttgttcgtagttttttatatcgttcgcgagttcgagttttcgtttcgaatttttcgcgtcgtcgtcgtcgtcgcgtattgttcgtttcgagcgtgtcgggcgtcgttaattagtagtcggcgtgttcggcggcgcgcgttattggttggcgtggcggaggcggggttgcgcgaggggtgggcggggcgagtttttgtttcgtagttttcgcgttttgttttggggagttcgttattggtcgtcgtagtcgttttttcgcggcgggggcgggtcgggggcgggtcgggggggggggcggggttgcgcgcgtagcggtgtagggcggaagcgttgttaggcgttcggagcggagtttttagggtttttgggtcgttagcgcgcgggcgcgcggttggagtcggcgtcgggtacggtatcgggggtttggattgtacggttcggtagtaggttggttttggcgtgggcgtgggcgcgggaggggttcggagttagggtcggtttgtttatcgggtttgtgcggggcgcgggtttgcgcggattgt

SEQ ID NO: 20956 - DNA, 928 bp, Artificial Sequence
  chemically treated genomic DNA (Homo sapiens) CpG-island No: 20956
acaatccgcgcaaacccgcgccccgcacaaacccgataaacaaaccgaccctaactccgaacccctcccgcgcccacgcccacgccaaaaccaacctactaccgaaccgtacaatccaaacccccgataccgtacccgacgccgactccaaccgcgcgcccgcgcgctaacgacccaaaaaccctaaaaactccgctccgaacgcctaacaacgcttccgccctacaccgctacgcgcgcaaccccgcccccccccccgacccgcccccgacccgcccccgccgcgaaaaaacgactacgacgaccaataacgaactccccaaaacaaaacgcgaaaactacgaaacaaaaactcgccccgcccacccctcgcgcaaccccgcctccgccacgccaaccaataacgcgcgccgccgaacacgccgactactaattaacgacgcccgacacgctcgaaacgaacaatacgcgacgacgacgacgacgcgaaaaattcgaaacgaaaactcgaactcgcgaacgatataaaaaactacgaacaaaaactatacgacgtcgaaaataatttccacaaccaattcgcgaccgaactaaaaatactaacaaaactaaaaaataaaacgcgacccccgaccgttaaaaaaaaactacgaaaaccgaaacaataacgacctcgaaaaaaacgtaccgaaaaccgaaaaaacctccacgtcgccgctaacgaaatctactatctcgaaacgaccgctaacaatctcctctcccaacaaaaacgtcgactccgtcgccctccgaaatccccctattcaccgcgaaccgacccccgcgaacgttcgaaaaaacccttaccaaaaaaaacgcgacctccaatcccgccccaaccgcatctataaacaacaaccaaaacgacgccaaaaaaaaacaaata

SEQ ID NO: 20957 - DNA, 646 bp, Artificial Sequence
  chemically treated genomic DNA (Homo sapiens) CpG-island No: 20957
gttcgcgaaggtcgcggcggggtcgggggcggagatcggggtcggagtgggaatcgcggataggtagcgggggtttagcgtagtgggtttcgcgggattcgcgtcgttttcgtttttttggagtttcgggtttttttcggtttttttttttaatataggttttgcggtttgatcggagttcgcggtttttacgtcgttatttatcgggttaagtagtattaggaagaagtcgtcgtcgtcgtcgtcgtcgtcgtcgttaggttgatcggttttcggcgttaataggtttgggttagggtttcgtgatgtcgtgttggttttttcgcgtcgtcgttcgggttcgttattttgggggtttcggagtagtaggaggcggcgcgtggggatttggttagtcggcgagttagggtttcggtggattcggtcgttattcgcggggatatcgtcgtcgtcgtcgttttgtagtgtttcgcgagtcgggagtagtttcgggatttttatttttgcgttcgagaggttcggttggaattagagtcgaggaggaggcgcgatttcgttttttgtcgcgggtttgaatacgtttttgaaaggggaaaaaaaaatgtgtaatgcgtagaaattggttttattagatattaaaacgtat

SEQ ID NO: 20958 - DNA, 646 bp, Artificial Sequence
  chemically treated genomic DNA (Homo sapiens) CpG-island No: 20958
atacgttttaatatctaataaaaccaatttctacgcattacacatttttttttcccctttcaaaaacgtattcaaacccgcgacaaaaaacgaaatcgcgcctcctcctcgactctaattccaaccgaacctctcgaacgcaaaaataaaaatcccgaaactactcccgactcgcgaaacactacaaaacgacgacgacgacgatatccccgcgaataacgaccgaatccaccgaaaccctaactcgccgactaaccaaatccccacgcgccgcctcctactactccgaaacccccaaaataacgaacccgaacgacgacgcgaaaaaaccaacacgacatcacgaaaccctaacccaaacctattaacgccgaaaaccgatcaacctaacgacgacgacgacgacgacgacgacgacttcttcctaatactacttaacccgataaataacgacgtaaaaaccgcgaactccgatcaaaccgcaaaacctatattaaaaaaaaaaaccgaaaaaaacccgaaactccaaaaaaacgaaaacgacgcgaatcccgcgaaacccactacgctaaacccccgctacctatccgcgattcccactccgaccccgatctccgcccccgaccccgccgcgaccttcgcgaac

SEQ ID NO: 20959 - DNA, 646 bp, Artificial Sequence
  chemically treated genomic DNA (Homo sapiens) CpG-island No: 20959
atacgttttaatatttgatagggttagtttttgcgtattgtatatttttttttttttttttaggaacgtgtttaggttcgcggtagggggcgggatcgcgtttttttttcggttttggttttagtcgagtttttcggacgtagagatggaaatttcgaagttgttttcggttcgcgggatattatagggcggcggcggcggcggtattttcgcgggtggcggtcgagtttatcgaggttttgattcgtcggttggttaggtttttacgcgtcgttttttgttgtttcggggtttttaagatggcgggttcgggcggcggcgcgaggaggttagtacggtattacggggttttggtttaagtttgttggcgtcgaggatcgattaatttagcggcggcggcggcggcggcggcgacgatttttttttggtgttgtttgattcggtgggtggcgacgtggagatcgcgggtttcggttaggtcgtagggtttgtgttgagggaggaggtcgaggagggttcggggttttaggggggcgagagcggcgcgaatttcgcggggtttattgcgttaggttttcgttgtttgttcgcggtttttatttcggtttcgattttcgttttcggtttcgtcgcggttttcgcgggt

SEQ ID NO: 20960 - DNA, 646 bp, Artificial Sequence
  chemically treated genomic DNA (Homo sapiens) CpG-island No: 20960
acccgcgaaaaccgcgacgaaaccgaaaacgaaaatcgaaaccgaaataaaaaccgcgaacaaacaacgaaaacctaacgcaataaaccccgcgaaattcgcgccgctctcgcccccctaaaaccccgaaccctcctcgacctcctccctcaacacaaaccctacgacctaaccgaaacccgcgatctccacgtcgccacccaccgaatcaaacaacaccaaaaaaaaatcgtcgccgccgccgccgccgccgccgctaaattaatcgatcctcgacgccaacaaacttaaaccaaaaccccgtaataccgtactaacctcctcgcgccgccgcccgaacccgccatcttaaaaaccccgaaacaacaaaaaacgacgcgtaaaaacctaaccaaccgacgaatcaaaacctcgataaactcgaccgccacccgcgaaaataccgccgccgccgccgccctataatatcccgcgaaccgaaaacaacttcgaaatttccatctctacgtccgaaaaactcgactaaaaccaaaaccgaaaaaaaaacgcgatcccgccccctaccgcgaacctaaacacgttcctaaaaaaaaaaaaaaaaatatacaatacgcaaaaactaaccctatcaaatattaaaacgtat

SEQ ID NO: 20961 - DNA, 1089 bp, Artificial Sequence
  chemically treated genomic DNA (Homo sapiens) CpG-island No: 20961
gttcgaggttttttatttagtcgatcggttttggggattttttttcgttggttcgggttacgcgtttcgggtatttattgtagagcgcgttcggtaatttcgaaaggtcggtcggggatttcggttgggagttaggattttagttttcgggcgcgattcgagaattttgaatttatttcgcgtatattcggtcgcgtgatttttgtcgatcggttggcgcgttatttatttttcgcggttcgcggattagttagtagttgttttagttcgggtttttttttttagttttttcgtcgattttcgtttttttgtagggtcgattttttagcgatcgtttttagagttagcggacggaattattttaaatagtttagtttcgtgttgagagttttttcggttttacgttgagattcgtttattttcgttttggttttttagatgttattttggttcgagtgttacgtcgggcgttttttagagaggattgggataagagttgcggacgcgaagaacgagtaagcggtggtttattttttttgattttattttcgtggtttggttcgatggtcgcgttcggggttgcgagatttgcgtttgcgtagtgcggcgtttagagggaaagcgagagggagacggacgttgagagaacgaggaggaaggagagaaaatggcgtttacgggtgagtatggtggaattgcggtcgcgtcggcggtagtcggaacgtttaaattgggggtcgttcgtttttgggtttggttgggaagattgagtggagttgtcgagagggggttgaggtattcgtcgcggttcgacgagttcggggattcgtatttttttttttttttttaatcgggcgggtcggttttggaatttttcggcgttcgtggcgcgcggggggtttgttgcggcgggggcgcgcggggttcgttttggtttttattgtgtggcggttttcgcgttttgagtttcgggtttttcgttacgtgggcggggtttgcggttttcgaggttttgcgtgaaggggaggatttggttaggttttaagtcggttattatgaaatcgtcggggggttcgtaggttgttgttt

SEQ ID NO: 20962 - DNA, 1089 bp, Artificial Sequence
  chemically treated genomic DNA (Homo sapiens) CpG-island No: 20962
aaacaacaacctacgaaccccccgacgatttcataataaccgacttaaaacctaaccaaatcctccccttcacgcaaaacctcgaaaaccgcaaaccccgcccacgtaacgaaaaacccgaaactcaaaacgcgaaaaccgccacacaataaaaaccaaaacgaaccccgcgcgcccccgccgcaacaaaccccccgcgcgccacgaacgccgaaaaattccaaaaccgacccgcccgattaaaaaaaaaaaaaaaaatacgaatccccgaactcgtcgaaccgcgacgaatacctcaaccccctctcgacaactccactcaatcttcccaaccaaacccaaaaacgaacgacccccaatttaaacgttccgactaccgccgacgcgaccgcaattccaccatactcacccgtaaacgccattttctctccttcctcctcgttctctcaacgtccgtctccctctcgctttccctctaaacgccgcactacgcaaacgcaaatctcgcaaccccgaacgcgaccatcgaaccaaaccacgaaaataaaatcaaaaaaaataaaccaccgcttactcgttcttcgcgtccgcaactcttatcccaatcctctctaaaaaacgcccgacgtaacactcgaaccaaaataacatctaaaaaaccaaaacgaaaataaacgaatctcaacgtaaaaccgaaaaaactctcaacacgaaactaaactatttaaaataattccgtccgctaactctaaaaacgatcgctaaaaaatcgaccctacaaaaaaacgaaaatcgacgaaaaaactaaaaaaaaaaacccgaactaaaacaactactaactaatccgcgaaccgcgaaaaataaataacgcgccaaccgatcgacaaaaatcacgcgaccgaatatacgcgaaataaattcaaaattctcgaatcgcgcccgaaaactaaaatcctaactcccaaccgaaatccccgaccgacctttcgaaattaccgaacgcgctctacaataaatacccgaaacgcgtaacccgaaccaacgaaaaaaaatccccaaaaccgatcgactaaataaaaaacctcgaac

SEQ ID NO: 20963 - DNA, 1089 bp, Artificial Sequence
  chemically treated genomic DNA (Homo sapiens) CpG-island No: 20963
ggatagtagtttgcgggtttttcggcggttttatagtgatcggtttgaggtttggttaaatttttttttttacgtagggtttcgaaggtcgtaggtttcgtttacgtggcgggaggttcggagtttagggcgcgaggatcgttatataatggaggttaaggcgggtttcgcgcgttttcgtcgtagtaagtttttcgcgcgttacgggcgtcggaagattttagaatcggttcgttcggttgggggaggggagaggaatgcggattttcgagttcgtcgggtcgcggcgggtgttttaattttttttcggtaattttatttagtttttttagttaagtttagagacgaacgatttttagtttgggcgtttcggttatcgtcggcgcgatcgtagttttattatatttattcgtggacgttattttttttttttttttttcgtttttttaacgttcgtttttttttcgttttttttttaggcgtcgtattgcgtaggcgtaaatttcgtaatttcgggcgcgattatcgggttaggttacgggggtggggttaggagggatgaattatcgtttattcgtttttcgcgttcgtaatttttgttttagttttttttaaagagcgttcgacgtgatattcgggttaaaatagtatttaaggggttagagcgggggtgagcgggttttagcgtgaaatcggagaggtttttagtacgagattaggttgtttggaatggtttcgttcgttggttttagggacggtcgttgaagagtcggttttgtagggagacggagatcggcgggagggttgggggaagggattcggattagaataattgttgattaattcgcgggtcgcggggaatgggtggcgcgttagtcggtcggtaggggttacgcggtcgggtgtgcgcggaatggatttagggttttcgggtcgcgttcgggagttagagttttgatttttagtcggggttttcgatcggtttttcggggttgtcgggcgcgttttgtagtgagtattcgggacgcgtggttcgggttagcggggaagggtttttaaggtcggtcggttgggtgggaggtttcgaat

SEQ ID NO: 20964 - DNA, 1089 bp, Artificial Sequence
  chemically treated genomic DNA (Homo sapiens) CpG-island No: 20964
attcgaaacctcccacccaaccgaccgaccttaaaaacccttccccgctaacccgaaccacgcgtcccgaatactcactacaaaacgcgcccgacaaccccgaaaaaccgatcgaaaaccccgactaaaaatcaaaactctaactcccgaacgcgacccgaaaaccctaaatccattccgcgcacacccgaccgcgtaacccctaccgaccgactaacgcgccacccattccccgcgacccgcgaattaatcaacaattattctaatccgaatcccttcccccaaccctcccgccgatctccgtctccctacaaaaccgactcttcaacgaccgtccctaaaaccaacgaacgaaaccattccaaacaacctaatctcgtactaaaaacctctccgatttcacgctaaaacccgctcacccccgctctaaccccttaaatactattttaacccgaatatcacgtcgaacgctctttaaaaaaaactaaaacaaaaattacgaacgcgaaaaacgaataaacgataattcatccctcctaaccccacccccgtaacctaacccgataatcgcgcccgaaattacgaaatttacgcctacgcaatacgacgcctaaaaaaaaaacgaaaaaaaaacgaacgttaaaaaaacgaaaaaaaaaaaaaaaaaataacgtccacgaataaatataataaaactacgatcgcgccgacgataaccgaaacgcccaaactaaaaatcgttcgtctctaaacttaactaaaaaaactaaataaaattaccgaaaaaaaattaaaacacccgccgcgacccgacgaactcgaaaatccgcattcctctcccctcccccaaccgaacgaaccgattctaaaatcttccgacgcccgtaacgcgcgaaaaacttactacgacgaaaacgcgcgaaacccgccttaacctccattatataacgatcctcgcgccctaaactccgaacctcccgccacgtaaacgaaacctacgaccttcgaaaccctacgtaaaaaaaaaaatttaaccaaacctcaaaccgatcactataaaaccgccgaaaaacccgcaaactactatcc

SEQ ID NO: 20965 - DNA, 571 bp, Artificial Sequence
  chemically treated genomic DNA (Homo sapiens) CpG-island No: 20965
gtcggaagagtttgagttgtatggtgcggcgtatttcgaggggattcgtaagagcgaagggcggagattagtttttcgggtttgggttacggtcggggatttaatcgattacgttcgggatgcggaggtttgagcgcgcgatcgggattagcgtattttggggggcggggagaggcggtgtagttgcggatcgcggtcgaggtatgttgcgggggtggttattttgtcgtcgcggtttcgtcgttagtaagtttcgttttatggttggtcgattgcggtatttacggtttttttttcgtttcgtttcggcggtcggtttgtcgttcgttttcgcgttgcgcgtttttattttcgtcggaagcggcgtcggagtagcgcggtagggcgcggaaattcgggcgggtggagtggtattaaacggagtgagatcggtttgtttagtcgttttttattttaatttatcgacgtattttattagggagattatattttttataattaacgttcgcgtttttgtttttgttgtttcggttatagttcgaaggatttttttttatgattagatgatttt

SEQ ID NO: 20966 - DNA, 571 bp, Artificial Sequence
  chemically treated genomic DNA (Homo sapiens) CpG-island No: 20966
aaaatcatctaatcataaaaaaaaatccttcgaactataaccgaaacaacaaaaacaaaaacgcgaacgttaattataaaaaatataatctccctaataaaatacgtcgataaattaaaataaaaaacgactaaacaaaccgatctcactccgtttaataccactccacccgcccgaatttccgcgccctaccgcgctactccgacgccgcttccgacgaaaataaaaacgcgcaacgcgaaaacgaacgacaaaccgaccgccgaaacgaaacgaaaaaaaaaccgtaaataccgcaatcgaccaaccataaaacgaaacttactaacgacgaaaccgcgacgacaaaataaccacccccgcaacatacctcgaccgcgatccgcaactacaccgcctctccccgccccccaaaatacgctaatcccgatcgcgcgctcaaacctccgcatcccgaacgtaatcgattaaatccccgaccgtaacccaaacccgaaaaactaatctccgcccttcgctcttacgaatcccctcgaaatacgccgcaccatacaactcaaactcttccgac

SEQ ID NO: 20967 - DNA, 571 bp, Artificial Sequence
  chemically treated genomic DNA (Homo sapiens) CpG-island No: 20967
ggggttatttagttataagggaaaatttttcgggttgtgatcgaagtaataaaggtaaaaacgcggacgttggttatgaagggtgtggtttttttggtggagtacgtcggtgggttgggatggggagcggttggatagatcggttttatttcgtttggtgttattttattcgttcgggttttcgcgttttgtcgcgttgtttcgacgtcgttttcggcggggatgggagcgcgtaacgcggaagcgggcggtagatcggtcgtcggggcgaggcgggggaggggtcgtgagtgtcgtagtcggttagttatggagcggagtttgttggcggcgaggtcgcggcgataaggtagttattttcgtagtatgtttcgatcgcggttcgtagttgtatcgttttttttcgttttttagggtgcgttggtttcggtcgcgcgtttagattttcgtatttcgggcgtggtcggttaagttttcggtcgtgatttaggttcggggagttagttttcgtttttcgtttttacggattttttcggagtacgtcgtattatgtagtttaggttttttcggt

SEQ ID NO: 20968 - DNA, 571 bp, Artificial Sequence
  chemically treated genomic DNA (Homo sapiens) CpG-island No: 20968
accgaaaaaacctaaactacataatacgacgtactccgaaaaaatccgtaaaaacgaaaaacgaaaactaactccccgaacctaaatcacgaccgaaaacttaaccgaccacgcccgaaatacgaaaatctaaacgcgcgaccgaaaccaacgcaccctaaaaaacgaaaaaaaacgatacaactacgaaccgcgatcgaaacatactacgaaaataactaccttatcgccgcgacctcgccgccaacaaactccgctccataactaaccgactacgacactcacgacccctcccccgcctcgccccgacgaccgatctaccgcccgcttccgcgttacgcgctcccatccccgccgaaaacgacgtcgaaacaacgcgacaaaacgcgaaaacccgaacgaataaaataacaccaaacgaaataaaaccgatctatccaaccgctccccatcccaacccaccgacgtactccaccaaaaaaaccacacccttcataaccaacgtccgcgtttttacctttattacttcgatcacaacccgaaaaattttcccttataactaaataacccc

SEQ ID NO: 20969 - DNA, 683 bp, Artificial Sequence
  chemically treated genomic DNA (Homo sapiens) CpG-island No: 20969
ttgcggacggatgcggtgttggtatggcgagcgggaggaggggcgtgtggaggaggggttcgtggaggaggggcgagtgggaggaggggcgcgtggagggggggcgtgtgggggggtgcgtggaggaggggcgcgtggaggaggggcgcgtggaggggggagcgtggggggcgtggaggaggggcgcgtggaggaggggcgcgtggaggggggagcgtggggggcgtggaggaggggcgcgtggaggggggagtgtgggggggcgtggaggaggaggggcgtatgggggggtgtggaggggggcgcgtggaggaggggcgcgtggaggggggagcgtggggggcgtggaggaggggcgcgtggaggggggcgcgtggggggggcgtatgggggggcgtggaggggggtgcgtggaggaggggcgcgtggaggaggaggggcgtatgggggggtgtggaggggggcgcgtggagggggtacgtggaggggtcgcgtggaggaggggcgcgtggagggggtcgtgtgggggggcgtggaggggggcgcgtggaggaggaggggcgtatgggggggtgtggaggggggcgcgtggagggggcgcgtggaggaggggtatatggaggggggggtaagtggagaagttttggtggaggggcgtatggaggaggggttaacggggggtg

SEQ ID NO: 20970 - DNA, 683 bp, Artificial Sequence
  chemically treated genomic DNA (Homo sapiens) CpG-island No: 20970
caccccccgttaacccctcctccatacgcccctccaccaaaacttctccacttacccccccctccatatacccctcctccacgcgccccctccacgcgcccccctccacacccccccatacgcccctcctcctccacgcgcccccctccacgcccccccacacgaccccctccacgcgcccctcctccacgcgacccctccacgtaccccctccacgcgcccccctccacacccccccatacgcccctcctcctccacgcgcccctcctccacgcacccccctccacgcccccccatacgccccccccacgcgcccccctccacgcgcccctcctccacgccccccacgctcccccctccacgcgcccctcctccacgcgcccccctccacacccccccatacgcccctcctcctccacgcccccccacactcccccctccacgcgcccctcctccacgccccccacgctcccccctccacgcgcccctcctccacgcgcccctcctccacgccccccacgctcccccctccacgcgcccctcctccacgcgcccctcctccacgcacccccccacacgccccccctccacgcgcccctcctcccactcgcccctcctccacgaacccctcctccacacgcccctcctcccgctcgccataccaacaccgcatccgtccgcaa

SEQ ID NO: 20971 - DNA, 683 bp, Artificial Sequence
  chemically treated genomic DNA (Homo sapiens) CpG-island No: 20971
tatttttcgttggttttttttttatgcgtttttttattagggtttttttatttgtttttttttttatgtgttttttttttacgcgttttttttacgcgtttttttttatatttttttatgcgtttttttttttttacgcgtttttttttacgtttttttatacggttttttttacgcgttttttttttacgcgatttttttacgtgttttttttacgcgtttttttttatatttttttatgcgtttttttttttttacgcgttttttttttacgtatttttttttacgtttttttatgcgttttttttacgcgtttttttttacgcgttttttttttacgttttttacgtttttttttttacgcgttttttttttacgcgtttttttttatatttttttatgcgtttttttttttttacgtttttttatatttttttttttacgcgttttttttttacgttttttacgtttttttttttacgcgttttttttttacgcgttttttttttacgttttttacgtttttttttttacgcgttttttttttacgcgttttttttttacgtatttttttatacgttttttttttacgcgtttttttttttattcgttttttttttacgggttttttttttatacgttttttttttcgttcgttatattagtatcgtattcgttcgtag

SEQ ID NO: 20972 - DNA, 683 bp, Artificial Sequence
  chemically treated genomic DNA (Homo sapiens) CpG-island No: 20972
ctacgaacgaatacgatactaatataacgaacgaaaaaaaaaacgtataaaaaaaaaacccgtaaaaaaaaaacgaataaaaaaaaaaacgcgtaaaaaaaaaacgtataaaaaaatacgtaaaaaaaaaacgcgtaaaaaaaaaacgcgtaaaaaaaaaaacgtaaaaaacgtaaaaaaaaaacgcgtaaaaaaaaaacgcgtaaaaaaaaaaacgtaaaaaacgtaaaaaaaaaacgcgtaaaaaaaaaaatataaaaaaacgtaaaaaaaaaaaaacgcataaaaaaatataaaaaaaaacgcgtaaaaaaaaaacgcgtaaaaaaaaaaacgtaaaaaacgtaaaaaaaaaacgcgtaaaaaaaaacgcgtaaaaaaaacgcataaaaaaacgtaaaaaaaaatacgtaaaaaaaaaacgcgtaaaaaaaaaaaaacgcataaaaaaatataaaaaaaaacgcgtaaaaaaaacacgtaaaaaaatcgcgtaaaaaaaaaacgcgtaaaaaaaaccgtataaaaaaacgtaaaaaaaaacgcgtaaaaaaaaaaaaacgcataaaaaaatataaaaaaaaacgcgtaaaaaaaacgcgtaaaaaaaaaacacataaaaaaaaaaacaaataaaaaaaccctaataaaaaaacgcataaaaaaaaaaccaacgaaaaata

SEQ ID NO: 20973 - DNA, 598 bp, Artificial Sequence
  chemically treated genomic DNA (Homo sapiens) CpG-island No: 20973
gttttttcgtattggttttgtaatcgttttcgttagacgcgttttcgttttttgtttttcggaaaggtgttcgttttttgtttttcggttcggcgttcgattttcgtttttcgatttagttgtgggttgcgttttacgttagttcgcgtttcgtatggttgtcgtcggggttaggtttgtggagttgggtttcgtcgagtcggcgtcggcgtggcgattgcgtagcgagtagttttttagtaaggtgggcgggcggtcggtatggttgggcgcggtcgggttgtcggggttttaggttttggtttgcgagttgtgcggtcgttcgtttttttttttgttgtaggtgtatgcgtcgttgtttggtcgttcggacgttttttatcgttgtattttttttttttgttgtcgcgagtagtcgtgttgtgtcggtttgcgaggtgagtcgttaaacggggtcgggacggggttatgttttcgacgcgtgcgcggcgttaatttcgggagcgattagggggacggcggtaagtatcgttgtcgttttagttttagagtttttttttcgcgttgttttaggagtattttttttcgggttttttta

SEQ ID NO: 20974 - DNA, 598 bp, Artificial Sequence
  chemically treated genomic DNA (Homo sapiens) CpG-island No: 20974
taaaaaaacccgaaaaaaaatactcctaaaacaacgcgaaaaaaaaactctaaaactaaaacgacaacgatacttaccgccgtccccctaatcgctcccgaaattaacgccgcgcacgcgtcgaaaacataaccccgtcccgaccccgtttaacgactcacctcgcaaaccgacacaacacgactactcgcgacaacaaaaaaaaaaaatacaacgataaaaaacgtccgaacgaccaaacaacgacgcatacacctacaacaaaaaaaaaaacgaacgaccgcacaactcgcaaaccaaaacctaaaaccccgacaacccgaccgcgcccaaccataccgaccgcccgcccaccttactaaaaaactactcgctacgcaatcgccacgccgacgccgactcgacgaaacccaactccacaaacctaaccccgacgacaaccatacgaaacgcgaactaacgtaaaacgcaacccacaactaaatcgaaaaacgaaaatcgaacgccgaaccgaaaaacaaaaaacgaacacctttccgaaaaacaaaaaacgaaaacgcgtctaacgaaaacgattacaaaaccaatacgaaaaaac

SEQ ID NO: 20975 - DNA, 598 bp, Artificial Sequence
  chemically treated genomic DNA (Homo sapiens) CpG-island No: 20975
tggaagggttcgggagaaggtgtttttggggtagcgcggagagggagttttgaggttggggcggtagcggtgtttgtcgtcgtttttttggtcgttttcggaattaacgtcgcgtacgcgtcggaggtatggtttcgtttcgatttcgtttggcggtttatttcgtaggtcggtatagtacggttgttcgcggtagtagaagaggaagatgtagcggtggaaggcgttcgggcggttaggtagcggcgtatatatttgtagtaggaaggagagcgggcggtcgtatagttcgtaggttagggtttggggtttcggtagttcggtcgcgtttagttatgtcggtcgttcgtttattttgttggggaattgttcgttgcgtagtcgttacgtcggcgtcgattcggcgaagtttagttttataggtttggtttcggcggtagttatgcggggcgcgggttggcgtggggcgtagtttatagttgggtcggaaggcggaaatcgggcgtcgggtcggaaggtaagaggcgggtattttttcggaggataggaggcggaaacgcgtttgacgggagcggttgtaggattaatgcgagggaat

SEQ ID NO: 20976 - DNA, 598 bp, Artificial Sequence
  chemically treated genomic DNA (Homo sapiens) CpG-island No: 20976
attccctcgcattaatcctacaaccgctcccgtcaaacgcgtttccgcctcctatcctccgaaaaaatacccgcctcttaccttccgacccgacgcccgatttccgccttccgacccaactataaactacgccccacgccaacccgcgccccgcataactaccgccgaaaccaaacctataaaactaaacttcgccgaatcgacgccgacgtaacgactacgcaacgaacaattccccaacaaaataaacgaacgaccgacataactaaacgcgaccgaactaccgaaaccccaaaccctaacctacgaactatacgaccgcccgctctccttcctactacaaatatatacgccgctacctaaccgcccgaacgccttccaccgctacatcttcctcttctactaccgcgaacaaccgtactataccgacctacgaaataaaccgccaaacgaaatcgaaacgaaaccatacctccgacgcgtacgcgacgttaattccgaaaacgaccaaaaaaacgacgacaaacaccgctaccgccccaacctcaaaactccctctccgcgctaccccaaaaacaccttctcccgaacccttcca

SEQ ID NO: 20977 - DNA, 932 bp, Artificial Sequence
  chemically treated genomic DNA (Homo sapiens) CpG-island No: 20977
cgcgttttttagtttcgcggggggtagacgacggcgggcggggcgcgtagagtatattcgattttcggcggtcgggagcgattacgcgtacgtcgcgcgggttcgggggcgggggcggggcgcgcggttttcgttagggtttaagttttattttcgggggcggtgtttggttcggggagtgttaggaagaggaagagcgcggtcggcggcgttgcgttgagagtaggggttcggttaaggcgagtgtcgcgcgggttattatggttacggacgagttggttattaagttgagtcggcggttgtagatggagggcgagggcggcggcgagatttcggagtagttcgggttgaacggggtagcggcggcggcggcgggggtattcgacgaggcggtcgaggcgttgggtagcgcggattgcgagttgagcgttaagttgttgcggcgcgtagattttaattagggtatcggcgagttttagtcgtttagtcgtcgcgtttttaatttttatatcgagtttaaggagttttttaggaagtagattaaggatatggagaagatgtttaagtagtaagtgttcgcgcgattcggtttttcgttcgtttcgcgattcggtttcgggtttcgaatttttcgattttcggatttcgtttcgtttcgggagtttgtcgttagttaagttttttcgaatttagacgtatcggggttggggattcggcggttttttttagatcgagattcggtattttatcgcgtacgttagtttgggggattttcggtttttggtacgcggcggagattcgtatttgtgttgttttcggtatattatagacgcgtttatagagtgggggattttaggtttttttttagataatcgttaggtttcgcgagttttatttttattattatacgtgtgggtttcgggtttttcgcg

SEQ ID NO: 20978 - DNA, 932 bp, Artificial Sequence
  chemically treated genomic DNA (Homo sapiens) CpG-island No: 20978
cgcgaaaaacccgaaacccacacgtataataataaaaataaaactcgcgaaacctaacgattatctaaaaaaaaacctaaaatcccccactctataaacgcgtctataatataccgaaaacaacacaaatacgaatctccgccgcgtaccaaaaaccgaaaatcccccaaactaacgtacgcgataaaataccgaatctcgatctaaaaaaaaccgccgaatccccaaccccgatacgtctaaattcgaaaaaacttaactaacgacaaactcccgaaacgaaacgaaatccgaaaatcgaaaaattcgaaacccgaaaccgaatcgcgaaacgaacgaaaaaccgaatcgcgcgaacacttactacttaaacatcttctccatatccttaatctacttcctaaaaaactccttaaactcgatataaaaattaaaaacgcgacgactaaacgactaaaactcgccgataccctaattaaaatctacgcgccgcaacaacttaacgctcaactcgcaatccgcgctacccaacgcctcgaccgcctcgtcgaatacccccgccgccgccgccgctaccccgttcaacccgaactactccgaaatctcgccgccgccctcgccctccatctacaaccgccgactcaacttaataaccaactcgtccgtaaccataataacccgcgcgacactcgccttaaccgaacccctactctcaacgcaacgccgccgaccgcgctcttcctcttcctaacactccccgaaccaaacaccgcccccgaaaataaaacttaaaccctaacgaaaaccgcgcgccccgcccccgcccccgaacccgcgcgacgtacgcgtaatcgctcccgaccgccgaaaatcgaatatactctacgcgccccgcccgccgtcgtctaccccccgcgaaactaaaaaacgcg

SEQ ID NO: 20979 - DNA, 932 bp, Artificial Sequence
  chemically treated genomic DNA (Homo sapiens) CpG-island No: 20979
cgcggagggttcgggatttatacgtgtggtggtgggggtggggttcgcggggtttggcgattatttggaaggaagtttggggttttttattttgtggacgcgtttatggtgtatcggaggtagtataaatacgagttttcgtcgcgtgttaggggtcgggggttttttagattaacgtgcgcggtgagatgtcgggtttcgatttggaaggggtcgtcgggtttttaatttcggtgcgtttgggttcggggaagtttggttgacggtaggttttcggggcggagcgggattcggggatcggggggttcggggttcgagatcgggtcgcggggcgggcggggggtcgggtcgcgcgggtatttattgtttgaatattttttttatgtttttgatttgttttttggagaattttttgaattcggtgtaggggttgaagacgcggcggttgggcgattggggttcgtcgatgttttggttgaggtttgcgcgtcgtagtagtttggcgtttagttcgtagttcgcgttgtttagcgtttcggtcgtttcgtcgggtgttttcgtcgtcgtcgtcgttgtttcgtttagttcgggttgtttcggggtttcgtcgtcgttttcgttttttatttgtagtcgtcggtttagtttggtggttagttcgttcgtggttatggtggttcgcgcggtattcgttttggtcgggtttttgtttttagcgtagcgtcgtcggtcgcgttttttttttttttgatatttttcgggttaggtatcgttttcgaaggtgggatttgggttttggcggggatcgcgcgtttcgttttcgttttcgggttcgcgcggcgtgcgcgtgatcgttttcggtcgtcgggggtcgagtgtattttgcgcgtttcgttcgtcgtcgtttgtttttcgcgaggttggggagcgcg

SEQ ID NO: 20980 - DNA, 932 bp, Artificial Sequence
  chemically treated genomic DNA (Homo sapiens) CpG-island No: 20980
cgcgctccccaacctcgcgaaaaacaaacgacgacgaacgaaacgcgcaaaatacactcgacccccgacgaccgaaaacgatcacgcgcacgccgcgcgaacccgaaaacgaaaacgaaacgcgcgatccccgccaaaacccaaatcccaccttcgaaaacgatacctaacccgaaaaatatcaaaaaaaaaaaaaacgcgaccgacgacgctacgctaaaaacaaaaacccgaccaaaacgaataccgcgcgaaccaccataaccacgaacgaactaaccaccaaactaaaccgacgactacaaataaaaaacgaaaacgacgacgaaaccccgaaacaacccgaactaaacgaaacaacgacgacgacgacgaaaacacccgacgaaacgaccgaaacgctaaacaacgcgaactacgaactaaacgccaaactactacgacgcgcaaacctcaaccaaaacatcgacgaaccccaatcgcccaaccgccgcgtcttcaacccctacaccgaattcaaaaaattctccaaaaaacaaatcaaaaacataaaaaaaatattcaaacaataaatacccgcgcgacccgaccccccgcccgccccgcgacccgatctcgaaccccgaaccccccgatccccgaatcccgctccgccccgaaaacctaccgtcaaccaaacttccccgaacccaaacgcaccgaaattaaaaacccgacgaccccttccaaatcgaaacccgacatctcaccgcgcacgttaatctaaaaaacccccgacccctaacacgcgacgaaaactcgtatttatactacctccgatacaccataaacgcgtccacaaaataaaaaaccccaaacttccttccaaataatcgccaaaccccgcgaaccccacccccaccaccacacgtataaatcccgaaccctccgcg

SEQ ID NO: 20981 - DNA, 535 bp, Artificial Sequence
  chemically treated genomic DNA (Homo sapiens) CpG-island No: 20981
taggttttcggttcggttcggttcggttcggaggtcgatgtttcgcggtagtgttttcgcgggttttgcggattcggcgttcgcggggtttatagcgttgtttagtttgtggacgtggagttcgggtcgtatcgtcgtatacgtttcgggtatttttgcgttacgtcgcgcgtttttacggtttcgtttcgtggcgtaattcggggcggggtcgttattttcgattggtcggcgcgttgttattacgtcgcgggaagttggtagggtgtgtgtttgtgtgcgtgtggggtttgttttgttattcgtattttcggtgcgcgttgacgcggtcggtttggtcgagttttttagtattcgtagaagggttttcggcgttgtttttgggatgtttttttatataatgacgcgattggttgaagcgtacgttagcgtagatatcgtatatgtcgtaaattcgggtttttcgattttatatattgttagacgagagtttataatgttatgtcgtacggtatgttttagtagggattataat

SEQ ID NO: 20982 - DNA, 535 bp, Artificial Sequence
  chemically treated genomic DNA (Homo sapiens) CpG-island No: 20982
attataatccctactaaaacataccgtacgacataacattataaactctcgtctaacaatatataaaatcgaaaaacccgaatttacgacatatacgatatctacgctaacgtacgcttcaaccaatcgcgtcattatataaaaaaacatcccaaaaacaacgccgaaaacccttctacgaatactaaaaaactcgaccaaaccgaccgcgtcaacgcgcaccgaaaatacgaataacaaaacaaaccccacacgcacacaaacacacaccctaccaacttcccgcgacgtaataacaacgcgccgaccaatcgaaaataacgaccccgccccgaattacgccacgaaacgaaaccgtaaaaacgcgcgacgtaacgcaaaaatacccgaaacgtatacgacgatacgacccgaactccacgtccacaaactaaacaacgctataaaccccgcgaacgccgaatccgcaaaacccgcgaaaacactaccgcgaaacatcgacctccgaaccgaaccgaaccgaaccgaaaaccta

SEQ ID NO: 20983 - DNA, 535 bp, Artificial Sequence
  chemically treated genomic DNA (Homo sapiens) CpG-island No: 20983
attgtaatttttattagagtatatcgtacggtatggtattgtaggttttcgtttagtaatgtatgaaatcggaaggttcgggtttgcggtatgtgcggtgtttgcgttgacgtgcgttttagttagtcgcgttattatgtaagggagtattttaggaatagcgtcggggatttttttgcggatgttggagagttcggttaggtcgatcgcgttagcgcgtatcgggggtacgaatgataaagtaaattttatacgtatatagatatatattttgttagtttttcgcgacgtggtgatagcgcgtcggttaatcggaggtggcggtttcgtttcgggttacgttacggggcggagtcgtgggggcgcgcgacgtagcgtagagatgttcggggcgtgtgcggcggtgcggttcgggttttacgtttataggttgggtagcgttgtgggtttcgcgggcgtcgagttcgtaggattcgcgagggtattatcgcgaagtatcggttttcgggtcgggtcgggtcggatcgggagtttg

SEQ ID NO: 20984 - DNA, 535 bp, Artificial Sequence
  chemically treated genomic DNA (Homo sapiens) CpG-island No: 20984
caaactcccgatccgacccgacccgacccgaaaaccgatacttcgcgataataccctcgcgaatcctacgaactcgacgcccgcgaaacccacaacgctacccaacctataaacgtaaaacccgaaccgcaccgccgcacacgccccgaacatctctacgctacgtcgcgcgcccccacgactccgccccgtaacgtaacccgaaacgaaaccgccacctccgattaaccgacgcgctatcaccacgtcgcgaaaaactaacaaaatatatatctatatacgtataaaatttactttatcattcgtacccccgatacgcgctaacgcgatcgacctaaccgaactctccaacatccgcaaaaaaatccccgacgctattcctaaaatactcccttacataataacgcgactaactaaaacgcacgtcaacgcaaacaccgcacataccgcaaacccgaaccttccgatttcatacattactaaacgaaaacctacaataccataccgtacgatatactctaataaaaattacaat

SEQ ID NO: 20985 - DNA, 614 bp, Artificial Sequence
  chemically treated genomic DNA (Homo sapiens) CpG-island No: 20985
cggcggcggtagttgaggtgagagacggcggcggcggcgcgggtattcggttttttagcgggaggatgaagcggcggaacgtcgattgtagtaagtttcgtcgttttttaaagcggaatcggattatcgagggtatttacggtaggtgagcggttgtatttttatttcgcgggcgcgggttttgcggtttttttttagtttcgaggggtttggtttcgttatgtaatttcgagtaggtcgtacgttcgcgtcgggggtttttttaaggagcgttggtttcggagtcgttggttcgttcgtcggggttcgtttcgggtgcgcggggcgtggcgagggtcggttcggtcgggcgggtagggcgcggcgggcgttggttgagggagtcgtcgcgtcgtcgttggaagcgtcgggttcgtcggggggaggggcggagagtttttaattagttcggcgttttttagtatttcggttatgtcgttgggtcgggagggtcgttttcgggatttttgattggtcgtcgttggttttcgagtttttcggtggtttgggggtttgtcggtcggagttaggaggcgcgtggattatagcgcgggggggtgggggaggttgataaa

SEQ ID NO: 20986 - DNA, 614 bp, Artificial Sequence
  chemically treated genomic DNA (Homo sapiens) CpG-island No: 20986
tttatcaacctcccccacccccccgcgctataatccacgcgcctcctaactccgaccgacaaacccccaaaccaccgaaaaactcgaaaaccaacgacgaccaatcaaaaatcccgaaaacgaccctcccgacccaacgacataaccgaaatactaaaaaacgccgaactaattaaaaactctccgcccctccccccgacgaacccgacgcttccaacgacgacgcgacgactccctcaaccaacgcccgccgcgccctacccgcccgaccgaaccgaccctcgccacgccccgcgcacccgaaacgaaccccgacgaacgaaccaacgactccgaaaccaacgctccttaaaaaaacccccgacgcgaacgtacgacctactcgaaattacataacgaaaccaaacccctcgaaactaaaaaaaaaccgcaaaacccgcgcccgcgaaataaaaatacaaccgctcacctaccgtaaataccctcgataatccgattccgctttaaaaaacgacgaaacttactacaatcgacgttccgccgcttcatcctcccgctaaaaaaccgaatacccgcgccgccgccgccgtctctcacctcaactaccgccgccg

SEQ ID NO: 20987 - DNA, 614 bp, Artificial Sequence
  chemically treated genomic DNA (Homo sapiens) CpG-island No: 20987
tttgttagttttttttattttttcgcgttgtggtttacgcgttttttggtttcggtcggtaagtttttaggttatcggggggttcgggggttagcggcggttagttagaggtttcggaagcggttttttcggtttagcggtatggtcgggatgttgaggaacgtcgggttggttgggggtttttcgttttttttttcggcgggttcggcgtttttaacggcggcgcggcggtttttttagttagcgttcgtcgcgttttgttcgttcggtcgggtcgattttcgttacgtttcgcgtattcggggcggatttcggcgggcgggttagcggtttcggggttagcgttttttaggagagttttcggcgcgggcgtgcggtttattcggggttatataacggggttaggtttttcggagttggagggggatcgtagggttcgcgttcgcggagtgggggtgtagtcgtttatttgtcgtaaatgttttcggtgattcggtttcgttttagggggcggcggagtttattgtagtcggcgtttcgtcgttttattttttcgttggggggtcgggtgttcgcgtcgtcgtcgtcgttttttattttagttgtcgtcgtcg

SEQ ID NO: 20988 - DNA, 614 bp, Artificial Sequence
  chemically treated genomic DNA (Homo sapiens) CpG-island No: 20988
cgacgacgacaactaaaataaaaaacgacgacgacgacgcgaacacccgaccccccaacgaaaaaataaaacgacgaaacgccgactacaataaactccgccgccccctaaaacgaaaccgaatcaccgaaaacatttacgacaaataaacgactacacccccactccgcgaacgcgaaccctacgatccccctccaactccgaaaaacctaaccccgttatataaccccgaataaaccgcacgcccgcgccgaaaactctcctaaaaaacgctaaccccgaaaccgctaacccgcccgccgaaatccgccccgaatacgcgaaacgtaacgaaaatcgacccgaccgaacgaacaaaacgcgacgaacgctaactaaaaaaaccgccgcgccgccgttaaaaacgccgaacccgccgaaaaaaaaaacgaaaaacccccaaccaacccgacgttcctcaacatcccgaccataccgctaaaccgaaaaaaccgcttccgaaacctctaactaaccgccgctaacccccgaaccccccgataacctaaaaacttaccgaccgaaaccaaaaaacgcgtaaaccacaacgcgaaaaaataaaaaaaactaacaaa

SEQ ID NO: 20989 - DNA, 827 bp, Artificial Sequence
  chemically treated genomic DNA (Homo sapiens) CpG-island No: 20989
tttgcgtcgtagggggttattgttttagtcgttttagtttaagacgcgcgtattttcgtagttttagatttttttattattttttagatcggagttggcgcgtttaataaggtgttaggttcgcggttttttcgttatcgattaattacgagcgagttttttcgtcgtcgtttttcgttaatgggagaaagttcgcgggtcgggtcgacgaggtatacggattttacgagcgcggcggcggcgatagtagcgggttaggtaagagtataatatggcggcgggtaggacggatcgagttatagtagcggtcgcgcgaggaagtgaggtttttggcgaaggcgggaagcgttgttttttttttcgtcgtcgtttttttattattttcgtatagaaattttcgtatatttatatatttttgtttaggagtttaggaagagtaggagtcgttttcgcgtttttacggagtcgggtaatgtagaggtttaggcgcggcggaggggagggggaagtgtgcgttacggagaacggagcgcgcgcgaagcgggggtataagtaagatggcggttacgtcgtttgtatcgtttttttttttttttttttttttttttggcgtttggatttttagtatcgtgcggtgcgtagaagttgtgttttttgaggtttcgcgagaattgggaaggggcgacgatagagggaggcggaatgagatttgagagttttaatttcgttttttttcgggagttcgagatttgagttttgatttcgttttttttcgggggattcggaggcgttgtttagtgatttttattattttgtttatttttgtg

SEQ ID NO: 20990 - DNA, 827 bp, Artificial Sequence
  chemically treated genomic DNA (Homo sapiens) CpG-island No: 20990
cacaaaaataaacaaaataataaaaatcactaaacaacgcctccgaatcccccgaaaaaaaacgaaatcaaaactcaaatctcgaactcccgaaaaaaaacgaaattaaaactctcaaatctcattccgcctccctctatcgtcgccccttcccaattctcgcgaaacctcaaaaaacacaacttctacgcaccgcacgatactaaaaatccaaacgccaaaaaaaaaaaaaaaaaaaaaaaaaaacgatacaaacgacgtaaccgccatcttacttatacccccgcttcgcgcgcgctccgttctccgtaacgcacacttccccctcccctccgccgcgcctaaacctctacattacccgactccgtaaaaacgcgaaaacgactcctactcttcctaaactcctaaacaaaaatatataaatatacgaaaatttctatacgaaaataataaaaaaacgacgacgaaaaaaaaaacaacgcttcccgccttcgccaaaaacctcacttcctcgcgcgaccgctactataactcgatccgtcctacccgccgccatattatactcttacctaacccgctactatcgccgccgccgcgctcgtaaaatccgtatacctcgtcgacccgacccgcgaactttctcccattaacgaaaaacgacgacgaaaaaactcgctcgtaattaatcgataacgaaaaaaccgcgaacctaacaccttattaaacgcgccaactccgatctaaaaaataataaaaaaatctaaaactacgaaaatacgcgcgtcttaaactaaaacgactaaaacaataaccccctacgacgcaaa

SEQ ID NO: 20991 - DNA, 827 bp, Artificial Sequence
  chemically treated genomic DNA (Homo sapiens) CpG-island No: 20991
tataaggataggtagggtggtggaggttattgggtagcgttttcggatttttcgaaagggggcggggttaaaatttagatttcgagttttcgaaagggggcggggttaaaatttttagattttatttcgtttttttttgtcgtcgtttttttttaattttcgcgagattttaaggagtatagtttttgcgtatcgtacgatattgggagtttaggcgttaagggagggggaagggaaaaggggaaacggtgtaaacggcgtggtcgttattttgtttgtgttttcgtttcgcgcgcgtttcgtttttcgtgacgtatatttttttttttttttcgtcgcgtttgggtttttgtattgttcgatttcgtaggagcgcgggggcggtttttgttttttttggatttttgagtagaggtgtgtgagtgtgcgggagtttttgtgcgagggtgatagggaagcggcggcggggggaggggtagcgtttttcgttttcgttagagattttattttttcgcgcggtcgttgttgtagttcggttcgttttgttcgtcgttatgttgtgtttttgtttggttcgttgttgtcgtcgtcgtcgcgttcgtggggttcgtgtgtttcgtcggttcggttcgcgggtttttttttattggcggaaggcgacggcgggggggttcgttcgtgattggtcggtggcggggaggtcgcggatttggtattttattggacgcgttagtttcggtttagggggtgatgaaggaatttgaggttgcggggatgcgcgcgttttgggttagggcggttggggtaatgattttttgcggcgtagg

SEQ ID NO: 20992 - DNA, 827 bp, Artificial Sequence
  chemically treated genomic DNA (Homo sapiens) CpG-island No: 20992
cctacgccgcaaaaaatcattaccccaaccgccctaacccaaaacgcgcgcatccccgcaacctcaaattccttcatcaccccctaaaccgaaactaacgcgtccaataaaataccaaatccgcgacctccccgccaccgaccaatcacgaacgaacccccccgccgtcgccttccgccaataaaaaaaaacccgcgaaccgaaccgacgaaacacacgaaccccacgaacgcgacgacgacgacaacaacgaaccaaacaaaaacacaacataacgacgaacaaaacgaaccgaactacaacaacgaccgcgcgaaaaaataaaatctctaacgaaaacgaaaaacgctacccctccccccgccgccgcttccctatcaccctcgcacaaaaactcccgcacactcacacacctctactcaaaaatccaaaaaaaacaaaaaccgcccccgcgctcctacgaaatcgaacaatacaaaaacccaaacgcgacgaaaaaaaaaaaaaaatatacgtcacgaaaaacgaaacgcgcgcgaaacgaaaacacaaacaaaataacgaccacgccgtttacaccgtttccccttttcccttccccctcccttaacgcctaaactcccaatatcgtacgatacgcaaaaactatactccttaaaatctcgcgaaaattaaaaaaaaacgacgacaaaaaaaaacgaaataaaatctaaaaattttaaccccgccccctttcgaaaactcgaaatctaaattttaaccccgccccctttcgaaaaatccgaaaacgctacccaataacctccaccaccctacctatccttata

SEQ ID NO: 20993 - DNA, 504 bp, Artificial Sequence
  chemically treated genomic DNA (Homo sapiens) CpG-island No: 20993
cgttttcggtttattttcgtttcggtttcgttttttttcgttttattatcggtttggtttcgttttttagtttcgttttattttttatcgttttttttttcgtttttgatttcgttttttttttgattcggttttgttcgtttcgtttttgattaggttttcgttttttattttttatcgttttttttttcgtttttggttcggtttcgttttttttcgttttttagtttatttttcggtttagttcgcgtcgtcggtatttgttttcgggcgggtttttagaggtcggcgtataagatggcggttttggcggtttaaagaaggcggtcgcggtttagtcgtgggttttaacgcggggttgggggtcggagatagatttcgtttaggtgacgggtagtaggggcggcgtcgtttggtttcgtggggtgtaagatttatttgttgttgttttcggattttgtcgttatattagttttgttttggggcggaatcgaaggaaggtcg

SEQ ID NO: 20994 - DNA, 504 bp, Artificial Sequence
  chemically treated genomic DNA (Homo sapiens) CpG-island No: 20994
cgaccttccttcgattccgccccaaaacaaaactaatataacgacaaaatccgaaaacaacaacaaataaatcttacaccccacgaaaccaaacgacgccgcccctactacccgtcacctaaacgaaatctatctccgacccccaaccccgcgttaaaacccacgactaaaccgcgaccgccttctttaaaccgccaaaaccgccatcttatacgccgacctctaaaaacccgcccgaaaacaaataccgacgacgcgaactaaaccgaaaaataaactaaaaaacgaaaaaaaacgaaaccgaaccaaaaacgaaaaaaaaaacgataaaaaataaaaaacgaaaacctaatcaaaaacgaaacgaacaaaaccgaatcaaaaaaaaaacgaaatcaaaaacgaaaaaaaaaacgataaaaaataaaacgaaactaaaaaacgaaaccaaaccgataataaaacgaaaaaaaacgaaaccgaaacgaaaataaaccgaaaacg

SEQ ID NO: 20995 - DNA, 504 bp, Artificial Sequence
  chemically treated genomic DNA (Homo sapiens) CpG-island No: 20995
cgattttttttcggtttcgttttaggatagggttggtgtggcggtaaggttcgggggtaatagtaagtgggttttatattttacgaggttaagcggcgtcgtttttattattcgttatttgggcgaagtttgttttcggtttttagtttcgcgttagagtttacggttgagtcgcggtcgttttttttaggtcgttagagtcgttattttgtgcgtcggtttttggaggttcgttcggaaataggtgtcggcggcgcgggttggatcggagggtgggttggagggcgggagggggcggggtcgagttagaggcggggagaagggcggtgaggggtggggggcgggggtttggttagaggcggggcgggtagggtcgagttagaggaggggcggggttagaggcggggagaagggcggtgaggggtggggcggggttgaggggcggggttagatcggtggtggggcgggagggggcggggtcggggcgggaatggatcgggagcg

SEQ ID NO: 20996 - DNA, 504 bp, Artificial Sequence
  chemically treated genomic DNA (Homo sapiens) CpG-island No: 20996
cgctcccgatccattcccgccccgaccccgccccctcccgccccaccaccgatctaaccccgcccctcaaccccgccccacccctcaccgcccttctccccgcctctaaccccgcccctcctctaactcgaccctacccgccccgcctctaaccaaacccccgccccccacccctcaccgcccttctccccgcctctaactcgaccccgccccctcccgccctccaacccaccctccgatccaacccgcgccgccgacacctatttccgaacgaacctccaaaaaccgacgcacaaaataacgactctaacgacctaaaaaaaacgaccgcgactcaaccgtaaactctaacgcgaaactaaaaaccgaaaacaaacttcgcccaaataacgaataataaaaacgacgccgcttaacctcgtaaaatataaaacccacttactattacccccgaaccttaccgccacaccaaccctatcctaaaacgaaaccgaaaaaaaatcg

SEQ ID NO: 20997 - DNA, 760 bp, Artificial Sequence
  chemically treated genomic DNA (Homo sapiens) CpG-island No: 20997
ttttcgtcggggatgtacggagggcggagttgcggttcgaggacgcgacgcgagtttagtttcggcgaggaggtcgcgttagtgatagcgatggcggcggagtcggcgttttaagttgtggagaagttgtaggcgcgtttggtcgcgaattcggattttaagaaggtaagcgagggggcggcgcgtagcgggatgggcgttgggtcggtgagggtttcgtaacggtcgcggttcgagcgtggcggggttcgggggttgggattttgagttaggtttcgcggggttggggtcgtgaagttcgcggttattgatcgttgttcgcgcgttgggatttcgtgcgtcgggcgtcgggacgcggggtttcggtcgtttttttttttttacgggttcgggatgggggcgcgttcggtgcggatatcgcgtgtttagcgtttttttttagaggcgtttcgtggcgtttcgagttagttgttttttgcgggagagcgtgttcggggcgggagggcgttggtcgtcgtttcgttggtttttcggtgtttgcgttggtgttcggtttttcgcggagcggcgcggattttttagcgggtgcgtgttcgttgggaggagaagacgggcgttcgaacgttgcggagtttggattcgcggtttggttcgcgtttttcggagacgcggttattatttttcggttggatattagagcgtggatttttcgtttttttagtgaattttttttaaaatagaataaagtttcgcgttattt

SEQ ID NO: 20998 - DNA, 760 bp, Artificial Sequence
  chemically treated genomic DNA (Homo sapiens) CpG-island No: 20998
aaataacgcgaaactttattctattttaaaaaaaattcactaaaaaaacgaaaaatccacgctctaatatccaaccgaaaaataataaccgcgtctccgaaaaacgcgaaccaaaccgcgaatccaaactccgcaacgttcgaacgcccgtcttctcctcccaacgaacacgcacccgctaaaaaatccgcgccgctccgcgaaaaaccgaacaccaacgcaaacaccgaaaaaccaacgaaacgacgaccaacgccctcccgccccgaacacgctctcccgcaaaaaacaactaactcgaaacgccacgaaacgcctctaaaaaaaaacgctaaacacgcgatatccgcaccgaacgcgcccccatcccgaacccgtaaaaaaaaaaaaacgaccgaaaccccgcgtcccgacgcccgacgcacgaaatcccaacgcgcgaacaacgatcaataaccgcgaacttcacgaccccaaccccgcgaaacctaactcaaaatcccaacccccgaaccccgccacgctcgaaccgcgaccgttacgaaaccctcaccgacccaacgcccatcccgctacgcgccgccccctcgcttaccttcttaaaatccgaattcgcgaccaaacgcgcctacaacttctccacaacttaaaacgccgactccgccgccatcgctatcactaacgcgacctcctcgccgaaactaaactcgcgtcgcgtcctcgaaccgcaactccgccctccgtacatccccgacgaaaa

SEQ ID NO: 20999 - DNA, 760 bp, Artificial Sequence
  chemically treated genomic DNA (Homo sapiens) CpG-island No: 20999
aggtgacgcgaggttttattttgttttgaaagggatttattgagaaagcgaaaggtttacgttttgatatttagtcggagagtagtaatcgcgttttcgagaggcgcggattagatcgcgagtttaggtttcgtagcgttcgggcgttcgttttttttttttagcgaatacgtattcgttggggagttcgcgtcgtttcgcggggagtcgggtattagcgtaggtatcgggaggttaacgaggcggcggttagcgttttttcgtttcgggtacgttttttcgtaggaaatagttggttcgggacgttacggagcgtttttgggaggaagcgttaggtacgcggtgttcgtatcgggcgcgtttttatttcgggttcgtgagggagggggagcggtcggggtttcgcgtttcgacgttcgacgtacggggttttaacgcgcgggtagcggttaatggtcgcgaattttacgattttagtttcgcggggtttggtttagggttttagttttcgaatttcgttacgttcgggtcgcgatcgttacggggtttttatcgatttaacgtttatttcgttacgcgtcgttttttcgtttatttttttagggttcgggttcgcggttaggcgcgtttgtagtttttttataatttggagcgtcgatttcgtcgttatcgttgttattggcgcggttttttcgtcggaattgggttcgcgtcgcgttttcgggtcgtagtttcgtttttcgtgtattttcggcggaga

SEQ ID NO: 21000 - DNA, 760 bp, Artificial Sequence
  chemically treated genomic DNA (Homo sapiens) CpG-island No: 21000
tctccgccgaaaatacacgaaaaacgaaactacgacccgaaaacgcgacgcgaacccaattccgacgaaaaaaccgcgccaataacaacgataacgacgaaatcgacgctccaaattataaaaaaactacaaacgcgcctaaccgcgaacccgaaccctaaaaaaataaacgaaaaaacgacgcgtaacgaaataaacgttaaatcgataaaaaccccgtaacgatcgcgacccgaacgtaacgaaattcgaaaactaaaaccctaaaccaaaccccgcgaaactaaaatcgtaaaattcgcgaccattaaccgctacccgcgcgttaaaaccccgtacgtcgaacgtcgaaacgcgaaaccccgaccgctccccctccctcacgaacccgaaataaaaacgcgcccgatacgaacaccgcgtacctaacgcttcctcccaaaaacgctccgtaacgtcccgaaccaactatttcctacgaaaaaacgtacccgaaacgaaaaaacgctaaccgccgcctcgttaacctcccgatacctacgctaatacccgactccccgcgaaacgacgcgaactccccaacgaatacgtattcgctaaaaaaaaaaaacgaacgcccgaacgctacgaaacctaaactcgcgatctaatccgcgcctctcgaaaacgcgattactactctccgactaaatatcaaaacgtaaacctttcgctttctcaataaatccctttcaaaacaaaataaaacctcgcgtcacct

SEQ ID NO: 21001 - DNA, 568 bp, Artificial Sequence
  chemically treated genomic DNA (Homo sapiens) CpG-island No: 21001
gttttacgttagtttcgttcgattttatttttttcgttttttcgttttttttttacgcgtatgcgtcgcgtagcggcgttttttacgacgcggtaggcgcggcgcgtttagttgtcggagttgaacggcgcggagttggtttgaggcgagtcgagtcgagcgagcgcggcggtggggtcgagaggacgcgtaggtggcggcgttgttatgtcgtacggttatagttacggcgggggtggttgtcgttgcgtcgtcgaacgggaggagtcgttcgagtagcgcggtttggtttacggtttgtatttgcgtatcgatttggagcggttgtaatgttttaacgagagtcgcgagggtagcggtcgcggcgtttttaagtcgtgggaggagcggatcgatcgttttaaggtgggtcgtttggggtttggggcgggcggggtagggtgcgtgtggggtttcgggtcgtcggtttatttatttttgatgttaagaataacgatagtttggttgttaagcgttttttcgtgtttgttttttgttagttttttgggaggcgagtagcgttgttttt

SEQ ID NO: 21002 - DNA, 568 bp, Artificial Sequence
  chemically treated genomic DNA (Homo sapiens) CpG-island No: 21002
aaaaacaacgctactcgcctcccaaaaaactaacaaaaaacaaacacgaaaaaacgcttaacaaccaaactatcgttattcttaacatcaaaaataaataaaccgacgacccgaaaccccacacgcaccctaccccgcccgccccaaaccccaaacgacccaccttaaaacgatcgatccgctcctcccacgacttaaaaacgccgcgaccgctaccctcgcgactctcgttaaaacattacaaccgctccaaatcgatacgcaaatacaaaccgtaaaccaaaccgcgctactcgaacgactcctcccgttcgacgacgcaacgacaaccacccccgccgtaactataaccgtacgacataacaacgccgccacctacgcgtcctctcgaccccaccgccgcgctcgctcgactcgactcgcctcaaaccaactccgcgccgttcaactccgacaactaaacgcgccgcgcctaccgcgtcgtaaaaaacgccgctacgcgacgcatacgcgtaaaaaaaaaacgaaaaaacgaaaaaaataaaatcgaacgaaactaacgtaaaac

SEQ ID NO: 21003 - DNA, 568 bp, Artificial Sequence
  chemically treated genomic DNA (Homo sapiens) CpG-island No: 21003
ggagataacgttgttcgttttttaaagagttggtaggagataggtacggaaaagcgtttggtaattaggttgtcgttatttttaatattagaaatgagtagatcgacggttcgaggttttatacgtattttgtttcgttcgttttaagttttaggcggtttattttggagcggtcggttcgttttttttacggtttgaagacgtcgcggtcgttgttttcgcggttttcgttaaggtattgtagtcgttttaggtcgatgcgtaggtataggtcgtaggttaggtcgcgttgttcgggcggtttttttcgttcggcggcgtagcggtagttattttcgtcgtggttgtgatcgtgcgatatggtaacgtcgttatttgcgcgttttttcggttttatcgtcgcgttcgttcggttcggttcgttttagattagtttcgcgtcgtttagtttcggtaattaagcgcgtcgcgtttgtcgcgtcgtaaaaagcgtcgttgcgcggcgtatgcgcgtggggagaaggcgggggggcggggggggtggggtcgagcggaattgacgtaggat

SEQ ID NO: 21004 - DNA, 568 bp, Artificial Sequence
  chemically treated genomic DNA (Homo sapiens) CpG-island No: 21004
atcctacgtcaattccgctcgaccccaccccccccgcccccccgccttctccccacgcgcatacgccgcgcaacgacgctttttacgacgcgacaaacgcgacgcgcttaattaccgaaactaaacgacgcgaaactaatctaaaacgaaccgaaccgaacgaacgcgacgataaaaccgaaaaaacgcgcaaataacgacgttaccatatcgcacgatcacaaccacgacgaaaataactaccgctacgccgccgaacgaaaaaaaccgcccgaacaacgcgacctaacctacgacctatacctacgcatcgacctaaaacgactacaataccttaacgaaaaccgcgaaaacaacgaccgcgacgtcttcaaaccgtaaaaaaaacgaaccgaccgctccaaaataaaccgcctaaaacttaaaacgaacgaaacaaaatacgtataaaacctcgaaccgtcgatctactcatttctaatattaaaaataacgacaacctaattaccaaacgcttttccgtacctatctcctaccaactctttaaaaaacgaacaacgttatctcc

SEQ ID NO: 21005 - DNA, 894 bp, Artificial Sequence
  chemically treated genomic DNA (Homo sapiens) CpG-island No: 21005
aagatcgtagttaatatcggtaaagatttttttttttttattttattcgtttagttagaggggacgtggcgtgcgtagcgatataaggggaggtttgagtggtcgtagggtttaagattcggcggcggcgggggagggcggagaagtttcggggaagttcggtattaggcggtgtcgtttgagggaagggtcgagttttattttcgttcgtttgcgtcggttggttcgacgttttttcggagtttttgttattttagtttttatgggggtcgtagatttaggtacgatagtagggtcggtttgaggttttgcggatttcggcggtttcgttaggttttcggggggcgaggttcgcggaggtttttttttgcggggtgtgcgtttttttatcgttttcggttcgatttcggttgggttcgataggttcgcgggttgcgcggttattttagattcgttttcggagtcgtttgttgttttagggttagttttcgtttcggttgttgtcgttgtagtcgtcgtcgtcgcggttgtcgttttttttttagataatatttcgggtcgtcgggtcgtcgacggtcgtaggggtcgttcgttttgtcgtttcgtgggttcgaaaagttttgtttcgtttcgttttacgttgttcgcgcgtcgttaatcgtcgtcgcgtacgtacgcgttaagcgcgttttcgtcgcgtcgggataaaaagggtcggagatatttacgagtttcgtttttttttcgtagttatagagcggcgttttcgcggttagagtggtatcgtagtaaagaacgtgtagtttgtttagagcgttttttcggcgtttggagtgggatttggtatagttcgtggttttagggtttttgggttagattaaattttcgaaggtg

SEQ ID NO: 21006 - DNA, 894 bp, Artificial Sequence
  chemically treated genomic DNA (Homo sapiens) CpG-island No: 21006
caccttcgaaaatttaatctaacccaaaaaccctaaaaccacgaactataccaaatcccactccaaacgccgaaaaaacgctctaaacaaactacacgttctttactacgataccactctaaccgcgaaaacgccgctctataactacgaaaaaaaaacgaaactcgtaaatatctccgaccctttttatcccgacgcgacgaaaacgcgcttaacgcgtacgtacgcgacgacgattaacgacgcgcgaacaacgtaaaacgaaacgaaacaaaacttttcgaacccacgaaacgacaaaacgaacgacccctacgaccgtcgacgacccgacgacccgaaatattatctaaaaaaaaaacgacaaccgcgacgacgacgactacaacgacaacaaccgaaacgaaaactaaccctaaaacaacaaacgactccgaaaacgaatctaaaataaccgcgcaacccgcgaacctatcgaacccaaccgaaatcgaaccgaaaacgataaaaaaacgcacaccccgcaaaaaaaaacctccgcgaacctcgccccccgaaaacctaacgaaaccgccgaaatccgcaaaacctcaaaccgaccctactatcgtacctaaatctacgacccccataaaaactaaaataacaaaaactccgaaaaaacgtcgaaccaaccgacgcaaacgaacgaaaataaaactcgacccttccctcaaacgacaccgcctaataccgaacttccccgaaacttctccgccctcccccgccgccgccgaatcttaaaccctacgaccactcaaacctccccttatatcgctacgcacgccacgtcccctctaactaaacgaataaaataaaaaaaaaaaaatctttaccgatattaactacgatctt

SEQ ID NO: 21007 - DNA, 894 bp, Artificial Sequence
  chemically treated genomic DNA (Homo sapiens) CpG-island No: 21007
tattttcggaggtttagtttggtttagaagttttaagattacggattgtgttaggttttattttaaacgtcggggagacgttttaggtaagttatacgttttttgttgcggtgttattttagtcgcgagaacgtcgttttatggttgcgggggaggggcggggttcgtgggtgttttcgattttttttgtttcggcgcggcgggagcgcgtttggcgcgtgcgtacgcgacggcggttggcggcgcgcgggtagcgtgaagcgaggcgaggtaaggtttttcggatttacggagcgatagagcgagcggtttttacggtcgtcggcggttcggcggttcgagatgttatttgggaagaaggcggtagtcgcggcggcggcggttgtagcggtagtaatcgggacggaggttggttttgggatagtaggcggtttcgagaacgggtttgaggtggtcgcgtagttcgcgggtttgtcgggtttagtcgaggtcgggtcgggggcggtgggggagcgtatatttcgtaagaaagagttttcgcgggtttcgtttttcgggggtttggcggaatcgtcggggttcgtagggttttaggtcggttttattgtcgtgtttgggtttgcgatttttatggaaattggaatagtagagatttcggaggggcgtcggattagtcggcgtaagcgggcgaaggtaaggttcgattttttttttaaacgatatcgtttggtgtcgagttttttcgaggttttttcgttttttttcgtcgtcgtcgggttttgggttttgcgattatttagatttttttttgtatcgttgcgtacgttacgttttttttagttggacgggtggggtgagaaaggaaaagtttttgtcggtgttgattgcggtttt

SEQ ID NO: 21008 - DNA, 894 bp, Artificial Sequence
  chemically treated genomic DNA (Homo sapiens) CpG-island No: 21008
aaaaccgcaatcaacaccgacaaaaacttttcctttctcaccccacccgtccaactaaaaaaaacgtaacgtacgcaacgatacaaaaaaaaatctaaataatcgcaaaacccaaaacccgacgacgacgaaaaaaaacgaaaaaacctcgaaaaaactcgacaccaaacgatatcgtttaaaaaaaaaatcgaaccttaccttcgcccgcttacgccgactaatccgacgcccctccgaaatctctactattccaatttccataaaaatcgcaaacccaaacacgacaataaaaccgacctaaaaccctacgaaccccgacgattccgccaaacccccgaaaaacgaaacccgcgaaaactctttcttacgaaatatacgctcccccaccgcccccgacccgacctcgactaaacccgacaaacccgcgaactacgcgaccacctcaaacccgttctcgaaaccgcctactatcccaaaaccaacctccgtcccgattactaccgctacaaccgccgccgccgcgactaccgccttcttcccaaataacatctcgaaccgccgaaccgccgacgaccgtaaaaaccgctcgctctatcgctccgtaaatccgaaaaaccttacctcgcctcgcttcacgctacccgcgcgccgccaaccgccgtcgcgtacgcacgcgccaaacgcgctcccgccgcgccgaaacaaaaaaaatcgaaaacacccacgaaccccgcccctcccccgcaaccataaaacgacgttctcgcgactaaaataacaccgcaacaaaaaacgtataacttacctaaaacgtctccccgacgtttaaaataaaacctaacacaatccgtaatcttaaaacttctaaaccaaactaaacctccgaaaata

SEQ ID NO: 21009 - DNA, 552 bp, Artificial Sequence
  chemically treated genomic DNA (Homo sapiens) CpG-island No: 21009
acgaggcgcggcgttcgtagttttcggttgggtttcggcggggatgggcgggtagggggcggagcgtagcgtagcgcggggcggcgggaaaggggcggagaggatagtttgggttttggcgggtcgcgggattggtagaatttgcgggcgaggtgggtggttcgttagtcgggacgaagggaaatgaggattatcgtttcggggcgcgagtaggcgcgtggagttcgggggtttagtcgtcgcgttttttttttttgtagttggagattgtaatagcggcgggtgtatcggtagtagcgacgattttgcgcgtaggtgggtattttcgagcgcggcgttttgtcggttttttcggttatcgcgggtcggacgttcgtttttttaggttattgcgtttgggggcgagggttgggtaggtttaggggtagaaggaaggtgtacggtttcgtggtgggcgcgtttttgcgcgcgcgttgtggtaggtgggaaagaggtgtagaaaagttgttttttttagggtttattttttcggttttattgtttttattttat

SEQ ID NO: 21010 - DNA, 552 bp, Artificial Sequence
  chemically treated genomic DNA (Homo sapiens) CpG-island No: 21010
ataaaataaaaacaataaaaccgaaaaaataaaccctaaaaaaaacaacttttctacacctctttcccacctaccacaacgcgcgcgcaaaaacgcgcccaccacgaaaccgtacaccttccttctacccctaaacctacccaaccctcgcccccaaacgcaataacctaaaaaaacgaacgtccgacccgcgataaccgaaaaaaccgacaaaacgccgcgctcgaaaatacccacctacgcgcaaaatcgtcgctactaccgatacacccgccgctattacaatctccaactacaaaaaaaaaaaacgcgacgactaaacccccgaactccacgcgcctactcgcgccccgaaacgataatcctcatttcccttcgtcccgactaacgaaccacccacctcgcccgcaaattctaccaatcccgcgacccgccaaaacccaaactatcctctccgcccctttcccgccgccccgcgctacgctacgctccgccccctacccgcccatccccgccgaaacccaaccgaaaactacgaacgccgcgcctcgt

SEQ ID NO: 21011 - DNA, 552 bp, Artificial Sequence
  chemically treated genomic DNA (Homo sapiens) CpG-island No: 21011
gtggggtggggatagtggaatcgagggagtgaattttaagggaggtagtttttttgtattttttttttatttattatagcgcgcgcgtagaagcgcgtttattacggggtcgtgtattttttttttgtttttggatttatttagttttcgtttttaagcgtagtggtttggaagagcgggcgttcggttcgcggtggtcgggggagtcggtagagcgtcgcgttcgggggtgtttatttgcgcgtagggtcgtcgttgttgtcggtgtattcgtcgttgttgtagtttttagttgtaggaggaagaggcgcggcggttgagttttcggattttacgcgtttattcgcgtttcggagcggtggtttttattttttttcgtttcggttggcgagttatttatttcgttcgtaggttttgttagtttcgcggttcgttagagtttaagttatttttttcgtttttttttcgtcgtttcgcgttgcgttgcgtttcgttttttgttcgtttattttcgtcggggtttagtcgggggttgcgggcgtcgcgtttcgt

SEQ ID NO: 21012 - DNA, 552 bp, Artificial Sequence
  chemically treated genomic DNA (Homo sapiens) CpG-island No: 21012
acgaaacgcgacgcccgcaacccccgactaaaccccgacgaaaataaacgaacaaaaaacgaaacgcaacgcaacgcgaaacgacgaaaaaaaaacgaaaaaaataacttaaactctaacgaaccgcgaaactaacaaaacctacgaacgaaataaataactcgccaaccgaaacgaaaaaaaataaaaaccaccgctccgaaacgcgaataaacgcgtaaaatccgaaaactcaaccgccgcgcctcttcctcctacaactaaaaactacaacaacgacgaatacaccgacaacaacgacgaccctacgcgcaaataaacacccccgaacgcgacgctctaccgactcccccgaccaccgcgaaccgaacgcccgctcttccaaaccactacgcttaaaaacgaaaactaaataaatccaaaaacaaaaaaaaaatacacgaccccgtaataaacgcgcttctacgcgcgcgctataataaataaaaaaaaaatacaaaaaaactacctcccttaaaattcactccctcgattccactatccccaccccac

SEQ ID NO: 21013 - DNA, 652 bp, Artificial Sequence
  chemically treated genomic DNA (Homo sapiens) CpG-island No: 21013
ttcgaaagtgtggaagcggagtgggcggggaatcgtcgcgttattttaaagtcgggggcgaggcggcggtggaattttagagtcgcgaggttaggtggttagtcggtttcggcggggcgggggggtttttgagtttcgattttcgcggttgacggtttttcggatttttttaggtttgggtgtggattcggtgtcggtcggcgtggatgttagtttaggcggcgtaggacgcgatttcggttcgttaggcggggcgttcgagaagcggcgggtgggtatcgcggagcggcgttatattatttgtagtttggattggcggatggggtggggtgggggcgtcgcggaggttcgggtcgggggaggcggcggcggtagtttggagcgttagcgcgtcggggcgcgggcgtcgggtagttgggagcgacggtagacgtttagcggtagttgggagcggcggtacggaggcggcggcggcggcggcggcgcgggaaagtcgggcggtagttgggagcggaggtaggcgggtagcggcgggggaggtagttgggagcggcgttatttcggttttaattcgttcgattcgtaggattttagtttcgacgtttattgtaatttggttattttggttgtagttaatagggtgagttcgagg

SEQ ID NO: 21014 - DNA, 652 bp, Artificial Sequence
  chemically treated genomic DNA (Homo sapiens) CpG-island No: 21014
cctcgaactcaccctattaactacaaccaaaataaccaaattacaataaacgtcgaaactaaaatcctacgaatcgaacgaattaaaaccgaaataacgccgctcccaactacctcccccgccgctacccgcctacctccgctcccaactaccgcccgactttcccgcgccgccgccgccgccgccgcctccgtaccgccgctcccaactaccgctaaacgtctaccgtcgctcccaactacccgacgcccgcgccccgacgcgctaacgctccaaactaccgccgccgcctcccccgacccgaacctccgcgacgcccccaccccaccccatccgccaatccaaactacaaataatataacgccgctccgcgatacccacccgccgcttctcgaacgccccgcctaacgaaccgaaatcgcgtcctacgccgcctaaactaacatccacgccgaccgacaccgaatccacacccaaacctaaaaaaatccgaaaaaccgtcaaccgcgaaaatcgaaactcaaaaacccccccgccccgccgaaaccgactaaccacctaacctcgcgactctaaaattccaccgccgcctcgcccccgactttaaaataacgcgacgattccccgcccactccgcttccacactttcgaa

SEQ ID NO: 21015 - DNA, 652 bp, Artificial Sequence
  chemically treated genomic DNA (Homo sapiens) CpG-island No: 21015
tttcgggtttattttgttggttatagttaggatgattaggttgtagtaggcgtcggggttggggttttgcgggtcgagcgggttggggtcggggtggcgtcgtttttagttgtttttttcgtcgttgttcgtttgttttcgtttttagttatcgttcggttttttcgcgtcgtcgtcgtcgtcgtcgttttcgtgtcgtcgtttttagttgtcgttgaacgtttgtcgtcgtttttagttgttcgacgttcgcgtttcggcgcgttggcgttttaagttgtcgtcgtcgtttttttcggttcgggttttcgcggcgtttttattttattttattcgttagtttaggttgtagatggtgtggcgtcgtttcgcggtgtttattcgtcgtttttcgggcgtttcgtttggcgggtcggggtcgcgttttgcgtcgtttgggttggtatttacgtcggtcggtatcgggtttatatttagatttaggagagttcgggggatcgttagtcgcggggatcgggatttagagattttttcgtttcgtcgaggtcggttggttatttgatttcgcggttttggggttttatcgtcgtttcgttttcggttttaaagtagcgcggcggtttttcgtttatttcgtttttatattttcggg

SEQ ID NO: 21016 - DNA, 652 bp, Artificial Sequence
  chemically treated genomic DNA (Homo sapiens) CpG-island No: 21016
cccgaaaatataaaaacgaaataaacgaaaaaccgccgcgctactttaaaaccgaaaacgaaacgacgataaaaccccaaaaccgcgaaatcaaataaccaaccgacctcgacgaaacgaaaaaatctctaaatcccgatccccgcgactaacgatcccccgaactctcctaaatctaaatataaacccgataccgaccgacgtaaataccaacccaaacgacgcaaaacgcgaccccgacccgccaaacgaaacgcccgaaaaacgacgaataaacaccgcgaaacgacgccacaccatctacaacctaaactaacgaataaaataaaataaaaacgccgcgaaaacccgaaccgaaaaaaacgacgacgacaacttaaaacgccaacgcgccgaaacgcgaacgtcgaacaactaaaaacgacgacaaacgttcaacgacaactaaaaacgacgacacgaaaacgacgacgacgacgacgacgcgaaaaaaccgaacgataactaaaaacgaaaacaaacgaacaacgacgaaaaaaacaactaaaaacgacgccaccccgaccccaacccgctcgacccgcaaaaccccaaccccgacgcctactacaacctaatcatcctaactataaccaacaaaataaacccgaaa

SEQ ID NO: 21017 - DNA, 937 bp, Artificial Sequence
  chemically treated genomic DNA (Homo sapiens) CpG-island No: 21017
ggtcgttcgttcggagttggggcgaggggttggcggcggcgagcggcgcggttttaagtttatgttaattcgtaaagagttcgtttttcgtttttttttcgcggttttagtcgttagtagcgtcggttatttcgcgggacgtagtcgtcgcgaagcgttaggcggtcgggttagcgagttcgggggtcgaaggggatttcgggattttcggggcgggattcgggtcgattagcggcgggggcggcgcggcgttgtaggcggatattcggcggggggtatcgcgcggggtcgggtagaggcgcgggggtcgttatgggtcgtcgtcgtttgttcgtttggttgtgcgtcgtcgcggcgttgttttcgggggcgtaggttaggggtatttcgtttttggcgcggtttgcgtcgttcggtgtttttcgttatagtttttatacgacgggatggcgttcgcggttgcgttcggggtcgtataagtaagcgcgggcgggcggcgggcgggaagagggagggatgggttcgcgcgcgtcgtcgtttttatttgttcgtattcgcggggggcgtcgaggtttcgggtatttcgaggtcgttgtatagagggggcggcgttcggggtcgagtttttgtttaggcgagcgttttacgtttcgggaggttgcggggttggcgaggaaaaaggaatcgagggggtttggcgcggcggtttgggattttggtagtgttagcggaaatttttttagcgaagtaatattttttagttgcgttgtgtgtagatttcgggcgagcggattaggtggagggagaggaggaaaggcggttcgcgcgttgagtacgcggggttttttcgtttcgggtttttttttttttttttggttcggttaggtaggagatagagttgcgtattcgggcggtcgttgttttttcgtagttagtt

SEQ ID NO: 21018 - DNA, 937 bp, Artificial Sequence
  chemically treated genomic DNA (Homo sapiens) CpG-island No: 21018
aactaactacgaaaaaacaacgaccgcccgaatacgcaactctatctcctacctaaccgaaccaaaaaaaaaaaaaaaaacccgaaacgaaaaaaccccgcgtactcaacgcgcgaaccgcctttcctcctctccctccacctaatccgctcgcccgaaatctacacacaacgcaactaaaaaatattacttcgctaaaaaaatttccgctaacactaccaaaatcccaaaccgccgcgccaaaccccctcgattcctttttcctcgccaaccccgcaacctcccgaaacgtaaaacgctcgcctaaacaaaaactcgaccccgaacgccgccccctctatacaacgacctcgaaatacccgaaacctcgacgccccccgcgaatacgaacaaataaaaacgacgacgcgcgcgaacccatccctccctcttcccgcccgccgcccgcccgcgcttacttatacgaccccgaacgcaaccgcgaacgccatcccgtcgtataaaaactataacgaaaaacaccgaacgacgcaaaccgcgccaaaaacgaaatacccctaacctacgcccccgaaaacaacgccgcgacgacgcacaaccaaacgaacaaacgacgacgacccataacgacccccgcgcctctacccgaccccgcgcgataccccccgccgaatatccgcctacaacgccgcgccgcccccgccgctaatcgacccgaatcccgccccgaaaatcccgaaatccccttcgacccccgaactcgctaacccgaccgcctaacgcttcgcgacgactacgtcccgcgaaataaccgacgctactaacgactaaaaccgcgaaaaaaaaacgaaaaacgaactctttacgaattaacataaacttaaaaccgcgccgctcgccgccgccaacccctcgccccaactccgaacgaacgacc

SEQ ID NO: 21019 - DNA, 937 bp, Artificial Sequence
  chemically treated genomic DNA (Homo sapiens) CpG-island No: 21019
ggttgattgcgagagggtagcggtcgttcggatgcgtagttttattttttatttggtcgggttaggggagagaagggaggttcggggcgggggagtttcgcgtgtttagcgcgcggatcgtttttttttttttttttttatttggttcgttcgttcggagtttgtatatagcgtagttggaaaatgttatttcgttggaaaggttttcgttggtattgttaggattttaagtcgtcgcgttaggttttttcggttttttttttttcgttagtttcgtaatttttcggagcgtagggcgttcgtttgggtaggggttcggtttcgggcgtcgttttttttgtgtagcggtttcggggtgttcggggtttcgacgtttttcgcgggtgcgggtaggtgggagcggcgacgcgcgcgggtttattttttttttttttcgttcgtcgttcgttcgcgtttatttgtgcggtttcgggcgtagtcgcgggcgttatttcgtcgtgtagagattgtagcgggaggtatcgggcggcgtaggtcgcgttaggagcggggtgtttttggtttgcgttttcgagagtagcgtcgcgacggcgtatagttagacgagtaggcggcggcggtttatagcggttttcgcgtttttgttcggtttcgcgcggtgtttttcgtcgggtgttcgtttgtagcgtcgcgtcgttttcgtcgttggtcggttcgggtttcgtttcgagggtttcggggtttttttcggttttcgagttcgttggttcggtcgtttggcgtttcgcggcggttgcgtttcgcggagtggtcggcgttgttagcggttggggtcgcggaggggaggcgggaggcgggttttttgcggattagtataaatttggggtcgcgtcgttcgtcgtcgttagtttttcgttttagtttcgagcggacggtt

SEQ ID NO: 21020 - DNA, 937 bp, Artificial Sequence
  chemically treated genomic DNA (Homo sapiens) CpG-island No: 21020
aaccgtccgctcgaaactaaaacgaaaaactaacgacgacgaacgacgcgaccccaaatttatactaatccgcaaaaaacccgcctcccgcctcccctccgcgaccccaaccgctaacaacgccgaccactccgcgaaacgcaaccgccgcgaaacgccaaacgaccgaaccaacgaactcgaaaaccgaaaaaaaccccgaaaccctcgaaacgaaacccgaaccgaccaacgacgaaaacgacgcgacgctacaaacgaacacccgacgaaaaacaccgcgcgaaaccgaacaaaaacgcgaaaaccgctataaaccgccgccgcctactcgtctaactatacgccgtcgcgacgctactctcgaaaacgcaaaccaaaaacaccccgctcctaacgcgacctacgccgcccgatacctcccgctacaatctctacacgacgaaataacgcccgcgactacgcccgaaaccgcacaaataaacgcgaacgaacgacgaacgaaaaaaaaaaaaaataaacccgcgcgcgtcgccgctcccacctacccgcacccgcgaaaaacgtcgaaaccccgaacaccccgaaaccgctacacaaaaaaaacgacgcccgaaaccgaacccctacccaaacgaacgccctacgctccgaaaaattacgaaactaacgaaaaaaaaaaaaccgaaaaaacctaacgcgacgacttaaaatcctaacaataccaacgaaaacctttccaacgaaataacattttccaactacgctatatacaaactccgaacgaacgaaccaaataaaaaaaaaaaaaaaaaaacgatccgcgcgctaaacacgcgaaactcccccgccccgaacctcccttctctcccctaacccgaccaaataaaaaataaaactacgcatccgaacgaccgctaccctctcgcaatcaacc

SEQ ID NO: 21021 - DNA, 739 bp, Artificial Sequence
  chemically treated genomic DNA (Homo sapiens) CpG-island No: 21021
cgtttagacgtcgcgtataggtcgttgggcggttatagcgtaagcgtaatttttttataaatggattataagtttcggtatgtttggcgacgcggcgtcgtttggtaattcgcgttatacgaagcgcgttaggttggtttttttgcgcgtttgcgttttggcgagttttgcgtaggcgtatttttaacgtttggaggagagggcggggtgtcgttttttttcgttgatgtaagagtttagtgcggtggtgggagaggtatcggtaggggtagcgttgtcgtcggggtttggggttgattcgtttgatttttcgttcgtgtcgagtttattcgagtcgtagttatgtttggggacgaggtgaggatttgagttcggcgtaagggttaaggattgaggcgagaagtttaatttattttagtgtgggagaacgggtttgcggtttagtagtcggtcgtcgttatgtgaggtagtcgcgtttaggcggttcggagcggtagagtcggcgaggatttcggagtcgtaggtttggtcgtagttcgttttttttagggcggtagcgttgaggcggattttttgtcgtggttggcgttttcggaatggagagtatacgttgagtcgttttttcggaaggggttcgaatgttcggttaataatttcgaacgagattggggttggcgatttttgtatttttttttgttgggtattgtcgttttagttcgttttattgggtgtcgggggt

SEQ ID NO: 21022 - DNA, 739 bp, Artificial Sequence
  chemically treated genomic DNA (Homo sapiens) CpG-island No: 21022
acccccgacacccaataaaacgaactaaaacgacaatacccaacaaaaaaaaatacaaaaatcgccaaccccaatctcgttcgaaattattaaccgaacattcgaaccccttccgaaaaaacgactcaacgtatactctccattccgaaaacgccaaccacgacaaaaaatccgcctcaacgctaccgccctaaaaaaaacgaactacgaccaaacctacgactccgaaatcctcgccgactctaccgctccgaaccgcctaaacgcgactacctcacataacgacgaccgactactaaaccgcaaacccgttctcccacactaaaataaattaaacttctcgcctcaatccttaacccttacgccgaactcaaatcctcacctcgtccccaaacataactacgactcgaataaactcgacacgaacgaaaaatcaaacgaatcaaccccaaaccccgacgacaacgctacccctaccgatacctctcccaccaccgcactaaactcttacatcaacgaaaaaaaacgacaccccgccctctcctccaaacgttaaaaatacgcctacgcaaaactcgccaaaacgcaaacgcgcaaaaaaaccaacctaacgcgcttcgtataacgcgaattaccaaacgacgccgcgtcgccaaacataccgaaacttataatccatttataaaaaaattacgcttacgctataaccgcccaacgacctatacgcgacgtctaaacg

SEQ ID NO: 21023 - DNA, 739 bp, Artificial Sequence
  chemically treated genomic DNA (Homo sapiens) CpG-island No: 21023
attttcggtatttagtgaggcgagttggggcggtagtgtttagtagaaaggaatgtagggatcgttagttttagtttcgttcggggttattaatcgggtattcgagtttttttcgggaggacgatttaacgtgtgttttttatttcggaaacgttaattacggtaggaggttcgttttagcgttgtcgttttgaggaaagcgggttgcggttaagtttgcggtttcggagttttcgtcggttttgtcgtttcgggtcgtttaggcgcggttgttttatatggcggcggtcggttgttaggtcgtaggttcgtttttttatattggagtgggttaggtttttcgttttaatttttagtttttacgtcgggtttagatttttatttcgtttttagatatggttgcggttcgagtgggttcggtacggacgggaagttagacgggttagttttaggtttcggcggtagcgttgtttttgtcgatattttttttattatcgtattaggtttttgtattagcgaaaggaaacgatatttcgtttttttttttaagcgttggaaatgcgtttgcgtagagttcgttaaggcgtaggcgcgtagaagagttaatttagcgcgtttcgtgtggcgcgagttattaggcgacgtcgcgtcgttaggtatgtcgggatttgtagtttatttataagagggttgcgtttgcgttgtagtcgtttagcgatttgtgcgcggcgtttgagcg

SEQ ID NO: 21024 - DNA, 739 bp, Artificial Sequence
  chemically treated genomic DNA (Homo sapiens) CpG-island No: 21024
cgctcaaacgccgcgcacaaatcgctaaacgactacaacgcaaacgcaaccctcttataaataaactacaaatcccgacatacctaacgacgcgacgtcgcctaataactcgcgccacacgaaacgcgctaaattaactcttctacgcgcctacgccttaacgaactctacgcaaacgcatttccaacgcttaaaaaaaaaaacgaaatatcgtttcctttcgctaatacaaaaacctaatacgataataaaaaaaatatcgacaaaaacaacgctaccgccgaaacctaaaactaacccgtctaacttcccgtccgtaccgaacccactcgaaccgcaaccatatctaaaaacgaaataaaaatctaaacccgacgtaaaaactaaaaattaaaacgaaaaacctaacccactccaatataaaaaaacgaacctacgacctaacaaccgaccgccgccatataaaacaaccgcgcctaaacgacccgaaacgacaaaaccgacgaaaactccgaaaccgcaaacttaaccgcaacccgctttcctcaaaacgacaacgctaaaacgaacctcctaccgtaattaacgtttccgaaataaaaaacacacgttaaatcgtcctcccgaaaaaaactcgaatacccgattaataaccccgaacgaaactaaaactaacgatccctacattcctttctactaaacactaccgccccaactcgcctcactaaataccgaaaat

SEQ ID NO: 21025 - DNA, 743 bp, Artificial Sequence
  chemically treated genomic DNA (Homo sapiens) CpG-island No: 21025
gagttttttcgagaagtttttttaaggatttcgggtcgcgtagtttcgggtggatcgttatgattaatattttggggcgtgtatttggacgattttcgaggattttggggagtgtagtttatcgaggggatgcgacgcgtagggtcgtatagttttcgggtcgcgtcgaggatgttgggtagcgtagtttcggtcgcgttgaggattttgggtagtgtagtttcgggcggcgtagagcgttttagatttttgggcgttagcgagtcgtgagatgcgtggtttattatcggtgattttatcgtttcggttcgtttttagtcgtttcggtgagttgcgtttttgcgggtttttttttgtagcgcgttttttcggcgtaggaagaagggtcgggaaggtttgggacgtgagggcgttgttggggtcgtagcgcgcgtttttttaggttcggcgttttcgcgttttggggaggggcggagatttaggtcgcgttttgaagtgggcggtggggttgcggtttgtcgagcgtttcgggtttgggtcgttatttagttttcgttttcggttgcgtgtagtggcggttcgggcggtgaatagttcggattttataggggcgtcgagtaatttaggtttttttgtgttagggtcgtcgtttttcgggtggggacgggttagcggtttagcgagttgttacgggggttttttggtcggaggtggagggggattcggttatagttagggtttat

SEQ ID NO: 21026 - DNA, 743 bp, Artificial Sequence
  chemically treated genomic DNA (Homo sapiens) CpG-island No: 21026
ataaaccctaactataaccgaatccccctccacctccgaccaaaaaacccccgtaacaactcgctaaaccgctaacccgtccccacccgaaaaacgacgaccctaacacaaaaaaacctaaattactcgacgcccctataaaatccgaactattcaccgcccgaaccgccactacacgcaaccgaaaacgaaaactaaataacgacccaaacccgaaacgctcgacaaaccgcaaccccaccgcccacttcaaaacgcgacctaaatctccgcccctccccaaaacgcgaaaacgccgaacctaaaaaaacgcgcgctacgaccccaacaacgccctcacgtcccaaaccttcccgacccttcttcctacgccgaaaaaacgcgctacaaaaaaaaacccgcaaaaacgcaactcaccgaaacgactaaaaacgaaccgaaacgataaaatcaccgataataaaccacgcatctcacgactcgctaacgcccaaaaatctaaaacgctctacgccgcccgaaactacactacccaaaatcctcaacgcgaccgaaactacgctacccaacatcctcgacgcgacccgaaaactatacgaccctacgcgtcgcatcccctcgataaactacactccccaaaatcctcgaaaatcgtccaaatacacgccccaaaatattaatcataacgatccacccgaaactacgcgacccgaaatccttaaaaaaacttctcgaaaaaactc

SEQ ID NO: 21027 - DNA, 743 bp, Artificial Sequence
  chemically treated genomic DNA (Homo sapiens) CpG-island No: 21027
gtggattttggttgtggtcgagtttttttttattttcggttaaaagattttcgtggtagttcgttaggtcgttggttcgtttttattcgaggagcggcgattttggtataagaggatttgggttgttcggcgtttttgtgaaattcgggttgtttatcgttcgagtcgttattatacgtaatcgggaacggagattgagtggcggtttagattcggggcgttcggtaagtcgtagttttatcgtttattttaaggcgcggtttgggttttcgtttttttttagaacgcggagacgtcgggtttggaggagcgcgcgttacggttttagtagcgtttttacgttttaggttttttcggtttttttttttgcgtcggaagggcgcgttgtagagagggattcgtaggagcgtagtttatcggggcggttgagggcgaatcgaggcggtgaggttatcgatggtggattacgtattttacggttcgttgacgtttagggatttggaacgttttgcgtcgttcgggattatattatttagaatttttagcgcggtcgggattacgttatttagtattttcggcgcggttcggaggttatgcgattttgcgcgtcgtattttttcggtggattatattttttagagttttcgggagtcgtttaggtatacgttttagaatattggttatagcggtttattcgggattgcgcgattcggaatttttggaaggatttttcggaaggattt

SEQ ID NO: 21028 - DNA, 743 bp, Artificial Sequence
  chemically treated genomic DNA (Homo sapiens) CpG-island No: 21028
aaatccttccgaaaaatccttccaaaaattccgaatcgcgcaatcccgaataaaccgctataaccaatattctaaaacgtatacctaaacgactcccgaaaactctaaaaaatataatccaccgaaaaaatacgacgcgcaaaatcgcataacctccgaaccgcgccgaaaatactaaataacgtaatcccgaccgcgctaaaaattctaaataatataatcccgaacgacgcaaaacgttccaaatccctaaacgtcaacgaaccgtaaaatacgtaatccaccatcgataacctcaccgcctcgattcgccctcaaccgccccgataaactacgctcctacgaatccctctctacaacgcgcccttccgacgcaaaaaaaaaaaccgaaaaaacctaaaacgtaaaaacgctactaaaaccgtaacgcgcgctcctccaaacccgacgtctccgcgttctaaaaaaaaacgaaaacccaaaccgcgccttaaaataaacgataaaactacgacttaccgaacgccccgaatctaaaccgccactcaatctccgttcccgattacgtataataacgactcgaacgataaacaacccgaatttcacaaaaacgccgaacaacccaaatcctcttataccaaaatcgccgctcctcgaataaaaacgaaccaacgacctaacgaactaccacgaaaatcttttaaccgaaaataaaaaaaaactcgaccacaaccaaaatccac

SEQ ID NO: 21029 - DNA, 741 bp, Artificial Sequence
  chemically treated genomic DNA (Homo sapiens) CpG-island No: 21029
ttttatttcggcgaaggtcgtaaatggcgcgaggcgggaaggcgtaggttttattttttttcgtttttagattatttatagtgatttgcgcgtataggtaggttaggatcgcgggcgtttaaggtagatattaggttcgtcgacgttttcgcgtcgttcgttcggttattcggagagtttgttgtttagcgtttggtagcgcggataatttttttcggggaggtgatgacggtttttcgcgtcggagggtttagggaggaaagagataagtagaaagatattagggaagaatattacgtttcggattaacgttagttatagttattgagaagtcgtcgtattcggcggcgtcgatatacgtttttagggtttttgagagattatattttgggagtttcgcgggattttatttttttcggcggcgtagggaatgagatagatcgcgggaattttattcgcgtcgggagatggtttggtgatttcgcggttttttttacgtttttttgggtagttcgttttgcgtatgcgtaggcggcggtggtaaggttacggttcgcgttagcggtcggcgttatggggttgagtcgcgtgcgggcggttttttttgatttggataatatttttatcgatacggtcggggcgagtaggagaggtatgttggaggtaacgtttttatttatggcgtttttttgggcggggttagtgcgtttcgtttcgttttgtacgtttatttttttttga

SEQ ID NO: 21030 - DNA, 741 bp, Artificial Sequence
  chemically treated genomic DNA (Homo sapiens) CpG-island No: 21030
tcaaaaaaaaataaacgtacaaaacgaaacgaaacgcactaaccccgcccaaaaaaacgccataaataaaaacgttacctccaacatacctctcctactcgccccgaccgtatcgataaaaatattatccaaatcaaaaaaaaccgcccgcacgcgactcaaccccataacgccgaccgctaacgcgaaccgtaaccttaccaccgccgcctacgcatacgcaaaacgaactacccaaaaaaacgtaaaaaaaaccgcgaaatcaccaaaccatctcccgacgcgaataaaattcccgcgatctatctcattccctacgccgccgaaaaaaataaaatcccgcgaaactcccaaaatataatctctcaaaaaccctaaaaacgtatatcgacgccgccgaatacgacgacttctcaataactataactaacgttaatccgaaacgtaatattcttccctaatatctttctacttatctctttcctccctaaaccctccgacgcgaaaaaccgtcatcacctccccgaaaaaaattatccgcgctaccaaacgctaaacaacaaactctccgaataaccgaacgaacgacgcgaaaacgtcgacgaacctaatatctaccttaaacgcccgcgatcctaacctacctatacgcgcaaatcactataaataatctaaaaacgaaaaaaaataaaacctacgccttcccgcctcgcgccatttacgaccttcgccgaaataaaa

SEQ ID NO: 21031 - DNA, 741 bp, Artificial Sequence
  chemically treated genomic DNA (Homo sapiens) CpG-island No: 21031
ttaaggggaggtgagcgtgtaggacggggcggggcgtattgatttcgtttagaggagcgttatgggtggggacgttatttttaatatgttttttttgttcgtttcggtcgtgtcgatgagagtgttgtttaagttaaagaaaatcgttcgtacgcggtttagttttatagcgtcggtcgttggcgcgaatcgtagttttgttatcgtcgtttgcgtatgcgtaaggcggattgtttagagagacgtgggaggagtcgcgaagttattagattatttttcggcgcgggtggaattttcgcgatttgttttattttttgcgtcgtcgagaaaagtgagatttcgcgagatttttagggtatggttttttaagagttttggaaacgtgtgtcggcgtcgtcggatgcggcgattttttagtggttgtggttggcgttggttcgaagcgtggtgtttttttttggtgtttttttgtttattttttttttttttgggtttttcggcgcgagggatcgttattattttttcgagagaggttgttcgcgttgttaggcgttgggtagtaggtttttcgggtggtcgggcgggcggcgcggagacgtcggcgggtttgatgtttgttttgagcgttcgcggttttagtttgtttgtacgcgtaggttattgtaggtgatttggggacgggggaaggtggagtttgcgttttttcgtttcgcgttatttgcggttttcgtcggggtggaa

SEQ ID NO: 21032 - DNA, 741 bp, Artificial Sequence
  chemically treated genomic DNA (Homo sapiens) CpG-island No: 21032
ttccaccccgacgaaaaccgcaaataacgcgaaacgaaaaaacgcaaactccaccttcccccgtccccaaatcacctacaataacctacgcgtacaaacaaactaaaaccgcgaacgctcaaaacaaacatcaaacccgccgacgtctccgcgccgcccgcccgaccacccgaaaaacctactacccaacgcctaacaacgcgaacaacctctctcgaaaaaataataacgatccctcgcgccgaaaaacccaaaaaaaaaaaaaataaacaaaaaaacaccaaaaaaaaacaccacgcttcgaaccaacgccaaccacaaccactaaaaaatcgccgcatccgacgacgccgacacacgtttccaaaactcttaaaaaaccataccctaaaaatctcgcgaaatctcacttttctcgacgacgcaaaaaataaaacaaatcgcgaaaattccacccgcgccgaaaaataatctaataacttcgcgactcctcccacgtctctctaaacaatccgccttacgcatacgcaaacgacgataacaaaactacgattcgcgccaacgaccgacgctataaaactaaaccgcgtacgaacgattttctttaacttaaacaacactctcatcgacacgaccgaaacgaacaaaaaaaacatattaaaaataacgtccccacccataacgctcctctaaacgaaatcaatacgccccgccccgtcctacacgctcacctccccttaa

SEQ ID NO: 21033 - DNA, 596 bp, Artificial Sequence
  chemically treated genomic DNA (Homo sapiens) CpG-island No: 21033
agattcgttagagtacgtgtgttttgtgagattcgttagagtacgtgtgttttgtgagattcgttagagtacgtgtgttttgtgattcgttagagtacgtgtgttttgtgagattcgttagagtacgtgtgttttgtgattcgttagagtacgtgtgttttgtgattcgttagagtacgtgtgttttgtgagattcgttagagtacgtgtgttttgtgagattcgttagagtacgtgtgttttgtgtgattcgttagagtacgtgtgttttgtgagattcgttagagtacgtgtgttttgtgagattcgttagagtacgtgtgttttgtgattcgttagagtacgtgtgttttgtgattcgttagagtacgtgtgttttgtgagattcgttagagtacgtgtgttttgtgattcgttagagtacgtgtgttttgtgagattcgttagagtacgtgtgttttgtgagattcgttagagtacgtgtgttttgtgattcgttagagtacgtgtggtttgtgattcgttagagtacgtgtggtttgtgattcgtttgagtacgtgtgtttgaatggtaattttttgttatttttgaatta

SEQ ID NO: 21034 - DNA, 596 bp, Artificial Sequence
  chemically treated genomic DNA (Homo sapiens) CpG-island No: 21034
taattcaaaaataacaaaaaattaccattcaaacacacgtactcaaacgaatcacaaaccacacgtactctaacgaatcacaaaccacacgtactctaacgaatcacaaaacacacgtactctaacgaatctcacaaaacacacgtactctaacgaatctcacaaaacacacgtactctaacgaatcacaaaacacacgtactctaacgaatctcacaaaacacacgtactctaacgaatcacaaaacacacgtactctaacgaatcacaaaacacacgtactctaacgaatctcacaaaacacacgtactctaacgaatctcacaaaacacacgtactctaacgaatcacacaaaacacacgtactctaacgaatctcacaaaacacacgtactctaacgaatctcacaaaacacacgtactctaacgaatcacaaaacacacgtactctaacgaatcacaaaacacacgtactctaacgaatctcacaaaacacacgtactctaacgaatcacaaaacacacgtactctaacgaatctcacaaaacacacgtactctaacgaatctcacaaaacacacgtactctaacgaatct

SEQ ID NO: 21035 - DNA, 596 bp, Artificial Sequence
  chemically treated genomic DNA (Homo sapiens) CpG-island No: 21035
tgatttaggaatggtaaggaattgttatttaggtatacgtgtttaggcggattataggttatacgtgttttggcggattataggttatacgtgttttggcggattataggatatacgtgttttggcggattttataggatatacgtgttttggcggattttataggatatacgtgttttggcggattataggatatacgtgttttggcggattttataggatatacgtgttttggcggattataggatatacgtgttttggcggattataggatatacgtgttttggcggattttataggatatacgtgttttggcggattttataggatatacgtgttttggcggattatataggatatacgtgttttggcggattttataggatatacgtgttttggcggattttataggatatacgtgttttggcggattataggatatacgtgttttggcggattataggatatacgtgttttggcggattttataggatatacgtgttttggcggattataggatatacgtgttttggcggattttataggatatacgtgttttggcggattttataggatatacgtgttttggcggattt

SEQ ID NO: 21036 - DNA, 596 bp, Artificial Sequence
  chemically treated genomic DNA (Homo sapiens) CpG-island No: 21036
aaatccgccaaaacacgtatatcctataaaatccgccaaaacacgtatatcctataaaatccgccaaaacacgtatatcctataatccgccaaaacacgtatatcctataaaatccgccaaaacacgtatatcctataatccgccaaaacacgtatatcctataatccgccaaaacacgtatatcctataaaatccgccaaaacacgtatatcctataaaatccgccaaaacacgtatatcctatataatccgccaaaacacgtatatcctataaaatccgccaaaacacgtatatcctataaaatccgccaaaacacgtatatcctataatccgccaaaacacgtatatcctataatccgccaaaacacgtatatcctataaaatccgccaaaacacgtatatcctataatccgccaaaacacgtatatcctataaaatccgccaaaacacgtatatcctataaaatccgccaaaacacgtatatcctataatccgccaaaacacgtataacctataatccgccaaaacacgtataacctataatccgcctaaacacgtatacctaaataacaattccttaccattcctaaatca

SEQ ID NO: 21037 - DNA, 549 bp, Artificial Sequence
  chemically treated genomic DNA (Homo sapiens) CpG-island No: 21037
tcgtacgcgacgcggcgacgggggcgcgggcgggtatttcgggggttgtttatgtttcggatgcggtcgcgttttttttttttttagtcgggtattttcgcggttgggcggcgtttagggtcgcgggttcgttcgggtgtttcgtcgggggcgatatttcggcggtcgcgttgaggttattatgtgatacggcgtcgtatcgttgtgcgattaagtagcggcgttttggtgtttttcgtttatgtttttgggttttagtttcgcgtaggttaaggatgaggtcgaggttcgaaggtagggggtttcgggcgggagtcgcgttgtttttcgcgttattgttgttgttgttgttgtcgtcgtcgtcgacgttgttggggcgtttgtgggtagcgggtatattttcgtcgtcggcgttcggagttcggtaggacggcgcgttgggagtcggtcgcgttaaacgcggttgggtgtggaattagtttttcgtggtagaggagtatacgggtacggagtttttgtatgtgggtaaggtaaagtggggttttattt

SEQ ID NO: 21038 - DNA, 549 bp, Artificial Sequence
  chemically treated genomic DNA (Homo sapiens) CpG-island No: 21038
aaataaaaccccactttaccttacccacatacaaaaactccgtacccgtatactcctctaccacgaaaaactaattccacacccaaccgcgtttaacgcgaccgactcccaacgcgccgtcctaccgaactccgaacgccgacgacgaaaatatacccgctacccacaaacgccccaacaacgtcgacgacgacgacaacaacaacaacaacaataacgcgaaaaacaacgcgactcccgcccgaaaccccctaccttcgaacctcgacctcatccttaacctacgcgaaactaaaacccaaaaacataaacgaaaaacaccaaaacgccgctacttaatcgcacaacgatacgacgccgtatcacataataacctcaacgcgaccgccgaaatatcgcccccgacgaaacacccgaacgaacccgcgaccctaaacgccgcccaaccgcgaaaatacccgactaaaaaaaaaaaaaacgcgaccgcatccgaaacataaacaacccccgaaatacccgcccgcgcccccgtcgccgcgtcgcgtacga

SEQ ID NO: 21039 - DNA, 549 bp, Artificial Sequence
  chemically treated genomic DNA (Homo sapiens) CpG-island No: 21039
gagtggggttttattttattttgtttatatataggggtttcgtgttcgtgtatttttttattacgaagaattggttttatatttagtcgcgtttgacgcggtcggtttttagcgcgtcgttttgtcgagtttcgggcgtcgacggcgagggtgtgttcgttgtttataggcgttttagtagcgtcggcggcggcggtagtagtagtagtagtagtagcgcgggggatagcgcgattttcgttcggagttttttattttcgggtttcggttttatttttggtttgcgcggggttggggtttaggagtatggacgagaggtattagggcgtcgttgtttggtcgtataacgatgcggcgtcgtgttatatggtggttttagcgcggtcgtcgggatgtcgttttcgacggggtattcggacgggttcgcggttttgaacgtcgtttagtcgcgggggtattcggttggagggggagggggcgcggtcgtattcggggtatggatagttttcggggtgttcgttcgcgttttcgtcgtcgcgtcgcgtgcgg

SEQ ID NO: 21040 - DNA, 549 bp, Artificial Sequence
  chemically treated genomic DNA (Homo sapiens) CpG-island No: 21040
ccgcacgcgacgcgacgacgaaaacgcgaacgaacaccccgaaaactatccataccccgaatacgaccgcgccccctccccctccaaccgaatacccccgcgactaaacgacgttcaaaaccgcgaacccgtccgaataccccgtcgaaaacgacatcccgacgaccgcgctaaaaccaccatataacacgacgccgcatcgttatacgaccaaacaacgacgccctaatacctctcgtccatactcctaaaccccaaccccgcgcaaaccaaaaataaaaccgaaacccgaaaataaaaaactccgaacgaaaatcgcgctatcccccgcgctactactactactactactaccgccgccgccgacgctactaaaacgcctataaacaacgaacacaccctcgccgtcgacgcccgaaactcgacaaaacgacgcgctaaaaaccgaccgcgtcaaacgcgactaaatataaaaccaattcttcgtaataaaaaaatacacgaacacgaaacccctatatataaacaaaataaaataaaaccccactc

SEQ ID NO: 21041 - DNA, 690 bp, Artificial Sequence
  chemically treated genomic DNA (Homo sapiens) CpG-island No: 21041
ggaggcgcggtttttttcggatgtcgggacgagggaggggaagggaggggaagaggcggggtaggtaggggcggggggcgcggtagcggtagcgcgtatgttcgggttcggggcgtttggatttcgggagggagcggagggcgtttatttgtaggtcgttggggtatgcgtcgttttcggagagcgagtttattaggtttttttcgtttagcgtggttcgtttgtacgtcgatatttgtaaggttaaatgtagtacggatttttttagcgtttttatggttttcgcgttcgaatggggaagcggtttcgattttggcgtcgtcgtcgtcgcgtttcgtttcggtttggatattcgagatcgagatcggtttacggagcggttcgcgcggggaggggtttcgttcgtttttcgttttcgttttttaggtcgcgttcgttttatttttagcgtcgatagtagggcggatatcgggggcggttatacgtttcgtatgttgtgttttagacgtttggtttcgttgttcgggtggtcgggatgggatgggtcgggttaggcgttgtattattttcgcgggcggggtttgatcggttcgtcggcgttcggtttttaattttcggtttttcggggagattttaagattcgagaggttcgggggagatggggatttttttttttttcggaggtcggga

SEQ ID NO: 21042 - DNA, 690 bp, Artificial Sequence
  chemically treated genomic DNA (Homo sapiens) CpG-island No: 21042
tcccgacctccgaaaaaaaaaaaaatccccatctcccccgaacctctcgaatcttaaaatctccccgaaaaaccgaaaattaaaaaccgaacgccgacgaaccgatcaaaccccgcccgcgaaaataatacaacgcctaacccgacccatcccatcccgaccacccgaacaacgaaaccaaacgtctaaaacacaacatacgaaacgtataaccgcccccgatatccgccctactatcgacgctaaaaataaaacgaacgcgacctaaaaaacgaaaacgaaaaacgaacgaaacccctccccgcgcgaaccgctccgtaaaccgatctcgatctcgaatatccaaaccgaaacgaaacgcgacgacgacgacgccaaaatcgaaaccgcttccccattcgaacgcgaaaaccataaaaacgctaaaaaaatccgtactacatttaaccttacaaatatcgacgtacaaacgaaccacgctaaacgaaaaaaacctaataaactcgctctccgaaaacgacgcataccccaacgacctacaaataaacgccctccgctccctcccgaaatccaaacgccccgaacccgaacatacgcgctaccgctaccgcgccccccgcccctacctaccccgcctcttcccctcccttcccctccctcgtcccgacatccgaaaaaaaccgcgcctcc

SEQ ID NO: 21043 - DNA, 690 bp, Artificial Sequence
  chemically treated genomic DNA (Homo sapiens) CpG-island No: 21043
tttcgattttcggggaagggaggggtttttatttttttcgggtttttcgggttttggggttttttcgggaggtcggaggttgggaatcgggcgtcggcgaatcgattaggtttcgttcgcgaaggtggtgtaacgtttggttcggtttattttatttcggttattcgggtagcgggattaggcgtttggggtatagtatgcggggcgtgtggtcgttttcggtgttcgttttgttgtcggcgttgggggtgaggcgggcgcggtttggagggcgggggcgggaggcgggcgggattttttttcgcgcgggtcgtttcgtgggtcggtttcggtttcgggtgtttaggtcggggcggggcgcggcggcggcggcgttagggtcggggtcgtttttttattcgggcgcgagagttatggaggcgttgagggagttcgtgttgtatttggttttgtagatgtcgacgtataagcgggttacgttggacgaggaggatttggtggattcgtttttcgagggcgacgtatattttaacggtttgtaggtaggcgtttttcgttttttttcgaggtttaggcgtttcgggttcgggtatgcgcgttgtcgttgtcgcgtttttcgtttttatttatttcgtttttttttttttttttttttttttcgtttcggtattcgggaggggtcgcgttttt

SEQ ID NO: 21044 - DNA, 690 bp, Artificial Sequence
  chemically treated genomic DNA (Homo sapiens) CpG-island No: 21044
aaaaacgcgacccctcccgaataccgaaacgaaaaaaaaaaaaaaaaaaaaaaaaacgaaataaataaaaacgaaaaacgcgacaacgacaacgcgcatacccgaacccgaaacgcctaaacctcgaaaaaaaacgaaaaacgcctacctacaaaccgttaaaatatacgtcgccctcgaaaaacgaatccaccaaatcctcctcgtccaacgtaacccgcttatacgtcgacatctacaaaaccaaatacaacacgaactccctcaacgcctccataactctcgcgcccgaataaaaaaacgaccccgaccctaacgccgccgccgccgcgccccgccccgacctaaacacccgaaaccgaaaccgacccacgaaacgacccgcgcgaaaaaaaatcccgcccgcctcccgcccccgccctccaaaccgcgcccgcctcacccccaacgccgacaacaaaacgaacaccgaaaacgaccacacgccccgcatactataccccaaacgcctaatcccgctacccgaataaccgaaataaaataaaccgaaccaaacgttacaccaccttcgcgaacgaaacctaatcgattcgccgacgcccgattcccaacctccgacctcccgaaaaaaccccaaaacccgaaaaacccgaaaaaaataaaaacccctcccttccccgaaaatcgaaa

SEQ ID NO: 21045 - DNA, 772 bp, Artificial Sequence
  chemically treated genomic DNA (Homo sapiens) CpG-island No: 21045
atattcggttgggattagaattaagttcggcgcggtcgttttcgacgggattaagcgtagcgtcgtcgggagagtcgcgttttgttcgggcgtttttcgattttacgtttttcgagagtcgggcgggggttgttgttgtagtcggcgtttagtttttcgcgagttagggcggtttcgggtgttattcgcggtatcgttgttcgcgatcgtcgaggttgggttggatcggattagattttcgcgcgtagtatttattatagttcgcgtgtttcgtttcggtttcgcgtagtttttcgcgttcggttttcgatttttagtttcgggttttttgtttttagtttagttgttcggacggttcggttgtttggtttaggcggcgcgtttagttttagcgggcgagttcgcggtttcggcgtcgagtgtcggaggggcggggtcgtcgcggggttaatggtagggcgcgggggtttgggtggcgtagttaattacggtttgaggttgtatttttcgcgttcgcgcgggtttttaatttttggcgcgttgggagtcggttgttcgggttgcgcggggaatttggagggtaggagtaggcgggagttgttgtttcggggcgtagggtttagattttgtcgagatcggcgttgggagttagtagaatcgggaagaggttcgattgtgttcggtggggtcgtcgggagtttcggcgatttttgttttttgtttggtttttgtattggagtgtgattcggggcgttgtagttgtttgtgtgtg

SEQ ID NO: 21046 - DNA, 772 bp, Artificial Sequence
  chemically treated genomic DNA (Homo sapiens) CpG-island No: 21046
cacacacaaacaactacaacgccccgaatcacactccaatacaaaaaccaaacaaaaaacaaaaatcgccgaaactcccgacgaccccaccgaacacaatcgaacctcttcccgattctactaactcccaacgccgatctcgacaaaatctaaaccctacgccccgaaacaacaactcccgcctactcctaccctccaaattccccgcgcaacccgaacaaccgactcccaacgcgccaaaaattaaaaacccgcgcgaacgcgaaaaatacaacctcaaaccgtaattaactacgccacccaaacccccgcgccctaccattaaccccgcgacgaccccgcccctccgacactcgacgccgaaaccgcgaactcgcccgctaaaactaaacgcgccgcctaaaccaaacaaccgaaccgtccgaacaactaaactaaaaacaaaaaacccgaaactaaaaatcgaaaaccgaacgcgaaaaactacgcgaaaccgaaacgaaacacgcgaactataataaatactacgcgcgaaaatctaatccgatccaacccaacctcgacgatcgcgaacaacgataccgcgaataacacccgaaaccgccctaactcgcgaaaaactaaacgccgactacaacaacaacccccgcccgactctcgaaaaacgtaaaatcgaaaaacgcccgaacaaaacgcgactctcccgacgacgctacgcttaatcccgtcgaaaacgaccgcgccgaacttaattctaatcccaaccgaatat

SEQ ID NO: 21047 - DNA, 772 bp, Artificial Sequence
  chemically treated genomic DNA (Homo sapiens) CpG-island No: 21047
tatatataagtagttgtagcgtttcgggttatattttagtgtaggagttaggtaggagataaaggtcgtcgaggttttcggcggttttatcggatataatcgagttttttttcggttttgttagtttttaacgtcggtttcggtaaggtttggattttgcgtttcgaagtaataattttcgtttgtttttgttttttaggtttttcgcgtagttcgggtagtcgatttttagcgcgttaagggttaagggttcgcgcgggcgcggggagtgtagttttaggtcgtgattggttgcgttatttaggttttcgcgttttgttattggtttcgcggcggtttcgttttttcggtattcggcgtcgaagtcgcgagttcgttcgttggagttgagcgcgtcgtttgggttaggtagtcgagtcgttcgagtagttgggttgggagtagggaattcggagttgggaatcgggagtcgggcgcggggagttgcgcgaagtcggggcggagtacgcgagttatggtgagtgttgcgcgcggaggtttggttcggtttagtttagtttcgacggtcgcgggtagcggtgtcgcgggtggtattcggggtcgttttggttcgcggggggttgggcgtcggttgtagtagtagttttcgttcggttttcggaaggcgtggagtcggggagcgttcgggtagagcgcggttttttcggcggcgttgcgtttggtttcgtcgggggcggtcgcgtcgagtttggttttggttttagtcggatgt

SEQ ID NO: 21048 - DNA, 772 bp, Artificial Sequence
  chemically treated genomic DNA (Homo sapiens) CpG-island No: 21048
acatccgactaaaaccaaaaccaaactcgacgcgaccgcccccgacgaaaccaaacgcaacgccgccgaaaaaaccgcgctctacccgaacgctccccgactccacgccttccgaaaaccgaacgaaaactactactacaaccgacgcccaaccccccgcgaaccaaaacgaccccgaataccacccgcgacaccgctacccgcgaccgtcgaaactaaactaaaccgaaccaaacctccgcgcgcaacactcaccataactcgcgtactccgccccgacttcgcgcaactccccgcgcccgactcccgattcccaactccgaattccctactcccaacccaactactcgaacgactcgactacctaacccaaacgacgcgctcaactccaacgaacgaactcgcgacttcgacgccgaataccgaaaaaacgaaaccgccgcgaaaccaataacaaaacgcgaaaacctaaataacgcaaccaatcacgacctaaaactacactccccgcgcccgcgcgaacccttaacccttaacgcgctaaaaatcgactacccgaactacgcgaaaaacctaaaaaacaaaaacaaacgaaaattattacttcgaaacgcaaaatccaaaccttaccgaaaccgacgttaaaaactaacaaaaccgaaaaaaaactcgattatatccgataaaaccgccgaaaacctcgacgacctttatctcctacctaactcctacactaaaatataacccgaaacgctacaactacttatatata

SEQ ID NO: 21049 - DNA, 854 bp, Artificial Sequence
  chemically treated genomic DNA (Homo sapiens) CpG-island No: 21049
ttcgtcgcgttttttcgcggttcgggattgtttattattttttttaggaagcgatcgtggaaataataaatacgtaggttttttagcgttttttcgtttcgcgttgttaggtcgtttcgtttttcgttttcgttcgtttcgcgggatatagttcgttcgtatttcggggttcgagcgtcgattatattttaggcgtagtcggggagagtttcgcgcgcgtattttttcgttcgcggtcgaggcgatttttcgcggtttcgttcgttcgagtttttcgcggaggtattcggtcgtttcgtttttttcgtttcgcgttcgttaatttttagttcgcggttttgattggtcgtcgtattttcgttttttttttcgaatcgttattttgaaaattttgttgattttggggagtcgagcgcgcggcgcgagcgttacgttagatagcggttcgcgcgtttttttttcggcgtcggtcgtcgtcgttttttagaattttttcgtgttttcgcgtgttaggttcgcggcggtcgaaattcgcggtaagggttgtttcgggacgtcggaggttcggtcgtttttgtcgcggtcgacgggggagggacgcggttatttggacggcggtttggggcgggggaggggacgtggagggtcggtagttcgggtcgggtcgggaatagcgtaggtcgggcgggcgcgcgcgtacgcggggtagcgggcgcggtttttcgtttcgggaatttttggacggcggcggcggagcgggagggaagtcgtttttggggattgagcgttgcggtttcggttatgggaggaggtaatttttagggtaggtgtttcgcgggaagggtagtattatt

SEQ ID NO: 21050 - DNA, 854 bp, Artificial Sequence
  chemically treated genomic DNA (Homo sapiens) CpG-island No: 21050
aataatactacccttcccgcgaaacacctaccctaaaaattacctcctcccataaccgaaaccgcaacgctcaatccccaaaaacgacttccctcccgctccgccgccgccgtccaaaaattcccgaaacgaaaaaccgcgcccgctaccccgcgtacgcgcgcgcccgcccgacctacgctattcccgacccgacccgaactaccgaccctccacgtcccctcccccgccccaaaccgccgtccaaataaccgcgtccctcccccgtcgaccgcgacaaaaacgaccgaacctccgacgtcccgaaacaacccttaccgcgaatttcgaccgccgcgaacctaacacgcgaaaacacgaaaaaattctaaaaaacgacgacgaccgacgccgaaaaaaaaacgcgcgaaccgctatctaacgtaacgctcgcgccgcgcgctcgactccccaaaatcaacaaaattttcaaaataacgattcgaaaaaaaaaacgaaaatacgacgaccaatcaaaaccgcgaactaaaaattaacgaacgcgaaacgaaaaaaacgaaacgaccgaatacctccgcgaaaaactcgaacgaacgaaaccgcgaaaaatcgcctcgaccgcgaacgaaaaaatacgcgcgcgaaactctccccgactacgcctaaaatataatcgacgctcgaaccccgaaatacgaacgaactatatcccgcgaaacgaacgaaaacgaaaaacgaaacgacctaacaacgcgaaacgaaaaaacgctaaaaaacctacgtatttattatttccacgatcgcttcctaaaaaaaataataaacaatcccgaaccgcgaaaaaacgcgacgaa

SEQ ID NO: 21051 - DNA, 854 bp, Artificial Sequence
  chemically treated genomic DNA (Homo sapiens) CpG-island No: 21051
aatgatgttatttttttcgcgggatatttgttttgaaagttgtttttttttatagtcgggatcgtagcgtttagtttttaggggcggtttttttttcgtttcgtcgtcgtcgtttagggattttcgaggcgggaaatcgcgttcgttgtttcgcgtgcgcgcgcgttcgttcggtttgcgttgttttcggttcggttcgagttgtcggttttttacgttttttttttcgttttaggtcgtcgtttaaatggtcgcgtttttttttcgtcggtcgcggtaggggcgatcgggttttcggcgtttcgaagtagtttttatcgcggatttcggtcgtcgcgggtttggtacgcgagggtacgaggaggttttgggaggcggcggcggtcgacgtcgaggagaaggcgcgcgggtcgttgtttggcgtgacgttcgcgtcgcgcgttcggttttttagaattaataagatttttaaaatggcggttcgggaaggagagcgggaatgcggcgattaattagggtcgcgagttgggagttggcgggcgcggggcgggggaggcggggcggtcgggtgttttcgcgggaagttcgggcgggcgggatcgcgaggggtcgtttcggtcgcgggcggagggatgcgcgcgcggggtttttttcggttgcgtttggagtgtggtcggcgttcgggtttcggagtgcgggcgggttgtgtttcgcggggcgggcgggagcgggaggcgaggcggtttggtagcgcggaacggaaggacgttagggggtttgcgtgtttattgtttttacggtcgttttttggaaaagatgatgagtagtttcgggtcgcggaggggcgcggcggg

SEQ ID NO: 21052 - DNA, 854 bp, Artificial Sequence
  chemically treated genomic DNA (Homo sapiens) CpG-island No: 21052
cccgccgcgcccctccgcgacccgaaactactcatcatcttttccaaaaaacgaccgtaaaaacaataaacacgcaaaccccctaacgtccttccgttccgcgctaccaaaccgcctcgcctcccgctcccgcccgccccgcgaaacacaacccgcccgcactccgaaacccgaacgccgaccacactccaaacgcaaccgaaaaaaaccccgcgcgcgcatccctccgcccgcgaccgaaacgacccctcgcgatcccgcccgcccgaacttcccgcgaaaacacccgaccgccccgcctcccccgccccgcgcccgccaactcccaactcgcgaccctaattaatcgccgcattcccgctctccttcccgaaccgccattttaaaaatcttattaattctaaaaaaccgaacgcgcgacgcgaacgtcacgccaaacaacgacccgcgcgccttctcctcgacgtcgaccgccgccgcctcccaaaacctcctcgtaccctcgcgtaccaaacccgcgacgaccgaaatccgcgataaaaactacttcgaaacgccgaaaacccgatcgcccctaccgcgaccgacgaaaaaaaaacgcgaccatttaaacgacgacctaaaacgaaaaaaaaaacgtaaaaaaccgacaactcgaaccgaaccgaaaacaacgcaaaccgaacgaacgcgcgcgcacgcgaaacaacgaacgcgatttcccgcctcgaaaatccctaaacgacgacgacgaaacgaaaaaaaaaccgcccctaaaaactaaacgctacgatcccgactataaaaaaaaacaactttcaaaacaaatatcccgcgaaaaaaataacatcatt

SEQ ID NO: 21053 - DNA, 725 bp, Artificial Sequence
  chemically treated genomic DNA (Homo sapiens) CpG-island No: 21053
aaggaggatataaagggcgaagagttcgtattttttttcgtttttaggagcgtaagaggtcgggagttaggcgagttggtagtttcggtggttcgcgatttgtttattgatttttttcgtatttttgtgacgaagcgcgtatgcgcgtttcgtatttatcgtttcggcggtttttttgcggcgtagttgtattagtttttcgagagtagcgtattttttcgtcgggcggttgatgcgggagcgttatgatataggcgtttgcgtagagtcgcgcgttggttttttgtttcgtttaaaggggcggtgtagaggcggtaggaagatggagttggggagttgtttggagggcgggagggaggcggcggaggaagagggcgagtttgaggtgaaaaagcggcgatttttgtgtgtggagtttgtttcggtcgtaagttgcgatgtcgtagtggtttagtgttttttggtcgagaacgattgggagatggaagtacgttttcgttgttttcgttttcggttttattatttaggtcggtggagcgtataaattttattttttgtgtttttgttttttagagggttttgaatttttatttcgagttttcggtggaggagagcgttttggaacgtcgatttgaaattatttttgagtttaagatttagtaagtgatgaggggagcgggagttagttcgtacggaggtagtttgatattaggtagttttgcgcg

SEQ ID NO: 21054 - DNA, 725 bp, Artificial Sequence
  chemically treated genomic DNA (Homo sapiens) CpG-island No: 21054
cgcgcaaaactacctaatatcaaactacctccgtacgaactaactcccgctcccctcatcacttactaaatcttaaactcaaaaataatttcaaatcgacgttccaaaacgctctcctccaccgaaaactcgaaataaaaattcaaaaccctctaaaaaacaaaaacacaaaaaataaaatttatacgctccaccgacctaaataataaaaccgaaaacgaaaacaacgaaaacgtacttccatctcccaatcgttctcgaccaaaaaacactaaaccactacgacatcgcaacttacgaccgaaacaaactccacacacaaaaatcgccgctttttcacctcaaactcgccctcttcctccgccgcctccctcccgccctccaaacaactccccaactccatcttcctaccgcctctacaccgcccctttaaacgaaacaaaaaaccaacgcgcgactctacgcaaacgcctatatcataacgctcccgcatcaaccgcccgacgaaaaaatacgctactctcgaaaaactaatacaactacgccgcaaaaaaaccgccgaaacgataaatacgaaacgcgcatacgcgcttcgtcacaaaaatacgaaaaaaatcaataaacaaatcgcgaaccaccgaaactaccaactcgcctaactcccgacctcttacgctcctaaaaacgaaaaaaaatacgaactcttcgccctttatatcctcctt

SEQ ID NO: 21055 - DNA, 725 bp, Artificial Sequence
  chemically treated genomic DNA (Homo sapiens) CpG-island No: 21055
cgcgtagggttatttggtattaaattgttttcgtgcggattggttttcgttttttttattatttattaggttttgggtttagagatggttttaggtcggcgttttaaggcgtttttttttatcggaggttcgaagtaggagtttagagttttttgaaaaataaaggtataagggatgaggtttgtgcgttttatcgatttaggtaatggagtcggaagcgaggatagcgaaagcgtatttttattttttagtcgttttcggttaggaagtattgagttattgcggtatcgtagtttgcgatcgaggtaaattttatatatagaagtcgtcgtttttttattttaggttcgtttttttttttcgtcgtttttttttcgttttttaggtaattttttaattttatttttttgtcgtttttgtatcgtttttttaagcggaataggaggttaacgcgcggttttgcgtaggcgtttgtgttatggcgttttcgtattaatcgttcggcggggaaatgcgttgttttcggaaaattggtgtagttgcgtcgtaagggagtcgtcggggcggtgggtgcgaagcgcgtatgcgcgtttcgttataagggtgcgaggaaagttagtgagtaaatcgcggattatcggggttgttagttcgtttgattttcggttttttgcgtttttaggggcggagaagggtgcgggtttttcgttttttgtgtttttttt

SEQ ID NO: 21056 - DNA, 725 bp, Artificial Sequence
  chemically treated genomic DNA (Homo sapiens) CpG-island No: 21056
aaaaaaaacacaaaaaacgaaaaacccgcacccttctccgcccctaaaaacgcaaaaaaccgaaaatcaaacgaactaacaaccccgataatccgcgatttactcactaactttcctcgcacccttataacgaaacgcgcatacgcgcttcgcacccaccgccccgacgactcccttacgacgcaactacaccaattttccgaaaacaacgcatttccccgccgaacgattaatacgaaaacgccataacacaaacgcctacgcaaaaccgcgcgttaacctcctattccgcttaaaaaaacgatacaaaaacgacaaaaaaataaaattaaaaaattacctaaaaaacgaaaaaaaaacgacgaaaaaaaaaaacgaacctaaaataaaaaaacgacgacttctatatataaaatttacctcgatcgcaaactacgataccgcaataactcaatacttcctaaccgaaaacgactaaaaaataaaaatacgctttcgctatcctcgcttccgactccattacctaaatcgataaaacgcacaaacctcatcccttatacctttatttttcaaaaaactctaaactcctacttcgaacctccgataaaaaaaaacgccttaaaacgccgacctaaaaccatctctaaacccaaaacctaataaataataaaaaaaacgaaaaccaatccgcacgaaaacaatttaataccaaataaccctacgcg

SEQ ID NO: 21057 - DNA, 635 bp, Artificial Sequence
  chemically treated genomic DNA (Homo sapiens) CpG-island No: 21057
ttttcggatgttttttacggcgaatatttgttcgtcgatggttgatagttttatgcggggcggcgggcgagcgggttcggggtcgggtcgggtcgggggcggagttgcggggtcgcggttgcggcgcgcgatgttggggttggcggggttttcgttattttcgttcgggcgcgtacgcgtacgcgtacgcgcgtatattttttcgcgtttttttacgtcgtcgacgttttatttttgaatttgcgtaacgtttttttcggcgttagcgagcgagcgcgcgtaaggagggggcggggcgggagcgcgcggaacggtcgcgggttcggttcgcgttttgagggttagtttcgttttcgagtttcgtttttatcggaatttcgttttcggggttcgttttcgcgggttgcgattgggtcgcgggtcgcgagtcgcgagcgttgtcgtgggatttatttggttcggttatcggttggggcggggcggaggttcgcgcgtttcgttttgttgtgacgtcggggcgggacgtgatttttaatatttaggcgggcgttttatagtttttcggtgattgttaggggtcgaagtggtagggtttagtggagtcgacgataaagttaaggtttagagcggggagg

SEQ ID NO: 21058 - DNA, 635 bp, Artificial Sequence
  chemically treated genomic DNA (Homo sapiens) CpG-island No: 21058
cctccccgctctaaaccttaactttatcgtcgactccactaaaccctaccacttcgacccctaacaatcaccgaaaaactataaaacgcccgcctaaatattaaaaatcacgtcccgccccgacgtcacaacaaaacgaaacgcgcgaacctccgccccgccccaaccgataaccgaaccaaataaatcccacgacaacgctcgcgactcgcgacccgcgacccaatcgcaacccgcgaaaacgaaccccgaaaacgaaattccgataaaaacgaaactcgaaaacgaaactaaccctcaaaacgcgaaccgaacccgcgaccgttccgcgcgctcccgccccgccccctccttacgcgcgctcgctcgctaacgccgaaaaaaacgttacgcaaattcaaaaataaaacgtcgacgacgtaaaaaaacgcgaaaaaatatacgcgcgtacgcgtacgcgtacgcgcccgaacgaaaataacgaaaaccccgccaaccccaacatcgcgcgccgcaaccgcgaccccgcaactccgcccccgacccgacccgaccccgaacccgctcgcccgccgccccgcataaaactatcaaccatcgacgaacaaatattcgccgtaaaaaacatccgaaaa

SEQ ID NO: 21059 - DNA, 635 bp, Artificial Sequence
  chemically treated genomic DNA (Homo sapiens) CpG-island No: 21059
ttttttcgttttgagttttgattttgtcgtcggttttattgggttttgttatttcggtttttggtagttatcgggaggttatgaggcgttcgtttgggtattaaggattacgtttcgtttcggcgttatagtaagacggggcgcgcgagttttcgtttcgttttagtcggtgatcgagttaaataagttttacggtagcgttcgcggttcgcggttcgcggtttaatcgtaattcgcgggggcgggtttcgggggcggggtttcgatgggggcggggttcgggggcggagttgatttttagggcgcgagtcgagttcgcggtcgtttcgcgcgttttcgtttcgttttttttttgcgcgcgttcgttcgttggcgtcgaggaaaacgttgcgtaggtttaaaaatggaacgtcggcggcgtgagggagcgcgagggggtgtgcgcgcgtgcgcgtgcgcgtgcgcgttcggacgagggtgacggggatttcgttagttttagtatcgcgcgtcgtagtcgcggtttcgtagtttcgttttcggttcggttcggtttcgggttcgttcgttcgtcgtttcgtatggagttgttagttatcggcgagtaggtgttcgtcgtggagagtattcggaag

SEQ ID NO: 21060 - DNA, 635 bp, Artificial Sequence
  chemically treated genomic DNA (Homo sapiens) CpG-island No: 21060
cttccgaatactctccacgacgaacacctactcgccgataactaacaactccatacgaaacgacgaacgaacgaacccgaaaccgaaccgaaccgaaaacgaaactacgaaaccgcgactacgacgcgcgatactaaaactaacgaaatccccgtcaccctcgtccgaacgcgcacgcgcacgcgcacgcgcgcacaccccctcgcgctccctcacgccgccgacgttccatttttaaacctacgcaacgttttcctcgacgccaacgaacgaacgcgcgcaaaaaaaaaacgaaacgaaaacgcgcgaaacgaccgcgaactcgactcgcgccctaaaaatcaactccgcccccgaaccccgcccccatcgaaaccccgcccccgaaacccgcccccgcgaattacgattaaaccgcgaaccgcgaaccgcgaacgctaccgtaaaacttatttaactcgatcaccgactaaaacgaaacgaaaactcgcgcgccccgtcttactataacgccgaaacgaaacgtaatccttaatacccaaacgaacgcctcataacctcccgataactaccaaaaaccgaaataacaaaacccaataaaaccgacgacaaaatcaaaactcaaaacgaaaaaa

SEQ ID NO: 21061 - DNA, 587 bp, Artificial Sequence
  chemically treated genomic DNA (Homo sapiens) CpG-island No: 21061
tgtcgcgtttcgtttttgtgcggcgtacgatcggagttagtgattaagtcggttttaagataaagcggaggtcgagtttaggaagtaagcgcgtttttcgtttcgtttggagggagggtttaattatagtatagtcgcgtttattttttattcggacgtgatttagtttttatagaggttcggtttttttcgttataatttcggttcgcggtttcgtttcgtttcgtgaatggtcggtcggttttaggttaaaaaagcgtttaggtgtttgcgacggagttttcggagaaaggtaagtacgtcgtagttaatgaggtgatagaaacgtaaagtagcgattaatgattagttgagttgggttgggtcggtcgacgaattacgaggtttcgtattcggatatggttatgggttcggaaatttagttcgggaaaagtgtgaggggttttttacgtggggaaggaatagtaggcgcggaggagggggtaagcgtgtgtgagatttagtggtttatgcgtgcgtttgtcgtgtaagggttatttttggggtttggagtgggggaataaattaatgtggttgttttttcgtgg

SEQ ID NO: 21062 - DNA, 587 bp, Artificial Sequence
  chemically treated genomic DNA (Homo sapiens) CpG-island No: 21062
ccacgaaaaaacaaccacattaatttattcccccactccaaaccccaaaaataacccttacacgacaaacgcacgcataaaccactaaatctcacacacgcttaccccctcctccgcgcctactattccttccccacgtaaaaaacccctcacacttttcccgaactaaatttccgaacccataaccatatccgaatacgaaacctcgtaattcgtcgaccgacccaacccaactcaactaatcattaatcgctactttacgtttctatcacctcattaactacgacgtacttacctttctccgaaaactccgtcgcaaacacctaaacgcttttttaacctaaaaccgaccgaccattcacgaaacgaaacgaaaccgcgaaccgaaattataacgaaaaaaaccgaacctctataaaaactaaatcacgtccgaataaaaaataaacgcgactatactataattaaaccctccctccaaacgaaacgaaaaacgcgcttacttcctaaactcgacctccgctttatcttaaaaccgacttaatcactaactccgatcgtacgccgcacaaaaacgaaacgcgaca

SEQ ID NO: 21063 - DNA, 587 bp, Artificial Sequence
  chemically treated genomic DNA (Homo sapiens) CpG-island No: 21063
ttacggaaaaatagttatattgatttgtttttttattttaaattttaggaatgatttttatacgataaacgtacgtatggattattgaattttatatacgtttgttttttttttcgcgtttgttgttttttttttacgtgaagagttttttatatttttttcgaattagattttcgagtttataattatattcgggtgcgaagtttcgtgattcgtcggtcggtttagtttaatttagttagttattggtcgttgttttgcgtttttattattttattggttgcgacgtgtttgttttttttcggaggtttcgtcgtagatatttaaacgtttttttgatttgaggtcggtcgattatttacggaacggggcgggatcgcgggtcggagttgtggcggaagaggtcgggtttttgtgagaattaggttacgttcgggtgaggagtgagcgcggttgtgttgtggttgggttttttttttaggcggggcggagagcgcgtttgttttttgggttcggttttcgttttgttttggagtcggtttaattattgatttcgatcgtgcgtcgtataagggcggagcgcggta

SEQ ID NO: 21064 - DNA, 587 bp, Artificial Sequence
  chemically treated genomic DNA (Homo sapiens) CpG-island No: 21064
taccgcgctccgcccttatacgacgcacgatcgaaatcaataattaaaccgactccaaaacaaaacgaaaaccgaacccaaaaaacaaacgcgctctccgccccgcctaaaaaaaaaacccaaccacaacacaaccgcgctcactcctcacccgaacgtaacctaattctcacaaaaacccgacctcttccgccacaactccgacccgcgatcccgccccgttccgtaaataatcgaccgacctcaaatcaaaaaaacgtttaaatatctacgacgaaacctccgaaaaaaaacaaacacgtcgcaaccaataaaataataaaaacgcaaaacaacgaccaataactaactaaattaaactaaaccgaccgacgaatcacgaaacttcgcacccgaatataattataaactcgaaaatctaattcgaaaaaaatataaaaaactcttcacgtaaaaaaaaaacaacaaacgcgaaaaaaaaaacaaacgtatataaaattcaataatccatacgtacgtttatcgtataaaaatcattcctaaaatttaaaataaaaaaacaaatcaatataactatttttccgtaa

SEQ ID NO: 21065 - DNA, 655 bp, Artificial Sequence
  chemically treated genomic DNA (Homo sapiens) CpG-island No: 21065
cggcgacgtaggtgtcggagagcgaggaggagggcggcgtggaggagggtattttcgggatcggcgggcgcgcgttggtagttcgtcgacggcgggggcgggggcggggggcggtaggggagcgagcgcgttggcggcgggcggtggcgttgcgcgcggggtggcgaaaggatgtgcgcgggatcgcgggggagggggagggagcgcgcgggttagttggaggcgggagggggcggagttttgtggcgtttgaattcgtttcgggggtgttaaggtgcgtttttagtttgacgcgatcgtttggggcggagttagcgggacgtgttatttgtagtgttggttagggttttttatttattagggagtagttttttcgcgcgatagttcgggagcgcgtaggtagtcgcgcgtatatacgtacgtaggtatatatatatatatatatatatatatatatatattttcgtatatataaatacgttaggacgttcgttttcgttattgtattttcgaattagtagagcgaagttattgcgggttttgttaattttagtatcgtggggcgaagtagagttattgtgtattaaggagaggtcggtgtttgcgttgtcgtttttggtatttaatttagtagatcgtttattttatcgggtaa

SEQ ID NO: 21066 - DNA, 655 bp, Artificial Sequence
  chemically treated genomic DNA (Homo sapiens) CpG-island No: 21066
ttacccgataaaataaacgatctactaaattaaataccaaaaacgacaacgcaaacaccgacctctccttaatacacaataactctacttcgccccacgatactaaaattaacaaaacccgcaataacttcgctctactaattcgaaaatacaataacgaaaacgaacgtcctaacgtatttatatatacgaaaatatatatatatatatatatatatatatatatatacctacgtacgtatatacgcgcgactacctacgcgctcccgaactatcgcgcgaaaaaactactccctaataaataaaaaaccctaaccaacactacaaataacacgtcccgctaactccgccccaaacgatcgcgtcaaactaaaaacgcaccttaacacccccgaaacgaattcaaacgccacaaaactccgccccctcccgcctccaactaacccgcgcgctccctccccctcccccgcgatcccgcgcacatcctttcgccaccccgcgcgcaacgccaccgcccgccgccaacgcgctcgctcccctaccgccccccgcccccgcccccgccgtcgacgaactaccaacgcgcgcccgccgatcccgaaaataccctcctccacgccgccctcctcctcgctctccgacacctacgtcgccg

SEQ ID NO: 21067 - DNA, 655 bp, Artificial Sequence
  chemically treated genomic DNA (Homo sapiens) CpG-island No: 21067
ttattcgatggggtgagcggtttgttgggttaggtgttagagacggtagcgtaggtatcggtttttttttgatgtataatggttttgtttcgttttacgatgttgaggttaatagaattcgtagtagtttcgttttgttggttcggggatgtagtagcgaagacgagcgttttagcgtgtttgtgtgtgcgaaagtgtgtgtgtgtgtgtgtgtgtgtgtgtgtgtgtgtttgcgtgcgtgtgtgcgcgcgattgtttgcgcgttttcgaattgtcgcgcggggaaattgttttttagtaaataaaaagttttagttagtattgtaggtggtacgtttcgttgatttcgttttaggcggtcgcgttagattggagacgtattttggtattttcggggcgggtttagacgttatagggtttcgttttttttcgtttttagttagttcgcgcgttttttttttttttttcgcgatttcgcgtatattttttcgttatttcgcgcgtaacgttatcgttcgtcgttagcgcgttcgtttttttgtcgtttttcgttttcgttttcgtcgtcggcgagttgttagcgcgcgttcgtcggtttcggaagtatttttttttacgtcgttttttttttcgtttttcggtatttgcgtcgtcg

SEQ ID NO: 21068 - DNA, 655 bp, Artificial Sequence
  chemically treated genomic DNA (Homo sapiens) CpG-island No: 21068
cgacgacgcaaataccgaaaaacgaaaaaaaaaacgacgtaaaaaaaaatacttccgaaaccgacgaacgcgcgctaacaactcgccgacgacgaaaacgaaaacgaaaaacgacaaaaaaacgaacgcgctaacgacgaacgataacgttacgcgcgaaataacgaaaaaatatacgcgaaatcgcgaaaaaaaaaaaaaaaacgcgcgaactaactaaaaacgaaaaaaaacgaaaccctataacgtctaaacccgccccgaaaataccaaaatacgtctccaatctaacgcgaccgcctaaaacgaaatcaacgaaacgtaccacctacaatactaactaaaactttttatttactaaaaaacaatttccccgcgcgacaattcgaaaacgcgcaaacaatcgcgcgcacacacgcacgcaaacacacacacacacacacacacacacacacacacactttcgcacacacaaacacgctaaaacgctcgtcttcgctactacatccccgaaccaacaaaacgaaactactacgaattctattaacctcaacatcgtaaaacgaaacaaaaccattatacatcaaaaaaaaaccgatacctacgctaccgtctctaacacctaacccaacaaaccgctcaccccatcgaataa

SEQ ID NO: 21069 - DNA, 802 bp, Artificial Sequence
  chemically treated genomic DNA (Homo sapiens) CpG-island No: 21069
cgcggagaggtgtttacgcgcgattcggttgttttttttttttgcgggttcgggtagggtagggcgggaacgcgggacgtgttttaagcgggttagtcgagcgcgagataggcgatgttgtagaagtttgttcgtttgcgggttatatatcggtcggtttcggttgtaggggttgcggggttacgggtcgcggggcgtcgggagtcgcgagtaggtgacggtcgcgtcgggtagtttcgcgggtcgcgattttcgagagtttggcgttatttcgcggaagtcggaggaattgcggttttttttcgttttcgcgcggaggggagagggaggcgtagcgcggaggggagagggaggcgtagcgcggaggggagagggaggcgtagcgcggaggggagagggaggcgtagttcgtatcgcgtaatttcggggttttggcgggagggaaggtgatttgcgtgggacgattttaagaggttaggttcggttttcgtagtttatttacgaggatatcgcgattaagttattaaagtattttttggttaggtcgagattttttttttttcgggttttaagagaaaaaagtatttttttttaaaatacgaatttttcgcggaggggttcggggttgtttggtacggggtagggtgtgcggttgtcgtgcgggcgcgggttagagttacgtggaggtaggcggagagggcgagggggttttcgtaaattattttgagggatttttggtttaagtttttgttttcgaaaggttgcgggacggttttgacgttgattatgtagttgttttttt

SEQ ID NO: 21070 - DNA, 802 bp, Artificial Sequence
  chemically treated genomic DNA (Homo sapiens) CpG-island No: 21070
aaaaaaacaactacataatcaacgtcaaaaccgtcccgcaacctttcgaaaacaaaaacttaaaccaaaaatccctcaaaataatttacgaaaaccccctcgccctctccgcctacctccacgtaactctaacccgcgcccgcacgacaaccgcacaccctaccccgtaccaaacaaccccgaacccctccgcgaaaaattcgtattttaaaaaaaaatacttttttctcttaaaacccgaaaaaaaaaaaatctcgacctaaccaaaaaatactttaataacttaatcgcgatatcctcgtaaataaactacgaaaaccgaacctaacctcttaaaatcgtcccacgcaaatcaccttccctcccgccaaaaccccgaaattacgcgatacgaactacgcctccctctcccctccgcgctacgcctccctctcccctccgcgctacgcctccctctcccctccgcgctacgcctccctctcccctccgcgcgaaaacgaaaaaaaaccgcaattcctccgacttccgcgaaataacgccaaactctcgaaaatcgcgacccgcgaaactacccgacgcgaccgtcacctactcgcgactcccgacgccccgcgacccgtaaccccgcaacccctacaaccgaaaccgaccgatatataacccgcaaacgaacaaacttctacaacatcgcctatctcgcgctcgactaacccgcttaaaacacgtcccgcgttcccgccctaccctacccgaacccgcaaaaaaaaaaaacaaccgaatcgcgcgtaaacacctctccgcg

SEQ ID NO: 21071 - DNA, 802 bp, Artificial Sequence
  chemically treated genomic DNA (Homo sapiens) CpG-island No: 21071
aagagaatagttatataattaacgttaaagtcgtttcgtaatttttcggaaatagggatttgggttaaaaattttttaggatgatttacgggggttttttcgtttttttcgtttgtttttacgtgattttggttcgcgttcgtacggtagtcgtatattttgtttcgtgttaggtagtttcgggttttttcgcggggagttcgtgttttaggagaaagtgttttttttttttggggttcgggggaaaaggggtttcggtttggttagagagtgttttggtggtttggtcgcggtattttcgtgggtgaattgcgaaggtcgggtttggttttttggagtcgttttacgtaagttattttttttttcgttagagtttcgggattgcgcggtgcgggttgcgtttttttttttttttcgcgttgcgtttttttttttttttcgcgttgcgtttttttttttttttcgcgttgcgtttttttttttttttcgcgcgggagcgggaagaagtcgtagttttttcggttttcgcggggtggcgttaggttttcgggaatcgcggttcgcggggttgttcggcgcggtcgttatttgttcgcggttttcggcgtttcgcgattcgtggtttcgtaatttttgtagtcgaggtcggtcggtgtgtgattcgtaggcgggtaggtttttgtagtatcgtttgtttcgcgttcggttggttcgtttagggtacgtttcgcgttttcgttttattttattcggattcgtaagaagagggggtagtcgagtcgcgcgtgggtattttttcgcg

SEQ ID NO: 21072 - DNA, 802 bp, Artificial Sequence
  chemically treated genomic DNA (Homo sapiens) CpG-island No: 21072
cgcgaaaaaatacccacgcgcgactcgactaccccctcttcttacgaatccgaataaaataaaacgaaaacgcgaaacgtaccctaaacgaaccaaccgaacgcgaaacaaacgatactacaaaaacctacccgcctacgaatcacacaccgaccgacctcgactacaaaaattacgaaaccacgaatcgcgaaacgccgaaaaccgcgaacaaataacgaccgcgccgaacaaccccgcgaaccgcgattcccgaaaacctaacgccaccccgcgaaaaccgaaaaaactacgacttcttcccgctcccgcgcgaaaaaaaaaaaaaaacgcaacgcgaaaaaaaaaaaaaaacgcaacgcgaaaaaaaaaaaaaaacgcaacgcgaaaaaaaaaaaaaaacgcaacccgcaccgcgcaatcccgaaactctaacgaaaaaaaaaataacttacgtaaaacgactccaaaaaaccaaacccgaccttcgcaattcacccacgaaaataccgcgaccaaaccaccaaaacactctctaaccaaaccgaaaccccttttcccccgaaccccaaaaaaaaaaaacactttctcctaaaacacgaactccccgcgaaaaaacccgaaactacctaacacgaaacaaaatatacgactaccgtacgaacgcgaaccaaaatcacgtaaaaacaaacgaaaaaaacgaaaaaacccccgtaaatcatcctaaaaaatttttaacccaaatccctatttccgaaaaattacgaaacgactttaacgttaattatataactattctctt

SEQ ID NO: 21073 - DNA, 890 bp, Artificial Sequence
  chemically treated genomic DNA (Homo sapiens) CpG-island No: 21073
tttggagagcgggggcgttaagaaggcgagttcggggttgcggcggttcgagaagtcgttttattcgtatatcgcgtttatcgttatggttatttagagttcgtttagtaagcgtttgacgtttagcgagatttattagtttttgtaggcgcgtttttttttttttcgcggcgtttattagggttggaagaattcggtgcgttataatttttcgtttaacgagtgttttattaagttgtttaagggtttcgggcggttcggtaagggttattattggattatcgattcggttagcgagtttatgttcgaggagggttcgtttcgtcgtcggtcgcgcggttttaggcggaagtgttaggcgtttaagtttatgtattatcgcgtggtgagcggtttgggtttcggggcgtcgttgttgttttagggtttcgatttttaggcgttttcgtcggcgtcgttcggttgttatagttagggcggttacggcggtttcgatatgatgttcgcgggttacgacgtcggcgcgggcgtttttagttacgcgtatttttattattattattattattacgtttcgtatatgtcgtttaattcgggttttatttatatggttagttgttcggtgttcgcgggattcgggggcgtcggtgcggtcgggggcggcggcggcggcgattacgggtcggatagtagtagtagttcggtattttcgttttcggttatggcgagcgttatcgaatgttattcgttttatacgagttttgcggcgtattggagttcgtttggcgtttcgttttattttaagtagtcgtttgttttgacgtttagtagtaatttcgtcgtttcggtaggtttgtattttagtatgtttttttattcgttggagtaga

SEQ ID NO: 21074 - DNA, 890 bp, Artificial Sequence
  chemically treated genomic DNA (Homo sapiens) CpG-island No: 21074
tctactccaacgaataaaaaaacatactaaaatacaaacctaccgaaacgacgaaattactactaaacgtcaaaacaaacgactacttaaaataaaacgaaacgccaaacgaactccaatacgccgcaaaactcgtataaaacgaataacattcgataacgctcgccataaccgaaaacgaaaataccgaactactactactatccgacccgtaatcgccgccgccgccgcccccgaccgcaccgacgcccccgaatcccgcgaacaccgaacaactaaccatataaataaaacccgaattaaacgacatatacgaaacgtaataataataataataataaaaatacgcgtaactaaaaacgcccgcgccgacgtcgtaacccgcgaacatcatatcgaaaccgccgtaaccgccctaactataacaaccgaacgacgccgacgaaaacgcctaaaaatcgaaaccctaaaacaacaacgacgccccgaaacccaaaccgctcaccacgcgataatacataaacttaaacgcctaacacttccgcctaaaaccgcgcgaccgacgacgaaacgaaccctcctcgaacataaactcgctaaccgaatcgataatccaataataacccttaccgaaccgcccgaaacccttaaacaacttaataaaacactcgttaaacgaaaaattataacgcaccgaattcttccaaccctaataaacgccgcgaaaaaaaaaaaaacgcgcctacaaaaactaataaatctcgctaaacgtcaaacgcttactaaacgaactctaaataaccataacgataaacgcgatatacgaataaaacgacttctcgaaccgccgcaaccccgaactcgccttcttaacgcccccgctctccaaa

SEQ ID NO: 21075 - DNA, 890 bp, Artificial Sequence
  chemically treated genomic DNA (Homo sapiens) CpG-island No: 21075
tttgttttagcgagtaggaggatatgttggagtgtaggtttgtcgaggcggcggggttgttgttgggcgttagggtaggcggttgtttgaggtaaggcgaggcgttaggcgagttttagtgcgtcgtagggttcgtgtagggcgagtggtattcgatggcgttcgttatggtcggggacgagggtatcgggttgttgttgttgttcggttcgtagtcgtcgtcgtcgtcgttttcggtcgtatcgacgttttcgggtttcgcgggtatcgggtagttggttatgtaggtggaattcgggttgggcgatatgtgcgggacgtggtggtggtggtggtggtgagggtgcgcgtggttgggggcgttcgcgtcggcgtcgtagttcgcgggtattatgtcgaggtcgtcgtagtcgttttggttgtggtagtcgagcggcgtcgacgggggcgtttggaagtcgaagttttggggtagtagcgacgtttcgaagtttaagtcgtttattacgcggtggtatatgggtttgagcgtttggtattttcgtttgaagtcgcgcggtcggcggcggaacgagtttttttcgaatatgaattcgttggtcgggtcgatggtttagtagtggtttttgtcgggtcgttcgaggtttttaggtagtttgatgaagtattcgttgagcgagagattgtggcgtatcgagtttttttagttttggtaggcgtcgcggaagaaggggaagcgcgtttgtaggaattggtagatttcgttgagcgttaggcgtttgttgggcgagttttggatggttatgacgatgagcgcgatgtacgagtagggcggtttttcgggtcgtcgtagtttcgagttcgtttttttggcgttttcgttttttagg

SEQ ID NO: 21076 - DNA, 890 bp, Artificial Sequence
  chemically treated genomic DNA (Homo sapiens) CpG-island No: 21076
cctaaaaaacgaaaacgccaaaaaaacgaactcgaaactacgacgacccgaaaaaccgccctactcgtacatcgcgctcatcgtcataaccatccaaaactcgcccaacaaacgcctaacgctcaacgaaatctaccaattcctacaaacgcgcttccccttcttccgcgacgcctaccaaaactaaaaaaactcgatacgccacaatctctcgctcaacgaatacttcatcaaactacctaaaaacctcgaacgacccgacaaaaaccactactaaaccatcgacccgaccaacgaattcatattcgaaaaaaactcgttccgccgccgaccgcgcgacttcaaacgaaaataccaaacgctcaaacccatataccaccgcgtaataaacgacttaaacttcgaaacgtcgctactaccccaaaacttcgacttccaaacgcccccgtcgacgccgctcgactaccacaaccaaaacgactacgacgacctcgacataatacccgcgaactacgacgccgacgcgaacgcccccaaccacgcgcaccctcaccaccaccaccaccaccacgtcccgcacatatcgcccaacccgaattccacctacataaccaactacccgatacccgcgaaacccgaaaacgtcgatacgaccgaaaacgacgacgacgacgactacgaaccgaacaacaacaacaacccgataccctcgtccccgaccataacgaacgccatcgaataccactcgccctacacgaaccctacgacgcactaaaactcgcctaacgcctcgccttacctcaaacaaccgcctaccctaacgcccaacaacaaccccgccgcctcgacaaacctacactccaacatatcctcctactcgctaaaacaaa

SEQ ID NO: 21077 - DNA, 633 bp, Artificial Sequence
  chemically treated genomic DNA (Homo sapiens) CpG-island No: 21077
agcgtcgacggtcgttttcgtgggtaggtgtgagcgttcgtttttttttttttcgagtttgttattttgtggtttaggatttgttattagaatttgttttaacgcgacgagggaatttatttgtgtgtagagcgtcgcgtatatatcggggttcgcgggatagggtagttgcgttagcgtagcgtcgggtgtgttcgggtaggtgttgcgggtaaggaagtaggtagcggtttttgagtagtcgtttcgtttcggtattgcggggatacggcggggttgaggttacgagagtagggttcgagttcggcgggtcgtggttacggtttttttgtattgaaaaattgaattcggttcgaagcgacgtgtattttatggtttttatattattcggttaattaagaaaagattcgggcgaatggatttaacgtagttcggtgtcgagagggttcggtttagtagtttttggggtttagtgcgtagggtattgcgggtcgattgcgtttcggggttaggaggcgtcgagaaagtaaaagtaaaagtcggcggcgggtggaggttaagcggttcggtgtaggtcggggatcggggagtcgtttcgggagagtagggtttaggttttttttgttttttttt

SEQ ID NO: 21078 - DNA, 633 bp, Artificial Sequence
  chemically treated genomic DNA (Homo sapiens) CpG-island No: 21078
aaaaaaaaacaaaaaaaacctaaaccctactctcccgaaacgactccccgatccccgacctacaccgaaccgcttaacctccacccgccgccgacttttacttttactttctcgacgcctcctaaccccgaaacgcaatcgacccgcaataccctacgcactaaaccccaaaaactactaaaccgaaccctctcgacaccgaactacgttaaatccattcgcccgaatcttttcttaattaaccgaataatataaaaaccataaaatacacgtcgcttcgaaccgaattcaatttttcaatacaaaaaaaccgtaaccacgacccgccgaactcgaaccctactctcgtaacctcaaccccgccgtatccccgcaataccgaaacgaaacgactactcaaaaaccgctacctacttccttacccgcaacacctacccgaacacacccgacgctacgctaacgcaactaccctatcccgcgaaccccgatatatacgcgacgctctacacacaaataaattccctcgtcgcgttaaaacaaattctaataacaaatcctaaaccacaaaataacaaactcgaaaaaaaaaaaaacgaacgctcacacctacccacgaaaacgaccgtcgacgct

SEQ ID NO: 21079 - DNA, 633 bp, Artificial Sequence
  chemically treated genomic DNA (Homo sapiens) CpG-island No: 21079
ggagggggatagagaaggtttggattttgttttttcggggcggtttttcggttttcggtttgtatcgggtcgtttgatttttattcgtcgtcggtttttgtttttgttttttcggcgttttttggtttcggggcgtaatcggttcgtagtgttttgcgtattgggttttagaggttgttggatcgggttttttcggtatcgggttgcgttaggtttattcgttcgggtttttttttagttaatcgagtggtgtggggattataaagtgtacgtcgtttcgggtcggatttagttttttagtgtaagaaaatcgtaattacggttcgtcgggttcgggttttgttttcgtggttttagtttcgtcgtgttttcgtaatgtcggagcgaggcggttgtttaggggtcgttgtttatttttttgttcgtaatatttattcgaatatattcggcgttgcgttaacgtagttgttttgtttcgcgagtttcgatgtgtgcgcggcgttttgtatataggtgagttttttcgtcgcgttaaagtaagttttgatggtaagttttggattataaaatagtaggttcgggaggagagagggcgagcgtttatatttgtttacgaaggcggtcgtcggcgtt

SEQ ID NO: 21080 - DNA, 633 bp, Artificial Sequence
  chemically treated genomic DNA (Homo sapiens) CpG-island No: 21080
aacgccgacgaccgccttcgtaaacaaatataaacgctcgccctctctcctcccgaacctactattttataatccaaaacttaccatcaaaacttactttaacgcgacgaaaaaactcacctatatacaaaacgccgcgcacacatcgaaactcgcgaaacaaaacaactacgttaacgcaacgccgaatatattcgaataaatattacgaacaaaaaaataaacaacgacccctaaacaaccgcctcgctccgacattacgaaaacacgacgaaactaaaaccacgaaaacaaaacccgaacccgacgaaccgtaattacgattttcttacactaaaaaactaaatccgacccgaaacgacgtacactttataatccccacaccactcgattaactaaaaaaaaacccgaacgaataaacctaacgcaacccgataccgaaaaaacccgatccaacaacctctaaaacccaatacgcaaaacactacgaaccgattacgccccgaaaccaaaaaacgccgaaaaaacaaaaacaaaaaccgacgacgaataaaaatcaaacgacccgatacaaaccgaaaaccgaaaaaccgccccgaaaaaacaaaatccaaaccttctctatccccctcc

SEQ ID NO: 21081 - DNA, 653 bp, Artificial Sequence
  chemically treated genomic DNA (Homo sapiens) CpG-island No: 21081
attttcgcggtttattgacgttcgttttttttagcgtttttttttcgggtttcggtatcgttttttttttacgtttttttttgcggttgtcgttttttttttttttttcgcgttttcggttttttttcggtttcggattcgtatagtcgggaagttgaatcgtcggcgggtcgtagaatgcgtattcggttttaggtcgtcgagtattcggttcgtcgcgtcgcgttttcggagtaataaacggtttagcgcggtcgggtttggggtttggaggcggggcgggcgcggagttttatgtcgtgtaatttttgttttagttttttatcgttagtttttgttttcgttttacgagtttcgttagttttcgtcgggtgttcgggatttgcggcggcgtcgttttgttgtgtatcgttatgttgggttgaggcgggcggcggcggcgcgaggttgggggcggtttttgcgtcgttagggggcgttttttcgttttgcgtttgcgcgcgcggttttcggagacgcgtgtagcgtcgtgtcgagtttcgttaaggtcggggttttcgaaggtttttttcggagagttttagagatgcggtttttgttttttgtcgttttttgtttttcggttggtcgtcggttttatagacgttataaat

SEQ ID NO: 21082 - DNA, 653 bp, Artificial Sequence
  chemically treated genomic DNA (Homo sapiens) CpG-island No: 21082
atttataacgtctataaaaccgacgaccaaccgaaaaacaaaaaacgacaaaaaacaaaaaccgcatctctaaaactctccgaaaaaaaccttcgaaaaccccgaccttaacgaaactcgacacgacgctacacgcgtctccgaaaaccgcgcgcgcaaacgcaaaacgaaaaaacgccccctaacgacgcaaaaaccgcccccaacctcgcgccgccgccgcccgcctcaacccaacataacgatacacaacaaaacgacgccgccgcaaatcccgaacacccgacgaaaactaacgaaactcgtaaaacgaaaacaaaaactaacgataaaaaactaaaacaaaaattacacgacataaaactccgcgcccgccccgcctccaaaccccaaacccgaccgcgctaaaccgtttattactccgaaaacgcgacgcgacgaaccgaatactcgacgacctaaaaccgaatacgcattctacgacccgccgacgattcaacttcccgactatacgaatccgaaaccgaaaaaaaaccgaaaacgcgaaaaaaaaaaaaaaaacgacaaccgcaaaaaaaaacgtaaaaaaaaaacgataccgaaacccgaaaaaaaaacgctaaaaaaaacgaacgtcaataaaccgcgaaaat

SEQ ID NO: 21083 - DNA, 653 bp, Artificial Sequence
  chemically treated genomic DNA (Homo sapiens) CpG-island No: 21083
atttgtggcgtttgtaaagtcggcggttagtcgaggggtaggaaacggtagaaagtagaagtcgtatttttagagtttttcgagaaggattttcgagagtttcggttttagcgaagttcggtacggcgttgtacgcgttttcggaagtcgcgcgcgtaggcgtagagcgggggggcgttttttggcggcgtagggatcgtttttaatttcgcgtcgtcgtcgttcgttttagtttaatatggcgatgtataataaggcggcgtcgtcgtagatttcggatattcggcgggagttggcggagttcgtgaagcggaagtaggagttggcggtgaggggttaggataggggttgtacggtatggggtttcgcgttcgtttcgtttttaggttttaagttcggtcgcgttaggtcgtttgttatttcgggggcgcggcgcggcgggtcgggtgttcggcggtttgaggtcgggtgcgtattttgcggttcgtcggcggtttagtttttcggttgtgcgaattcggagtcgggagagagtcgggagcgcgggagggggaggggaagcggtagtcgtaggagggggcgtggagggaggacggtgtcggggttcggggagagggcgttaggaagggcgagcgttagtgagtcgcgggggt

SEQ ID NO: 21084 - DNA, 653 bp, Artificial Sequence
  chemically treated genomic DNA (Homo sapiens) CpG-island No: 21084
acccccgcgactcactaacgctcgcccttcctaacgccctctccccgaaccccgacaccgtcctccctccacgccccctcctacgactaccgcttcccctccccctcccgcgctcccgactctctcccgactccgaattcgcacaaccgaaaaactaaaccgccgacgaaccgcaaaatacgcacccgacctcaaaccgccgaacacccgacccgccgcgccgcgcccccgaaataacaaacgacctaacgcgaccgaacttaaaacctaaaaacgaaacgaacgcgaaaccccataccgtacaacccctatcctaacccctcaccgccaactcctacttccgcttcacgaactccgccaactcccgccgaatatccgaaatctacgacgacgccgccttattatacatcgccatattaaactaaaacgaacgacgacgacgcgaaattaaaaacgatccctacgccgccaaaaaacgcccccccgctctacgcctacgcgcgcgacttccgaaaacgcgtacaacgccgtaccgaacttcgctaaaaccgaaactctcgaaaatccttctcgaaaaactctaaaaatacgacttctactttctaccgtttcctacccctcgactaaccgccgactttacaaacgccacaaat

SEQ ID NO: 21085 - DNA, 550 bp, Artificial Sequence
  chemically treated genomic DNA (Homo sapiens) CpG-island No: 21085
tcgtgcgttcgttcggcgtttgggtatcgcggtttggttcggagggggggtgggaattgggggggtggataggagttttcgtcggttcgcgattcgacgttagggtggttcggggcgggggttttttcgcgttggtcggggcggggggttcgcggaggggcggggggcgtttatttgggtcggcgggcgggcgggtttatcggtagacggacgtacgggagggcggatcgcgggacgtttagcgggacgggtagacggcggtttggtcgtttcggtttttaggtcggaatggatttcgggtcgggagagatagatcgagagagaaagggaggaggaggaggaggaggcggcggcggttcggggaggggaagaggagggagggagcgttcgagttgtgaggaggggttcggtatgtagtcgggaggaggaggaatgaggaagcgcgcggtgacggatttttcgtcggtgattcgggagagatttaggggcggttttagttgggggttcgggcggggtggggatatcgggtatagaagtttcgttttttatt

SEQ ID NO: 21086 - DNA, 550 bp, Artificial Sequence
  chemically treated genomic DNA (Homo sapiens) CpG-island No: 21086
aataaaaaacgaaacttctatacccgatatccccaccccgcccgaacccccaactaaaaccgcccctaaatctctcccgaatcaccgacgaaaaatccgtcaccgcgcgcttcctcattcctcctcctcccgactacataccgaacccctcctcacaactcgaacgctccctccctcctcttcccctccccgaaccgccgccgcctcctcctcctcctcctccctttctctctcgatctatctctcccgacccgaaatccattccgacctaaaaaccgaaacgaccaaaccgccgtctacccgtcccgctaaacgtcccgcgatccgccctcccgtacgtccgtctaccgataaacccgcccgcccgccgacccaaataaacgccccccgcccctccgcgaaccccccgccccgaccaacgcgaaaaaacccccgccccgaaccaccctaacgtcgaatcgcgaaccgacgaaaactcctatccacccccccaattcccaccccccctccgaaccaaaccgcgatacccaaacgccgaacgaacgcacga

SEQ ID NO: 21087 - DNA, 550 bp, Artificial Sequence
  chemically treated genomic DNA (Homo sapiens) CpG-island No: 21087
agtgggaggcggggtttttgtgttcggtgtttttatttcgttcggatttttagttagggtcgtttttgggtttttttcgggttatcggcggggaattcgttatcgcgcgtttttttatttttttttttttcggttgtatgtcgggtttttttttatagttcgagcgttttttttttttttttttttttttcgggtcgtcgtcgttttttttttttttttttttttttttttttcgatttgtttttttcggttcggaatttatttcggtttgggagtcggagcggttaggtcgtcgtttgttcgtttcgttggacgtttcgcggttcgttttttcgtgcgttcgtttgtcggtgagttcgttcgttcgtcggtttaggtgagcgtttttcgttttttcgcggatttttcgtttcggttagcgcgggggagttttcgtttcggattattttggcgtcggatcgcgggtcggcggggatttttgtttatttttttaatttttatttttttttcgggttaagtcgcgatatttaagcgtcgggcgggcgtacgg

SEQ ID NO: 21088 - DNA, 550 bp, Artificial Sequence
  chemically treated genomic DNA (Homo sapiens) CpG-island No: 21088
ccgtacgcccgcccgacgcttaaatatcgcgacttaacccgaaaaaaaaataaaaattaaaaaaataaacaaaaatccccgccgacccgcgatccgacgccaaaataatccgaaacgaaaactcccccgcgctaaccgaaacgaaaaatccgcgaaaaaacgaaaaacgctcacctaaaccgacgaacgaacgaactcaccgacaaacgaacgcacgaaaaaacgaaccgcgaaacgtccaacgaaacgaacaaacgacgacctaaccgctccgactcccaaaccgaaataaattccgaaccgaaaaaaacaaatcgaaaaaaaaaaaaaaaaaaaaaaaaaaaaaacgacgacgacccgaaaaaaaaaaaaaaaaaaaaaaaacgctcgaactataaaaaaaaacccgacatacaaccgaaaaaaaaaaaaataaaaaaacgcgcgataacgaattccccgccgataacccgaaaaaaacccaaaaacgaccctaactaaaaatccgaacgaaataaaaacaccgaacacaaaaaccccgcctcccact

SEQ ID NO: 21089 - DNA, 1376 bp, Artificial Sequence
  chemically treated genomic DNA (Homo sapiens) CpG-island No: 21089
cgtcgcggggcggggattagcgtcgttttaaatatttagggtaagggagtgttttatttttggggaggggtgtcgttcgggtttttttttttatcgtgggtggcgaaaggcgggacggaaaagcgtcgtttggataggcgcgttttttttagggatgtagggtcgggcgggggattcggcggcggtttagttcggaggaaggatttttacgtttcggttcgggttttcgggttttcggttttaggtagcgttcgaggtcggaataatagcgcgcgcgggcggggcgggggcgggggcggggcgtttttttgggtatcgttttcggttcgtttttcgcgttcgtagtttcgttcgtatattggtttttattcgtcgttcgtttaggtattgttcgcgggagtcgtcgtcgtcgtcgtcgcgttcgttatggacgttcgtttgtatttttcggcgttcgcggtgggcgcgcggttcggggtcgagtcggtcggtttggcgtatttggattattattacggcggtaaggtaggcgggggcgggcgggggttttcggcgggcggggtcggagttatttggtagttcgggatttaggcgttttcggggttatacggggtcgcgtatattagtttcgtcgacgggtacgggcggtttatatcgattttttcgcggttacgtttacgttttgagttgttgggatcgcgggtagaagttatttcgatagttattcgtgcgacgatatagtggttttttattcgcgtttttttgatagtttcgtagttatttataagtcgttatagtgatttatagttatacgtaggcggttaggtattgtttatacggtttcgtcgttttacgtaagttattttgatagttatttatatataacgatacgtaattatttattcgtaaatagttttatcgttatagacgagttatttatagacgtttcgatgttttatatatcgtgatatgtttttattcgttgttatatttaggtataacgggggatagttatataaagaagtcgttcgatagttatattttcgtagttataacgttttatttaggcgtacgttgttatatatagttatttttttggacggtgagttttagatatagatcgttttgacggttatatagttatacgcggttatatttagggacggttatatttcggttatttatattcgcgcgtcgaggtttaattttttagcgtcgtagtatattaattgggtagtttattaattggtcgttattgtttggcggggtttcggatttcgagtaggttgcggttaatcgaggtttgtgttttttcgggagcggtgagtcggcgtttttttaggttggggttgtagtgtcggatatttttttttttt

SEQ ID NO: 21090 - DNA, 1376 bp, Artificial Sequence
  chemically treated genomic DNA (Homo sapiens) CpG-island No: 21090
aaaaaaaaaaaatatccgacactacaaccccaacctaaaaaaacgccgactcaccgctcccgaaaaaacacaaacctcgattaaccgcaacctactcgaaatccgaaaccccgccaaacaataacgaccaattaataaactacccaattaatatactacgacgctaaaaaattaaacctcgacgcgcgaatataaataaccgaaatataaccgtccctaaatataaccgcgtataactatataaccgtcaaaacgatctatatctaaaactcaccgtccaaaaaaataactatatataacaacgtacgcctaaataaaacgttataactacgaaaatataactatcgaacgacttctttatataactatcccccgttatacctaaatataacaacgaataaaaacatatcacgatatataaaacatcgaaacgtctataaataactcgtctataacgataaaactatttacgaataaataattacgtatcgttatatataaataactatcaaaataacttacgtaaaacgacgaaaccgtataaacaatacctaaccgcctacgtataactataaatcactataacgacttataaataactacgaaactatcaaaaaaacgcgaataaaaaaccactatatcgtcgcacgaataactatcgaaataacttctacccgcgatcccaacaactcaaaacgtaaacgtaaccgcgaaaaaatcgatataaaccgcccgtacccgtcgacgaaactaatatacgcgaccccgtataaccccgaaaacgcctaaatcccgaactaccaaataactccgaccccgcccgccgaaaacccccgcccgcccccgcctaccttaccgccgtaataataatccaaatacgccaaaccgaccgactcgaccccgaaccgcgcgcccaccgcgaacgccgaaaaatacaaacgaacgtccataacgaacgcgacgacgacgacgacgactcccgcgaacaatacctaaacgaacgacgaataaaaaccaatatacgaacgaaactacgaacgcgaaaaacgaaccgaaaacgatacccaaaaaaacgccccgcccccgcccccgccccgcccgcgcgcgctattattccgacctcgaacgctacctaaaaccgaaaacccgaaaacccgaaccgaaacgtaaaaatccttcctccgaactaaaccgccgccgaatcccccgcccgaccctacatccctaaaaaaaacgcgcctatccaaacgacgcttttccgtcccgcctttcgccacccacgataaaaaaaaaaacccgaacgacacccctccccaaaaataaaacactcccttaccctaaatatttaaaacgacgctaatccccgccccgcgacg

SEQ ID NO: 21091 - DNA, 1376 bp, Artificial Sequence
  chemically treated genomic DNA (Homo sapiens) CpG-island No: 21091
gaggagggagggtgttcggtattatagttttagtttggagggacgtcggtttatcgttttcgggaggatataggtttcgattggtcgtagtttattcggaattcgaggtttcgttaggtagtgacggttaattagtaaattgtttaattagtgtgttgcggcgttgagaagttaaatttcgacgcgcgagtgtggatgatcgaggtgtggtcgtttttgggtgtgatcgcgtgtgattgtgtggtcgttaggacgatttgtgtttgaggtttatcgtttaggggggtggttgtgtgtgatagcgtgcgtttgggtgaggcgttgtggttgcgagagtgtgattgtcgggcgatttttttgtgtgattgtttttcgttgtgtttgggtgtgatagcgggtgggggtatgttacggtgtgtggggtatcggagcgtttgtgggtgattcgtttgtggcggtgaggttgtttgcgggtgagtggttgcgtgtcgttgtgtataagtgattgttagggtgatttgcgtgggacggcgggatcgtgtaagtagtgtttggtcgtttgcgtgtggttgtgggttattgtgacggtttgtgaatgattgcgaggttgttagggggacgcgagtgaggggttattgtgtcgtcgtacgggtggttgtcgggatgatttttgttcgcgattttaataatttagggcgtgagcgtggtcgcgaggggatcgatgtgagtcgttcgtgttcgtcggcggggttgatgtgcgcggtttcgtgtgatttcgggagcgtttgagtttcgagttgttaggtgatttcggtttcgttcgtcggggattttcgttcgttttcgtttattttgtcgtcgtggtaatagtttaggtgcgttaggtcggtcggttcggtttcgggtcgcgcgtttatcgcgggcgtcgaggggtataggcggacgtttatggcgggcgcggcggcggcggcggcggttttcgcgggtagtgtttgggcgggcggcgggtgggagttagtgtgcgagcgggattgcgagcgcggggggcgggtcgggggcggtgtttagaggagcgtttcgttttcgttttcgtttcgttcgcgcgcgttattgtttcggtttcgggcgttgtttagggtcgggggttcgggggttcgggtcggggcgtggaggtttttttttcgggttgggtcgtcgtcgggtttttcgttcggttttgtatttttgaggggggcgcgtttgtttagacggcgttttttcgtttcgtttttcgttatttacggtgaggagagaagttcgaacggtatttttttttagaagtgggatatttttttgttttaaatatttgaggcggcgttagttttcgtttcgcggcg

SEQ ID NO: 21092 - DNA, 1376 bp, Artificial Sequence
  chemically treated genomic DNA (Homo sapiens) CpG-island No: 21092
cgccgcgaaacgaaaactaacgccgcctcaaatatttaaaacaaaaaaatatcccacttctaaaaaaaaataccgttcgaacttctctcctcaccgtaaataacgaaaaacgaaacgaaaaaacgccgtctaaacaaacgcgcccccctcaaaaatacaaaaccgaacgaaaaacccgacgacgacccaacccgaaaaaaaaacctccacgccccgacccgaacccccgaacccccgaccctaaacaacgcccgaaaccgaaacaataacgcgcgcgaacgaaacgaaaacgaaaacgaaacgctcctctaaacaccgcccccgacccgccccccgcgctcgcaatcccgctcgcacactaactcccacccgccgcccgcccaaacactacccgcgaaaaccgccgccgccgccgccgcgcccgccataaacgtccgcctatacccctcgacgcccgcgataaacgcgcgacccgaaaccgaaccgaccgacctaacgcacctaaactattaccacgacgacaaaataaacgaaaacgaacgaaaatccccgacgaacgaaaccgaaatcacctaacaactcgaaactcaaacgctcccgaaatcacacgaaaccgcgcacatcaaccccgccgacgaacacgaacgactcacatcgatcccctcgcgaccacgctcacgccctaaattattaaaatcgcgaacaaaaatcatcccgacaaccacccgtacgacgacacaataacccctcactcgcgtccccctaacaacctcgcaatcattcacaaaccgtcacaataacccacaaccacacgcaaacgaccaaacactacttacacgatcccgccgtcccacgcaaatcaccctaacaatcacttatacacaacgacacgcaaccactcacccgcaaacaacctcaccgccacaaacgaatcacccacaaacgctccgataccccacacaccgtaacatacccccacccgctatcacacccaaacacaacgaaaaacaatcacacaaaaaaatcgcccgacaatcacactctcgcaaccacaacgcctcacccaaacgcacgctatcacacacaaccacccccctaaacgataaacctcaaacacaaatcgtcctaacgaccacacaatcacacgcgatcacacccaaaaacgaccacacctcgatcatccacactcgcgcgtcgaaatttaacttctcaacgccgcaacacactaattaaacaatttactaattaaccgtcactacctaacgaaacctcgaattccgaataaactacgaccaatcgaaacctatatcctcccgaaaacgataaaccgacgtccctccaaactaaaactataataccgaacaccctccctcctc

SEQ ID NO: 21093 - DNA, 530 bp, Artificial Sequence
  chemically treated genomic DNA (Homo sapiens) CpG-island No: 21093
taattttcggagttcgtgcgggtagtcgttgcgcgtcgtttttgttttttagtttttttttaggcgtttttacgagtgtagagtttaggtaagagtttgtttttcgcgacgtatatttttttcgcgtttcgggtttttcgttttgggtttttttgtgtgcgttcgcgttaggagaggcgcgtcgtttcgtgcgtttatttgcggcggaggttattgtgagttcgaaaaggagttatagtttcggttttatgaatttagattaggcgtcggagtatcggattaggaggacggtcgtttgtggtcgcgaaagggtattggggtcgggtatagttggtttcgttttttagttgtgggggttcgaggtcggtcgatcgttcgttgcgtttttagtttcggttaggagttggttgcggcggttataaatttttagagcgcgttgtttatttttgcgcggagttggtcggttgtggttcgggtttttttggtttttgtattattttcgtcgttttttcgttttttagaggggttgg

SEQ ID NO: 21094 - DNA, 530 bp, Artificial Sequence
  chemically treated genomic DNA (Homo sapiens) CpG-island No: 21094
ccaacccctctaaaaaacgaaaaaacgacgaaaataatacaaaaaccaaaaaaacccgaaccacaaccgaccaactccgcgcaaaaataaacaacgcgctctaaaaatttataaccgccgcaaccaactcctaaccgaaactaaaaacgcaacgaacgatcgaccgacctcgaacccccacaactaaaaaacgaaaccaactatacccgaccccaataccctttcgcgaccacaaacgaccgtcctcctaatccgatactccgacgcctaatctaaattcataaaaccgaaactataactccttttcgaactcacaataacctccgccgcaaataaacgcacgaaacgacgcgcctctcctaacgcgaacgcacacaaaaaaacccaaaacgaaaaacccgaaacgcgaaaaaaatatacgtcgcgaaaaacaaactcttacctaaactctacactcgtaaaaacgcctaaaaaaaaactaaaaaacaaaaacgacgcgcaacgactacccgcacgaactccgaaaatta

SEQ ID NO: 21095 - DNA, 530 bp, Artificial Sequence
  chemically treated genomic DNA (Homo sapiens) CpG-island No: 21095
ttagtttttttggggggcggggaggcgacgggggtggtgtagaagttagaaaagttcgagttatagtcggttagtttcgcgtagggatgggtagcgcgttttgaaagtttatgatcgtcgtagttaatttttggtcggagttggagacgtagcgagcgatcggtcggtttcgaatttttatagttggagggcgaggttagttgtattcggttttagtgttttttcgcggttataagcggtcgtttttttggttcggtgtttcggcgtttgatttaggtttatggagtcggggttgtggttttttttcgggtttatagtgattttcgtcgtaggtaagcgtacggggcggcgcgttttttttggcgcgagcgtatataaaaggatttagggcgggggattcgaggcgcggagaagatgtgcgtcgcggggagtaaatttttgtttgggttttgtattcgtgaagacgtttgggggagggttggggagtagaagcggcgcgtaacgattattcgtacgggtttcgggagttg

SEQ ID NO: 21096 - DNA, 530 bp, Artificial Sequence
  chemically treated genomic DNA (Homo sapiens) CpG-island No: 21096
caactcccgaaacccgtacgaataatcgttacgcgccgcttctactccccaaccctcccccaaacgtcttcacgaatacaaaacccaaacaaaaatttactccccgcgacgcacatcttctccgcgcctcgaatcccccgccctaaatccttttatatacgctcgcgccaaaaaaaacgcgccgccccgtacgcttacctacgacgaaaatcactataaacccgaaaaaaaaccacaaccccgactccataaacctaaatcaaacgccgaaacaccgaaccaaaaaaacgaccgcttataaccgcgaaaaaacactaaaaccgaatacaactaacctcgccctccaactataaaaattcgaaaccgaccgatcgctcgctacgtctccaactccgaccaaaaattaactacgacgatcataaactttcaaaacgcgctacccatccctacgcgaaactaaccgactataactcgaacttttctaacttctacaccacccccgtcgcctccccgccccccaaaaaaactaa

SEQ ID NO: 21097 - DNA, 586 bp, Artificial Sequence
  chemically treated genomic DNA (Homo sapiens) CpG-island No: 21097
agcgcgcgacggagaataaaagggcggtaatgattcgtagttgggcgagtagcgtgttcggtttgcggagatattcgattatcgggggtcgtcgtgtttattgcgcgtgcgcggttagcgggcggggcgtttcggggttttgggggcggggtggggacggtttggtgtgtgggtgagggtgtgggggcgggatttggtatggatgggcggggtttgacgcgcgggggcggggtttggtgtgggtgggcggtagcggacgtttgggatcgggtaggcgtttggcgttttttttcggattagttgtttcgcgtcgttttgttgttattaggcgggcgaggaaaagtttcgcgttcgtcggtcggcgcggagtcgagtagaaaattgttgatttagagaaaatgagagtattacgattaaataatggcggaaagcggcgacgacgtcgatagggcgttttagtattttttttttttcgttcgcggggatacggggagcgaagagggagttgagttgagggttcgcgcggagaagggggcgagcgttgttagttttgggttggaggttgggggtatcgattttagggttg

SEQ ID NO: 21098 - DNA, 586 bp, Artificial Sequence
  chemically treated genomic DNA (Homo sapiens) CpG-island No: 21098
caaccctaaaatcgatacccccaacctccaacccaaaactaacaacgctcgcccccttctccgcgcgaaccctcaactcaactccctcttcgctccccgtatccccgcgaacgaaaaaaaaaaaatactaaaacgccctatcgacgtcgtcgccgctttccgccattatttaatcgtaatactctcattttctctaaatcaacaattttctactcgactccgcgccgaccgacgaacgcgaaacttttcctcgcccgcctaataacaacaaaacgacgcgaaacaactaatccgaaaaaaaacgccaaacgcctacccgatcccaaacgtccgctaccgcccacccacaccaaaccccgcccccgcgcgtcaaaccccgcccatccataccaaatcccgcccccacaccctcacccacacaccaaaccgtccccaccccgcccccaaaaccccgaaacgccccgcccgctaaccgcgcacgcgcaataaacacgacgacccccgataatcgaatatctccgcaaaccgaacacgctactcgcccaactacgaatcattaccgcccttttattctccgtcgcgcgct

SEQ ID NO: 21099 - DNA, 586 bp, Artificial Sequence
  chemically treated genomic DNA (Homo sapiens) CpG-island No: 21099
tagttttggggtcggtatttttagtttttaatttagagttggtagcgttcgttttttttttcgcgcgggtttttagtttagtttttttttcgtttttcgtgttttcgcgagcgggagggaggggatgttaggacgttttgtcggcgtcgtcgtcgtttttcgttattgtttagtcgtgatgtttttattttttttgaattaataattttttgttcggtttcgcgtcgatcggcgaacgcggggttttttttcgttcgtttgatgatagtagagcggcgcggagtagttggttcggaaggaagcgttaggcgtttgttcggttttaggcgttcgttgtcgtttatttatattagatttcgttttcgcgcgttaagtttcgtttatttatattaagtttcgtttttatatttttatttatatattaggtcgtttttatttcgtttttagagtttcggggcgtttcgttcgttagtcgcgtacgcgtagtgagtacggcgattttcggtggtcgggtgttttcgtaggtcgaatacgttgttcgtttagttgcggattattatcgtttttttgtttttcgtcgcgcgtt

SEQ ID NO: 21100 - DNA, 586 bp, Artificial Sequence
  chemically treated genomic DNA (Homo sapiens) CpG-island No: 21100
aacgcgcgacgaaaaacaaaaaaacgataataatccgcaactaaacgaacaacgtattcgacctacgaaaacacccgaccaccgaaaatcgccgtactcactacgcgtacgcgactaacgaacgaaacgccccgaaactctaaaaacgaaataaaaacgacctaatatataaataaaaatataaaaacgaaacttaatataaataaacgaaacttaacgcgcgaaaacgaaatctaatataaataaacgacaacgaacgcctaaaaccgaacaaacgcctaacgcttccttccgaaccaactactccgcgccgctctactatcatcaaacgaacgaaaaaaaaccccgcgttcgccgatcgacgcgaaaccgaacaaaaaattattaattcaaaaaaaataaaaacatcacgactaaacaataacgaaaaacgacgacgacgccgacaaaacgtcctaacatcccctccctcccgctcgcgaaaacacgaaaaacgaaaaaaaaactaaactaaaaacccgcgcgaaaaaaaaaacgaacgctaccaactctaaattaaaaactaaaaataccgaccccaaaacta

SEQ ID NO: 21101 - DNA, 820 bp, Artificial Sequence
  chemically treated genomic DNA (Homo sapiens) CpG-island No: 21101
aggtaaatcgaagaataataggaaattacgtaaggcgtacgtgtttttgaggggggcgggtgcggggcgttggagaggcgcggtcgtcgttttgcgtttgcgtagtcgtcggttgtcgcgttgtcgagttattggggtgggaggagtataagtagggggaggggtgtatgtcggagtgcgtaggcgtaacgcgattttcgaggcgcgggtcgtttttttggttggtttggattcgggttagtcgggtgtcgagatttgggagagacgttttgaattgattgtttcgtattatcggagcgttttagttgcgaggaggtaagtgttttgacgtgacggggaggggtcgtagtattgcgttttagtttttattgtcggtttggtcgcgggcggtttttttcgggttcgttcgttttgggtcgcgtcgtttttcgacgttttttgtttgggtcgggtttgggttttttcgcgtttttttatttgtcgcggtttgtgtttgttggagtttcgagttttacgttttttttttttttcgttttttcgttttttcgcggtttttcgtttcgtttcgttttttcgtcgtttttcgtttagcggtagtttttttttttcgttttttttggtcgttttttgttttttttagttttttttttttcgtttcggagttttattttttttggttattttttcggttttattttttttttttttcgtattttttgtgtttcgtttcgattttagtttttcgttttgattttaggaatttttcgaggagcgtaattttatagttggagatttcgggcgggtagtgtttttggatagt

SEQ ID NO: 21102 - DNA, 820 bp, Artificial Sequence
  chemically treated genomic DNA (Homo sapiens) CpG-island No: 21102
actatccaaaaacactacccgcccgaaatctccaactataaaattacgctcctcgaaaaattcctaaaatcaaaacgaaaaactaaaatcgaaacgaaacacaaaaaatacgaaaaaaaaaaaaaataaaaccgaaaaaataaccaaaaaaaataaaactccgaaacgaaaaaaaaaaaactaaaaaaaacaaaaaacgaccaaaaaaaacgaaaaaaaaaaactaccgctaaacgaaaaacgacgaaaaaacgaaacgaaacgaaaaaccgcgaaaaaacgaaaaaacgaaaaaaaaaaaaaacgtaaaactcgaaactccaacaaacacaaaccgcgacaaataaaaaaacgcgaaaaaacccaaacccgacccaaacaaaaaacgtcgaaaaacgacgcgacccaaaacgaacgaacccgaaaaaaaccgcccgcgaccaaaccgacaataaaaactaaaacgcaatactacgacccctccccgtcacgtcaaaacacttacctcctcgcaactaaaacgctccgataatacgaaacaatcaattcaaaacgtctctcccaaatctcgacacccgactaacccgaatccaaaccaaccaaaaaaacgacccgcgcctcgaaaatcgcgttacgcctacgcactccgacatacacccctccccctacttatactcctcccaccccaataactcgacaacgcgacaaccgacgactacgcaaacgcaaaacgacgaccgcgcctctccaacgccccgcacccgcccccctcaaaaacacgtacgccttacgtaatttcctattattcttcgatttacct

SEQ ID NO: 21103 - DNA, 820 bp, Artificial Sequence
  chemically treated genomic DNA (Homo sapiens) CpG-island No: 21103
gttgtttaggggtattgttcgttcggggtttttagttgtgaagttgcgtttttcgggagatttttggggttagaacgagaggttggagtcggagcgaggtataagggatgcgggagaagaaaggagtggggtcgaagaggtagttaaagagaatggggtttcgaggcgagagagaaaggattggaaggggtaaagggcggttaaggagggcgaaaaggggaagttgtcgttgggcgggagacggcggaggagcgagacggggcgggggatcgcgggaggacgggaaggcgggaaggggagagagcgtggagttcggagttttagtaggtataggtcgcggtagataagggggcgcggagaggtttaggttcggtttaggtaggaggcgtcgggagacgacgcgatttaaggcgggcgggttcggggaaaatcgttcgcggttagatcggtagtggaagttgagacgtagtgttgcggttttttttcgttacgttagggtatttattttttcgtagttgggacgtttcggtgatgcggggtagttagtttagagcgttttttttaaatttcggtattcgattgattcggatttaaattagttaagggggcggttcgcgtttcgggagtcgcgttgcgtttgcgtatttcggtatgtatttttttttttgtttatgttttttttattttagtgattcggtagcgcggtagtcgacgattgcgtagacgtagggcggcggtcgcgtttttttaacgtttcgtattcgttttttttagaagtacgtgcgttttacgtaattttttgttatttttcggtttgttt

SEQ ID NO: 21104 - DNA, 820 bp, Artificial Sequence
  chemically treated genomic DNA (Homo sapiens) CpG-island No: 21104
aaacaaaccgaaaaataacaaaaaattacgtaaaacgcacgtacttctaaaaaaaacgaatacgaaacgttaaaaaaacgcgaccgccgccctacgtctacgcaatcgtcgactaccgcgctaccgaatcactaaaataaaaaaaacataaacaaaaaaaaaaatacataccgaaatacgcaaacgcaacgcgactcccgaaacgcgaaccgcccccttaactaatttaaatccgaatcaatcgaataccgaaatttaaaaaaaacgctctaaactaactaccccgcatcaccgaaacgtcccaactacgaaaaaataaataccctaacgtaacgaaaaaaaaccgcaacactacgtctcaacttccactaccgatctaaccgcgaacgattttccccgaacccgcccgccttaaatcgcgtcgtctcccgacgcctcctacctaaaccgaacctaaacctctccgcgcccccttatctaccgcgacctatacctactaaaactccgaactccacgctctctccccttcccgccttcccgtcctcccgcgatcccccgccccgtctcgctcctccgccgtctcccgcccaacgacaacttccccttttcgccctccttaaccgccctttaccccttccaatcctttctctctcgcctcgaaaccccattctctttaactacctcttcgaccccactcctttcttctcccgcatcccttatacctcgctccgactccaacctctcgttctaaccccaaaaatctcccgaaaaacgcaacttcacaactaaaaaccccgaacgaacaatacccctaaacaac

SEQ ID NO: 21105 - DNA, 760 bp, Artificial Sequence
  chemically treated genomic DNA (Homo sapiens) CpG-island No: 21105
cgcggcgagcgttaaggttcggttcggtttcgtcgtttttcgcgatagcgtcgtcggggtggggacgagggtcgacgttattcgtcgcgtcgggtttcgtttttttagtattggggcggaggtcgcgggtaggaaggtggcggtttttggggtttatttcggaatttgagttcgtgttgcggttcgaggtttaggatttgttttattttcgttatgttttttagcggcggagtatttttggcggggagatttttgagaggttatcggggcgggaagcgttaatgttgcgttcgttttaagttttataaaaaggcggggatcggtcggggtacgggcgggggttttttatcgggtgggcgcgttgggggggggtcggtttacgcggtgtaggcgtaggggcggagggcgagggcgaggtcgcggtgttcggcgagttgacggtacgtacgtacgtacgtacgtacgtagagtcgtatatacgtacgtacgtagtaggttggttcgttttggcggcgggaagttgcgttttgcgtcgtcggttttaggggcggggattaaagttgcgcgcgtagagtttttttcgggatagtgcgtaggcgcggtataagttacgggggcgggattgcggggtagtaaggggcggggtttcgggtcgtttaggaggcggggtttgtagtttagttacgatagttatcgcggaaattattaagggttcgttgggggttagtttcgtgttaagtgttttatttaataataataa

SEQ ID NO: 21106 - DNA, 760 bp, Artificial Sequence
  chemically treated genomic DNA (Homo sapiens) CpG-island No: 21106
ttattattattaaataaaacacttaacacgaaactaacccccaacgaacccttaataatttccgcgataactatcgtaactaaactacaaaccccgcctcctaaacgacccgaaaccccgccccttactaccccgcaatcccgcccccgtaacttataccgcgcctacgcactatcccgaaaaaaactctacgcgcgcaactttaatccccgcccctaaaaccgacgacgcaaaacgcaacttcccgccgccaaaacgaaccaacctactacgtacgtacgtatatacgactctacgtacgtacgtacgtacgtacgtaccgtcaactcgccgaacaccgcgacctcgccctcgccctccgcccctacgcctacaccgcgtaaaccgacccccccccaacgcgcccacccgataaaaaacccccgcccgtaccccgaccgatccccgcctttttataaaacttaaaacgaacgcaacattaacgcttcccgccccgataacctctcaaaaatctccccgccaaaaatactccgccgctaaaaaacataacgaaaataaaacaaatcctaaacctcgaaccgcaacacgaactcaaattccgaaataaaccccaaaaaccgccaccttcctacccgcgacctccgccccaatactaaaaaaacgaaacccgacgcgacgaataacgtcgaccctcgtccccaccccgacgacgctatcgcgaaaaacgacgaaaccgaaccgaaccttaacgctcgccgcg

SEQ ID NO: 21107 - DNA, 760 bp, Artificial Sequence
  chemically treated genomic DNA (Homo sapiens) CpG-island No: 21107
ttgttattattgaataaagtatttaatacgaagttggtttttagcgggtttttaatagttttcgcggtggttgtcgtagttggattatagatttcgttttttgagcggttcgaagtttcgttttttattgtttcgtagtttcgttttcgtggtttgtgtcgcgtttgcgtattgtttcggaaggggttttacgcgcgtagttttagttttcgtttttggagtcggcggcgtagggcgtagtttttcgtcgttagagcgggttagtttgttgcgtgcgtgcgtgtgtacgattttgcgtgcgtgcgtgcgtgcgtgcgtgtcgttagttcgtcgggtatcgcggtttcgttttcgtttttcgtttttgcgtttgtatcgcgtagatcgatttttttttagcgcgtttattcggtagaggattttcgttcgtgtttcgatcggttttcgtttttttgtaaaatttaaagcgggcgtagtattaacgtttttcgtttcggtgattttttaggggttttttcgttaaaggtgtttcgtcgttaaggaatatggcgaaggtggagtaggttttgagtttcgagtcgtagtacgagtttaaatttcgaggtaagttttagaggtcgttatttttttgttcgcggttttcgttttagtgttggaaggacggagttcggcgcggcgggtgacgtcggttttcgtttttatttcgacggcgttgtcgcggggggcggcgaggtcgggtcgggttttggcgttcgtcgcg

SEQ ID NO: 21108 - DNA, 760 bp, Artificial Sequence
  chemically treated genomic DNA (Homo sapiens) CpG-island No: 21108
cgcgacgaacgccaaaacccgacccgacctcgccgccccccgcgacaacgccgtcgaaataaaaacgaaaaccgacgtcacccgccgcgccgaactccgtccttccaacactaaaacgaaaaccgcgaacaaaaaaataacgacctctaaaacttacctcgaaatttaaactcgtactacgactcgaaactcaaaacctactccaccttcgccatattccttaacgacgaaacacctttaacgaaaaaacccctaaaaaatcaccgaaacgaaaaacgttaatactacgcccgctttaaattttacaaaaaaacgaaaaccgatcgaaacacgaacgaaaatcctctaccgaataaacgcgctaaaaaaaaatcgatctacgcgatacaaacgcaaaaacgaaaaacgaaaacgaaaccgcgatacccgacgaactaacgacacgcacgcacgcacgcacgcacgcaaaatcgtacacacgcacgcacgcaacaaactaacccgctctaacgacgaaaaactacgccctacgccgccgactccaaaaacgaaaactaaaactacgcgcgtaaaaccccttccgaaacaatacgcaaacgcgacacaaaccacgaaaacgaaactacgaaacaataaaaaacgaaacttcgaaccgctcaaaaaacgaaatctataatccaactacgacaaccaccgcgaaaactattaaaaacccgctaaaaaccaacttcgtattaaatactttattcaataataacaa

SEQ ID NO: 21109 - DNA, 773 bp, Artificial Sequence
  chemically treated genomic DNA (Homo sapiens) CpG-island No: 21109
tagagtcggcggttttgagatttggggcggttttttggaggttagtttcgttcgtttttttcggtttttttttttttttcgaggttcgaggcgggtagcgggttgtgggcgggtaggaggttgcggaggggcggggggtaggaaggggcggggggttcggcgtattcggtaggaagagatcgattcgttattcgtcgtagttcgcgcgtttttggtatttaattttcgttatgtgggggtttttgttcgttttggtcgttttcgcgtcggtcgtcggttcggttttgggggcgtttaggaattcggtgttgggtttcgcgtagttcgggattattaaggttttaggttcgatttcggttttgtatagtagttcggtatagtcgtcggcggagatagttaacggtgagtttttcgatcgacggttcgttttttcgtaagtcgattgttcggtttttttgtttcgtggggcgatttttttttaatacgcgggtatacgtatatttacgtatatttatagttatgtatatttatttcgtacgtatattcgtatttacgcgtatatacgcgcgcgtatttatatatatttatatacgcgtatatttgtatttatacgcgcgcgtatttatacgtatgtatatatacgtatatttatacgcgcgtgcgcgtatatatagtgtacgcgcgcgtatatttatatttatagtgtatatatatatatatatatttatatttttttaattttttgttgggagtaatggttgttgattcggtag

SEQ ID NO: 21110 - DNA, 773 bp, Artificial Sequence
  chemically treated genomic DNA (Homo sapiens) CpG-island No: 21110
ctaccgaatcaacaaccattactcccaacaaaaaattaaaaaaatataaatatatatatatatatatacactataaatataaatatacgcgcgcgtacactatatatacgcgcacgcgcgtataaatatacgtatatatacatacgtataaatacgcgcgcgtataaatacaaatatacgcgtatataaatatatataaatacgcgcgcgtatatacgcgtaaatacgaatatacgtacgaaataaatatacataactataaatatacgtaaatatacgtatacccgcgtattaaaaaaaaatcgccccacgaaacaaaaaaaccgaacaatcgacttacgaaaaaacgaaccgtcgatcgaaaaactcaccgttaactatctccgccgacgactataccgaactactatacaaaaccgaaatcgaacctaaaaccttaataatcccgaactacgcgaaacccaacaccgaattcctaaacgcccccaaaaccgaaccgacgaccgacgcgaaaacgaccaaaacgaacaaaaacccccacataacgaaaattaaataccaaaaacgcgcgaactacgacgaataacgaatcgatctcttcctaccgaatacgccgaaccccccgccccttcctaccccccgcccctccgcaacctcctacccgcccacaacccgctacccgcctcgaacctcgaaaaaaaaaaaaaaaccgaaaaaaacgaacgaaactaacctccaaaaaaccgccccaaatctcaaaaccgccgactcta

SEQ ID NO: 21111 - DNA, 773 bp, Artificial Sequence
  chemically treated genomic DNA (Homo sapiens) CpG-island No: 21111
ttgtcgagttagtagttattgtttttagtagggagttgagggagtgtgagtgtgtatatgtgtgtgtgtattgtgagtgtgagtgtgcgcgcgcgtgtattgtgtgtgcgcgtacgcgcgtgtgagtgtgcgtgtgtgtgtatgcgtgtgaatgcgcgcgcgtgtgagtgtaagtgtgcgcgtgtgtgaatgtgtgtgagtgcgcgcgcgtgtgtgcgcgtgagtgcgagtgtgcgtgcggggtgagtgtgtatgattgtgagtgtgcgtgggtgtgcgtgtgttcgcgtgttagggagggatcgttttacggggtaggagagtcgggtagtcggtttgcgggggagcggatcgtcggtcggggaatttatcgttagttgttttcgtcggcggttgtgtcgggttgttatgtagggtcggggtcgagtttgggattttggtggtttcgggttgcgcgaggtttagtatcgagtttttgggcgtttttagagtcgggtcgacggtcggcgcgaaggcggttagggcgagtaggagtttttatatggcggggattgagtgttaggggcgcgcgggttacggcgggtggcgggtcggtttttttttgtcgagtgcgtcgagtttttcgtttttttttgtttttcgttttttcgtagttttttgttcgtttatagttcgttgttcgtttcggatttcggagaggaggagagggtcgggaggagcgagcggggttgatttttaaggggtcgttttaagttttaggatcgtcgattttg

SEQ ID NO: 21112 - DNA, 773 bp, Artificial Sequence
  chemically treated genomic DNA (Homo sapiens) CpG-island No: 21112
caaaatcgacgatcctaaaacttaaaacgaccccttaaaaatcaaccccgctcgctcctcccgaccctctcctcctctccgaaatccgaaacgaacaacgaactataaacgaacaaaaaactacgaaaaaacgaaaaacaaaaaaaaacgaaaaactcgacgcactcgacaaaaaaaaaccgacccgccacccgccgtaacccgcgcgcccctaacactcaatccccgccatataaaaactcctactcgccctaaccgccttcgcgccgaccgtcgacccgactctaaaaacgcccaaaaactcgatactaaacctcgcgcaacccgaaaccaccaaaatcccaaactcgaccccgaccctacataacaacccgacacaaccgccgacgaaaacaactaacgataaattccccgaccgacgatccgctcccccgcaaaccgactacccgactctcctaccccgtaaaacgatccctccctaacacgcgaacacacgcacacccacgcacactcacaatcatacacactcaccccgcacgcacactcgcactcacgcgcacacacgcgcgcgcactcacacacattcacacacgcgcacacttacactcacacgcgcgcgcattcacacgcatacacacacacgcacactcacacgcgcgtacgcgcacacacaatacacgcgcgcgcacactcacactcacaatacacacacacatatacacactcacactccctcaactccctactaaaaacaataactactaactcgacaa

SEQ ID NO: 21113 - DNA, 736 bp, Artificial Sequence
  chemically treated genomic DNA (Homo sapiens) CpG-island No: 21113
gcgtcggcgttttaattttttcgggatgggcgggggcggggttgagtttcgtttcgtttttcggttttagattttttttcgcgggcgggggatatttattggcgaagggcgaggtggcggtggagttattgaggaagttgggggatttaggtacgtcgaggtcggttacgttcggcgcgtcgtagtcgtttaggttagtttcgaggtcgtcgtcgtagtcgttttgttgcgagtcggggttgggcgcgaattcgcggggggacgcgttgttgtagttgcgcgcgtagtttgcgagagagagcgcggtcgttagggggcggtgtcggtcggggaggggcggtggcggcgttcgaggacggcggggaggcgcggtttacgtattcggttcgggtttcggggtggcgttttcgacggcgatggttagcgggttgttgaaggcgttgatgtttacgacggcggggtgtgggtggttcggggttaggggtgcgagcggttcgggtgcgcggggggtgttgtatagagtttcggttacgttcgtcgcgcgttttaggagtagtttttgcgaagataagagcggggtacggtcggggtagtcgcgggcgtcgcgtgttggggggtttcggtttcggcggcgttgggagggcggaggcgttatatttggttattgtcgggtatttcgtatagggtttttgttaagtcggtcgttcgttttagtagtattttttggggatagggg

SEQ ID NO: 21114 - DNA, 736 bp, Artificial Sequence
  chemically treated genomic DNA (Homo sapiens) CpG-island No: 21114
cccctatccccaaaaaatactactaaaacgaacgaccgacttaacaaaaaccctatacgaaatacccgacaataaccaaatataacgcctccgccctcccaacgccgccgaaaccgaaaccccccaacacgcgacgcccgcgactaccccgaccgtaccccgctcttatcttcgcaaaaactactcctaaaacgcgcgacgaacgtaaccgaaactctatacaacaccccccgcgcacccgaaccgctcgcacccctaaccccgaaccacccacaccccgccgtcgtaaacatcaacgccttcaacaacccgctaaccatcgccgtcgaaaacgccaccccgaaacccgaaccgaatacgtaaaccgcgcctccccgccgtcctcgaacgccgccaccgcccctccccgaccgacaccgccccctaacgaccgcgctctctctcgcaaactacgcgcgcaactacaacaacgcgtccccccgcgaattcgcgcccaaccccgactcgcaacaaaacgactacgacgacgacctcgaaactaacctaaacgactacgacgcgccgaacgtaaccgacctcgacgtacctaaatcccccaacttcctcaataactccaccgccacctcgcccttcgccaataaatatcccccgcccgcgaaaaaaaatctaaaaccgaaaaacgaaacgaaactcaaccccgcccccgcccatcccgaaaaaattaaaacgccgacgc

SEQ ID NO: 21115 - DNA, 736 bp, Artificial Sequence
  chemically treated genomic DNA (Homo sapiens) CpG-island No: 21115
tttttgtttttaggaagtgttgttgaagcgggcggtcgatttggtagaagttttgtacggagtgttcggtagtaattaggtatggcgttttcgtttttttagcgtcgtcgggatcggggttttttagtacgcggcgttcgcggttgtttcggtcgtgtttcgtttttgttttcgtaggagttgtttttgaagcgcgcggcggacgtggtcgaggttttgtatagtatttttcgcgtattcgggtcgttcgtatttttggtttcgagttatttatatttcgtcgtcgtgggtattaacgtttttagtagttcgttggttatcgtcgtcggggacgttatttcggggttcgagtcgggtgcgtgggtcgcgttttttcgtcgttttcgggcgtcgttatcgttttttttcggtcggtatcgttttttgacggtcgcgttttttttcgtaggttacgcgcgtagttgtagtagcgcgttttttcgcgggttcgcgtttagtttcggttcgtagtagagcggttacggcggcggtttcggagttggtttgggcggttacggcgcgtcgggcgtggtcggtttcggcgtgtttgggttttttagtttttttaatggttttatcgttatttcgtttttcgttagtgagtgtttttcgttcgcgagggaaggtttggggtcggggagcggaacgggatttagtttcgttttcgtttatttcggagaggttggggcgtcggcgt

SEQ ID NO: 21116 - DNA, 736 bp, Artificial Sequence
  chemically treated genomic DNA (Homo sapiens) CpG-island No: 21116
acgccgacgccccaacctctccgaaataaacgaaaacgaaactaaatcccgttccgctccccgaccccaaaccttccctcgcgaacgaaaaacactcactaacgaaaaacgaaataacgataaaaccattaaaaaaactaaaaaacccaaacacgccgaaaccgaccacgcccgacgcgccgtaaccgcccaaaccaactccgaaaccgccgccgtaaccgctctactacgaaccgaaactaaacgcgaacccgcgaaaaaacgcgctactacaactacgcgcgtaacctacgaaaaaaaacgcgaccgtcaaaaaacgataccgaccgaaaaaaaacgataacgacgcccgaaaacgacgaaaaaacgcgacccacgcacccgactcgaaccccgaaataacgtccccgacgacgataaccaacgaactactaaaaacgttaatacccacgacgacgaaatataaataactcgaaaccaaaaatacgaacgacccgaatacgcgaaaaatactatacaaaacctcgaccacgtccgccgcgcgcttcaaaaacaactcctacgaaaacaaaaacgaaacacgaccgaaacaaccgcgaacgccgcgtactaaaaaaccccgatcccgacgacgctaaaaaaacgaaaacgccatacctaattactaccgaacactccgtacaaaacttctaccaaatcgaccgcccgcttcaacaacacttcctaaaaacaaaaa

SEQ ID NO: 21117 - DNA, 1666 bp, Artificial Sequence
  chemically treated genomic DNA (Homo sapiens) CpG-island No: 21117
aggcggcgcgtagtcgtttaattcgagcgtatcgggttcggttcgagcgtttatttttgcgtcgcggtgttggcgtttaggatgttcgcgttttgtatttaggagcgtattgagtttaggtcggcgggtagtagcggttttttttttaggtttagttcgttgcggggtagagcgttttgcgtagggaatatgagggcgcgcggtgagtgagcgttttcgtcgtttcggattcggtttcgttgaggttgcgggcgtttagtttagttcgattcgacggtattaggcgtttttagtagcgtagcgtcgagttcgggtggtttagtgcgcgttcgttttttgggcgttttttcggagaaagcgggttcgcgggcgtcggcgttgttttttttttttttggggcgttgggcggggagatggagggattttttcgcggtttgagcgttggcgggcggattgcgagcggggcggggagggcggggagcggagttcgtattcggttcgcgcggaggcgttttagaggcgcgttttggcggttgttcggggtcgcggtcgtcggagggggggttcgagcgtttcgggagttgtttcgggtaaggcgggggcgcggggtcgttcgttttttttttttcgtcgtttttatttttcgttcgttcgttcgttcgcggcgttagcgcggggcgttgattattattcgggaggcggaggttgcgggcgcggagttcggcggcggcggcgatagtggcggtagcggcggtaggagtagtagtagtcgcgcgtttcggggaaaggttggggtcgcgtcgggttagtagacgtcgtcgtcgttagcgttagcgtttcgcgtgtttcggcgtttcggttttgtcgtagtttcgggcggtagtatttggagtagtagtagtagtagttcggtcgatttttttcggggttcggttttcgcgtcgtttcgtcgcggtcgtcgtcgttcgtcgtttttcggggtttggtttcgggttcgggttatttcgtcgtcgtcgtcgtcgtcgtcgtcgttttcgggggagcggtagtcgaagggagggagcgtaggcgggaggagggatgtcgggagcgggcgggtttaggggacgggggttcgggggaggcgggggcggggcggcgcggtcggtcgaggggcggtcggggacgtgatattatcgggggaggagcggtcgggttcgggtcgcggcggcggggcggattttggcgagtcggtcgtttgggttgggggttgcggtttggtcgaggtcgcgggagggaacggaagagttcggcgggggttacggaaattcgcgtagggaggattcggggtcgcgcggcgagggagttcggttcgagcgggaggtgcgcgtttcgttgcgttcgggaattttcgcggttttttcgtcgtcgtcggacgaagtttcggcgttttcgcggttttatttttttttttcggtattcgtcgtatttttcgcgttcgacgttttgtgtttggatttgttgtttattttgacgttttcgagttttcgtttttgacgtttttttttcgcgtgattgtattttcgtattttttcggcgattttgattttatttttattttagttaaggattgaaacgtttttgtcgtaggttgcggttttagataagttgggcgaggtttttgtat

SEQ ID NO: 21118 - DNA, 1666 bp, Artificial Sequence
  chemically treated genomic DNA (Homo sapiens) CpG-island No: 21118
atacaaaaacctcgcccaacttatctaaaaccgcaacctacgacaaaaacgtttcaatccttaactaaaataaaaataaaatcaaaatcgccgaaaaaatacgaaaatacaatcacgcgaaaaaaaaacgtcaaaaacgaaaactcgaaaacgtcaaaataaacaacaaatccaaacacaaaacgtcgaacgcgaaaaatacgacgaataccgaaaaaaaaaaataaaaccgcgaaaacgccgaaacttcgtccgacgacgacgaaaaaaccgcgaaaattcccgaacgcaacgaaacgcgcacctcccgctcgaaccgaactccctcgccgcgcgaccccgaatcctccctacgcgaatttccgtaacccccgccgaactcttccgttccctcccgcgacctcgaccaaaccgcaacccccaacccaaacgaccgactcgccaaaatccgccccgccgccgcgacccgaacccgaccgctcctcccccgataatatcacgtccccgaccgcccctcgaccgaccgcgccgccccgcccccgcctcccccgaacccccgtcccctaaacccgcccgctcccgacatccctcctcccgcctacgctccctcccttcgactaccgctcccccgaaaacgacgacgacgacgacgacgacgacgaaataacccgaacccgaaaccaaaccccgaaaaacgacgaacgacgacgaccgcgacgaaacgacgcgaaaaccgaaccccgaaaaaaatcgaccgaactactactactactactccaaatactaccgcccgaaactacgacaaaaccgaaacgccgaaacacgcgaaacgctaacgctaacgacgacgacgtctactaacccgacgcgaccccaacctttccccgaaacgcgcgactactactactcctaccgccgctaccgccactatcgccgccgccgccgaactccgcgcccgcaacctccgcctcccgaataataatcaacgccccgcgctaacgccgcgaacgaacgaacgaacgaaaaataaaaacgacgaaaaaaaaaaaacgaacgaccccgcgcccccgccttacccgaaacaactcccgaaacgctcgaaccccccctccgacgaccgcgaccccgaacaaccgccaaaacgcgcctctaaaacgcctccgcgcgaaccgaatacgaactccgctccccgccctccccgccccgctcgcaatccgcccgccaacgctcaaaccgcgaaaaaatccctccatctccccgcccaacgccccaaaaaaaaaaaaaacaacgccgacgcccgcgaacccgctttctccgaaaaaacgcccaaaaaacgaacgcgcactaaaccacccgaactcgacgctacgctactaaaaacgcctaataccgtcgaatcgaactaaactaaacgcccgcaacctcaacgaaaccgaatccgaaacgacgaaaacgctcactcaccgcgcgccctcatattccctacgcaaaacgctctaccccgcaacgaactaaacctaaaaaaaaaaccgctactacccgccgacctaaactcaatacgctcctaaatacaaaacgcgaacatcctaaacgccaacaccgcgacgcaaaaataaacgctcgaaccgaacccgatacgctcgaattaaacgactacgcgccgcct

SEQ ID NO: 21119 - DNA, 1666 bp, Artificial Sequence
  chemically treated genomic DNA (Homo sapiens) CpG-island No: 21119
atgtagggatttcgtttagtttgtttggggtcgtagtttacggtagggacgttttagtttttagttggggtgaaagtgaggttagggtcgtcggggaaatgcgggagtatagttacgcgggagaaagacgttaagagcgaaagttcggaggcgttaaaatgagtagtaagtttaggtataaggcgtcgggcgcggagagtacggcgggtgtcgggggagggagatgaggtcgcgaagacgtcggggtttcgttcggcggcgacggggaggtcgcggaggttttcgagcgtagcggggcgcgtatttttcgttcgggtcgggttttttcgtcgcgcggtttcggattttttttgcgcgggttttcgtggttttcgtcgggttttttcgttttttttcgcggtttcgattaggtcgtagtttttagtttaggcgatcgattcgttagggttcgtttcgtcgtcgcggttcgggttcggtcgtttttttttcgatgatgttacgttttcggtcgtttttcggtcggtcgcgtcgtttcgttttcgtttttttcgggttttcgttttttgggttcgttcgttttcgatattttttttttcgtttgcgtttttttttttcggttatcgttttttcgggagcggcggcggcggcggcggcggcggcgggatggttcgggttcgaggttaggtttcggggagcggcgggcggcggcggtcgcggcggggcggcgcgggaatcgggtttcggggggagtcggtcgggttgttgttgttgttgttttaggtgttgtcgttcggggttacggtagggtcgggacgtcggggtacgcggggcgttggcgttggcggcggcggcgtttgttggttcggcgcggttttagttttttttcgggacgcgcggttgttgttgtttttgtcgtcgttgtcgttattgtcgtcgtcgtcgtcgagtttcgcgttcgtagttttcgtttttcggatggtaattagcgtttcgcgttggcgtcgcgggcgggcgggcgggcgggaggtgggggcggcgagggggaaagggcgggcggtttcgcgttttcgttttgttcgaggtagttttcggggcgttcgggtttttttttcgacgatcgcggtttcgggtagtcgttagagcgcgtttttggggcgttttcgcgcggatcgggtgcgggtttcgtttttcgtttttttcgtttcgttcgtagttcgttcgttagcgtttaggtcgcgggggaatttttttattttttcgtttagcgttttaggaggggaggggatagcgtcggcgttcgcggattcgtttttttcgagggagcgtttaagaggcgagcgcgtattgagttattcggattcggcgttgcgttgttggaggcgtttggtgtcgtcgggtcgggttgagttagacgttcgtagttttagcgggatcggattcggggcggcgggggcgtttatttatcgcgcgtttttatgttttttgcgtaggacgttttgtttcgtagcgggttgaatttgaaggaggagtcgttgttgttcgtcggtttgggtttagtgcgtttttggatgtagggcgcgggtattttggacgttagtatcgcggcgtagaggtaagcgttcggatcggattcggtgcgttcgggttggacggttgcgcgtcgttt

SEQ ID NO: 21120 - DNA, 1666 bp, Artificial Sequence
  chemically treated genomic DNA (Homo sapiens) CpG-island No: 21120
aaacgacgcgcaaccgtccaacccgaacgcaccgaatccgatccgaacgcttacctctacgccgcgatactaacgtccaaaatacccgcgccctacatccaaaaacgcactaaacccaaaccgacgaacaacaacgactcctccttcaaattcaacccgctacgaaacaaaacgtcctacgcaaaaaacataaaaacgcgcgataaataaacgcccccgccgccccgaatccgatcccgctaaaactacgaacgtctaactcaacccgacccgacgacaccaaacgcctccaacaacgcaacgccgaatccgaataactcaatacgcgctcgcctcttaaacgctccctcgaaaaaaacgaatccgcgaacgccgacgctatcccctcccctcctaaaacgctaaacgaaaaaataaaaaaattcccccgcgacctaaacgctaacgaacgaactacgaacgaaacgaaaaaaacgaaaaacgaaacccgcacccgatccgcgcgaaaacgccccaaaaacgcgctctaacgactacccgaaaccgcgatcgtcgaaaaaaaaacccgaacgccccgaaaactacctcgaacaaaacgaaaacgcgaaaccgcccgccctttccccctcgccgcccccacctcccgcccgcccgcccgcccgcgacgccaacgcgaaacgctaattaccatccgaaaaacgaaaactacgaacgcgaaactcgacgacgacgacgacaataacgacaacgacgacaaaaacaacaacaaccgcgcgtcccgaaaaaaaactaaaaccgcgccgaaccaacaaacgccgccgccgccaacgccaacgccccgcgtaccccgacgtcccgaccctaccgtaaccccgaacgacaacacctaaaacaacaacaacaacaacccgaccgactccccccgaaacccgattcccgcgccgccccgccgcgaccgccgccgcccgccgctccccgaaacctaacctcgaacccgaaccatcccgccgccgccgccgccgccgccgccgctcccgaaaaaacgataaccgaaaaaaaaaaacgcaaacgaaaaaaaaaatatcgaaaacgaacgaacccaaaaaacgaaaacccgaaaaaaacgaaaacgaaacgacgcgaccgaccgaaaaacgaccgaaaacgtaacatcatcgaaaaaaaaacgaccgaacccgaaccgcgacgacgaaacgaaccctaacgaatcgatcgcctaaactaaaaactacgacctaatcgaaaccgcgaaaaaaaacgaaaaaacccgacgaaaaccacgaaaacccgcgcaaaaaaaatccgaaaccgcgcgacgaaaaaacccgacccgaacgaaaaatacgcgccccgctacgctcgaaaacctccgcgacctccccgtcgccgccgaacgaaaccccgacgtcttcgcgacctcatctccctcccccgacacccgccgtactctccgcgcccgacgccttatacctaaacttactactcattttaacgcctccgaactttcgctcttaacgtctttctcccgcgtaactatactcccgcatttccccgacgaccctaacctcactttcaccccaactaaaaactaaaacgtccctaccgtaaactacgaccccaaacaaactaaacgaaatccctacat

SEQ ID NO: 21121 - DNA, 1102 bp, Artificial Sequence
  chemically treated genomic DNA (Homo sapiens) CpG-island No: 21121
tttattattcgggttcggagcggtttgtttttagtggattagggcgggtgtgttgtcggagtcgttttttattggttatattttcggggattggttgggtttttcgatatttgattgggcggaatagttttttgtacgtcgatattattggagggcgttggagttagggggcggagcgggttttttaggatttttgatcgggcgcgttagttcgttcgttgagtcgggcgcggggcgtaagagcggagttgcgcgagtcgttgcggagggaagggtttttagttaattggggtttttgaggcgaatgcgaggttggggtcggttgtttatcggtcgtttttcgtcgaggtagtttagatttttttttcggcggtgttcgttttaagatagtatttgttaacgttttttttttttttttttttttttgtcgggtcgggtttcgtcggttgcggtcgagaggacgcgggattcggcgcggtgagtttattagttgttaggcgagcggcgaagcggttggagggcggcgagagatatataaagaacgcggtgggcggcggcggcgaaaggggacggtaattttttttcgcgttcgtcggtgttatcgtcggtcgtgtttgtttcgaggtcgcgtagataatgcggtcgggttcgttttcgcgtgttttagagtgcggagcgttcgcgttttttcgattttaatttgatcgtttttcggttcgtttagttttttttcggggtaggggcgtttttttttttcggtggtcggcgaaggaagtcggttcgcggtcgtagatttcggtaatttgcgaatcgggaaaagtttgcggcgttttcgcggggcggcgcgacgcggttcgtttttcgcgttcgcggttatcgcgggtgattttttcgattcgtcgttagtcggggtcgtagcgcggtcggtggggattgcggggcgggtcggagttcgttcgagggttttcgtatttcgggttgcgggtgagtcggttttaggcgtcgtgggtttaagtggtttagggtatttgggtttgggaagaagtcgtggagagagtttttaatattttatggagttggcggggagaataaataaaattgt

SEQ ID NO: 21122 - DNA, 1102 bp, Artificial Sequence
  chemically treated genomic DNA (Homo sapiens) CpG-island No: 21122
acaattttatttattctccccgccaactccataaaatattaaaaactctctccacgacttcttcccaaacccaaataccctaaaccacttaaacccacgacgcctaaaaccgactcacccgcaacccgaaatacgaaaaccctcgaacgaactccgacccgccccgcaatccccaccgaccgcgctacgaccccgactaacgacgaatcgaaaaaatcacccgcgataaccgcgaacgcgaaaaacgaaccgcgtcgcgccgccccgcgaaaacgccgcaaacttttcccgattcgcaaattaccgaaatctacgaccgcgaaccgacttccttcgccgaccaccgaaaaaaaaaaacgcccctaccccgaaaaaaaactaaacgaaccgaaaaacgatcaaattaaaatcgaaaaaacgcgaacgctccgcactctaaaacacgcgaaaacgaacccgaccgcattatctacgcgacctcgaaacaaacacgaccgacgataacaccgacgaacgcgaaaaaaaattaccgtcccctttcgccgccgccgcccaccgcgttctttatatatctctcgccgccctccaaccgcttcgccgctcgcctaacaactaataaactcaccgcgccgaatcccgcgtcctctcgaccgcaaccgacgaaacccgacccgacaaaaaaaaaaaaaaaaaaaaaaaacgttaacaaatactatcttaaaacgaacaccgccgaaaaaaaaatctaaactacctcgacgaaaaacgaccgataaacaaccgaccccaacctcgcattcgcctcaaaaaccccaattaactaaaaacccttccctccgcaacgactcgcgcaactccgctcttacgccccgcgcccgactcaacgaacgaactaacgcgcccgatcaaaaatcctaaaaaacccgctccgccccctaactccaacgccctccaataatatcgacgtacaaaaaactattccgcccaatcaaatatcgaaaaacccaaccaatccccgaaaatataaccaataaaaaacgactccgacaacacacccgccctaatccactaaaaacaaaccgctccgaacccgaataataaa

SEQ ID NO: 21123 - DNA, 1102 bp, Artificial Sequence
  chemically treated genomic DNA (Homo sapiens) CpG-island No: 21123
gtaattttatttgtttttttcgttagttttataaagtattaaaggttttttttacgatttttttttaagtttaggtgttttaaattatttgagtttacggcgtttaaagtcgatttattcgtagttcgaggtgcgggagttttcggacggatttcggttcgtttcgtagtttttatcggtcgcgttgcggtttcggttgacgacgagtcgagaaagttattcgcgatgatcgcggacgcgaggggcgggtcgcgtcgcgtcgtttcgcggaggcgtcgtaaatttttttcggttcgtaagttgtcgggatttgcggtcgcggatcgatttttttcgtcggttatcggagggagggggcgtttttatttcgggagggggttgggcgagtcgggagacggttaagttggggtcgggggagcgcgggcgtttcgtattttggggtacgcggggacgagttcggtcgtattgtttgcgcggtttcggaataagtacggtcggcggtggtatcggcgggcgcggggaggagttgtcgttttttttcgtcgtcgtcgtttatcgcgttttttgtgtgtttttcgtcgttttttagtcgtttcgtcgttcgtttgatagttgatgggtttatcgcgtcgggtttcgcgttttttcggtcgtagtcggcggagttcggttcggtaggaggaggaggggagaagaggagcgttgatagatgttgttttggagcgggtatcgtcgggggaaaagtttggattgtttcggcgagaagcggtcggtaggtaatcggttttagtttcgtattcgttttaaagattttaattggttaggagttttttttttcgtagcggttcgcgtagtttcgtttttgcgtttcgcgttcggtttagcggacggattagcgcgttcggttaagaattttggggaattcgtttcgttttttggttttagcgttttttaatgatgtcggcgtatagagggttgtttcgtttaattaggtgtcggaaagtttagttagttttcgggagtgtagttaatagaaggcgatttcggtaatatattcgttttgatttattaggaataaatcgtttcgagttcgggtggtggg

SEQ ID NO: 21124 - DNA, 1102 bp, Artificial Sequence
  chemically treated genomic DNA (Homo sapiens) CpG-island No: 21124
cccaccacccgaactcgaaacgatttattcctaataaatcaaaacgaatatattaccgaaatcgccttctattaactacactcccgaaaactaactaaactttccgacacctaattaaacgaaacaaccctctatacgccgacatcattaaaaaacgctaaaaccaaaaaacgaaacgaattccccaaaattcttaaccgaacgcgctaatccgtccgctaaaccgaacgcgaaacgcaaaaacgaaactacgcgaaccgctacgaaaaaaaaaactcctaaccaattaaaatctttaaaacgaatacgaaactaaaaccgattacctaccgaccgcttctcgccgaaacaatccaaacttttcccccgacgatacccgctccaaaacaacatctatcaacgctcctcttctcccctcctcctcctaccgaaccgaactccgccgactacgaccgaaaaaacgcgaaacccgacgcgataaacccatcaactatcaaacgaacgacgaaacgactaaaaaacgacgaaaaacacacaaaaaacgcgataaacgacgacgacgaaaaaaaacgacaactcctccccgcgcccgccgataccaccgccgaccgtacttattccgaaaccgcgcaaacaatacgaccgaactcgtccccgcgtaccccaaaatacgaaacgcccgcgctcccccgaccccaacttaaccgtctcccgactcgcccaaccccctcccgaaataaaaacgccccctccctccgataaccgacgaaaaaaatcgatccgcgaccgcaaatcccgacaacttacgaaccgaaaaaaatttacgacgcctccgcgaaacgacgcgacgcgacccgcccctcgcgtccgcgatcatcgcgaataactttctcgactcgtcgtcaaccgaaaccgcaacgcgaccgataaaaactacgaaacgaaccgaaatccgtccgaaaactcccgcacctcgaactacgaataaatcgactttaaacgccgtaaactcaaataatttaaaacacctaaacttaaaaaaaaatcgtaaaaaaaacctttaatactttataaaactaacgaaaaaaacaaataaaattac

SEQ ID NO: 21125 - DNA, 684 bp, Artificial Sequence
  chemically treated genomic DNA (Homo sapiens) CpG-island No: 21125
ttatagggcgcgtcgtagttagaggggcgttggtcgtttatttggtatatcggtttcggatttgcggaaaatagggtttagcgggcggcgtcggaggcgggtaaggggcgattttttcgtagatgcgcgttttttacgtttatttattcgtgcgagtcgtgttacgtttttttttagtcggattttcgcgcggggttcgttatgcgcgtttgtttcgggcgtttttgtttaggtttcgttggttttcgggtgttcgtttggcgttttttttttttttattcgttgtttttttttatttcggcgttagtttacgtcgttcgtttttttttttttttttttttttttttagtttttttcgttttttttttattcgttttttttttttttttttttttggtttatttttttttcgtttttttttcgtttttttagtcgtttttttgcgggttttttttttcgcgtcgggtttggtttagttaggagtcggatacgtttgttcgcggggcgttcgaggttcgagtttttataggaagtcggttgggcgcgtttttttcgcgttttcggagcggggttttagttttttcgattttttgttttttgaggttcggagattcgcgggttgtacgtttttttttgtttgtttaaattttgtaaaagtttttggaaaattaggagaaagagaga

SEQ ID NO: 21126 - DNA, 684 bp, Artificial Sequence
  chemically treated genomic DNA (Homo sapiens) CpG-island No: 21126
tctctctttctcctaattttccaaaaacttttacaaaatttaaacaaacaaaaaaaaacgtacaacccgcgaatctccgaacctcaaaaaacaaaaaatcgaaaaaactaaaaccccgctccgaaaacgcgaaaaaaacgcgcccaaccgacttcctataaaaactcgaacctcgaacgccccgcgaacaaacgtatccgactcctaactaaaccaaacccgacgcgaaaaaaaaaacccgcaaaaaaacgactaaaaaaacgaaaaaaaaacgaaaaaaaaataaaccaaaaaaaaaaaaaaaaaaaaaacgaataaaaaaaaaacgaaaaaaactaaaaaaaaaaaaaaaaaaaaaaaaaaacgaacgacgtaaactaacgccgaaataaaaaaaaacaacgaataaaaaaaaaaaaaacgccaaacgaacacccgaaaaccaacgaaacctaaacaaaaacgcccgaaacaaacgcgcataacgaaccccgcgcgaaaatccgactaaaaaaaaacgtaacacgactcgcacgaataaataaacgtaaaaaacgcgcatctacgaaaaaatcgccccttacccgcctccgacgccgcccgctaaaccctattttccgcaaatccgaaaccgatataccaaataaacgaccaacgcccctctaactacgacgcgccctataa

SEQ ID NO: 21127 - DNA, 684 bp, Artificial Sequence
  chemically treated genomic DNA (Homo sapiens) CpG-island No: 21127
ttttttttttttttgattttttagaaatttttgtagagtttggataggtaaaggaaaacgtgtagttcgcggattttcgggttttagagagtagggagtcggggagattgaggtttcgtttcgagagcgcggaggaagcgcgtttagtcggttttttgtgggggttcgggtttcgggcgtttcgcggatagacgtgttcggtttttggttgggttaagttcggcgcgggggaggggattcgtagaggggcgattgagaaggcgaggagggggcggggagagggtgggttagggaagaggggaggggagaggcgagtaggggaggagcgaggggggttggagggagagaaggaagaaggaaggggcgaacggcgtgagttggcgtcgaaatgggagaaagtagcgagtgagaggggaaggggcgttaggcgagtattcgggagttagcgggatttgggtaggggcgttcggagtaggcgcgtatggcgggtttcgcgcggggattcggttggaagagagcgtagtacggttcgtacgagtgagtggacgtgggaggcgcgtatttgcgggggaatcgttttttgttcgttttcggcgtcgttcgttgagttttgtttttcgtaggttcggggtcgatgtattaggtgagcggttagcgtttttttggttgcgacgcgttttatgg

SEQ ID NO: 21128 - DNA, 684 bp, Artificial Sequence
  chemically treated genomic DNA (Homo sapiens) CpG-island No: 21128
ccataaaacgcgtcgcaaccaaaaaaacgctaaccgctcacctaatacatcgaccccgaacctacgaaaaacaaaactcaacgaacgacgccgaaaacgaacaaaaaacgattcccccgcaaatacgcgcctcccacgtccactcactcgtacgaaccgtactacgctctcttccaaccgaatccccgcgcgaaacccgccatacgcgcctactccgaacgcccctacccaaatcccgctaactcccgaatactcgcctaacgccccttcccctctcactcgctactttctcccatttcgacgccaactcacgccgttcgccccttccttcttccttctctccctccaacccccctcgctcctcccctactcgcctctcccctcccctcttccctaacccaccctctccccgccccctcctcgccttctcaatcgcccctctacgaatcccctcccccgcgccgaacttaacccaaccaaaaaccgaacacgtctatccgcgaaacgcccgaaacccgaacccccacaaaaaaccgactaaacgcgcttcctccgcgctctcgaaacgaaacctcaatctccccgactccctactctctaaaacccgaaaatccgcgaactacacgttttcctttacctatccaaactctacaaaaatttctaaaaaatcaaaaaaaaaaaaaa

SEQ ID NO: 21129 - DNA, 617 bp, Artificial Sequence
  chemically treated genomic DNA (Homo sapiens) CpG-island No: 21129
cgcgtgtcgtatttattcgtggagggtgggagatagcggtcgttttagcgtttagcggtggttcgggatagtgtggttaggttcgcggatagttttttttttttcggtatcggttagtttaggtcgcgcgtttttttttttcggttttttggtggcggtttcgttttcgtcggtttggtcgttttgttttcgtttttacgtttttttttttttcgttttttcgggttgtaataggtgttttcggagtaggaagttcgcgtcgtcgtcgtcgtcgtcgtttagttttttcgggcgcgtttaggattcgttgcgttaggcgcgtcgttttcggattcggcgtgcgtttttacgaggaaagggatttcgtcgttcgagtcgttttcgttagttttattgcgaggggttttagagttagtcgcgttcgttttcgttttcggtttcgtagttttttcgttttgcgcgttatgaacgttttcgagcggtagttttaattcgacggcggggacgttttaggttacgagtttgggggtagtttttaagacgagtttgatttttttatttttttcgattatgagtatttgaattcgaacgaaggtcggtggaggttatttttggtt

SEQ ID NO: 21130 - DNA, 617 bp, Artificial Sequence
  chemically treated genomic DNA (Homo sapiens) CpG-island No: 21130
aaccaaaaataacctccaccgaccttcgttcgaattcaaatactcataatcgaaaaaaataaaaaaatcaaactcgtcttaaaaactacccccaaactcgtaacctaaaacgtccccgccgtcgaattaaaactaccgctcgaaaacgttcataacgcgcaaaacgaaaaaactacgaaaccgaaaacgaaaacgaacgcgactaactctaaaacccctcgcaataaaactaacgaaaacgactcgaacgacgaaatccctttcctcgtaaaaacgcacgccgaatccgaaaacgacgcgcctaacgcaacgaatcctaaacgcgcccgaaaaaactaaacgacgacgacgacgacgacgcgaacttcctactccgaaaacacctattacaacccgaaaaaacgaaaaaaaaaaaaacgtaaaaacgaaaacaaaacgaccaaaccgacgaaaacgaaaccgccaccaaaaaaccgaaaaaaaaaaacgcgcgacctaaactaaccgataccgaaaaaaaaaaaactatccgcgaacctaaccacactatcccgaaccaccgctaaacgctaaaacgaccgctatctcccaccctccacgaataaatacgacacgcg

SEQ ID NO: 21131 - DNA, 617 bp, Artificial Sequence
  chemically treated genomic DNA (Homo sapiens) CpG-island No: 21131
ggttaggggtagtttttatcgattttcgttcggatttaaatatttatagtcgaagaggatggagaagttaagttcgttttgggggttgtttttaggttcgtggtttggggcgttttcgtcgtcgggttggggttgtcgttcgggggcgtttatggcgcgtagggcgggaaggttgcggggtcgggggcgagggcgggcgcggttggttttgggatttttcgtagtggggttggcggaggcggttcgagcggcggggttttttttttcgtagggacgtacgtcgggttcggggacggcgcgtttggcgtagcgggttttggacgcgttcggggaagttgagcggcggcggcgacggcggcgcgagttttttgtttcggaggtatttgttgtagttcggggaggcggggggggggggggcgtggaggcggggatagggcggttaggtcggcgggggcggggtcgttattaggggatcggaggggaggggcgcgcggtttgggttggtcggtgtcgggaggaaggaggttgttcgcggatttgattatattgtttcgggttatcgttgggcgttggggcggtcgttgttttttattttttacgggtgagtgcgatacgcg

SEQ ID NO: 21132 - DNA, 617 bp, Artificial Sequence
  chemically treated genomic DNA (Homo sapiens) CpG-island No: 21132
cgcgtatcgcactcacccgtaaaaaataaaaaacaacgaccgccccaacgcccaacgataacccgaaacaatataatcaaatccgcgaacaacctccttcctcccgacaccgaccaacccaaaccgcgcgcccctcccctccgatcccctaataacgaccccgcccccgccgacctaaccgccctatccccgcctccacgccccccccccccccgcctccccgaactacaacaaatacctccgaaacaaaaaactcgcgccgccgtcgccgccgccgctcaacttccccgaacgcgtccaaaacccgctacgccaaacgcgccgtccccgaacccgacgtacgtccctacgaaaaaaaaaaccccgccgctcgaaccgcctccgccaaccccactacgaaaaatcccaaaaccaaccgcgcccgccctcgcccccgaccccgcaaccttcccgccctacgcgccataaacgcccccgaacgacaaccccaacccgacgacgaaaacgccccaaaccacgaacctaaaaacaacccccaaaacgaacttaacttctccatcctcttcgactataaatatttaaatccgaacgaaaatcgataaaaactacccctaacc

SEQ ID NO: 21133 - DNA, 746 bp, Artificial Sequence
  chemically treated genomic DNA (Homo sapiens) CpG-island No: 21133
ggtgtcggtggcgggggattttggttggtgattggggaatatttagggaacgcgggagggtattcggagtaaagtttttaattggatagagcggggtcgggtttcgaggggcgggagcgttttcggtaggggtgtttaagcgagtcgtgatttttgattcgtcggagaggttttaggtttaggcgttattgcggattcgggttttgtttgttttgttttttttcgcgtaggcgcggtcggcggtagtttttatggtgacgggggcgcgttttcgttcgaggtttcgtttttagtaggttaggttgcgcggggttgcgggtttttagggtaggtgtcgcgggttgcgggtaggtggcggcgcggcgcgggttggcggtggttttacggtaggttgcgtagcggttgcgggtagtgggggtcggttggtcgttttttgttttcggtcgacgaggtagttgggggtgacggcggttggcgagggtcgttaagtttttgttcggtcgaggtttcgggagaaaagttggtaaagttggtcggggaagaggcggggagtcggaggatttttttagatttcgggtttgtagggagggaggatttcggtttgggagtcggggaattcgtttttcgagatttgagagtggatttcgcgggaagatttcgtatagggtaattaatggattacgtgttatttggttggcgatttgggagtcgatttttggaggggatcgggcgttggaggtttgggg

SEQ ID NO: 21134 - DNA, 746 bp, Artificial Sequence
  chemically treated genomic DNA (Homo sapiens) CpG-island No: 21134
ccccaaacctccaacgcccgatcccctccaaaaatcgactcccaaatcgccaaccaaataacacgtaatccattaattaccctatacgaaatcttcccgcgaaatccactctcaaatctcgaaaaacgaattccccgactcccaaaccgaaatcctccctccctacaaacccgaaatctaaaaaaatcctccgactccccgcctcttccccgaccaactttaccaacttttctcccgaaacctcgaccgaacaaaaacttaacgaccctcgccaaccgccgtcacccccaactacctcgtcgaccgaaaacaaaaaacgaccaaccgacccccactacccgcaaccgctacgcaacctaccgtaaaaccaccgccaacccgcgccgcgccgccacctacccgcaacccgcgacacctaccctaaaaacccgcaaccccgcgcaacctaacctactaaaaacgaaacctcgaacgaaaacgcgcccccgtcaccataaaaactaccgccgaccgcgcctacgcgaaaaaaaacaaaacaaacaaaacccgaatccgcaataacgcctaaacctaaaacctctccgacgaatcaaaaatcacgactcgcttaaacacccctaccgaaaacgctcccgcccctcgaaacccgaccccgctctatccaattaaaaactttactccgaataccctcccgcgttccctaaatattccccaatcaccaaccaaaatcccccgccaccgacacc

SEQ ID NO: 21135 - DNA, 746 bp, Artificial Sequence
  chemically treated genomic DNA (Homo sapiens) CpG-island No: 21135
ttttaggtttttagcgttcgattttttttagggatcgatttttaagtcgttaattaggtggtacgtgatttattggttgttttgtgcgggattttttcgcgggatttatttttaagtttcgggagacggatttttcggtttttaaatcgggattttttttttttgtagattcggagtttggggaaatttttcggtttttcgtttttttttcggttaattttgttaatttttttttcggggtttcggtcgggtagaaatttggcggttttcgttagtcgtcgttatttttagttatttcgtcggtcggggataggaggcggttagtcggtttttattgttcgtagtcgttgcgtaatttatcgtggagttatcgttagttcgcgtcgcgtcgttatttgttcgtagttcgcggtatttgttttgggagttcgtagtttcgcgtagtttagtttgttgggggcggggtttcgagcggggacgcgttttcgttattatgggaattgtcgtcggtcgcgtttgcgcggaggggagtagagtaggtaggattcgagttcgtagtggcgtttgggtttgggattttttcggcgggttagaggttacgattcgtttggatatttttgtcggaagcgttttcgtttttcgaggttcgatttcgttttgtttaattgggaattttgtttcgggtattttttcgcgttttttggatgttttttagttattagttaggatttttcgttatcggtatt

SEQ ID NO: 21136 - DNA, 746 bp, Artificial Sequence
  chemically treated genomic DNA (Homo sapiens) CpG-island No: 21136
aataccgataacgaaaaatcctaactaataactaaaaaacatccaaaaaacgcgaaaaaatacccgaaacaaaattcccaattaaacaaaacgaaatcgaacctcgaaaaacgaaaacgcttccgacaaaaatatccaaacgaatcgtaacctctaacccgccgaaaaaatcccaaacccaaacgccactacgaactcgaatcctacctactctactcccctccgcgcaaacgcgaccgacgacaattcccataataacgaaaacgcgtccccgctcgaaaccccgcccccaacaaactaaactacgcgaaactacgaactcccaaaacaaataccgcgaactacgaacaaataacgacgcgacgcgaactaacgataactccacgataaattacgcaacgactacgaacaataaaaaccgactaaccgcctcctatccccgaccgacgaaataactaaaaataacgacgactaacgaaaaccgccaaatttctacccgaccgaaaccccgaaaaaaaaattaacaaaattaaccgaaaaaaaaacgaaaaaccgaaaaatttccccaaactccgaatctacaaaaaaaaaaaatcccgatttaaaaaccgaaaaatccgtctcccgaaacttaaaaataaatcccgcgaaaaaatcccgcacaaaacaaccaataaatcacgtaccacctaattaacgacttaaaaatcgatccctaaaaaaaatcgaacgctaaaaacctaaaa

SEQ ID NO: 21137 - DNA, 749 bp, Artificial Sequence
  chemically treated genomic DNA (Homo sapiens) CpG-island No: 21137
tacggtttttttcggcggcgtatttatttgtagttgggtttggttggcgttgttcgcggtcgcgtcgggttcgtcggcggttttcgagtcgcgtagtacggtgatgtgtagcgtgagtagtagtagttttagtagtagtagtagttcggtcgttaggcgtattatttttttgagacgcgcggttttaggattcggcgcggcggtcggcggcggcggcggtgacgtcgggggaggaggagtaggagttcgggagttcggtagcgcggttttcgtttcggttttcgttagggtttcgtttttcgggttcgcggggttggcgttgggcgcggcggggtgtgcggggtcgggggagtaggagttgtcggcgtcgtcgtcgtcgtcgtcgtcgtattacggcggagttatcgcgaggtcgggggtgtttaagtcggttgcggagtaagtttcggcgttgtttggcggcggcggcggcggagacggagattgggtttcgggatagttcgggattcgggtcgggtcggaggttattttgttggtagggggttgcggggtcggcggcggggcgggcgtagtcgagttttcgagcgtatatgggcgttttagatgtggtcgcggcgtcgtagttggagcgggagcggtcgttagagaagcgcggggaggaggaggaggagaaggagaaggaggaggaggaggaggaggaggaggaggaggaggaggaggagtaggagggttttagttgcggtcgggag

SEQ ID NO: 21138 - DNA, 749 bp, Artificial Sequence
  chemically treated genomic DNA (Homo sapiens) CpG-island No: 21138
ctcccgaccgcaactaaaaccctcctactcctcctcctcctcctcctcctcctcctcctcctcctcctccttctccttctcctcctcctcctccccgcgcttctctaacgaccgctcccgctccaactacgacgccgcgaccacatctaaaacgcccatatacgctcgaaaactcgactacgcccgccccgccgccgaccccgcaaccccctaccaacaaaataacctccgacccgacccgaatcccgaactatcccgaaacccaatctccgtctccgccgccgccgccgccaaacaacgccgaaacttactccgcaaccgacttaaacacccccgacctcgcgataactccgccgtaatacgacgacgacgacgacgacgacgccgacaactcctactcccccgaccccgcacaccccgccgcgcccaacgccaaccccgcgaacccgaaaaacgaaaccctaacgaaaaccgaaacgaaaaccgcgctaccgaactcccgaactcctactcctcctcccccgacgtcaccgccgccgccgccgaccgccgcgccgaatcctaaaaccgcgcgtctcaaaaaaataatacgcctaacgaccgaactactactactactaaaactactactactcacgctacacatcaccgtactacgcgactcgaaaaccgccgacgaacccgacgcgaccgcgaacaacgccaaccaaacccaactacaaataaatacgccgccgaaaaaaaccgta

SEQ ID NO: 21139 - DNA, 749 bp, Artificial Sequence
  chemically treated genomic DNA (Homo sapiens) CpG-island No: 21139
ttttcggtcgtagttgaagtttttttattttttttttttttttttttttttttttttttttttttttttttttttttttttttttttttttttttcgcgtttttttggcggtcgttttcgttttagttgcggcgtcgcggttatatttggggcgtttatgtgcgttcgggggttcggttgcgttcgtttcgtcgtcgatttcgtagttttttgttagtagggtggttttcggttcggttcgggtttcgggttgtttcgggatttagttttcgttttcgtcgtcgtcgtcgttaggtagcgtcggggtttgtttcgtagtcggtttggatattttcggtttcgcggtggtttcgtcgtggtgcggcggcggcggcggcggcggcgtcggtagtttttgttttttcggtttcgtatatttcgtcgcgtttagcgttagtttcgcgggttcgggaagcggagttttggcgggagtcgaggcgggagtcgcgttgtcgggttttcgggtttttattttttttttttcggcgttatcgtcgtcgtcgtcggtcgtcgcgtcgggttttaaagtcgcgcgttttaaaaggatggtgcgtttggcggtcgagttgttgttgttgttggggttgttgttgtttacgttgtatattatcgtgttgcgcggttcgggagtcgtcgacgggttcgacgcggtcgcgggtaacgttagttaagtttagttgtaggtgagtgcgtcgtcggagagggtcgtg

SEQ ID NO: 21140 - DNA, 749 bp, Artificial Sequence
  chemically treated genomic DNA (Homo sapiens) CpG-island No: 21140
cacgaccctctccgacgacgcactcacctacaactaaacttaactaacgttacccgcgaccgcgtcgaacccgtcgacgactcccgaaccgcgcaacacgataatatacaacgtaaacaacaacaaccccaacaacaacaacaactcgaccgccaaacgcaccatccttttaaaacgcgcgactttaaaacccgacgcgacgaccgacgacgacgacgataacgccgaaaaaaaaaaaataaaaacccgaaaacccgacaacgcgactcccgcctcgactcccgccaaaactccgcttcccgaacccgcgaaactaacgctaaacgcgacgaaatatacgaaaccgaaaaaacaaaaactaccgacgccgccgccgccgccgccgccgcaccacgacgaaaccaccgcgaaaccgaaaatatccaaaccgactacgaaacaaaccccgacgctacctaacgacgacgacgacgaaaacgaaaactaaatcccgaaacaacccgaaacccgaaccgaaccgaaaaccaccctactaacaaaaaactacgaaatcgacgacgaaacgaacgcaaccgaacccccgaacgcacataaacgccccaaatataaccgcgacgccgcaactaaaacgaaaacgaccgccaaaaaaacgcgaaaaaaaaaaaaaaaaaaaaaaaaaaaaaaaaaaaaaaaaaaaaaaaaaaaaaaaaaaaaaaaaaaaataaaaaaacttcaactacgaccgaaaa

SEQ ID NO: 21141 - DNA, 653 bp, Artificial Sequence
  chemically treated genomic DNA (Homo sapiens) CpG-island No: 21141
ggttttcggtttgtttcgtagcgtttgttcggtcgttttgtttagttattttttgtattttgttttttttttcggtttagggcgagtatgtttacggcgtgggcgacgagtaggagtaggtagagtggcgttcgtatttgggtagtcggattcgggttggcgttttttaggcggttcgacggtttaagggttttacgtttcggcggcggtacggcgggcgcgggggttgttgtgggcgcgtcgggcgtattcgttaggcgcgggtcggttcggtcgttaggtttagtgagggcgttggcggagtcggggtattgttttggcggggaggagtcggcgcggcgggggcggcgcgttaattagttcggggttcgggagcgcgcgcggggagggggcgggggttattcgggtcggggttttcgagttcgatttgtttcgtagtcggcggttttgcgtttttttcgtttttagtattgttttcgagtacgtgtacgtgtttatcgttagttataggtacgtacgcgcgcgtaggtatagatgcgcggatattcggagattcgtacggtttttcgcgtttttttagcgtttgtgattttttttttttttttttagttttttttttttgtttgtttttttttttggtttttaaggataat

SEQ ID NO: 21142 - DNA, 653 bp, Artificial Sequence
  chemically treated genomic DNA (Homo sapiens) CpG-island No: 21142
attatccttaaaaaccaaaaaaaaaaacaaacaaaaaaaaaaaactaaaaaaaaaaaaaaaaaatcacaaacgctaaaaaaacgcgaaaaaccgtacgaatctccgaatatccgcgcatctatacctacgcgcgcgtacgtacctataactaacgataaacacgtacacgtactcgaaaacaatactaaaaacgaaaaaaacgcaaaaccgccgactacgaaacaaatcgaactcgaaaaccccgacccgaataacccccgccccctccccgcgcgcgctcccgaaccccgaactaattaacgcgccgcccccgccgcgccgactcctccccgccaaaacaataccccgactccgccaacgccctcactaaacctaacgaccgaaccgacccgcgcctaacgaatacgcccgacgcgcccacaacaacccccgcgcccgccgtaccgccgccgaaacgtaaaacccttaaaccgtcgaaccgcctaaaaaacgccaacccgaatccgactacccaaatacgaacgccactctacctactcctactcgtcgcccacgccgtaaacatactcgccctaaaccgaaaaaaaaaacaaaatacaaaaaataactaaacaaaacgaccgaacaaacgctacgaaacaaaccgaaaacc

SEQ ID NO: 21143 - DNA, 653 bp, Artificial Sequence
  chemically treated genomic DNA (Homo sapiens) CpG-island No: 21143
gttgtttttaagggttagaaggaggaatagatagagaaaggggattggggggagggaaagaaaattataggcgttgagagggcgcgggggatcgtacgggttttcgggtgttcgcgtatttgtatttgcgcgcgcgtgcgtatttgtggttggcggtgggtacgtgtacgtgttcgggggtagtgttgggggcgggaaagacgtaagatcgtcggttgcgggatagatcgaattcgagggtttcgattcgggtgattttcgtttttttttcgcgcgcgttttcgggtttcgagttggttaacgcgtcgttttcgtcgcgtcggttttttttcgttagggtagtgtttcggtttcgttaacgtttttattagatttggcggtcggatcgattcgcgtttggcggatgcgttcggcgcgtttatagtagttttcgcgttcgtcgtgtcgtcgtcgggacgtggggtttttgggtcgtcgggtcgtttggggagcgttagttcggattcggttgtttagatgcgggcgttattttgtttgtttttgttcgtcgtttacgtcgtggatatgttcgttttgaatcgaaggaagaagtaaggtataaggggtggttgggtagggcggtcgggtaggcgttgcggggtagatcgggggtt

SEQ ID NO: 21144 - DNA, 653 bp, Artificial Sequence
  chemically treated genomic DNA (Homo sapiens) CpG-island No: 21144
aacccccgatctaccccgcaacgcctacccgaccgccctacccaaccaccccttataccttacttcttccttcgattcaaaacgaacatatccacgacgtaaacgacgaacaaaaacaaacaaaataacgcccgcatctaaacaaccgaatccgaactaacgctccccaaacgacccgacgacccaaaaaccccacgtcccgacgacgacacgacgaacgcgaaaactactataaacgcgccgaacgcatccgccaaacgcgaatcgatccgaccgccaaatctaataaaaacgttaacgaaaccgaaacactaccctaacgaaaaaaaaccgacgcgacgaaaacgacgcgttaaccaactcgaaacccgaaaacgcgcgcgaaaaaaaaacgaaaatcacccgaatcgaaaccctcgaattcgatctatcccgcaaccgacgatcttacgtctttcccgcccccaacactacccccgaacacgtacacgtacccaccgccaaccacaaatacgcacgcgcgcgcaaatacaaatacgcgaacacccgaaaacccgtacgatcccccgcgccctctcaacgcctataattttctttccctccccccaatcccctttctctatctattcctccttctaacccttaaaaacaac

SEQ ID NO: 21145 - DNA, 809 bp, Artificial Sequence
  chemically treated genomic DNA (Homo sapiens) CpG-island No: 21145
tttttttaggttgggtaaggtgttgacggagaggttgacggcggtgacggttacgaagagtatcgataggtaggcgaatattttgttaggtagtttcgagtgcggtttttttattatgtcgcgtagtcgtcgtatgtagcgttttaggcggttttcgttttcggtcgggttttcgttgtcgcggttttcgttgtttagcgcgtcgttttttttttttcgttttattattttcgcgaattttttaattttttgtaggtagcggcgtttgtagtagtcgtttaggtggtttttcgcgatgttttagtatagtagttttttttggaaggatagcgcgtatatttcgcgtagtagtcgtagtttgttcgcgcgtaggaaggttaggatagtgtcgaaggttttcgggttgcggtcgaagaagaattcgttgtaggtgacgtcgtagttatcgtatacgttgaggatgtcgtcgaagttggtgtaggttttgagttggtttaggcgcgttagcgggaattcgtttagcgtggtttagggtagcgagtatttgatgtcgtttacgttgatgatgattcgacggcggcggttttcgggttgatagttttggcggggtttattttgcggtcgtagtcgttgcgttcggcggtagaacgcgtttttgatggtttggcgttgcgggaggaaggtcgggtggaaggaggcgttcgaggtgtagtttagcgcgttgtagtcgtagttagaattgtttttcggtaagagggttattttgggtttttatatttttttcgggtttgtggggagaagggagggaa

SEQ ID NO: 21146 - DNA, 809 bp, Artificial Sequence
  chemically treated genomic DNA (Homo sapiens) CpG-island No: 21146
ttccctcccttctccccacaaacccgaaaaaaatataaaaacccaaaataaccctcttaccgaaaaacaattctaactacgactacaacgcgctaaactacacctcgaacgcctccttccacccgaccttcctcccgcaacgccaaaccatcaaaaacgcgttctaccgccgaacgcaacgactacgaccgcaaaataaaccccgccaaaactatcaacccgaaaaccgccgccgtcgaatcatcatcaacgtaaacgacatcaaatactcgctaccctaaaccacgctaaacgaattcccgctaacgcgcctaaaccaactcaaaacctacaccaacttcgacgacatcctcaacgtatacgataactacgacgtcacctacaacgaattcttcttcgaccgcaacccgaaaaccttcgacactatcctaaccttcctacgcgcgaacaaactacgactactacgcgaaatatacgcgctatccttccaaaaaaaactactatactaaaacatcgcgaaaaaccacctaaacgactactacaaacgccgctacctacaaaaaattaaaaaattcgcgaaaataataaaacgaaaaaaaaaaaacgacgcgctaaacaacgaaaaccgcgacaacgaaaacccgaccgaaaacgaaaaccgcctaaaacgctacatacgacgactacgcgacataataaaaaaaccgcactcgaaactacctaacaaaatattcgcctacctatcgatactcttcgtaaccgtcaccgccgtcaacctctccgtcaacaccttacccaacctaaaaaaa

SEQ ID NO: 21147 - DNA, 809 bp, Artificial Sequence
  chemically treated genomic DNA (Homo sapiens) CpG-island No: 21147
tttttttttttttttttataggttcgagagggatgtgaaggtttaaaatgatttttttatcgggagataattttgattacgattatagcgcgttgagttgtatttcggacgtttttttttattcggtttttttttcgtagcgttaggttattaagggcgcgttttatcgtcgggcgtagcggttgcggtcgtaggatgagtttcgttagggttgttagttcgaggatcgtcgtcgtcggattattattaacgtaggcggtattaagtattcgttgttttggattacgttggacgagttttcgttgacgcgtttgggttagtttaaggtttgtattaatttcgacgatatttttaacgtgtgcgatgattacgacgttatttgtaacgagttttttttcgatcgtaattcgggggttttcggtattattttgatttttttgcgcgcgggtaagttgcggttgttgcgcgagatgtgcgcgttgtttttttaggaggagttgttgtattggggtatcgcggaggattatttggacggttgttgtaagcgtcgttatttgtagaagattgaggagttcgcggagatggtggagcgggaggaagaggacgacgcgttggatagcgagggtcgcgatagcgagggttcggtcgagggcgagggtcgtttggggcgttgtatgcggcgattgcgcgatatggtggagaggtcgtattcggggttgtttggtaaggtgttcgtttgtttgtcggtgtttttcgtgatcgttatcgtcgttaattttttcgttagtattttgtttagtttgagggag

SEQ ID NO: 21148 - DNA, 809 bp, Artificial Sequence
  chemically treated genomic DNA (Homo sapiens) CpG-island No: 21148
ctccctcaaactaaacaaaatactaacgaaaaaattaacgacgataacgatcacgaaaaacaccgacaaacaaacgaacaccttaccaaacaaccccgaatacgacctctccaccatatcgcgcaatcgccgcatacaacgccccaaacgaccctcgccctcgaccgaaccctcgctatcgcgaccctcgctatccaacgcgtcgtcctcttcctcccgctccaccatctccgcgaactcctcaatcttctacaaataacgacgcttacaacaaccgtccaaataatcctccgcgataccccaatacaacaactcctcctaaaaaaacaacgcgcacatctcgcgcaacaaccgcaacttacccgcgcgcaaaaaaatcaaaataataccgaaaacccccgaattacgatcgaaaaaaaactcgttacaaataacgtcgtaatcatcgcacacgttaaaaatatcgtcgaaattaatacaaaccttaaactaacccaaacgcgtcaacgaaaactcgtccaacgtaatccaaaacaacgaatacttaataccgcctacgttaataataatccgacgacgacgatcctcgaactaacaaccctaacgaaactcatcctacgaccgcaaccgctacgcccgacgataaaacgcgcccttaataacctaacgctacgaaaaaaaaaccgaataaaaaaaaacgtccgaaatacaactcaacgcgctataatcgtaatcaaaattatctcccgataaaaaaatcattttaaaccttcacatccctctcgaacctataaaaaaaaaaaaaaaaa

SEQ ID NO: 21149 - DNA, 831 bp, Artificial Sequence
  chemically treated genomic DNA (Homo sapiens) CpG-island No: 21149
gcgtatgaacgtagtgattattgttattgatatattatttttttcgttacgtacgtatacgtagttattatttttattgatacgttatttttttcgttacgtacgtatacgtagttattattgttatttatacgttattttttttattacgtatgtatacgtagttattattgttattaatacgtcgttttttttattacgtacgtatacgtagtgattattgttattgatacgttatttttttcgttacgtacgtatacgtagttattattgttatttatacgttatttttttcgttacgtacgtatacgtagttattattgttattgatacgttatttttttcgttacgtacgtatacgtagttattattgttattgatacgttatttttttcgttacgtacgtatacgtagttattattgttattgatacgtcgttttttttattacgtacgtatacgtagttattattgttattgatacgtcgtttttttcgttacgtacgtatacgtagtgattattgttattgatacgtcgtttttttcgttacgtacgtatacgtagttattattgttattgatacgtcgttttttttattacgtatgtatacgtagttattattgttattgatacgttatttttttcgttacgtacgtatacgtagtgattattgttattgatacgttatttttttcgttacgtatgtatacgtagttattattgttattgatacgtcgtttttttcgttatttgcgttggtatggttgagatagcggttttttttaatttatttttttttttaagattgtttttattggatatgttggtatg

SEQ ID NO: 21150 - DNA, 831 bp, Artificial Sequence
  chemically treated genomic DNA (Homo sapiens) CpG-island No: 21150
cataccaacatatccaataaaaacaatcttaaaaaaaaaaataaattaaaaaaaaccgctatctcaaccataccaacgcaaataacgaaaaaaacgacgtatcaataacaataataactacgtatacatacgtaacgaaaaaaataacgtatcaataacaataatcactacgtatacgtacgtaacgaaaaaaataacgtatcaataacaataataactacgtatacatacgtaataaaaaaaacgacgtatcaataacaataataactacgtatacgtacgtaacgaaaaaaacgacgtatcaataacaataatcactacgtatacgtacgtaacgaaaaaaacgacgtatcaataacaataataactacgtatacgtacgtaataaaaaaaacgacgtatcaataacaataataactacgtatacgtacgtaacgaaaaaaataacgtatcaataacaataataactacgtatacgtacgtaacgaaaaaaataacgtatcaataacaataataactacgtatacgtacgtaacgaaaaaaataacgtataaataacaataataactacgtatacgtacgtaacgaaaaaaataacgtatcaataacaataatcactacgtatacgtacgtaataaaaaaaacgacgtattaataacaataataactacgtatacatacgtaataaaaaaaataacgtataaataacaataataactacgtatacgtacgtaacgaaaaaaataacgtatcaataaaaataataactacgtatacgtacgtaacgaaaaaaataatatatcaataacaataatcactacgttcatacgc

SEQ ID NO: 21151 - DNA, 831 bp, Artificial Sequence
  chemically treated genomic DNA (Homo sapiens) CpG-island No: 21151
tatgttaatatgtttagtagaaatagttttgaaaagggaaataagttagaaaaggtcgttgttttagttatgttagcgtaggtggcggaggaggcggcgtattagtgatagtggtgattgcgtgtgtatgcgtggcggaggaggtggcgtattagtgatagtggttattgcgtgtgcgtgcgtggcggaggaggtggcgtattagtgatagtggtgattgcgtgtgtatgcgtggtggaggaggcggcgtattagtgatagtggtgattgcgtgtgcgtgcgtggcggaggaggcggcgtattagtgatagtggttattgcgtgtgcgtgcgtggcggaggaggcggcgtattagtgatagtggtgattgcgtgtgcgtgcgtggtggaggaggcggcgtattagtgatagtggtgattgcgtgtgcgtgcgtggcggaggaggtggcgtattagtgatagtggtgattgcgtgtgcgtgcgtggcggaggaggtggcgtattagtgatagtggtgattgcgtgtgcgtgcgtggcggaggaggtggcgtatgagtgatagtggtgattgcgtgtgcgtgcgtggcggaggaggtggcgtattagtgatagtggttattgcgtgtgcgtgcgtggtggaggaggcggcgtattagtgatagtggtgattgcgtgtgtatgcgtggtggaggaggtggcgtatgagtgatagtggtgattgcgtgtgcgtgcgtggcggaggaggtggcgtgttagtgagagtggtgattgcgtgtgcgtgcgtggcggaggaggtggtgtattagtgatagtagttattgcgtttatacgt

SEQ ID NO: 21152 - DNA, 831 bp, Artificial Sequence
  chemically treated genomic DNA (Homo sapiens) CpG-island No: 21152
acgtataaacgcaataactactatcactaatacaccacctcctccgccacgcacgcacacgcaatcaccactctcactaacacgccacctcctccgccacgcacgcacacgcaatcaccactatcactcatacgccacctcctccaccacgcatacacacgcaatcaccactatcactaatacgccgcctcctccaccacgcacgcacacgcaataaccactatcactaatacgccacctcctccgccacgcacgcacacgcaatcaccactatcactcatacgccacctcctccgccacgcacgcacacgcaatcaccactatcactaatacgccacctcctccgccacgcacgcacacgcaatcaccactatcactaatacgccacctcctccgccacgcacgcacacgcaatcaccactatcactaatacgccgcctcctccaccacgcacgcacacgcaatcaccactatcactaatacgccgcctcctccgccacgcacgcacacgcaataaccactatcactaatacgccgcctcctccgccacgcacgcacacgcaatcaccactatcactaatacgccgcctcctccaccacgcatacacacgcaatcaccactatcactaatacgccacctcctccgccacgcacgcacacgcaataaccactatcactaatacgccacctcctccgccacgcatacacacgcaatcaccactatcactaatacgccgcctcctccgccacctacgctaacataactaaaacaacgaccttttctaacttatttcccttttcaaaactatttctactaaacatattaacata

SEQ ID NO: 21153 - DNA, 943 bp, Artificial Sequence
  chemically treated genomic DNA (Homo sapiens) CpG-island No: 21153
cgttaatgacgtcgatgatagtgatagcgtcggtcgagtgttttttttgtttcgggtcggttaggtatcgggtttttttttagtattcgtagtacgtattgaagaagacgttacggaatttttcgttttttagattcgggggaattaggaaattcgttcggcgattttcgcgtagtagtatcgggttaggtttgttttcggaatcgttgattgtattcgtcgtttttttcgtttgggtttttcgcgggtcgtaggggtggaagttcgatttgggttagggttcggatttttttttttcggtttttgcgttatcgttttcggtgtaggacgcgttttgttttcgtcgagatttagacgcgttgaaagtttcgcgcgggtagtttttcgttttacgtttcgggttgcgcgttttttcgtaaagtttttgtcgagtgcgcgtaacggcgtcgtcggatttttcgggatcgcgttttcgcgtacgtttgatcggagtatttcgttttacgggggcgttttgcgcgtttttttttttcggtgcgatttttatttttttttttttcgcggtttttaggagtttaggtatttttcgatttttcgggattttttgcgggttcgaagtcgttttttcgaggcggcggagttgggtagtttcgggtttcgcgtcgtttcgtagagtcggagttttttttcggagtttggatatagtttttcgtttcgtcgtcgcgtattggatttcggtagcgtggagtttgttcgggaagttgggttgcgtcggtttggggcgaaggtttaaggggcgcgggggtcgggacgcggggttgtggtaacgatcggttttttgcgaacgttcgggtcggcgggttcggggttataggttgggagtggagttggcggttattggggagtagagaggacgtttaggaataggtgtattagggtttcg

SEQ ID NO: 21154 - DNA, 943 bp, Artificial Sequence
  chemically treated genomic DNA (Homo sapiens) CpG-island No: 21154
cgaaaccctaatacacctattcctaaacgtcctctctactccccaataaccgccaactccactcccaacctataaccccgaacccgccgacccgaacgttcgcaaaaaaccgatcgttaccacaaccccgcgtcccgacccccgcgccccttaaaccttcgccccaaaccgacgcaacccaacttcccgaacaaactccacgctaccgaaatccaatacgcgacgacgaaacgaaaaactatatccaaactccgaaaaaaaactccgactctacgaaacgacgcgaaacccgaaactacccaactccgccgcctcgaaaaaacgacttcgaacccgcaaaaaatcccgaaaaatcgaaaaatacctaaactcctaaaaaccgcgaaaaaaaaaaaaataaaaatcgcaccgaaaaaaaaaaacgcgcaaaacgcccccgtaaaacgaaatactccgatcaaacgtacgcgaaaacgcgatcccgaaaaatccgacgacgccgttacgcgcactcgacaaaaactttacgaaaaaacgcgcaacccgaaacgtaaaacgaaaaactacccgcgcgaaactttcaacgcgtctaaatctcgacgaaaacaaaacgcgtcctacaccgaaaacgataacgcaaaaaccgaaaaaaaaaaatccgaaccctaacccaaatcgaacttccacccctacgacccgcgaaaaacccaaacgaaaaaaacgacgaatacaatcaacgattccgaaaacaaacctaacccgatactactacgcgaaaatcgccgaacgaatttcctaattcccccgaatctaaaaaacgaaaaattccgtaacgtcttcttcaatacgtactacgaatactaaaaaaaaacccgatacctaaccgacccgaaacaaaaaaaacactcgaccgacgctatcactatcatcgacgtcattaacg

SEQ ID NO: 21155 - DNA, 943 bp, Artificial Sequence
  chemically treated genomic DNA (Homo sapiens) CpG-island No: 21155
cgggattttggtgtatttgtttttgggcgttttttttattttttagtggtcgttagttttatttttagtttgtggtttcggattcgtcggttcgagcgttcgtagagggtcggtcgttgttatagtttcgcgtttcggttttcgcgttttttggattttcgttttaggtcggcgtagtttagtttttcgggtaggttttacgttatcggggtttagtgcgcggcgacgaagcggagagttgtatttagatttcggagagaaatttcggttttgcggggcggcgcggggttcggagttgtttaatttcgtcgtttcgggaaggcggtttcgggttcgtagggagtttcggggagtcgaggggtgtttgggtttttggggatcgcgagaggaaaaagaatggaaatcgtatcggggaggaaggacgcgtagaacgttttcgtgaagcggggtgtttcggttaggcgtgcgcgggagcgcggtttcggggagttcggcggcgtcgttgcgcgtattcggtagaggttttgcgggagaacgcgtagttcggggcgtggggcggggaattgttcgcgcgaggtttttagcgcgtttgggtttcggcgagagtaaagcgcgttttgtatcgggggcggtggcgtagaggtcgggaggaagaaattcgggttttggtttaggtcgggtttttatttttgcgattcgcgagaggtttaggcgggaaaggcggcgagtgtagttagcggtttcgaaagtaaatttggttcggtgttattgcgcgagggtcgtcgggcgagttttttaattttttcgagtttggaaaacggagagtttcgtagcgttttttttagtgcgtgttgcgagtgttgaaggaggattcggtgtttggtcgattcggagtaggggaagtattcggtcgacgttgttattgttatcggcgttattggcg

SEQ ID NO: 21156 - DNA, 943 bp, Artificial Sequence
  chemically treated genomic DNA (Homo sapiens) CpG-island No: 21156
cgccaataacgccgataacaataacaacgtcgaccgaatacttcccctactccgaatcgaccaaacaccgaatcctccttcaacactcgcaacacgcactaaaaaaaacgctacgaaactctccgttttccaaactcgaaaaaattaaaaaactcgcccgacgaccctcgcgcaataacaccgaaccaaatttactttcgaaaccgctaactacactcgccgcctttcccgcctaaacctctcgcgaatcgcaaaaataaaaacccgacctaaaccaaaacccgaatttcttcctcccgacctctacgccaccgcccccgatacaaaacgcgctttactctcgccgaaacccaaacgcgctaaaaacctcgcgcgaacaattccccgccccacgccccgaactacgcgttctcccgcaaaacctctaccgaatacgcgcaacgacgccgccgaactccccgaaaccgcgctcccgcgcacgcctaaccgaaacaccccgcttcacgaaaacgttctacgcgtccttcctccccgatacgatttccattctttttcctctcgcgatccccaaaaacccaaacacccctcgactccccgaaactccctacgaacccgaaaccgccttcccgaaacgacgaaattaaacaactccgaaccccgcgccgccccgcaaaaccgaaatttctctccgaaatctaaatacaactctccgcttcgtcgccgcgcactaaaccccgataacgtaaaacctacccgaaaaactaaactacgccgacctaaaacgaaaatccaaaaaacgcgaaaaccgaaacgcgaaactataacaacgaccgaccctctacgaacgctcgaaccgacgaatccgaaaccacaaactaaaaataaaactaacgaccactaaaaaataaaaaaaacgcccaaaaacaaatacaccaaaatcccg

SEQ ID NO: 21157 - DNA, 617 bp, Artificial Sequence
  chemically treated genomic DNA (Homo sapiens) CpG-island No: 21157
gggcgggagaaaatttggtagcgaggtagaagcgatttttgtcgagggagttagcgagcggtcgcgcggagaggaggggcgggcggtttttaggcgggcgggtgtagggcgcggggcgtcgatttgttggagaggggttcgggcgcgaggcggagtttcggcgcgtagttaggttggcggaggttttcggtcggttgtagatttttttcggtttcgggagtcgtagtaggatcggtcgggaggcgtcgcggaggggagtcgtatttcggtgcggatagtgtttatcgcgttttgcgaggatcggcgatttatcggttttttttagggttagcgtagttattcgtttaattttattcggagcgcgttgtcgttcgtcgatttgcgcgatcgttagggtcgtattacgggggtgggtagcgacggtaggtatttcggtaggacggtcgtcgaggtcggggggtcgatggtcgcggttaacggggcgagtgttcggatgtttttcgtttttcgtcgcgtcgtcgtcgcgtttttttttggtttttgttcgtttgttgttttcgggtttagttgggaggtttttgttcggttttgtttttttattttcgcgtttttatttt

SEQ ID NO: 21158 - DNA, 617 bp, Artificial Sequence
  chemically treated genomic DNA (Homo sapiens) CpG-island No: 21158
aaaataaaaacgcgaaaataaaaaaacaaaaccgaacaaaaacctcccaactaaacccgaaaacaacaaacgaacaaaaaccaaaaaaaaacgcgacgacgacgcgacgaaaaacgaaaaacatccgaacactcgccccgttaaccgcgaccatcgaccccccgacctcgacgaccgtcctaccgaaatacctaccgtcgctacccacccccgtaatacgaccctaacgatcgcgcaaatcgacgaacgacaacgcgctccgaataaaattaaacgaataactacgctaaccctaaaaaaaaccgataaatcgccgatcctcgcaaaacgcgataaacactatccgcaccgaaatacgactcccctccgcgacgcctcccgaccgatcctactacgactcccgaaaccgaaaaaaatctacaaccgaccgaaaacctccgccaacctaactacgcgccgaaactccgcctcgcgcccgaacccctctccaacaaatcgacgccccgcgccctacacccgcccgcctaaaaaccgcccgcccctcctctccgcgcgaccgctcgctaactccctcgacaaaaatcgcttctacctcgctaccaaattttctcccgccc

SEQ ID NO: 21159 - DNA, 617 bp, Artificial Sequence
  chemically treated genomic DNA (Homo sapiens) CpG-island No: 21159
agggtgaggacgcgggagtgagggagtaaagtcgggtaggggttttttagttgggttcggaggtagtaggcggataagggttaggagagggcgcggcggcggcgcggcgggaagcgaggggtattcggatattcgtttcgttggtcgcggttatcggtttttcgatttcgacggtcgttttgtcgaagtatttgtcgtcgttgtttattttcgtggtgcggttttgacggtcgcgtaggtcgacggacgatagcgcgtttcggatgaagttgggcgggtagttgcgttggttttggaagaggtcggtgggtcgtcggttttcgtagggcgcggtgggtattgttcgtatcgggatgcgattttttttcgcggcgtttttcggtcggttttgttgcggttttcggggtcggagggaatttgtagtcggtcgggggttttcgttagtttggttgcgcgtcgggatttcgtttcgcgttcgggtttttttttagtaggtcggcgtttcgcgttttgtattcgttcgtttggggatcgttcgtttttttttttcgcgcggtcgttcgttgattttttcggtagggatcgtttttgtttcgttgttaagttttttttcgttt

SEQ ID NO: 21160 - DNA, 617 bp, Artificial Sequence
  chemically treated genomic DNA (Homo sapiens) CpG-island No: 21160
aaacgaaaaaaaacttaacaacgaaacaaaaacgatccctaccgaaaaaatcaacgaacgaccgcgcgaaaaaaaaaaacgaacgatccccaaacgaacgaatacaaaacgcgaaacgccgacctactaaaaaaaaacccgaacgcgaaacgaaatcccgacgcgcaaccaaactaacgaaaacccccgaccgactacaaattccctccgaccccgaaaaccgcaacaaaaccgaccgaaaaacgccgcgaaaaaaaatcgcatcccgatacgaacaatacccaccgcgccctacgaaaaccgacgacccaccgacctcttccaaaaccaacgcaactacccgcccaacttcatccgaaacgcgctatcgtccgtcgacctacgcgaccgtcaaaaccgcaccacgaaaataaacaacgacgacaaatacttcgacaaaacgaccgtcgaaatcgaaaaaccgataaccgcgaccaacgaaacgaatatccgaatacccctcgcttcccgccgcgccgccgccgcgccctctcctaacccttatccgcctactacctccgaacccaactaaaaaacccctacccgactttactccctcactcccgcgtcctcaccct

SEQ ID NO: 21161 - DNA, 559 bp, Artificial Sequence
  chemically treated genomic DNA (Homo sapiens) CpG-island No: 21161
acgttcggaagataacggatgggagtcgtgtgtacgtcgggagttcggagtgagcgtgagtttcgtgtttaggttcgcgattcggtttattaggatagcgtttcgggtcgacggggttttggagtcgcgttcggggagggcgtagcggagggtgagcggcggcgttaggattcggaggcgcgggcggaggtggcggggttaggatttagcggtttcggtagagcggaagcggcggcgggagttttcgggagggcggttcgcgggtgaggaggcgttcggggtcgcgggaagtagggtcgtgggggtttggcggggcgaagtaggggattcggaggggttggagggaggcgggcgggaggttcgggatcgtttttgatcgagaagtttgcgttaagttggtgtttcgcggtcgttgttcggtgttcggttttattgcgaacgtcgtcgttgggtttcgatcgttcgggaggcgttttgggttcgtttcggagttttttttttggagtcgcgttttgtattcggttttgttcggttttagtagggaagttaaggtttgtgg

SEQ ID NO: 21162 - DNA, 559 bp, Artificial Sequence
  chemically treated genomic DNA (Homo sapiens) CpG-island No: 21162
ccacaaaccttaacttccctactaaaaccgaacaaaaccgaatacaaaacgcgactccaaaaaaaaaactccgaaacgaacccaaaacgcctcccgaacgatcgaaacccaacgacgacgttcgcaataaaaccgaacaccgaacaacgaccgcgaaacaccaacttaacgcaaacttctcgatcaaaaacgatcccgaacctcccgcccgcctccctccaacccctccgaatcccctacttcgccccgccaaacccccacgaccctacttcccgcgaccccgaacgcctcctcacccgcgaaccgccctcccgaaaactcccgccgccgcttccgctctaccgaaaccgctaaatcctaaccccgccacctccgcccgcgcctccgaatcctaacgccgccgctcaccctccgctacgccctccccgaacgcgactccaaaaccccgtcgacccgaaacgctatcctaataaaccgaatcgcgaacctaaacacgaaactcacgctcactccgaactcccgacgtacacacgactcccatccgttatcttccgaacgt

SEQ ID NO: 21163 - DNA, 559 bp, Artificial Sequence
  chemically treated genomic DNA (Homo sapiens) CpG-island No: 21163
ttataagttttggtttttttgttagggtcgggtaaggtcgggtgtagggcgcggttttagggaggaagtttcggggcgagtttaagacgtttttcgggcggtcggggtttagcggcggcgttcgtagtggagtcgggtatcgggtagcggtcgcggaatattagtttggcgtaggtttttcggttaggaacggtttcgggtttttcgttcgtttttttttagttttttcgggttttttatttcgtttcgttaggtttttacgattttatttttcgcggtttcggacgtttttttattcgcgagtcgttttttcggaagttttcgtcgtcgttttcgttttgtcggagtcgttgggttttagtttcgttattttcgttcgcgttttcgggttttaacgtcgtcgtttatttttcgttgcgtttttttcgagcgcggttttaggatttcgtcgattcggagcgttgttttggtggatcgagtcgcgggtttgggtacggaatttacgtttatttcgagttttcgacgtgtatacggtttttattcgttgtttttcgagcgt

SEQ ID NO: 21164 - DNA, 559 bp, Artificial Sequence
  chemically treated genomic DNA (Homo sapiens) CpG-island No: 21164
acgctcgaaaaacaacgaataaaaaccgtatacacgtcgaaaactcgaaataaacgtaaattccgtacccaaacccgcgactcgatccaccaaaacaacgctccgaatcgacgaaatcctaaaaccgcgctcgaaaaaaacgcaacgaaaaataaacgacgacgttaaaacccgaaaacgcgaacgaaaataacgaaactaaaacccaacgactccgacaaaacgaaaacgacgacgaaaacttccgaaaaaacgactcgcgaataaaaaaacgtccgaaaccgcgaaaaataaaatcgtaaaaacctaacgaaacgaaataaaaaacccgaaaaaactaaaaaaaaacgaacgaaaaacccgaaaccgttcctaaccgaaaaacctacgccaaactaatattccgcgaccgctacccgatacccgactccactacgaacgccgccgctaaaccccgaccgcccgaaaaacgtcttaaactcgccccgaaacttcctccctaaaaccgcgccctacacccgaccttacccgaccctaacaaaaaaaccaaaacttataa

SEQ ID NO: 21165 - DNA, 536 bp, Artificial Sequence
  chemically treated genomic DNA (Homo sapiens) CpG-island No: 21165
tcgtattcggtcgtatgcgtattttttgcggttttttcgttaggcgtcgcgttgggtagttagcgtttcggcggggttttttaggttttcggtcgggtagtttttttcggggtttttgcgcggttgcgtagtagttgcgaggacgcggggcgagtcggaagtggagtgcgttgcggtgcgagttgggtcggcggggtggttcgagagcgcgtagagtttagattggcggtagggttcgaggggtcgattcgtagcgtttttggtttttttagtttttattcggaatcgtacgtgagggtaaattcgtttcggtggttggtttagtacgcggggatagttttttcgaggtttttttagcggtgtgggcgagagggcgttcgggtcgggggaagtacggaaaggtggtttcgcgaggttgttgtggggggcgggacgggtagtttggcgatgtttggatatggttggtggttaaaaatatttatcgaaagatagtatatttatttagatggcgaggatatcgataagtaagttttcgt

SEQ ID NO: 21166 - DNA, 536 bp, Artificial Sequence
  chemically treated genomic DNA (Homo sapiens) CpG-island No: 21166
acgaaaacttacttatcgatatcctcgccatctaaataaatatactatctttcgataaatatttttaaccaccaaccatatccaaacatcgccaaactacccgtcccgccccccacaacaacctcgcgaaaccacctttccgtacttcccccgacccgaacgccctctcgcccacaccgctaaaaaaacctcgaaaaaactatccccgcgtactaaaccaaccaccgaaacgaatttaccctcacgtacgattccgaataaaaactaaaaaaaccaaaaacgctacgaatcgacccctcgaaccctaccgccaatctaaactctacgcgctctcgaaccaccccgccgacccaactcgcaccgcaacgcactccacttccgactcgccccgcgtcctcgcaactactacgcaaccgcgcaaaaaccccgaaaaaaactacccgaccgaaaacctaaaaaaccccgccgaaacgctaactacccaacgcgacgcctaacgaaaaaaccgcaaaaaatacgcatacgaccgaatacga

SEQ ID NO: 21167 - DNA, 536 bp, Artificial Sequence
  chemically treated genomic DNA (Homo sapiens) CpG-island No: 21167
gcgaagatttgtttgtcgatgttttcgttatttaagtgggtatgttatttttcgataaatgtttttggttattaattatgtttaggtatcgttaggttgttcgtttcgttttttataatagtttcgcgaagttattttttcgtgtttttttcgattcggacgttttttcgtttatatcgttagggaggtttcggaggggttgttttcgcgtgttaagttagttatcggggcggatttgtttttacgtgcggtttcgagtgagggttggagagattagggacgttgcgggtcggtttttcgggttttgtcgttagtttggattttgcgcgttttcgaattatttcgtcggtttagttcgtatcgtagcgtattttattttcggttcgtttcgcgttttcgtagttgttacgtaatcgcgtaaggatttcgagggaggttgttcggtcgaaggtttgaaggatttcgtcggggcgttggttgtttagcgcggcgtttggcgggagggtcgtagggagtgcgtatgcggtcgagtgcgg

SEQ ID NO: 21168 - DNA, 536 bp, Artificial Sequence
  chemically treated genomic DNA (Homo sapiens) CpG-island No: 21168
ccgcactcgaccgcatacgcactccctacgaccctcccgccaaacgccgcgctaaacaaccaacgccccgacgaaatccttcaaaccttcgaccgaacaacctccctcgaaatccttacgcgattacgtaacaactacgaaaacgcgaaacgaaccgaaaataaaatacgctacgatacgaactaaaccgacgaaataattcgaaaacgcgcaaaatccaaactaacgacaaaacccgaaaaaccgacccgcaacgtccctaatctctccaaccctcactcgaaaccgcacgtaaaaacaaatccgccccgataactaacttaacacgcgaaaacaacccctccgaaacctccctaacgatataaacgaaaaaacgtccgaatcgaaaaaaacacgaaaaaataacttcgcgaaactattataaaaaacgaaacgaacaacctaacgatacctaaacataattaataaccaaaaacatttatcgaaaaataacatacccacttaaataacgaaaacatcgacaaacaaatcttcgc

SEQ ID NO: 21169 - DNA, 503 bp, Artificial Sequence
  chemically treated genomic DNA (Homo sapiens) CpG-island No: 21169
gggcgttgacgggtacggagcgtacgggatcgcggaggaattcgcgcgcgttttcgtttcgcgtcgcgcgtacgtgattgcgttttcggtttcgttttcggtttgtttttcgtttttattggtcgttcggtcgcgcgcgggtcggtcggttttatggggaaagcggcggtttcgagtcgaggcggcggttgtggcggtcgttttcgcgggttttcgtcgttgtttacggttgttttttgtttgtcgtgttatacggcggcgtcgggtatgagcgtttttacgttcggtttcgggtcggagtttaagttttagttttagttcgtgttcgaatcggagcggggatcgttgttagaataggtgtcggaggtagtttcggaggtagtgttaagatcggaatttgtgttcgagacgacgtttgagtcggagttaggggttgggtagttatcggaattgttgtaggggtcgcggtcggggttagagttaagtttaggtgtaggggttgg

SEQ ID NO: 21170 - DNA, 503 bp, Artificial Sequence
  chemically treated genomic DNA (Homo sapiens) CpG-island No: 21170
ccaacccctacacctaaacttaactctaaccccgaccgcgacccctacaacaattccgataactacccaacccctaactccgactcaaacgtcgtctcgaacacaaattccgatcttaacactacctccgaaactacctccgacacctattctaacaacgatccccgctccgattcgaacacgaactaaaactaaaacttaaactccgacccgaaaccgaacgtaaaaacgctcatacccgacgccgccgtataacacgacaaacaaaaaacaaccgtaaacaacgacgaaaacccgcgaaaacgaccgccacaaccgccgcctcgactcgaaaccgccgctttccccataaaaccgaccgacccgcgcgcgaccgaacgaccaataaaaacgaaaaacaaaccgaaaacgaaaccgaaaacgcaatcacgtacgcgcgacgcgaaacgaaaacgcgcgcgaattcctccgcgatcccgtacgctccgtacccgtcaacgccc

SEQ ID NO: 21171 - DNA, 503 bp, Artificial Sequence
  chemically treated genomic DNA (Homo sapiens) CpG-island No: 21171
ttagtttttatatttgagtttgattttgatttcggtcgcgatttttgtagtagtttcgatggttgtttagtttttggtttcggtttagacgtcgtttcggatataggtttcgattttggtattgttttcgaaattgttttcgatatttgttttgatagcggttttcgtttcggttcgggtacgggttggggttggggtttgggtttcggttcggagtcggacgtggaagcgtttatgttcggcgtcgtcgtgtggtacgataggtaggggataatcgtgaatagcgacgagagttcgcgggagcggtcgttatagtcgtcgtttcggttcggagtcgtcgttttttttatagagtcggtcgattcgcgcgcggtcgagcggttagtgggggcggggggtaggtcgggggcggggtcgggggcgtagttacgtgcgcgcggcgcgaggcgggggcgcgcgcgggttttttcgcggtttcgtgcgtttcgtgttcgttagcgttt

SEQ ID NO: 21172 - DNA, 503 bp, Artificial Sequence
  chemically treated genomic DNA (Homo sapiens) CpG-island No: 21172
aaacgctaacgaacacgaaacgcacgaaaccgcgaaaaaacccgcgcgcgcccccgcctcgcgccgcgcgcacgtaactacgcccccgaccccgcccccgacctaccccccgcccccactaaccgctcgaccgcgcgcgaatcgaccgactctataaaaaaaacgacgactccgaaccgaaacgacgactataacgaccgctcccgcgaactctcgtcgctattcacgattatcccctacctatcgtaccacacgacgacgccgaacataaacgcttccacgtccgactccgaaccgaaacccaaaccccaaccccaacccgtacccgaaccgaaacgaaaaccgctatcaaaacaaatatcgaaaacaatttcgaaaacaataccaaaatcgaaacctatatccgaaacgacgtctaaaccgaaaccaaaaactaaacaaccatcgaaactactacaaaaatcgcgaccgaaatcaaaatcaaactcaaatataaaaactaa

SEQ ID NO: 21173 - DNA, 992 bp, Artificial Sequence
  chemically treated genomic DNA (Homo sapiens) CpG-island No: 21173
gtcgcgggcgtttatttacgttagtatcgggagtcgcgcggcgattcggcgagttcggtaggtaggataggattgcggcgtaggtttggtttaggcggaggaagtagtcgtcgttttagttgacggagtgcggtcgggggttttttagaggaggcggcgacgtcgagttttttcgaacgtttttattcggttagtttacgtagtttcggtttcgttcggtttcgttcggtttcgttttatttatttcggttatcgtttttttttcggtttatagttcgcgggtggggcgatttgcgatagtttttttaagaggcgtggttacgtgtttcgtttttattttcgtttcgcgcgttagtaaggggtggggtgcgggaggaggtgtcggggaggtggggggagcgaagtgtgcgttgttgcgtaggcgcggtggtcggacgatagatcgtgtgtttttaaaatggcggtagcgatggatgtggatatttcgagcggtattaatagcggcgcgggtaagaagcgttttgaagtgaaaaaggttgggtttcgttagcgttttttttagggaagttagagaggcgcggatttggttggtaggttcgaggatggtcgaggcgcggagtaaagggttttattttagggcgtttttgggatcgggtattacgaaaggaagtcggggggcgggttttagagttgatcggcgtgacggcggtttattgttgggggaagtgttggtttcgttgtgaggttaaggggttaattatagagttgtttattgagatacgcggggttgcgatttggcggcgggagttaagcgtttgagttgttattggagtggttgagaggtgggggaaggatagggtagggtggggtggggtgggtggaatggggagtcgaagcgaatgcggcggtggaggatggggtagtgcggcgagagtttggaatttgaggttttatcgtattagaggtttttgaggattttttttggtgatttt

SEQ ID NO: 21174 - DNA, 992 bp, Artificial Sequence
  chemically treated genomic DNA (Homo sapiens) CpG-island No: 21174
aaaatcaccaaaaaaaatcctcaaaaacctctaatacgataaaacctcaaattccaaactctcgccgcactaccccatcctccaccgccgcattcgcttcgactccccattccacccaccccaccccaccctaccctatccttcccccacctctcaaccactccaataacaactcaaacgcttaactcccgccgccaaatcgcaaccccgcgtatctcaataaacaactctataattaaccccttaacctcacaacgaaaccaacacttcccccaacaataaaccgccgtcacgccgatcaactctaaaacccgccccccgacttcctttcgtaatacccgatcccaaaaacgccctaaaataaaaccctttactccgcgcctcgaccatcctcgaacctaccaaccaaatccgcgcctctctaacttccctaaaaaaaacgctaacgaaacccaacctttttcacttcaaaacgcttcttacccgcgccgctattaataccgctcgaaatatccacatccatcgctaccgccattttaaaaacacacgatctatcgtccgaccaccgcgcctacgcaacaacgcacacttcgctccccccacctccccgacacctcctcccgcaccccaccccttactaacgcgcgaaacgaaaataaaaacgaaacacgtaaccacgcctcttaaaaaaactatcgcaaatcgccccacccgcgaactataaaccgaaaaaaaaacgataaccgaaataaataaaacgaaaccgaacgaaaccgaacgaaaccgaaactacgtaaactaaccgaataaaaacgttcgaaaaaactcgacgtcgccgcctcctctaaaaaacccccgaccgcactccgtcaactaaaacgacgactacttcctccgcctaaaccaaacctacgccgcaatcctatcctacctaccgaactcgccgaatcgccgcgcgactcccgatactaacgtaaataaacgcccgcgac

SEQ ID NO: 21175 - DNA, 992 bp, Artificial Sequence
  chemically treated genomic DNA (Homo sapiens) CpG-island No: 21175
aagattattaaggggggtttttagaggtttttaatgcggtaggattttaggttttaggttttcgtcgtattgttttattttttatcgtcgtattcgtttcgattttttattttatttattttattttattttattttgttttttttttattttttaattattttagtgatagtttaagcgtttggttttcgtcgttaagtcgtaatttcgcgtattttaataagtagttttgtgattggttttttagttttatagcgaaattaatattttttttaatagtgggtcgtcgttacgtcgattaattttaagattcgtttttcggttttttttcgtggtattcggttttaggaacgttttgaaatgaaattttttatttcgcgtttcgattattttcgggtttgttagttagattcgcgtttttttagtttttttgaggaaggcgttggcgagatttaattttttttattttaaagcgttttttgttcgcgtcgttgttggtgtcgttcggggtatttatatttatcgttgtcgttattttggaaatatacggtttgtcgttcgattatcgcgtttgcgtagtagcgtatatttcgttttttttattttttcggtattttttttcgtattttattttttattggcgcgcgaggcggaggtgggggcggagtacgtgattacgttttttaaaggggttgtcgtaggtcgttttattcgcgaattgtaggtcggggagggggcggtggtcggagtgggtggggcggggtcgggcggggtcgggcggggtcgaggttacgtgagttagtcgggtggaaacgttcgaaagggttcgacgtcgtcgttttttttgggaagttttcggtcgtatttcgttagttggggcggcggttgtttttttcgtttgagttagatttgcgtcgtagttttgttttgtttgtcgggttcgtcgagtcgtcgcgcggttttcggtgttggcgtgggtgggcgttcgcggt

SEQ ID NO: 21176 - DNA, 992 bp, Artificial Sequence
  chemically treated genomic DNA (Homo sapiens) CpG-island No: 21176
accgcgaacgcccacccacgccaacaccgaaaaccgcgcgacgactcgacgaacccgacaaacaaaacaaaactacgacgcaaatctaactcaaacgaaaaaaacaaccgccgccccaactaacgaaatacgaccgaaaacttcccaaaaaaaacgacgacgtcgaaccctttcgaacgtttccacccgactaactcacgtaacctcgaccccgcccgaccccgcccgaccccgccccacccactccgaccaccgccccctccccgacctacaattcgcgaataaaacgacctacgacaacccctttaaaaaacgtaatcacgtactccgcccccacctccgcctcgcgcgccaataaaaaataaaatacgaaaaaaaataccgaaaaaataaaaaaaacgaaatatacgctactacgcaaacgcgataatcgaacgacaaaccgtatatttccaaaataacgacaacgataaatataaataccccgaacgacaccaacaacgacgcgaacaaaaaacgctttaaaataaaaaaaattaaatctcgccaacgccttcctcaaaaaaactaaaaaaacgcgaatctaactaacaaacccgaaaataatcgaaacgcgaaataaaaaatttcatttcaaaacgttcctaaaaccgaataccacgaaaaaaaaccgaaaaacgaatcttaaaattaatcgacgtaacgacgacccactattaaaaaaaatattaatttcgctataaaactaaaaaaccaatcacaaaactacttattaaaatacgcgaaattacgacttaacgacgaaaaccaaacgcttaaactatcactaaaataattaaaaaataaaaaaaaaacaaaataaaataaaataaaataaataaaataaaaaatcgaaacgaatacgacgataaaaaataaaacaatacgacgaaaacctaaaacctaaaatcctaccgcattaaaaacctctaaaaaccccccttaataatctt

SEQ ID NO: 21177 - DNA, 842 bp, Artificial Sequence
  chemically treated genomic DNA (Homo sapiens) CpG-island No: 21177
cggtcgtcgtcgttatcgttagtttgtaaggaggattcggtagagggaagaaataatagtcgttattttgtttgtgtgttaggttgggggggagagagggcgagagagagcgggcgagagtgggtaagtaggacgtcgggttgagtgttaattgcgggagttagagagtgcggaggggagtcgggtcggagagaggcggtaggggtcgagatagtggtagggggttcggggcgtacgggttgaggcgatttttagttttttttcgttcgtatatatttttatcgcggtttagtagtcgggtcggcgtcgacgtttaggggggattattatataatttcgcgtttcgcggcgttttttttcgtcgtcgcgggcggtttcgaacggagtttcggggggcgggcgtttttagtatttggtcgtcggcggtgggggtcgtagtagcggtcgtatttatttatttttcgcgggaaaggaaggcgaaggaggggagcgcggcgcgaggaggggtcgtttgcgtcgtcgtcggagcggggttttttcggtgggtttcgcgtcggcgcgggcgtgcgggcggcgttgttcggttcggttttttcggttttttggttcggttagtttcgttttcggcgtttttgtcgcgttttcgtcggtcgtcgcgcgatgtgaggcggcggcgttagtttggttttcggttcgggcgagttttttgcggttattaggggtcggtgcggcggcggcggcgcggagcgcggcggtaggaggagggttcggagggtgggggcgtaggttcgggagggggtatcgggaggaggtgagtgttttttgtcgtttttttttttttt

SEQ ID NO: 21178 - DNA, 842 bp, Artificial Sequence
  chemically treated genomic DNA (Homo sapiens) CpG-island No: 21178
aaaaaaaaaaaaaacgacaaaaaacactcacctcctcccgataccccctcccgaacctacgcccccaccctccgaaccctcctcctaccgccgcgctccgcgccgccgccgccgcaccgacccctaataaccgcaaaaaactcgcccgaaccgaaaaccaaactaacgccgccgcctcacatcgcgcgacgaccgacgaaaacgcgacaaaaacgccgaaaacgaaactaaccgaaccaaaaaaccgaaaaaaccgaaccgaacaacgccgcccgcacgcccgcgccgacgcgaaacccaccgaaaaaaccccgctccgacgacgacgcaaacgacccctcctcgcgccgcgctcccctccttcgccttcctttcccgcgaaaaataaataaatacgaccgctactacgacccccaccgccgacgaccaaatactaaaaacgcccgccccccgaaactccgttcgaaaccgcccgcgacgacgaaaaaaaacgccgcgaaacgcgaaattatataataatcccccctaaacgtcgacgccgacccgactactaaaccgcgataaaaatatatacgaacgaaaaaaaactaaaaatcgcctcaacccgtacgccccgaaccccctaccactatctcgacccctaccgcctctctccgacccgactcccctccgcactctctaactcccgcaattaacactcaacccgacgtcctacttacccactctcgcccgctctctctcgccctctctcccccccaacctaacacacaaacaaaataacgactattatttcttccctctaccgaatcctccttacaaactaacgataacgacgacgaccg

SEQ ID NO: 21179 - DNA, 842 bp, Artificial Sequence
  chemically treated genomic DNA (Homo sapiens) CpG-island No: 21179
gggagaggaggaggcgataagagatatttattttttttcggtgttttttttcgggtttgcgtttttatttttcgaattttttttttgtcgtcgcgtttcgcgtcgtcgtcgtcgtatcggtttttaatggtcgtagagaattcgttcgagtcgagagttaggttggcgtcgtcgttttatatcgcgcggcggtcggcggaggcgcggtaaggacgtcgggagcggagttggtcggattagagggtcgagggggtcgggtcgagtagcgtcgttcgtacgttcgcgtcgacgcggagtttatcgaggaggtttcgtttcggcggcggcgtaggcggttttttttcgcgtcgcgtttttttttttcgtttttttttttcgcggaaaataaataaatacggtcgttgttacggtttttatcgtcggcggttaggtgttgggagcgttcgtttttcggggtttcgttcggggtcgttcgcggcggcgggagaagacgtcgcggggcgcggggttatgtaatggttttttttaggcgtcgacgtcggttcggttgttggatcgcggtgggggtgtgtgcggacgggagggggttgggggtcgttttagttcgtgcgtttcgggttttttgttattgtttcggtttttgtcgttttttttcgattcgattttttttcgtattttttggttttcgtagttagtatttagttcggcgttttgtttgtttattttcgttcgttttttttcgtttttttttttttttagtttagtatataaataagatggcggttgttgttttttttttttgtcgaattttttttataggttagcggtagcggcggcggtcg

SEQ ID NO: 21180 - DNA, 842 bp, Artificial Sequence
  chemically treated genomic DNA (Homo sapiens) CpG-island No: 21180
cgaccgccgccgctaccgctaacctataaaaaaaattcgacaaaaaaaaaaaacaacaaccgccatcttatttatatactaaactaaaaaaaaaaaaaaacgaaaaaaaacgaacgaaaataaacaaacaaaacgccgaactaaatactaactacgaaaaccaaaaaatacgaaaaaaaatcgaatcgaaaaaaaacgacaaaaaccgaaacaataacaaaaaacccgaaacgcacgaactaaaacgacccccaaccccctcccgtccgcacacacccccaccgcgatccaacaaccgaaccgacgtcgacgcctaaaaaaaaccattacataaccccgcgccccgcgacgtcttctcccgccgccgcgaacgaccccgaacgaaaccccgaaaaacgaacgctcccaacacctaaccgccgacgataaaaaccgtaacaacgaccgtatttatttattttccgcgaaaaaaaaaaacgaaaaaaaaaaacgcgacgcgaaaaaaaaccgcctacgccgccgccgaaacgaaacctcctcgataaactccgcgtcgacgcgaacgtacgaacgacgctactcgacccgaccccctcgaccctctaatccgaccaactccgctcccgacgtccttaccgcgcctccgccgaccgccgcgcgatataaaacgacgacgccaacctaactctcgactcgaacgaattctctacgaccattaaaaaccgatacgacgacgacgacgcgaaacgcgacgacaaaaaaaaaattcgaaaaataaaaacgcaaacccgaaaaaaaacaccgaaaaaaaataaatatctcttatcgcctcctcctctccc

SEQ ID NO: 21181 - DNA, 556 bp, Artificial Sequence
  chemically treated genomic DNA (Homo sapiens) CpG-island No: 21181
ttcgggttcgatttttatcgtgtagtaagtgtttagtttttcgtagttttcgttttttttcgtttagtagtttgattatcgttagtaattcgggttttttgatttttaaatgggttttagatttcgtttggcgttcgaggaaggttcgtaagggttcgtttcgggtgaatagtttttttagcggcgggttatcggagtttaggggtcggcgggttgggttaacggttcggcggggttagagttatcgggtagcgttttatagaattcgggatcgtatttttagttcgagatcgcggattttgatcggaatcggaagtttcggatatagtagttttcgcgataatatttagaatttggagataagggtgagagcgtattaagtttcgtttagcgtaagcgttgttttttaaaggatttttcggaagttttggcgggaattttttgttaagcgtgagaacgttgcgaatttttcggaggttaaaagttgagggggttgagcggagcgtgattggggaggggcgggtttgggagattttgggcgttttttttgaaagtt

SEQ ID NO: 21182 - DNA, 556 bp, Artificial Sequence
  chemically treated genomic DNA (Homo sapiens) CpG-island No: 21182
aactttcaaaaaaaacgcccaaaatctcccaaacccgcccctccccaatcacgctccgctcaaccccctcaacttttaacctccgaaaaattcgcaacgttctcacgcttaacaaaaaattcccgccaaaacttccgaaaaatcctttaaaaaacaacgcttacgctaaacgaaacttaatacgctctcacccttatctccaaattctaaatattatcgcgaaaactactatatccgaaacttccgattccgatcaaaatccgcgatctcgaactaaaaatacgatcccgaattctataaaacgctacccgataactctaaccccgccgaaccgttaacccaacccgccgacccctaaactccgataacccgccgctaaaaaaactattcacccgaaacgaacccttacgaaccttcctcgaacgccaaacgaaatctaaaacccatttaaaaatcaaaaaacccgaattactaacgataatcaaactactaaacgaaaaaaaacgaaaactacgaaaaactaaacacttactacacgataaaaatcgaacccgaa

SEQ ID NO: 21183 - DNA, 556 bp, Artificial Sequence
  chemically treated genomic DNA (Homo sapiens) CpG-island No: 21183
ggtttttagaggaggcgtttaaggttttttaggttcgtttttttttaattacgtttcgtttagtttttttaatttttggttttcgggaagttcgtagcgtttttacgtttggtaggaagttttcgttaaggttttcggaaaattttttaaaaagtaacgtttgcgttgggcggggtttggtgcgtttttatttttatttttaaattttgggtgttgtcgcgagggttgttgtgttcggaattttcggtttcggttagggttcgcgatttcggattaaggatgcggtttcgggttttgtggggcgttgttcggtggttttggtttcgtcgggtcgttggtttagttcgtcggtttttgagtttcggtagttcgtcgttggaggagttgtttattcggggcgggtttttgcggatttttttcgagcgttaggcggggtttgaagtttatttgaaggttaggaggttcgagttgttggcggtgattaaattgttgaacgagaaggagcgggagttgcgggagattgagtatttgttgtacggtaagggtcgggttcggg

SEQ ID NO: 21184 - DNA, 556 bp, Artificial Sequence
  chemically treated genomic DNA (Homo sapiens) CpG-island No: 21184
cccgaacccgacccttaccgtacaacaaatactcaatctcccgcaactcccgctccttctcgttcaacaatttaatcaccgccaacaactcgaacctcctaaccttcaaataaacttcaaaccccgcctaacgctcgaaaaaaatccgcaaaaacccgccccgaataaacaactcctccaacgacgaactaccgaaactcaaaaaccgacgaactaaaccaacgacccgacgaaaccaaaaccaccgaacaacgccccacaaaacccgaaaccgcatccttaatccgaaatcgcgaaccctaaccgaaaccgaaaattccgaacacaacaaccctcgcgacaacacccaaaatttaaaaataaaaataaaaacgcaccaaaccccgcccaacgcaaacgttactttttaaaaaattttccgaaaaccttaacgaaaacttcctaccaaacgtaaaaacgctacgaacttcccgaaaaccaaaaattaaaaaaactaaacgaaacgtaattaaaaaaaaacgaacctaaaaaaccttaaacgcctcctctaaaaacc

SEQ ID NO: 21185 - DNA, 1118 bp, Artificial Sequence
  chemically treated genomic DNA (Homo sapiens) CpG-island No: 21185
tcgtcgttgttttcgtcgtttttacggtattttttatttttttcgcgttatttggtcgttttagcgttcggacgtcgttcggttattttaaagacgatttagagaataaattattgtagttatagagaagttttttttcggttcgacgcgtcgtttttcgacgcgggtattcggggtcgcgtggattaggttttcgggtcgttttttgttttcgttttcgtattttcgagacgcgtaggtttatagagtagtcggggcgcgcggataaagaggcggcggcgggcggcgaggggtcggagttaggtttacgggtcgcgtatttattttttagtcggcgttttcgttgtagtcgttgttcgttggattaggtcggtaggaacggtcggttcggttgggcgtggcgtagtattttgcgcgggtatcgtcgattggtcgttgtaggttttttttttttcgcggtcggtttcgtttttggcggggttgaggaaggggttgagttatacgtcgggcggcggagcggttcgggtagttatttgatttggtcgcgcgattgattggcgacgtcggattgcgttattcgtcgtattgcgttattcgtcgcgagttaaggtttgcgtttgcgtaggagatagcgacgtttgcgttgcggtacgttataggggggcggggttagtcgcgaaaagttacgtgagcgttagattcgcgtggttattttcgcgtttatttcgggtttttggtcgtaaggcgttagcgttttcgggttttagtagtttgcggttagggtttgtagttggttttttattaagagttgtttacgttttcgaggtcgagcgtatttttagggtacggtggttacgcgagggatttcgcggaaagtcgggtttggagttggtatttattttggttattaggggcgtagatgtttttacgggcgttggagaattggcgttaggcggggttcggcgcggcgtttttttttggggcgtttttttcgcggtgttttcgttttgttggggggttcggcgcgttaggagtcgggatcgtattttgtcgtttttattgtagggttttatttttaggagtttttattcgggcgaaagttttgtttattatagaat

SEQ ID NO: 21186 - DNA, 1118 bp, Artificial Sequence
  chemically treated genomic DNA (Homo sapiens) CpG-island No: 21186
attctataataaacaaaactttcgcccgaataaaaactcctaaaaataaaaccctacaataaaaacgacaaaatacgatcccgactcctaacgcgccgaaccccccaacaaaacgaaaacaccgcgaaaaaaacgccccaaaaaaaaacgccgcgccgaaccccgcctaacgccaattctccaacgcccgtaaaaacatctacgcccctaataaccaaaataaataccaactccaaacccgactttccgcgaaatccctcgcgtaaccaccgtaccctaaaaatacgctcgacctcgaaaacgtaaacaactcttaataaaaaaccaactacaaaccctaaccgcaaactactaaaacccgaaaacgctaacgccttacgaccaaaaacccgaaataaacgcgaaaataaccacgcgaatctaacgctcacgtaacttttcgcgactaaccccgcccccctataacgtaccgcaacgcaaacgtcgctatctcctacgcaaacgcaaaccttaactcgcgacgaataacgcaatacgacgaataacgcaatccgacgtcgccaatcaatcgcgcgaccaaatcaaataactacccgaaccgctccgccgcccgacgtataactcaaccccttcctcaaccccgccaaaaacgaaaccgaccgcgaaaaaaaaaaaacctacaacgaccaatcgacgatacccgcgcaaaatactacgccacgcccaaccgaaccgaccgttcctaccgacctaatccaacgaacaacgactacaacgaaaacgccgactaaaaaataaatacgcgacccgtaaacctaactccgacccctcgccgcccgccgccgcctctttatccgcgcgccccgactactctataaacctacgcgtctcgaaaatacgaaaacgaaaacaaaaaacgacccgaaaacctaatccacgcgaccccgaatacccgcgtcgaaaaacgacgcgtcgaaccgaaaaaaaacttctctataactacaataatttattctctaaatcgtctttaaaataaccgaacgacgtccgaacgctaaaacgaccaaataacgcgaaaaaaataaaaaataccgtaaaaacgacgaaaacaacgacga

SEQ ID NO: 21187 - DNA, 1118 bp, Artificial Sequence
  chemically treated genomic DNA (Homo sapiens) CpG-island No: 21187
gttttgtagtgaataaagttttcgttcgaatgggaatttttggaaataaagttttgtagtaaagacggtagggtgcggtttcggtttttggcgcgtcgagttttttagtagggcgggggtatcgcggaagaagcgttttagaggagagcgtcgcgtcgagtttcgtttggcgttagttttttagcgttcgtggaggtatttgcgtttttagtagttaaggtgagtattagttttaagttcggtttttcgcgaggtttttcgcgtggttatcgtgttttaagggtgcgttcggtttcggggacgtgagtagtttttagtgggaagttagttgtaggttttgatcgtaggttgttggggttcggaagcgttggcgttttgcggttagaagttcggaatggacgcgaaagtgattacgcgaatttgacgtttacgtgatttttcgcgattggtttcgtttttttgtggcgtgtcgtagcgtagacgtcgttgttttttgcgtaggcgtaggttttggttcgcggcgggtgacgtaatgcggcgggtgacgtaattcggcgtcgttagttagtcgcgcggttagattaggtaattgttcgaatcgtttcgtcgttcgacgtgtggtttagttttttttttagtttcgttaggggcggggtcggtcgcgggaggggaggggtttgtagcgattaatcggcggtgttcgcgtagggtgttacgttacgtttagtcgggtcggtcgtttttatcggtttggtttagcggatagcggttgtagcgggggcgtcggttgggaggtgagtgcgcggttcgtaggtttggtttcggtttttcgtcgttcgtcgtcgtttttttgttcgcgcgtttcggttgttttgtggatttgcgcgtttcggggatgcgggagcgggggtagggggcggttcgagggtttgatttacgcggtttcggatgttcgcgtcgggaggcggcgcgtcgggtcgaggaggggtttttttgtggttgtagtagtttgttttttgggtcgtttttggagtggtcgagcggcgttcgggcgttggggcggttaagtggcgcgggaagggtgggaggtgtcgtgagggcggcgaggatagcggcgg

SEQ ID NO: 21188 - DNA, 1118 bp, Artificial Sequence
  chemically treated genomic DNA (Homo sapiens) CpG-island No: 21188
ccgccgctatcctcgccgccctcacgacacctcccacccttcccgcgccacttaaccgccccaacgcccgaacgccgctcgaccactccaaaaacgacccaaaaaacaaactactacaaccacaaaaaaacccctcctcgacccgacgcgccgcctcccgacgcgaacatccgaaaccgcgtaaatcaaaccctcgaaccgccccctacccccgctcccgcatccccgaaacgcgcaaatccacaaaacaaccgaaacgcgcgaacaaaaaaacgacgacgaacgacgaaaaaccgaaaccaaacctacgaaccgcgcactcacctcccaaccgacgcccccgctacaaccgctatccgctaaaccaaaccgataaaaacgaccgacccgactaaacgtaacgtaacaccctacgcgaacaccgccgattaatcgctacaaacccctcccctcccgcgaccgaccccgcccctaacgaaactaaaaaaaaaactaaaccacacgtcgaacgacgaaacgattcgaacaattacctaatctaaccgcgcgactaactaacgacgccgaattacgtcacccgccgcattacgtcacccgccgcgaaccaaaacctacgcctacgcaaaaaacaacgacgtctacgctacgacacgccacaaaaaaacgaaaccaatcgcgaaaaatcacgtaaacgtcaaattcgcgtaatcactttcgcgtccattccgaacttctaaccgcaaaacgccaacgcttccgaaccccaacaacctacgatcaaaacctacaactaacttcccactaaaaactactcacgtccccgaaaccgaacgcacccttaaaacacgataaccacgcgaaaaacctcgcgaaaaaccgaacttaaaactaatactcaccttaactactaaaaacgcaaatacctccacgaacgctaaaaaactaacgccaaacgaaactcgacgcgacgctctcctctaaaacgcttcttccgcgatacccccgccctactaaaaaactcgacgcgccaaaaaccgaaaccgcaccctaccgtctttactacaaaactttatttccaaaaattcccattcgaacgaaaactttattcactacaaaac

SEQ ID NO: 21189 - DNA, 510 bp, Artificial Sequence
  chemically treated genomic DNA (Homo sapiens) CpG-island No: 21189
gtcgttttttcgtacgatttatatcgtcgagtgttcggagatggacgggaaaagttattatagtggtatggttttattttttgtgagtcgtttttaatttaaatttagatagacgtacgttttgttcggttttttttagattcgagagttgcgttgtgaggggacgcgttttttttcgttgatgagaattcgttgttacgttttttgtataggcgagagttttatcgcggcggtaattttattacgtggataaaggtatagtcgtgttttattttcgataatggaggagggcgtggggtatgtattaggggttgtttcgggggttagatcgtcgggggacggtaacgtatttgcgcggcgacgtttagggttagcgcgggtcgcggtttttacggtcgggacgtttttcgcgtgggacgtagttttattgaggggtcggtcgcggaggttataaggtgggtttatcgaagtttttggtaggggtacgggaagagtcgttttttttttttt

SEQ ID NO: 21190 - DNA, 510 bp, Artificial Sequence
  chemically treated genomic DNA (Homo sapiens) CpG-island No: 21190
aaaaaaaaaaaaacgactcttcccgtacccctaccaaaaacttcgataaacccaccttataacctccgcgaccgacccctcaataaaactacgtcccacgcgaaaaacgtcccgaccgtaaaaaccgcgacccgcgctaaccctaaacgtcgccgcgcaaatacgttaccgtcccccgacgatctaacccccgaaacaacccctaatacataccccacgccctcctccattatcgaaaataaaacacgactatacctttatccacgtaataaaattaccgccgcgataaaactctcgcctatacaaaaaacgtaacaacgaattctcatcaacgaaaaaaaacgcgtcccctcacaacgcaactctcgaatctaaaaaaaaccgaacaaaacgtacgtctatctaaatttaaattaaaaacgactcacaaaaaataaaaccataccactataataacttttcccgtccatctccgaacactcgacgatataaatcgtacgaaaaaacgac

SEQ ID NO: 21191 - DNA, 510 bp, Artificial Sequence
  chemically treated genomic DNA (Homo sapiens) CpG-island No: 21191
gaggagagaaaggcggtttttttcgtgtttttattagaggtttcggtgggtttattttgtgattttcgcggtcggttttttagtggaattgcgttttacgcggggggcgtttcgatcgtgggggtcgcggttcgcgttgattttggacgtcgtcgcgtaggtacgttgtcgtttttcggcggtttgattttcgagatagtttttagtgtatattttacgtttttttttattgtcgagaatgagatacggttgtgtttttgtttacgtggtagagttgtcgtcgcggtgaggttttcgtttgtgtaaaaagcgtggtagcgaatttttattaacgaggggaggcgcgtttttttatagcgtagttttcgggtttgaggagggtcgggtagggcgtgcgtttgtttaggtttgaattaaaggcgatttataggaaataaggttatgttattgtggtagtttttttcgtttattttcggatattcgacggtgtgggtcgtgcgaggaggcggt

SEQ ID NO: 21192 - DNA, 510 bp, Artificial Sequence
  chemically treated genomic DNA (Homo sapiens) CpG-island No: 21192
accgcctcctcgcacgacccacaccgtcgaatatccgaaaataaacgaaaaaaactaccacaataacataaccttatttcctataaatcgcctttaattcaaacctaaacaaacgcacgccctacccgaccctcctcaaacccgaaaactacgctataaaaaaacgcgcctcccctcgttaataaaaattcgctaccacgctttttacacaaacgaaaacctcaccgcgacgacaactctaccacgtaaacaaaaacacaaccgtatctcattctcgacaataaaaaaaaacgtaaaatatacactaaaaactatctcgaaaatcaaaccgccgaaaaacgacaacgtacctacgcgacgacgtccaaaatcaacgcgaaccgcgacccccacgatcgaaacgccccccgcgtaaaacgcaattccactaaaaaaccgaccgcgaaaatcacaaaataaacccaccgaaacctctaataaaaacacgaaaaaaaccgcctttctctcctc

SEQ ID NO: 21193 - DNA, 699 bp, Artificial Sequence
  chemically treated genomic DNA (Homo sapiens) CpG-island No: 21193
gtttcgcggtttttcgcgcgcggttagtcggtttttacgtagacgcgagcgtttcggcgtcgttttttttcgtattttcgtgacgggtagcgaagttagttagtgggattgcgggtcggaaggttaatttcgtttatgtgtggtttataagaggcggtagttttcgggagtgttatttttttagaaatttcggtaaattcgttttagagttttcgttggtttaatcgggttatagatttcggttcgtttggttaggtgggatgtttgattgggttaaattttttaggtttcgtatttagagcggggagtagcgtttgttttttttttcgttgagcggaggtcgttaggttggagagggaggggaaggtgtgtggggtcgggtgagatgtttttttttcgtttcgtatgcgtttgtattggagtgattttagttaaaagtttcgtgaaacgttattagtgatgtagttacggttagtagtagttgtttgatttcgtcgaggtttttcgtttggtaatatgtggggcgtcgtaatgtttgaggttacggcgagggtaacgtcggtcgcgtttcgtggaaatcgcgtggcggagtgtttgagtcgatcgcgttttttaggagttaggttatttagaggcgatattttggtggatacggaggaagttagttttagttagatgggaaaagtagttaaaagtggg

SEQ ID NO: 21194 - DNA, 699 bp, Artificial Sequence
  chemically treated genomic DNA (Homo sapiens) CpG-island No: 21194
cccacttttaactacttttcccatctaactaaaactaacttcctccgtatccaccaaaatatcgcctctaaataacctaactcctaaaaaacgcgatcgactcaaacactccgccacgcgatttccacgaaacgcgaccgacgttaccctcgccgtaacctcaaacattacgacgccccacatattaccaaacgaaaaacctcgacgaaatcaaacaactactactaaccgtaactacatcactaataacgtttcacgaaacttttaactaaaatcactccaatacaaacgcatacgaaacgaaaaaaaaacatctcacccgaccccacacaccttcccctccctctccaacctaacgacctccgctcaacgaaaaaaaaaacaaacgctactccccgctctaaatacgaaacctaaaaaatttaacccaatcaaacatcccacctaaccaaacgaaccgaaatctataacccgattaaaccaacgaaaactctaaaacgaatttaccgaaatttctaaaaaaataacactcccgaaaactaccgcctcttataaaccacacataaacgaaattaaccttccgacccgcaatcccactaactaacttcgctacccgtcacgaaaatacgaaaaaaaacgacgccgaaacgctcgcgtctacgtaaaaaccgactaaccgcgcgcgaaaaaccgcgaaac

SEQ ID NO: 21195 - DNA, 699 bp, Artificial Sequence
  chemically treated genomic DNA (Homo sapiens) CpG-island No: 21195
tttatttttagttattttttttatttgattaaaattggtttttttcgtgtttattaagatgtcgtttttaagtggtttaatttttaaagagcgcgatcggtttaagtatttcgttacgcggtttttacggggcgcggtcggcgttgttttcgtcgtggttttaagtattgcggcgttttatatgttgttagacggaaggtttcggcggggttaggtagttgttgttggtcgtgattatattattggtgacgttttacgagatttttaattgaaattattttaatataggcgtatgcgggacgaggggaaagtattttattcgattttatatatttttttttttttttttagtttagcggttttcgtttagcggaaaaaaaagtagacgttatttttcgttttaggtgcgggatttaagaggtttggtttaattaggtattttatttaattagacgggtcggagtttgtggttcggttggattaacgaaaattttagggcggatttgtcgggatttttgggaaagtgatattttcggaagttatcgttttttataagttatatatgggcggagttagtttttcggttcgtagttttattggttgatttcgttgttcgttacgggaatgcgggagagggcggcgtcggggcgttcgcgtttgcgtggagatcggttggtcgcgcgcgggaagtcgcggaat

SEQ ID NO: 21196 - DNA, 699 bp, Artificial Sequence
  chemically treated genomic DNA (Homo sapiens) CpG-island No: 21196
attccgcgacttcccgcgcgcgaccaaccgatctccacgcaaacgcgaacgccccgacgccgccctctcccgcattcccgtaacgaacaacgaaatcaaccaataaaactacgaaccgaaaaactaactccgcccatatataacttataaaaaacgataacttccgaaaatatcactttcccaaaaatcccgacaaatccgccctaaaattttcgttaatccaaccgaaccacaaactccgacccgtctaattaaataaaatacctaattaaaccaaacctcttaaatcccgcacctaaaacgaaaaataacgtctacttttttttccgctaaacgaaaaccgctaaactaaaaaaaaaaaaaaaaatatataaaatcgaataaaatactttcccctcgtcccgcatacgcctatattaaaataatttcaattaaaaatctcgtaaaacgtcaccaataatataatcacgaccaacaacaactacctaaccccgccgaaaccttccgtctaacaacatataaaacgccgcaatacttaaaaccacgacgaaaacaacgccgaccgcgccccgtaaaaaccgcgtaacgaaatacttaaaccgatcgcgctctttaaaaattaaaccacttaaaaacgacatcttaataaacacgaaaaaaaccaattttaatcaaataaaaaaaataactaaaaataaa

SEQ ID NO: 21197 - DNA, 1352 bp, Artificial Sequence
  chemically treated genomic DNA (Homo sapiens) CpG-island No: 21197
gaattttagttcgtcgcggcgattttgtatatatatacgtattagtttggtagttagagttcgtttggagacgtttttagttcggggtttgcgtttttcgggattttcgacgtagtttttcgttttcgttttttacgtttaatcgggtagggcgtcggggcgtgattttcgattttttgtttgtttgttgggtttttcggaggcgggttagatcgtattcgtcgcgggcgttcggtgcgtttttagtttttggttcgcggcggcgatagcggcgttgttcgttggagtttgatttttcggcggcggcggtagcggcgcgtagtagcgaacggttggagtaaggcgagtcgggtcgttagtttttcgcgttgcgttgggattggtttttttagaagagtgttggtcgagggttggttgcgggtcggttgaagaataggtgtattttatcgttcgggttcgcggagtagtcgtcgaagatcgcggcggttaggtaggttttttgtgtcggaatgcgggtggcgggtattcggtatttcgcgatcggtcgtcggggttattgaaggcggcgcgaggtttaggcgcggcgcgagcgggcgttttagggagcgggttgggcgcggtgtttcgaggatgtcggcgtttttggagcgtacgtaggcggcgggtagtagtagtagtagcgggcgcggggattcggcgcgtaggaggcggtttggagggttgtagacgcgtttcgtcgttttttgatcgatcggaggcgtcgggggttcgtttcgtttttttttcgagttttttatcgtttttttttcggtttcgttttttttttcgtttttttttttttcgttcgtcgttcgtttttcggggggaggggcgtgggggtagggagcggatttgtatgcggtcgtcgcggtcgttgtttgcgttcgagttcgtcgtcgtcgtcggagttcgcgttcgcgttcgcgttcggttcgcgcggttttatgtttttgtcgcggttttcgggggggcgaaggtgaagatcggtttttaggatgagtgaaggggcggtcgttgtttcgttatttggtgtcgtttcggtagtcgtcgtttcggtcgaggagggtatcgcggcggttgcggcggcggtagcggcgggcgggggttcggacggcggcggcgaaggggcggtcgagttttttcgggagttacgttgtagcgattgtatcgtgtggaatcggtagtagacgtggttgtgcgtggtatttttgtttatcggttttatcggtttggggtttagttttatgttttttaaatggatcgtggtgggtttcgttaaggagtacgtgtttatcgatttagtggattttaag

SEQ ID NO: 21198 - DNA, 1352 bp, Artificial Sequence
  chemically treated genomic DNA (Homo sapiens) CpG-island No: 21198
cttaaaatccactaaatcgataaacacgtactccttaacgaaacccaccacgatccatttaaaaaacataaaactaaaccccaaaccgataaaaccgataaacaaaaataccacgcacaaccacgtctactaccgattccacacgatacaatcgctacaacgtaactcccgaaaaaactcgaccgccccttcgccgccgccgtccgaacccccgcccgccgctaccgccgccgcaaccgccgcgataccctcctcgaccgaaacgacgactaccgaaacgacaccaaataacgaaacaacgaccgccccttcactcatcctaaaaaccgatcttcaccttcgcccccccgaaaaccgcgacaaaaacataaaaccgcgcgaaccgaacgcgaacgcgaacgcgaactccgacgacgacgacgaactcgaacgcaaacaacgaccgcgacgaccgcatacaaatccgctccctacccccacgcccctccccccgaaaaacgaacgacgaacgaaaaaaaaaaaaacgaaaaaaaaaacgaaaccgaaaaaaaaacgataaaaaactcgaaaaaaaaacgaaacgaacccccgacgcctccgatcgatcaaaaaacgacgaaacgcgtctacaaccctccaaaccgcctcctacgcgccgaatccccgcgcccgctactactactactacccgccgcctacgtacgctccaaaaacgccgacatcctcgaaacaccgcgcccaacccgctccctaaaacgcccgctcgcgccgcgcctaaacctcgcgccgccttcaataaccccgacgaccgatcgcgaaataccgaatacccgccacccgcattccgacacaaaaaacctacctaaccgccgcgatcttcgacgactactccgcgaacccgaacgataaaatacacctattcttcaaccgacccgcaaccaaccctcgaccaacactcttctaaaaaaaccaatcccaacgcaacgcgaaaaactaacgacccgactcgccttactccaaccgttcgctactacgcgccgctaccgccgccgccgaaaaatcaaactccaacgaacaacgccgctatcgccgccgcgaaccaaaaactaaaaacgcaccgaacgcccgcgacgaatacgatctaacccgcctccgaaaaacccaacaaacaaacaaaaaatcgaaaatcacgccccgacgccctacccgattaaacgtaaaaaacgaaaacgaaaaactacgtcgaaaatcccgaaaaacgcaaaccccgaactaaaaacgtctccaaacgaactctaactaccaaactaatacgtatatatatacaaaatcgccgcgacgaactaaaattc

SEQ ID NO: 21199 - DNA, 1352 bp, Artificial Sequence
  chemically treated genomic DNA (Homo sapiens) CpG-island No: 21199
tttggagtttattaggtcggtgggtacgtattttttgacggagtttattacgatttatttgagaagtatgaggttgagttttaggtcgatgaagtcgatgaatagaggtattacgtatagttacgtttgttgtcggttttatacgatgtagtcgttatagcgtaattttcgggggggttcggtcgttttttcgtcgtcgtcgttcgggttttcgttcgtcgttgtcgtcgtcgtagtcgtcgcggtgtttttttcggtcgaggcggcggttgtcgaagcggtattaggtggcgaggtagcggtcgtttttttatttattttaggagtcggtttttattttcgttttttcgagggtcgcggtagaggtatggggtcgcgcgggtcgggcgcgggcgcgggcgcgggtttcggcggcggcggcgggttcgggcgtaggtagcggtcgcggcggtcgtatgtaaattcgttttttgtttttacgttttttttttcgagaggcgggcggcgggcggggaggagaggagcgggggaggggacggggtcggggagggggcggtaaggagttcggaagaggggcgagacgggttttcggcgttttcggtcggttagagagcggcggggcgcgtttgtagttttttaagtcgttttttgcgcgtcgggttttcgcgttcgttgttgttgttgttgttcgtcgtttgcgtgcgttttaggagcgtcgatattttcggggtatcgcgtttagttcgttttttggggcgttcgttcgcgtcgcgtttgggtttcgcgtcgtttttagtggtttcggcggtcggtcgcggggtgtcgggtgttcgttattcgtatttcgatatagagggtttgtttggtcgtcgcgattttcggcggttgtttcgcgagttcgggcggtgaggtgtatttgttttttagtcggttcgtagttaattttcggttagtatttttttggagagattaattttagcgtagcgcggagggttagcggttcggttcgttttgttttagtcgttcgttgttgcgcgtcgttgtcgtcgtcgtcggagagttaaattttagcgaatagcgtcgttgtcgtcgtcgcgagttaggggttgggggcgtatcgggcgttcgcggcgggtgcggtttgattcgttttcgagggatttaataagtaggtagaggatcggaaattacgtttcggcgttttgttcggttgagcgtgggggacggaagcgggagattgcgtcgggggtttcggggaacgtagatttcgggttgagggcgtttttagacgggttttggttgttaggttggtgcgtgtgtgtgtgtagaatcgtcgcggcgggttgggattt

SEQ ID NO: 21200 - DNA, 1352 bp, Artificial Sequence
  chemically treated genomic DNA (Homo sapiens) CpG-island No: 21200
aaatcccaacccgccgcgacgattctacacacacacacgcaccaacctaacaaccaaaacccgtctaaaaacgccctcaacccgaaatctacgttccccgaaacccccgacgcaatctcccgcttccgtcccccacgctcaaccgaacaaaacgccgaaacgtaatttccgatcctctacctacttattaaatccctcgaaaacgaatcaaaccgcacccgccgcgaacgcccgatacgcccccaacccctaactcgcgacgacgacaacgacgctattcgctaaaatttaactctccgacgacgacgacaacgacgcgcaacaacgaacgactaaaacaaaacgaaccgaaccgctaaccctccgcgctacgctaaaattaatctctccaaaaaaatactaaccgaaaattaactacgaaccgactaaaaaacaaatacacctcaccgcccgaactcgcgaaacaaccgccgaaaatcgcgacgaccaaacaaaccctctatatcgaaatacgaataacgaacacccgacaccccgcgaccgaccgccgaaaccactaaaaacgacgcgaaacccaaacgcgacgcgaacgaacgccccaaaaaacgaactaaacgcgataccccgaaaatatcgacgctcctaaaacgcacgcaaacgacgaacaacaacaacaacaacgaacgcgaaaacccgacgcgcaaaaaacgacttaaaaaactacaaacgcgccccgccgctctctaaccgaccgaaaacgccgaaaacccgtctcgcccctcttccgaactccttaccgccccctccccgaccccgtcccctcccccgctcctctcctccccgcccgccgcccgcctctcgaaaaaaaaaacgtaaaaacaaaaaacgaatttacatacgaccgccgcgaccgctacctacgcccgaacccgccgccgccgccgaaacccgcgcccgcgcccgcgcccgacccgcgcgaccccatacctctaccgcgaccctcgaaaaaacgaaaataaaaaccgactcctaaaataaataaaaaaacgaccgctacctcgccacctaataccgcttcgacaaccgccgcctcgaccgaaaaaaacaccgcgacgactacgacgacgacaacgacgaacgaaaacccgaacgacgacgacgaaaaaacgaccgaacccccccgaaaattacgctataacgactacatcgtataaaaccgacaacaaacgtaactatacgtaatacctctattcatcgacttcatcgacctaaaactcaacctcatacttctcaaataaatcgtaataaactccgtcaaaaaatacgtacccaccgacctaataaactccaaa

SEQ ID NO: 21201 - DNA, 553 bp, Artificial Sequence
  chemically treated genomic DNA (Homo sapiens) CpG-island No: 21201
tttcggtatttatcgcgcgggtgcggttcgaacgttattagtacgaagtagttcgcgagtcgcgttatggcgagggacgcggggcggttcgaggggcgcgggcgggtttcgcggttcggggattcgaggacggcgcgtttatggttcggtttcggttttggatcgcgtatttcggatatttttggttcgtttcgcggcggcggcggcggcggcggcggcggtttaggttttcgtcgttatttttttagttagtcggttcgttcgggcgcgtcgtgcgtttgcgcgttgtcgttaagttttgagcgggcggggtttgtaatcgcgtatttttattggtttagagggtgggagggcggttttcgagagtagcgtttcgtttatcgttgattattttggggttcgagtatcgtttttcgggtcgggtatttggattacggtttcggcgggtttgacgttttgattcgggtcggttgtggtgtcggcgggaggtatgggttaggattatagttgttttcgtcgttgggatttttcgtataggagttcgaattttatt

SEQ ID NO: 21202 - DNA, 553 bp, Artificial Sequence
  chemically treated genomic DNA (Homo sapiens) CpG-island No: 21202
aataaaattcgaactcctatacgaaaaatcccaacgacgaaaacaactataatcctaacccatacctcccgccgacaccacaaccgacccgaatcaaaacgtcaaacccgccgaaaccgtaatccaaatacccgacccgaaaaacgatactcgaaccccaaaataatcaacgataaacgaaacgctactctcgaaaaccgccctcccaccctctaaaccaataaaaatacgcgattacaaaccccgcccgctcaaaacttaacgacaacgcgcaaacgcacgacgcgcccgaacgaaccgactaactaaaaaaataacgacgaaaacctaaaccgccgccgccgccgccgccgccgccgcgaaacgaaccaaaaatatccgaaatacgcgatccaaaaccgaaaccgaaccataaacgcgccgtcctcgaatccccgaaccgcgaaacccgcccgcgcccctcgaaccgccccgcgtccctcgccataacgcgactcgcgaactacttcgtactaataacgttcgaaccgcacccgcgcgataaataccgaaa

SEQ ID NO: 21203 - DNA, 553 bp, Artificial Sequence
  chemically treated genomic DNA (Homo sapiens) CpG-island No: 21203
ggtggggttcgggtttttgtgcggggagttttaacggcgagggtagttgtggttttggtttatgtttttcgtcgatattatagtcgattcgggttagggcgttagattcgtcggagtcgtagtttaggtgttcggttcgaggggcggtgttcgggttttagagtggttagcgatgggcggggcgttgttttcgggagtcgtttttttattttttggattaatggagatgcgcggttgtaggtttcgttcgtttagggtttgacgatagcgcgtaggcgtacggcgcgttcgggcgggtcggttggttgggaagatggcggcgggaatttgggtcgtcgtcgtcgtcgtcgtcgtcgtcgcggagcgaattaggggtgttcggggtgcgcggtttagggtcggggtcgggttatgagcgcgtcgttttcgagttttcgagtcgcggagttcgttcgcgtttttcgggtcgtttcgcgtttttcgttatggcgcggttcgcggattatttcgtgttggtggcgttcgggtcgtattcgcgcggtgagtgtcgagg

SEQ ID NO: 21204 - DNA, 553 bp, Artificial Sequence
  chemically treated genomic DNA (Homo sapiens) CpG-island No: 21204
cctcgacactcaccgcgcgaatacgacccgaacgccaccaacacgaaataatccgcgaaccgcgccataacgaaaaacgcgaaacgacccgaaaaacgcgaacgaactccgcgactcgaaaactcgaaaacgacgcgctcataacccgaccccgaccctaaaccgcgcaccccgaacacccctaattcgctccgcgacgacgacgacgacgacgacgacgacccaaattcccgccgccatcttcccaaccaaccgacccgcccgaacgcgccgtacgcctacgcgctatcgtcaaaccctaaacgaacgaaacctacaaccgcgcatctccattaatccaaaaaataaaaaaacgactcccgaaaacaacgccccgcccatcgctaaccactctaaaacccgaacaccgcccctcgaaccgaacacctaaactacgactccgacgaatctaacgccctaacccgaatcgactataatatcgacgaaaaacataaaccaaaaccacaactaccctcgccgttaaaactccccgcacaaaaacccgaaccccacc

SEQ ID NO: 21205 - DNA, 872 bp, Artificial Sequence
  chemically treated genomic DNA (Homo sapiens) CpG-island No: 21205
ttcggggtcggcggtatcgcgttagaggagagcggaatggttagttcgttgcggaatttcgcggatttgttggttaggttggggggtcggggtttatcgggttagattttggagggtgggatcgttcggattcgggaggtggttgacggggtgggtttcgtcgggttcgagttcgttttagtcgtgggattagttcggacgacggttcgttttttagaatttcgttgtagcgtggggaagttcggttttcgtaggttcggggttgcgtttttattagaaggcgtttggagtgaggttggcggtttcgcggtttcgggtcggtcgtcgagcgtttttagcggggataggtttttttatcgtttttttcgtcgtagtttttttttcgtttcgagggtggttgggttcggaggaggggcgtttcgtttcgttcgtgtattcggtttcgttttttgttggaaaggttacgtatttagttttggaggtgttatttcgggtcgcgatttcgttttaggtaggatttttaattcgtttagttcgtttcgttttgcgtttcggattcgcggtcgattttagattcgttgttcgtttcgcgttcgaggtttgcgtttcgacggacgttcgtgtttagtttgttacgtttacgttcggcgtttcgatcgcggaggatttttcgaggtgtcggcggagggggtggttcgcggtttaggttgttttcgacgtgttcggtttatcgtttttttttttgtagtttcgttcgttatggttcggatttcgacggtcgttttgggttgtattagttttttttgtttgtagttttttggttcgttgtttcgtagtttgggcggggattcgcgattcgttaaatttaggtg

SEQ ID NO: 21206 - DNA, 872 bp, Artificial Sequence
  chemically treated genomic DNA (Homo sapiens) CpG-island No: 21206
cacctaaatttaacgaatcgcgaatccccgcccaaactacgaaacaacgaaccaaaaaactacaaacaaaaaaaactaatacaacccaaaacgaccgtcgaaatccgaaccataacgaacgaaactacaaaaaaaaaaacgataaaccgaacacgtcgaaaacaacctaaaccgcgaaccaccccctccgccgacacctcgaaaaatcctccgcgatcgaaacgccgaacgtaaacgtaacaaactaaacacgaacgtccgtcgaaacgcaaacctcgaacgcgaaacgaacaacgaatctaaaatcgaccgcgaatccgaaacgcaaaacgaaacgaactaaacgaattaaaaatcctacctaaaacgaaatcgcgacccgaaataacacctccaaaactaaatacgtaacctttccaacaaaaaacgaaaccgaatacacgaacgaaacgaaacgcccctcctccgaacccaaccaccctcgaaacgaaaaaaaaactacgacgaaaaaaacgataaaaaaacctatccccgctaaaaacgctcgacgaccgacccgaaaccgcgaaaccgccaacctcactccaaacgccttctaataaaaacgcaaccccgaacctacgaaaaccgaacttccccacgctacaacgaaattctaaaaaacgaaccgtcgtccgaactaatcccacgactaaaacgaactcgaacccgacgaaacccaccccgtcaaccacctcccgaatccgaacgatcccaccctccaaaatctaacccgataaaccccgaccccccaacctaaccaacaaatccgcgaaattccgcaacgaactaaccattccgctctcctctaacgcgataccgccgaccccgaa

SEQ ID NO: 21207 - DNA, 872 bp, Artificial Sequence
  chemically treated genomic DNA (Homo sapiens) CpG-island No: 21207
tatttgggtttgacgggtcgcgggttttcgtttaggttgcgggatagcgagttagggagttgtaggtagaggaggttgatgtaatttagggcggtcgtcgggattcgggttatggcgggcggggttgtaggggagggggcggtgagtcgggtacgtcgggggtagtttgagtcgcgagttatttttttcgtcggtatttcggggagtttttcgcggtcggggcgtcgggcgtgggcgtggtaagttgggtacgggcgttcgtcggggcgtaggtttcgggcgcgaagcgggtagcgggtttggggtcggtcgcgggttcggggcgtaaggcggagcgggttgggcgggttgggggttttgtttggagcggagtcgcggttcgggatggtatttttagggttgaatacgtagtttttttagtaaggggcggagtcggatgtacggacggggcggggcgtttttttttcgggtttagttattttcggggcggggagggggttgcggcgaagggagcggtggaggggtttgttttcgttgggagcgttcggcgatcggttcgggatcgcgggatcgttagttttattttaagcgttttttggtggggacgtagtttcgagtttgcgggggtcggatttttttacgttgtagcggggttttggggggcgaatcgtcgttcgagttgattttacggttggggcggattcggattcgacggggtttatttcgttaattatttttcgagttcgggcggttttattttttagggtttgattcggtggatttcggttttttagtttgattagtaagttcgcgggatttcgtagcgggttggttatttcgtttttttttgacgcggtgtcgtcgatttcggg

SEQ ID NO: 21208 - DNA, 872 bp, Artificial Sequence
  chemically treated genomic DNA (Homo sapiens) CpG-island No: 21208
cccgaaatcgacgacaccgcgtcaaaaaaaaacgaaataaccaacccgctacgaaatcccgcgaacttactaatcaaactaaaaaaccgaaatccaccgaatcaaaccctaaaaaataaaaccgcccgaactcgaaaaataattaacgaaataaaccccgtcgaatccgaatccgccccaaccgtaaaatcaactcgaacgacgattcgccccccaaaaccccgctacaacgtaaaaaaatccgacccccgcaaactcgaaactacgtccccaccaaaaaacgcttaaaataaaactaacgatcccgcgatcccgaaccgatcgccgaacgctcccaacgaaaacaaacccctccaccgctcccttcgccgcaaccccctccccgccccgaaaataactaaacccgaaaaaaaaacgccccgccccgtccgtacatccgactccgccccttactaaaaaaactacgtattcaaccctaaaaataccatcccgaaccgcgactccgctccaaacaaaacccccaacccgcccaacccgctccgccttacgccccgaacccgcgaccgaccccaaacccgctacccgcttcgcgcccgaaacctacgccccgacgaacgcccgtacccaacttaccacgcccacgcccgacgccccgaccgcgaaaaactccccgaaataccgacgaaaaaaataactcgcgactcaaactacccccgacgtacccgactcaccgccccctcccctacaaccccgcccgccataacccgaatcccgacgaccgccctaaattacatcaacctcctctacctacaactccctaactcgctatcccgcaacctaaacgaaaacccgcgacccgtcaaacccaaata

SEQ ID NO: 21209 - DNA, 543 bp, Artificial Sequence
  chemically treated genomic DNA (Homo sapiens) CpG-island No: 21209
tttgaaattttcggttcgtagagggcgtcgcgttaaggatagcgcgggtagattcgggagggggcggggtcgtagttacggtcgttttttatgaatgggggagcgggcggtgcgaggttttattattatgtcgcgtaacgcgcgttgcgttttagcgcgtcgcgtttattggttgatcggatcgttgacgttatcgaatcggtggtcgggggcggggcggggtgatttacgtcgtttttttcgcggtcgcgggggtttttcggggtttacgtacgttttgcgtcgttaggattcgagcggagttttttcgcggttcggtcgcgtttggttttgagcggtgagtagcgggtttcgtcgcgggtattaggggttttgaagggtacgtaggatgttggggtattgggtcggcggaaggtttttagtggtcggtcggggttcgagttcgaggtgggaattttgggtttaggcgattttgggttagtaggtttgggtttaagtgttcgagtgttggggttgagttggatgattcggcgaagggtaagt

SEQ ID NO: 21210 - DNA, 543 bp, Artificial Sequence
  chemically treated genomic DNA (Homo sapiens) CpG-island No: 21210
acttacccttcgccgaatcatccaactcaaccccaacactcgaacacttaaacccaaacctactaacccaaaatcgcctaaacccaaaattcccacctcgaactcgaaccccgaccgaccactaaaaaccttccgccgacccaataccccaacatcctacgtacccttcaaaacccctaatacccgcgacgaaacccgctactcaccgctcaaaaccaaacgcgaccgaaccgcgaaaaaactccgctcgaatcctaacgacgcaaaacgtacgtaaaccccgaaaaacccccgcgaccgcgaaaaaaacgacgtaaatcaccccgccccgcccccgaccaccgattcgataacgtcaacgatccgatcaaccaataaacgcgacgcgctaaaacgcaacgcgcgttacgcgacataataataaaacctcgcaccgcccgctcccccattcataaaaaacgaccgtaactacgaccccgccccctcccgaatctacccgcgctatccttaacgcgacgccctctacgaaccgaaaatttcaaa

SEQ ID NO: 21211 - DNA, 543 bp, Artificial Sequence
  chemically treated genomic DNA (Homo sapiens) CpG-island No: 21211
gtttatttttcgtcgggttatttaatttaattttagtattcgagtatttgggtttaagtttgttaatttagaatcgtttaaatttagaatttttatttcgaattcgaatttcggtcggttattaggagtttttcgtcggtttagtgttttagtattttgcgtgttttttaggatttttggtgttcgcggcggggttcgttatttatcgtttaggattaggcgcggtcgggtcgcggggaggtttcgttcgggttttggcggcgtagggcgtgcgtggatttcgagaagttttcgcggtcgcgggagaagcggcgtgagttatttcgtttcgttttcggttatcggttcggtgacgttagcggttcgattagttaatgggcgcggcgcgttggggcgtagcgcgcgttgcgcggtatagtaataaggtttcgtatcgttcgtttttttatttataaaaagcgatcgtggttgcggtttcgttttttttcgagtttgttcgcgttgtttttgacgcggcgttttttgcgggtcgggggttttaga

SEQ ID NO: 21212 - DNA, 543 bp, Artificial Sequence
  chemically treated genomic DNA (Homo sapiens) CpG-island No: 21212
tctaaaacccccgacccgcaaaaaacgccgcgtcaaaaacaacgcgaacaaactcgaaaaaaaacgaaaccgcaaccacgatcgctttttataaataaaaaaacgaacgatacgaaaccttattactataccgcgcaacgcgcgctacgccccaacgcgccgcgcccattaactaatcgaaccgctaacgtcaccgaaccgataaccgaaaacgaaacgaaataactcacgccgcttctcccgcgaccgcgaaaacttctcgaaatccacgcacgccctacgccgccaaaacccgaacgaaacctccccgcgacccgaccgcgcctaatcctaaacgataaataacgaaccccgccgcgaacaccaaaaatcctaaaaaacacgcaaaatactaaaacactaaaccgacgaaaaactcctaataaccgaccgaaattcgaattcgaaataaaaattctaaatttaaacgattctaaattaacaaacttaaacccaaatactcgaatactaaaattaaattaaataacccgacgaaaaataaac

SEQ ID NO: 21213 - DNA, 1424 bp, Artificial Sequence
  chemically treated genomic DNA (Homo sapiens) CpG-island No: 21213
ggcgatttttatttttattcggtttttttttatttatataataaagcggggcgttttataaggagtttaattcggaaaaggagaagtagtcggtgatacgtattttgagggttatagtttttaggggtttttcgggacggcgaataatgtaggggggagaggaggagcggaggcggggagcggagcgcgatagtcgtattgggtaattcggcggcgttttttcgttcgtagtgttgggaaggggggagcgttgcgttcgcggggaacgttttgcgttcgggttgtttggttttttcgttcgttcgtttttgttttttcgattgtttatttttttttttagtgtatttgcgttcggcgtagggggcggcggggcgggggaagggagttgtagttttttttttcgaagtgtcggtttttgcgtttatttttcgggtgtgtttatttatcgttgatttcgtggaggggggtatcgtttttgttgaagtttttggatacgtaaagacgtcgtattttcgagtaatttttcgatttgagttcggtagttagtagcgcggcgttgagtattgttagggtgtagagaagcgcgggtaagtcgaatcgtgttatggtgcgggtcggggcggacgcgtttttatttttgggatcggacgggaagcggcgttacggtagcgggtcgagggttggcggagtcggggattagcgagtggagttggagggagaaggagttggagttggtggaagaggcgagtaggcggaggagacgcggggcgaaaagtagagttgggtttcgcgttaggtaacggttttcggtgttaggcgtcgggttaggggagaaggagggcgtggaggcggcgcgcggtttagggaagtagaggcgcgggttggtgatttcggggtttcgcggggtagcgaattcggtaagttgattggtcggcgaggcggggacgcggggaaggagggaagggtggtaggcgtcgcggggatcgtagagggtgtgggcggcggcgggcgttcgttgcgcgttgtttgggttgttttgcgttggttcgttcgttcggttggattcggttcggttgattttgtttttcgtcgcgcggttgtgttttttttagttttgtcgttgattgattggtcggcgtgcgcggcgacgtttcgtaaatttggttaagcgggcggtattcggggggagggggcgggcgtcgtgggggggtcggagataggcgggagtacgttgggtcgggtcgggagaaaatttggaagtcgggttggattcggagcggttaaatttattttttagggggtcgtatcgggcgttcggcgttttttcgcgtgatacgttttattcggtttttttttttttttttttttttcggaggcggggagttagtttatcgttttttaattataaagggaaggttaattat

SEQ ID NO: 21214 - DNA, 1424 bp, Artificial Sequence
  chemically treated genomic DNA (Homo sapiens) CpG-island No: 21214
ataattaaccttccctttataattaaaaaacgataaactaactccccgcctccgaaaaaaaaaaaaaaaaaaaaaaaccgaataaaacgtatcacgcgaaaaaacgccgaacgcccgatacgaccccctaaaaaataaatttaaccgctccgaatccaacccgacttccaaattttctcccgacccgacccaacgtactcccgcctatctccgacccccccacgacgcccgccccctccccccgaataccgcccgcttaaccaaatttacgaaacgtcgccgcgcacgccgaccaatcaatcaacgacaaaactaaaaaaaacacaaccgcgcgacgaaaaacaaaatcaaccgaaccgaatccaaccgaacgaacgaaccaacgcaaaacaacccaaacaacgcgcaacgaacgcccgccgccgcccacaccctctacgatccccgcgacgcctaccacccttccctccttccccgcgtccccgcctcgccgaccaatcaacttaccgaattcgctaccccgcgaaaccccgaaatcaccaacccgcgcctctacttccctaaaccgcgcgccgcctccacgccctccttctcccctaacccgacgcctaacaccgaaaaccgttacctaacgcgaaacccaactctacttttcgccccgcgtctcctccgcctactcgcctcttccaccaactccaactccttctccctccaactccactcgctaatccccgactccgccaaccctcgacccgctaccgtaacgccgcttcccgtccgatcccaaaaataaaaacgcgtccgccccgacccgcaccataacacgattcgacttacccgcgcttctctacaccctaacaatactcaacgccgcgctactaactaccgaactcaaatcgaaaaattactcgaaaatacgacgtctttacgtatccaaaaacttcaacaaaaacgatacccccctccacgaaatcaacgataaataaacacacccgaaaaataaacgcaaaaaccgacacttcgaaaaaaaaaactacaactcccttcccccgccccgccgccccctacgccgaacgcaaatacactaaaaaaaaaaataaacaatcgaaaaaacaaaaacgaacgaacgaaaaaaccaaacaacccgaacgcaaaacgttccccgcgaacgcaacgctccccccttcccaacactacgaacgaaaaaacgccgccgaattacccaatacgactatcgcgctccgctccccgcctccgctcctcctctcccccctacattattcgccgtcccgaaaaacccctaaaaactataaccctcaaaatacgtatcaccgactacttctccttttccgaattaaactccttataaaacgccccgctttattatataaataaaaaaaaaccgaataaaaataaaaatcgcc

SEQ ID NO: 21215 - DNA, 1424 bp, Artificial Sequence
  chemically treated genomic DNA (Homo sapiens) CpG-island No: 21215
gtagttggttttttttttgtggttggggggcggtgggttggtttttcgttttcgaggaggaggggaggaaggaggagtcgggtggggcgtgttacgcgaaggagcgtcgggcgttcggtgcggttttttaggaagtggatttggtcgtttcggatttaattcggtttttaggttttttttcggttcggtttagcgtgttttcgtttgttttcggtttttttacgacgttcgtttttttttttcgagtgtcgttcgtttggttaagtttgcggagcgtcgtcgcgtacgtcggttagttaattagcggtagagttgagaagggtatagtcgcgcggcggagggtagagttagtcgagtcgagtttagtcggacgagcggattagcgtagggtagtttaagtagcgcgtagcgaacgttcgtcgtcgtttatattttttgcggttttcgcggcgtttgttattttttttttttttttcgcgttttcgtttcgtcggttagttagtttgtcgggttcgttgtttcgcgaaatttcgaggttattagttcgcgtttttgtttttttgggtcgcgcgtcgtttttacgtttttttttttttttggttcggcgtttggtatcggggatcgttgtttgacgcgaggtttagttttatttttcgtttcgcgtttttttcgtttgttcgttttttttattaattttaattttttttttttttagttttattcgttagttttcgatttcgttagttttcggttcgttgtcgtagcgtcgtttttcgttcggttttaaaggtgggaacgcgttcgtttcggttcgtattatggtacggttcggtttgttcgcgtttttttgtattttggtagtgtttagcgtcgcgttgttggttgtcgagtttaagtcgaaaagttgttcggaagtgcgacgtttttacgtgtttaaaggttttaataagaacgatgtttttttttacgagattaacggtaggtgggtatattcgggaggtgggcgtagagatcgatatttcgggaagggaggttgtaatttttttttttcgtttcgtcgttttttgcgtcggacgtaggtatattagagggagaaatgggtagtcgagagggtaggagcgagcgagcgagagagttaggtagttcgggcgtaggacgtttttcgcgggcgtagcgtttttttttttttagtattgcgagcggaggggcgtcgtcgggttgtttagtgcgattgtcgcgtttcgtttttcgttttcgtttttttttttttttttgtattattcgtcgtttcgggaagtttttgaggattgtggtttttaaagtgcgtgttatcggttattttttttttttcgggttgaattttttataggacgtttcgttttgttgtatgggtgaggagaggtcgggtgggggtgggggtcgtt

SEQ ID NO: 21216 - DNA, 1424 bp, Artificial Sequence
  chemically treated genomic DNA (Homo sapiens) CpG-island No: 21216
aacgacccccacccccacccgacctctcctcacccatacaacaaaacgaaacgtcctataaaaaattcaacccgaaaaaaaaaaaataaccgataacacgcactttaaaaaccacaatcctcaaaaacttcccgaaacgacgaataatacaaaaaaaaaaaaaaaaacgaaaacgaaaaacgaaacgcgacaatcgcactaaacaacccgacgacgcccctccgctcgcaatactaaaaaaaaaaaaacgctacgcccgcgaaaaacgtcctacgcccgaactacctaactctctcgctcgctcgctcctaccctctcgactacccatttctccctctaatatacctacgtccgacgcaaaaaacgacgaaacgaaaaaaaaaaattacaacctcccttcccgaaatatcgatctctacgcccacctcccgaatatacccacctaccgttaatctcgtaaaaaaaaacatcgttcttattaaaacctttaaacacgtaaaaacgtcgcacttccgaacaacttttcgacttaaactcgacaaccaacaacgcgacgctaaacactaccaaaatacaaaaaaacgcgaacaaaccgaaccgtaccataatacgaaccgaaacgaacgcgttcccacctttaaaaccgaacgaaaaacgacgctacgacaacgaaccgaaaactaacgaaatcgaaaactaacgaataaaactaaaaaaaaaaaaaattaaaattaataaaaaaaacgaacaaacgaaaaaaacgcgaaacgaaaaataaaactaaacctcgcgtcaaacaacgatccccgataccaaacgccgaaccaaaaaaaaaaaaaaacgtaaaaacgacgcgcgacccaaaaaaacaaaaacgcgaactaataacctcgaaatttcgcgaaacaacgaacccgacaaactaactaaccgacgaaacgaaaacgcgaaaaaaaaaaaaaaaataacaaacgccgcgaaaaccgcaaaaaatataaacgacgacgaacgttcgctacgcgctacttaaactaccctacgctaatccgctcgtccgactaaactcgactcgactaactctaccctccgccgcgcgactatacccttctcaactctaccgctaattaactaaccgacgtacgcgacgacgctccgcaaacttaaccaaacgaacgacactcgaaaaaaaaaaacgaacgtcgtaaaaaaaccgaaaacaaacgaaaacacgctaaaccgaaccgaaaaaaaacctaaaaaccgaattaaatccgaaacgaccaaatccacttcctaaaaaaccgcaccgaacgcccgacgctccttcgcgtaacacgccccacccgactcctccttcctcccctcctcctcgaaaacgaaaaaccaacccaccgccccccaaccacaaaaaaaaaaccaactac

SEQ ID NO: 21217 - DNA, 911 bp, Artificial Sequence
  chemically treated genomic DNA (Homo sapiens) CpG-island No: 21217
cgcgaacgtttttggtagcggcgtttagggggttcggcggtattcgcggtggggttgtttgggttgcgggtgacgatttgcggggtttcgtattcggtttcgcggagttcggattcgtacgtaggcggcgcggtaaaggtatatttttttcgcggtcgcgaatttagcgtcgttttcgtagcgcggtaatgtacggttatcgttgtttttagttcgttcgtcgtagtcgcgagtatttaaatatttattttgcggggcgacgattttcggagtttaggcgaggtcgttcgggcgtgttattttcgcggttatgacggcgattcggggaagcgtttcgcgcgttaaggtttcgcgttgttgagttgtgagtacggttgtttcgttcgttcgttcgtttagtattcgttcggagagtgaggttagagtacgttttagtcgtgtttaaattaaggttcggggcggtatcgacgggttgaatgataaatggtagatgtcgtgggttttgtcgttcgcggtagttaagaggatggttgcgtcgaggaggtcgcgcgtaggcggggttcgggagtcggaacggcgcggtcgcgaggagggcgttggggtttttggcgggggcgttacgtggtaggaggaggtttcgtcggggagttgggggtcggcggtcgaggcggggggagttgagcggtatttatacgttttgcgggtcgggttatcggtgggggtaaagttaaggtcgtttaggtatagcgttggcgtaggtagattcgagtcggtttggggtttgtagcggggtttgttagtcgaagttttcgttaggatgggtcgttagagtttaattatatatgagaaacgcgatagatgttgggacgttgtaataggttaaattaatttattttttgtgttagtagcgt

SEQ ID NO: 21218 - DNA, 911 bp, Artificial Sequence
  chemically treated genomic DNA (Homo sapiens) CpG-island No: 21218
acgctactaacacaaaaaataaattaatttaacctattacaacgtcccaacatctatcgcgtttctcatatataattaaactctaacgacccatcctaacgaaaacttcgactaacaaaccccgctacaaaccccaaaccgactcgaatctacctacgccaacgctatacctaaacgaccttaactttacccccaccgataacccgacccgcaaaacgtataaataccgctcaactccccccgcctcgaccgccgacccccaactccccgacgaaacctcctcctaccacgtaacgcccccgccaaaaaccccaacgccctcctcgcgaccgcgccgttccgactcccgaaccccgcctacgcgcgacctcctcgacgcaaccatcctcttaactaccgcgaacgacaaaacccacgacatctaccatttatcattcaacccgtcgataccgccccgaaccttaatttaaacacgactaaaacgtactctaacctcactctccgaacgaatactaaacgaacgaacgaacgaaacaaccgtactcacaactcaacaacgcgaaaccttaacgcgcgaaacgcttccccgaatcgccgtcataaccgcgaaaataacacgcccgaacgacctcgcctaaactccgaaaatcgtcgccccgcaaaataaatatttaaatactcgcgactacgacgaacgaactaaaaacaacgataaccgtacattaccgcgctacgaaaacgacgctaaattcgcgaccgcgaaaaaaatatacctttaccgcgccgcctacgtacgaatccgaactccgcgaaaccgaatacgaaaccccgcaaatcgtcacccgcaacccaaacaaccccaccgcgaataccgccgaaccccctaaacgccgctaccaaaaacgttcgcg

SEQ ID NO: 21219 - DNA, 911 bp, Artificial Sequence
  chemically treated genomic DNA (Homo sapiens) CpG-island No: 21219
gcgttgttggtataggaggtaagttagtttggtttattgtagcgttttagtatttgtcgcgttttttatgtgtgattgggttttggcggtttattttggcggagatttcggttagtaggtttcgttgtagattttaggtcggttcgggtttatttgcgttagcgttgtatttgggcgattttggttttgtttttatcggtgattcggttcgtaggacgtgtgggtgtcgtttagtttttttcgtttcggtcgtcgatttttagtttttcggcggggtttttttttgttacgtgacgttttcgttaggggttttagcgtttttttcgcggtcgcgtcgtttcggttttcgagtttcgtttgcgcgcggttttttcggcgtagttatttttttggttgtcgcgggcggtaaagtttacggtatttgttatttgttatttagttcgtcggtatcgtttcgagttttgatttagatacggttggggcgtgttttggttttatttttcgggcgggtgttggacggacggacggacggggtagtcgtgtttatagtttagtagcgcggggttttggcgcgcggggcgttttttcgggtcgtcgttatggtcgcggaggtggtacgttcgagcggtttcgtttgagtttcgggggtcgtcgtttcgtagggtaggtgtttgggtgttcgcggttgcggcgggcgggttgggggtagcggtggtcgtgtattgtcgcgttgcgaggacggcgttgggttcgcggtcgcgaggagggtgtgtttttgtcgcgtcgtttacgtgcgggttcgggtttcgcggggtcgggtgcgggatttcgtagatcgttattcgtaatttaggtagttttatcgcgagtgtcgtcggattttttggacgtcgttgttagaggcgttcgcg

SEQ ID NO: 21220 - DNA, 911 bp, Artificial Sequence
  chemically treated genomic DNA (Homo sapiens) CpG-island No: 21220
cgcgaacgcctctaacaacgacgtccaaaaaatccgacgacactcgcgataaaactacctaaattacgaataacgatctacgaaatcccgcacccgaccccgcgaaacccgaacccgcacgtaaacgacgcgacaaaaacacaccctcctcgcgaccgcgaacccaacgccgtcctcgcaacgcgacaatacacgaccaccgctacccccaacccgcccgccgcaaccgcgaacacccaaacacctaccctacgaaacgacgacccccgaaactcaaacgaaaccgctcgaacgtaccacctccgcgaccataacgacgacccgaaaaaacgccccgcgcgccaaaaccccgcgctactaaactataaacacgactaccccgtccgtccgtccgtccaacacccgcccgaaaaataaaaccaaaacacgccccaaccgtatctaaatcaaaactcgaaacgataccgacgaactaaataacaaataacaaataccgtaaactttaccgcccgcgacaaccaaaaaaataactacgccgaaaaaaccgcgcgcaaacgaaactcgaaaaccgaaacgacgcgaccgcgaaaaaaacgctaaaacccctaacgaaaacgtcacgtaacaaaaaaaaaccccgccgaaaaactaaaaatcgacgaccgaaacgaaaaaaactaaacgacacccacacgtcctacgaaccgaatcaccgataaaaacaaaaccaaaatcgcccaaatacaacgctaacgcaaataaacccgaaccgacctaaaatctacaacgaaacctactaaccgaaatctccgccaaaataaaccgccaaaacccaatcacacataaaaaacgcgacaaatactaaaacgctacaataaaccaaactaacttacctcctataccaacaacgc

SEQ ID NO: 21221 - DNA, 883 bp, Artificial Sequence
  chemically treated genomic DNA (Homo sapiens) CpG-island No: 21221
ttagcgcgatttttttttagcgtttaggttttcgggagtcgcggaataaatttgtgttcggcgttgatcgtgtaaagtggttttcgcgcgtcgcggtttcggtcggcgtcgtcgttgtcgttcgggtttcgcgattcgggtcgggttgtgggcgcgcggtaggcgggttgcggcggcggcgggacggggcggtcgcgggttgcgtggggtttgtgcgcgcgtgtgcgcgggcgtcggttgtgcgcgtcgcgggcggatagggttcggtcggcggcggtaaagttgggattcgcgggtcgggcgcgttcgcgtaacggggattagaggcgcgggggcgcgggtttttaagcgttttttttttttggcgtttttcgttgttcggtttagagtttcggtttggggatttcgcggcgagtttcgcgagtggggtttacgtttggcggggcgcggcggggcggcgcggggaataaggtaggaaaggtatttatttaacgtcgtcgggagtcgcgcggatgggggcgagttgggcggcgggtgtgtttgcggagttgttatttgggtttagagatcgggaagtattatagatagatttttttttcggggtagacgaggtttttgcgtcgggatgggtcggtgtgcgtgcgtttcgcgtttttttttttcggtttttggggaagttgttatttgggtcggacgtacggagcgttgaagtcggataatggggtttggatggcgttttgggtttcgggtggaaggagggtgggggagggggcggacggatcgacggacgcgcggggttgttatttgtatcgtagttgtagtgtttattgatttgtgttgttgtgttaagggaaatatatatttttttgtttggcgtgagagt

SEQ ID NO: 21222 - DNA, 883 bp, Artificial Sequence
  chemically treated genomic DNA (Homo sapiens) CpG-island No: 21222
actctcacgccaaacaaaaaaatatatatttcccttaacacaacaacacaaatcaataaacactacaactacgatacaaataacaaccccgcgcgtccgtcgatccgtccgccccctcccccaccctccttccacccgaaacccaaaacgccatccaaaccccattatccgacttcaacgctccgtacgtccgacccaaataacaacttccccaaaaaccgaaaaaaaaaaacgcgaaacgcacgcacaccgacccatcccgacgcaaaaacctcgtctaccccgaaaaaaaaatctatctataatacttcccgatctctaaacccaaataacaactccgcaaacacacccgccgcccaactcgcccccatccgcgcgactcccgacgacgttaaataaatacctttcctaccttattccccgcgccgccccgccgcgccccgccaaacgtaaaccccactcgcgaaactcgccgcgaaatccccaaaccgaaactctaaaccgaacaacgaaaaacgccaaaaaaaaaaaacgcttaaaaacccgcgcccccgcgcctctaatccccgttacgcgaacgcgcccgacccgcgaatcccaactttaccgccgccgaccgaaccctatccgcccgcgacgcgcacaaccgacgcccgcgcacacgcgcgcacaaaccccacgcaacccgcgaccgccccgtcccgccgccgccgcaacccgcctaccgcgcgcccacaacccgacccgaatcgcgaaacccgaacgacaacgacgacgccgaccgaaaccgcgacgcgcgaaaaccactttacacgatcaacgccgaacacaaatttattccgcgactcccgaaaacctaaacgctaaaaaaaaatcgcgctaa

SEQ ID NO: 21223 - DNA, 883 bp, Artificial Sequence
  chemically treated genomic DNA (Homo sapiens) CpG-island No: 21223
atttttacgttaggtagaggggtgtgtgttttttttggtatagtagtataaattaataaatattgtagttgcggtgtaagtagtagtttcgcgcgttcgtcggttcgttcgtttttttttttattttttttttattcgagatttagagcgttatttaagttttattattcggttttagcgtttcgtgcgttcggtttaggtaataatttttttaaaaatcgaaagagaaaagcgcgaggcgtacgtatatcggtttatttcggcgtagagatttcgtttgtttcgggagggggatttgtttgtggtgtttttcggtttttaagtttaggtaataatttcgtaaatatattcgtcgtttagttcgtttttattcgcgcggttttcggcggcgttaagtgggtattttttttgttttgtttttcgcgtcgtttcgtcgcgtttcgttaaacgtggattttattcgcggggttcgtcgcggagtttttaggtcggggttttgggtcgggtagcgggaggcgttagggaggaggggcgtttagggattcgcgttttcgcgtttttaattttcgttacgcgagcgcgttcggttcgcgggttttaattttatcgtcgtcggtcgaattttgttcgttcgcggcgcgtatagtcggcgttcgcgtatacgcgcgtataaattttacgtaattcgcggtcgtttcgtttcgtcgtcgtcgtagttcgtttgtcgcgcgtttatagttcggttcgagtcgcggggttcgagcgatagcgacggcgtcggtcggggtcgcggcgcgcggaagttattttgtacggttagcgtcgggtataagtttgtttcgcggttttcgggggtttgggcgttgagggagaatcgcgttga

SEQ ID NO: 21224 - DNA, 883 bp, Artificial Sequence
  chemically treated genomic DNA (Homo sapiens) CpG-island No: 21224
tcaacgcgattctccctcaacgcccaaacccccgaaaaccgcgaaacaaacttatacccgacgctaaccgtacaaaataacttccgcgcgccgcgaccccgaccgacgccgtcgctatcgctcgaaccccgcgactcgaaccgaactataaacgcgcgacaaacgaactacgacgacgacgaaacgaaacgaccgcgaattacgtaaaatttatacgcgcgtatacgcgaacgccgactatacgcgccgcgaacgaacaaaattcgaccgacgacgataaaattaaaacccgcgaaccgaacgcgctcgcgtaacgaaaattaaaaacgcgaaaacgcgaatccctaaacgcccctcctccctaacgcctcccgctacccgacccaaaaccccgacctaaaaactccgcgacgaaccccgcgaataaaatccacgtttaacgaaacgcgacgaaacgacgcgaaaaacaaaacaaaaaaaatacccacttaacgccgccgaaaaccgcgcgaataaaaacgaactaaacgacgaatatatttacgaaattattacctaaacttaaaaaccgaaaaacaccacaaacaaatccccctcccgaaacaaacgaaatctctacgccgaaataaaccgatatacgtacgcctcgcgcttttctctttcgatttttaaaaaaattattacctaaaccgaacgcacgaaacgctaaaaccgaataataaaacttaaataacgctctaaatctcgaataaaaaaaaaataaaaaaaaaaacgaacgaaccgacgaacgcgcgaaactactacttacaccgcaactacaatatttattaatttatactactataccaaaaaaaacacacacccctctacctaacgtaaaaat

SEQ ID NO: 21225 - DNA, 839 bp, Artificial Sequence
  chemically treated genomic DNA (Homo sapiens) CpG-island No: 21225
cgcgcggtggggagcgtttggtattttttttcgggatttatttatagttcgttttgtttagaggtgttttgcggatagatcgtatcgggggttacgatttcgcgtttcgggttttattttttcgcggggatggggcgtcggttttttttttattgcgcggcgttttgttttcgggttttcggagtagacggcggcgtatagttcggtttttggtttcggtttttttttcgtttgtttcgatttttttttggcgtttgcgtttttagggttttcggttttattatagtcgttcgttttttgtattcggtttttttagtcgggttttttaagtcgttttcgttttttggttaggttcggtcgaattcgggcggcggcgatatttattcgcgtcgggggcgtcggtttcgggtttcgggtttcgttattagcgtagtagagttcgcgcgggttttaggtttacggcgtagcgttgttgttttatttatagtacggattgtagcggtttcgtcgttttcgtcgtttttattttcgtcgtcgggttcgttcgttaggttgggggcgcgcggacgtcgaggggcgtcggatcgttagcggtttttgtagtggttcgggcggcgggcggcgggcggcgggaggcggcgttgcgttatttcgtacgcgggcggcggggatcgcggaggggacgggcggggcgggggcgaggaggaggcgtgggtagaggaggggtcgggagttagggagagacggggggattcgagaaggggagaagagggaggaggaaggggtcgggatggggttggtcgaggttagggcgttggggtcgggaggcggttgttttt

SEQ ID NO: 21226 - DNA, 839 bp, Artificial Sequence
  chemically treated genomic DNA (Homo sapiens) CpG-island No: 21226
aaaaacaaccgcctcccgaccccaacgccctaacctcgaccaaccccatcccgaccccttcctcctccctcttctccccttctcgaatccccccgtctctccctaactcccgacccctcctctacccacgcctcctcctcgcccccgccccgcccgtcccctccgcgatccccgccgcccgcgtacgaaataacgcaacgccgcctcccgccgcccgccgcccgccgcccgaaccactacaaaaaccgctaacgatccgacgcccctcgacgtccgcgcgcccccaacctaacgaacgaacccgacgacgaaaataaaaacgacgaaaacgacgaaaccgctacaatccgtactataaataaaacaacaacgctacgccgtaaacctaaaacccgcgcgaactctactacgctaataacgaaacccgaaacccgaaaccgacgcccccgacgcgaataaatatcgccgccgcccgaattcgaccgaacctaaccaaaaaacgaaaacgacttaaaaaacccgactaaaaaaaccgaatacaaaaaacgaacgactataataaaaccgaaaaccctaaaaacgcaaacgccaaaaaaaaatcgaaacaaacgaaaaaaaaaccgaaaccaaaaaccgaactatacgccgccgtctactccgaaaacccgaaaacaaaacgccgcgcaataaaaaaaaaaccgacgccccatccccgcgaaaaaataaaacccgaaacgcgaaatcgtaacccccgatacgatctatccgcaaaacacctctaaacaaaacgaactataaataaatcccgaaaaaaaataccaaacgctccccaccgcgcg

SEQ ID NO: 21227 - DNA, 839 bp, Artificial Sequence
  chemically treated genomic DNA (Homo sapiens) CpG-island No: 21227
aaaggtagtcgtttttcggttttagcgttttggtttcggttagttttatttcggtttttttttttttttttttttttttttttcgggttttttcgtttttttttggttttcggttttttttttatttacgtttttttttcgttttcgtttcgttcgtttttttcgcggttttcgtcgttcgcgtacggggtgacgtagcgtcgtttttcgtcgttcgtcgttcgtcgttcgggttattgtaggggtcgttaacggttcggcgtttttcggcgttcgcgcgtttttagtttggcggacgagttcggcggcggagatgggggcgacgggggcggcggagtcgttgtaattcgtgttgtgggtgaagtagtagcgttgcgtcgtgagtttggagttcgcgcgggttttgttgcgttggtggcggagttcggggttcggagtcggcgttttcggcgcgggtgagtgtcgtcgtcgttcgggttcggtcggatttggttagggagcgggggcggtttgggggattcggttggggggatcgggtgtagggagcgagcggttgtggtaaggtcgggggttttgggagcgtaggcgttagggaggggtcggggtaggcgggagggaggtcggggttaggggtcgggttgtgcgtcgtcgtttgtttcgggaattcgaggataaagcgtcgcgtagtggaggggaggtcggcgttttattttcgcggggaggtgggattcggggcgcggggtcgtggttttcggtgcggtttgttcgtagggtatttttggataagacggattgtggatggatttcgagggggggtgttaggcgttttttatcgcgcg

SEQ ID NO: 21228 - DNA, 839 bp, Artificial Sequence
  chemically treated genomic DNA (Homo sapiens) CpG-island No: 21228
cgcgcgataaaaaacgcctaacaccccccctcgaaatccatccacaatccgtcttatccaaaaataccctacgaacaaaccgcaccgaaaaccacgaccccgcgccccgaatcccacctccccgcgaaaataaaacgccgacctcccctccactacgcgacgctttatcctcgaattcccgaaacaaacgacgacgcacaacccgacccctaaccccgacctccctcccgcctaccccgacccctccctaacgcctacgctcccaaaacccccgaccttaccacaaccgctcgctccctacacccgatccccccaaccgaatcccccaaaccgcccccgctccctaaccaaatccgaccgaacccgaacgacgacgacactcacccgcgccgaaaacgccgactccgaaccccgaactccgccaccaacgcaacaaaacccgcgcgaactccaaactcacgacgcaacgctactacttcacccacaacacgaattacaacgactccgccgcccccgtcgcccccatctccgccgccgaactcgtccgccaaactaaaaacgcgcgaacgccgaaaaacgccgaaccgttaacgacccctacaataacccgaacgacgaacgacgaacgacgaaaaacgacgctacgtcaccccgtacgcgaacgacgaaaaccgcgaaaaaaacgaacgaaacgaaaacgaaaaaaaaacgtaaataaaaaaaaaaccgaaaaccaaaaaaaaacgaaaaaacccgaaaaaaaaaaaaaaaaaaaaaaaaaaaaaccgaaataaaactaaccgaaaccaaaacgctaaaaccgaaaaacgactaccttt

SEQ ID NO: 21229 - DNA, 774 bp, Artificial Sequence
  chemically treated genomic DNA (Homo sapiens) CpG-island No: 21229
tcgcggattttagcggagtcgcgtttttcgtgtcgtttttgagggttttcgcggcgtcggcgtttttgttttcggcgcgtttaagtcgttgaggtcgaattaagcgaaggcggaaaagcggcgcgtagttcgcgttagttgtagtttcgtttttttggttttcggtgcgttaataaaggtatttgtatgaaaataggaatttcgtttgtagaaaggattcgttggcggggtgtatcgtgcgttttagtgtttttatcgcggcgtttcgttttttaggtggggaagaagcggggtgcggggattggttttaaatacggttcggtcggcggggatcggtacgttgcggttcgggcgattttttttttcgttttttttttaggtcggcggaaacggtcgtttcgggcgtgggcgcgtttttgcggatttttcgggattttttatttaggcgtgcggtcggggcgttcggggtttcggggagtcggcgttagcgtgcggagcgtagcggagcggagggagcggcgggagcggcgttcgtggttggtttaggtttggggcgtagtttttaggttcgttttgcgtcgttttgggtttcggttttttcgtttgttcgatcggggcgtaagcgtgttatagcgtttgtttgtagggggaagcgggttttttagaggggcgcgtggttcgtagaggggtttcgggaatattcgtttcgttggttttttttagagtttttttttagttgttttttttttgaaattcgttttttttttagtagtt

SEQ ID NO: 21230 - DNA, 774 bp, Artificial Sequence
  chemically treated genomic DNA (Homo sapiens) CpG-island No: 21230
aactactaaaaaaaaaacgaatttcaaaaaaaaaacaactaaaaaaaaactctaaaaaaaaccaacgaaacgaatattcccgaaacccctctacgaaccacgcgcccctctaaaaaacccgcttccccctacaaacaaacgctataacacgcttacgccccgatcgaacaaacgaaaaaaccgaaacccaaaacgacgcaaaacgaacctaaaaactacgccccaaacctaaaccaaccacgaacgccgctcccgccgctccctccgctccgctacgctccgcacgctaacgccgactccccgaaaccccgaacgccccgaccgcacgcctaaataaaaaatcccgaaaaatccgcaaaaacgcgcccacgcccgaaacgaccgtttccgccgacctaaaaaaaaaacgaaaaaaaaaatcgcccgaaccgcaacgtaccgatccccgccgaccgaaccgtatttaaaaccaatccccgcaccccgcttcttccccacctaaaaaacgaaacgccgcgataaaaacactaaaacgcacgatacaccccgccaacgaatcctttctacaaacgaaattcctattttcatacaaatacctttattaacgcaccgaaaaccaaaaaaacgaaactacaactaacgcgaactacgcgccgcttttccgccttcgcttaattcgacctcaacgacttaaacgcgccgaaaacaaaaacgccgacgccgcgaaaaccctcaaaaacgacacgaaaaacgcgactccgctaaaatccgcga

SEQ ID NO: 21231 - DNA, 774 bp, Artificial Sequence
  chemically treated genomic DNA (Homo sapiens) CpG-island No: 21231
ggttgttgggaaaaaggcggattttaaaggagaagtagttaaggaaaagttttggaaagggttaacggagcggatattttcggagtttttttgcgagttacgcgtttttttgggaagttcgtttttttttgtagataggcgttgtgatacgtttgcgtttcggtcgaataggcgaagaggtcgaggtttagagcggcgtagggcgagtttggaggttgcgttttagatttggattagttacggacgtcgttttcgtcgtttttttcgtttcgttgcgtttcgtacgttggcgtcggtttttcgaggtttcgggcgtttcggtcgtacgtttgggtaaaaggtttcgaggagttcgtagaagcgcgtttacgttcgagacggtcgttttcgtcggtttgggaaaggggcggagaagggggtcgttcgggtcgtagcgtgtcggttttcgtcggtcgagtcgtgtttggggttagttttcgtatttcgttttttttttatttggggagcggggcgtcgcggtaggggtattggagcgtacgatgtatttcgttaacgagttttttttgtagacggggtttttgtttttatgtaaatgtttttgttagcgtatcgggaattagggggacggaattgtagttgacgcgggttgcgcgtcgttttttcgttttcgtttgattcggttttaacgatttaaacgcgtcgggaataaaaacgtcggcgtcgcggaaatttttaggagcggtacgagaagcgcggtttcgttggggttcgcga

SEQ ID NO: 21232 - DNA, 774 bp, Artificial Sequence
  chemically treated genomic DNA (Homo sapiens) CpG-island No: 21232
tcgcgaaccccaacgaaaccgcgcttctcgtaccgctcctaaaaatttccgcgacgccgacgtttttattcccgacgcgtttaaatcgttaaaaccgaatcaaacgaaaacgaaaaaacgacgcgcaacccgcgtcaactacaattccgtccccctaattcccgatacgctaacaaaaacatttacataaaaacaaaaaccccgtctacaaaaaaaactcgttaacgaaatacatcgtacgctccaatacccctaccgcgacgccccgctccccaaataaaaaaaaaacgaaatacgaaaactaaccccaaacacgactcgaccgacgaaaaccgacacgctacgacccgaacgacccccttctccgcccctttcccaaaccgacgaaaacgaccgtctcgaacgtaaacgcgcttctacgaactcctcgaaaccttttacccaaacgtacgaccgaaacgcccgaaacctcgaaaaaccgacgccaacgtacgaaacgcaacgaaacgaaaaaaacgacgaaaacgacgtccgtaactaatccaaatctaaaacgcaacctccaaactcgccctacgccgctctaaacctcgacctcttcgcctattcgaccgaaacgcaaacgtatcacaacgcctatctacaaaaaaaaacgaacttcccaaaaaaacgcgtaactcgcaaaaaaactccgaaaatatccgctccgttaaccctttccaaaacttttccttaactacttctcctttaaaatccgcctttttcccaacaacc

SEQ ID NO: 21233 - DNA, 616 bp, Artificial Sequence
  chemically treated genomic DNA (Homo sapiens) CpG-island No: 21233
tacggtagtgttgtaatgtcgtgtgattgtgtagtggatattgcgtgcggtcgtcgtgtgttatagttttgttattattatagtagtgttgtaatgttacgtgattgtgtagtggatatcgcgtggggtcgtcgtgtgttatagttttgtcgttgttacggtggagttgtaatgttacgtgattgtgtagtggagatcgtatgcggtcgtcgtgtgttatagttttgtcgttattatggtatagttgtaatgtcgcgtgattgtgtagtggatatcgcgtggggtcgtcgttatagttttgtcgttattatggtatagttgtaatgtcgcgtgattgtgtagtggagatcgcgtggggtcgtcgtgtgttatagttttgttattgttacggtagtgttgtaatgttatgtgattgtgtagtggatatcgcgtgcggtcgtcgtgtgttatagttttgtcgtcgttatagtagtgttgtaatgttacgtgattgtgtagtggatatcgcgtggggtcgtcgtgtgttatagttttgtcgttattatggtatagttgtaatgtcgcgtgattgtgtagtggatatcgtgtggggttgtcgtgtgttatagttttgtag

SEQ ID NO: 21234 - DNA, 616 bp, Artificial Sequence
  chemically treated genomic DNA (Homo sapiens) CpG-island No: 21234
ctacaaaactataacacacgacaaccccacacgatatccactacacaatcacgcgacattacaactataccataataacgacaaaactataacacacgacgaccccacgcgatatccactacacaatcacgtaacattacaacactactataacgacgacaaaactataacacacgacgaccgcacgcgatatccactacacaatcacataacattacaacactaccgtaacaataacaaaactataacacacgacgaccccacgcgatctccactacacaatcacgcgacattacaactataccataataacgacaaaactataacgacgaccccacgcgatatccactacacaatcacgcgacattacaactataccataataacgacaaaactataacacacgacgaccgcatacgatctccactacacaatcacgtaacattacaactccaccgtaacaacgacaaaactataacacacgacgaccccacgcgatatccactacacaatcacgtaacattacaacactactataataataacaaaactataacacacgacgaccgcacgcaatatccactacacaatcacacgacattacaacactaccgta

SEQ ID NO: 21235 - DNA, 616 bp, Artificial Sequence
  chemically treated genomic DNA (Homo sapiens) CpG-island No: 21235
ttgtaagattgtgatatacggtagttttatacggtgtttattgtatagttacgcgatattgtagttgtgttatggtgacggtaagattgtgatatacggcggttttacgcggtgtttattgtatagttacgtgatattgtagtattgttgtggcgacggtaagattgtgatatacggcggtcgtacgcggtgtttattgtatagttatatgatattgtagtattgtcgtggtaatggtaagattgtgatatacggcggttttacgcggtttttattgtatagttacgcgatattgtagttgtgttatggtgacggtaagattgtgacggcggttttacgcggtgtttattgtatagttacgcgatattgtagttgtgttatggtgacggtaagattgtgatatacggcggtcgtatgcggtttttattgtatagttacgtgatattgtagttttatcgtggtaacggtaagattgtgatatacggcggttttacgcggtgtttattgtatagttacgtgatattgtagtattgttgtggtgatggtaagattgtgatatacggcggtcgtacgtagtgtttattgtatagttatacgatattgtagtattgtcgtg

SEQ ID NO: 21236 - DNA, 616 bp, Artificial Sequence
  chemically treated genomic DNA (Homo sapiens) CpG-island No: 21236
cacgacaatactacaatatcgtataactatacaataaacactacgtacgaccgccgtatatcacaatcttaccatcaccacaacaatactacaatatcacgtaactatacaataaacaccgcgtaaaaccgccgtatatcacaatcttaccgttaccacgataaaactacaatatcacgtaactatacaataaaaaccgcatacgaccgccgtatatcacaatcttaccgtcaccataacacaactacaatatcgcgtaactatacaataaacaccgcgtaaaaccgccgtcacaatcttaccgtcaccataacacaactacaatatcgcgtaactatacaataaaaaccgcgtaaaaccgccgtatatcacaatcttaccattaccacgacaatactacaatatcatataactatacaataaacaccgcgtacgaccgccgtatatcacaatcttaccgtcgccacaacaatactacaatatcacgtaactatacaataaacaccgcgtaaaaccgccgtatatcacaatcttaccgtcaccataacacaactacaatatcgcgtaactatacaataaacaccgtataaaactaccgtatatcacaatcttacaa

SEQ ID NO: 21237 - DNA, 519 bp, Artificial Sequence
  chemically treated genomic DNA (Homo sapiens) CpG-island No: 21237
gtttgcgtttgcgtagggttttttaggcgttggagttcgtcggcggtttcgtcgttgtcggtcgtttacggaggaattataatttttaggagatcgcgcggtgggtgggggcggggtagtgggcggggtatcggtaggttaggtttttttcgtagcgttagtcgtagaggaagatggcgtcgcggagggttaggtcgtttttcgcgggttttcggcgttgttattgttgttgttttttttcgggttttggttcgtgcgagttacggcggtaagtattcgcgggagaagaattagtttaagtcgttttcgaaacgcgagttcggagaggagtttcgtatggagaagttgaattagttgtgggagaaggtttagcgagtgagcgcggttcgcggtcggtggagcggggtttgggggcgggggtcgtggttggggtcgttggagcggggtttaggggtcggaggcggaggggggcgtatcgggtatttgtgttttacgcgttttgtttttgtatagtttttt

SEQ ID NO: 21238 - DNA, 519 bp, Artificial Sequence
  chemically treated genomic DNA (Homo sapiens) CpG-island No: 21238
aaaaaactatacaaaaacaaaacgcgtaaaacacaaatacccgatacgcccccctccgcctccgacccctaaaccccgctccaacgaccccaaccacgacccccgcccccaaaccccgctccaccgaccgcgaaccgcgctcactcgctaaaccttctcccacaactaattcaacttctccatacgaaactcctctccgaactcgcgtttcgaaaacgacttaaactaattcttctcccgcgaatacttaccgccgtaactcgcacgaaccaaaacccgaaaaaaaacaacaacaataacaacgccgaaaacccgcgaaaaacgacctaaccctccgcgacgccatcttcctctacgactaacgctacgaaaaaaacctaacctaccgataccccgcccactaccccgcccccacccaccgcgcgatctcctaaaaattataattcctccgtaaacgaccgacaacgacgaaaccgccgacgaactccaacgcctaaaaaaccctacgcaaacgcaaac

SEQ ID NO: 21239 - DNA, 519 bp, Artificial Sequence
  chemically treated genomic DNA (Homo sapiens) CpG-island No: 21239
gggaggttgtgtaaggatagggcgcgtagggtataggtgttcggtgcgttttttttcgttttcgatttttgggtttcgttttaacgattttaattacggttttcgtttttaggtttcgttttatcgatcgcgggtcgcgtttattcgttgggtttttttttatagttggtttaatttttttatgcggaattttttttcggattcgcgtttcggggacggtttgggttggtttttttttcgcgagtatttgtcgtcgtggttcgtacgggttagggttcgaggaagagtagtagtagtagtagcgtcgggagttcgcgagaaacgatttgatttttcgcggcgttatttttttttgcgattggcgttgcggagaaaatttagtttgtcgatgtttcgtttattatttcgtttttatttatcgcgcggttttttgggaattgtagttttttcgtgagcggtcggtagcggcgaggtcgtcggcggattttagcgtttaggaagttttgcgtaggcgtaagt

SEQ ID NO: 21240 - DNA, 519 bp, Artificial Sequence
  chemically treated genomic DNA (Homo sapiens) CpG-island No: 21240
acttacgcctacgcaaaacttcctaaacgctaaaatccgccgacgacctcgccgctaccgaccgctcacgaaaaaactacaattcccaaaaaaccgcgcgataaataaaaacgaaataataaacgaaacatcgacaaactaaattttctccgcaacgccaatcgcaaaaaaaaataacgccgcgaaaaatcaaatcgtttctcgcgaactcccgacgctactactactactactcttcctcgaaccctaacccgtacgaaccacgacgacaaatactcgcgaaaaaaaaaccaacccaaaccgtccccgaaacgcgaatccgaaaaaaaattccgcataaaaaaattaaaccaactataaaaaaaaacccaacgaataaacgcgacccgcgatcgataaaacgaaacctaaaaacgaaaaccgtaattaaaatcgttaaaacgaaacccaaaaatcgaaaacgaaaaaaaacgcaccgaacacctataccctacgcgccctatccttacacaacctccc

SEQ ID NO: 21241 - DNA, 651 bp, Artificial Sequence
  chemically treated genomic DNA (Homo sapiens) CpG-island No: 21241
aatagtttttagtgtttacgcgttgattgtcgtgtgtgattttagtcggcgttttagtagtttttagtgtttacgcgttgattgtcgtgtgtgattttagtcggcgttttagtagttttcggtgtttacgcgttgattgtcgtgtgtgattttagtcggcgttttagtagttttcggtgtttacgcgttgattgtcgtgtgtgattttagtcggcgttttagtagttttcggtgtttacgcgttgattgtcgtgtgtgattttagtcggcgttttagtagttttcggtgtttacgcgttgattgtcgtgtgtgattttagtcggcgttttagtagttttcggtgtttacgcgttgattgtcgtgtgtgattttagtcggcgttttagtagttttcggtgtttacgcgttgattgtcgtgtgtattttagtcggcgttttagtagttttcggtgttacgcgttgattgtcgtgtgtgattttagtcggcgttttagtagttttcggtgtttacgcgttgattgtcgtgtgtgattttagtcggcgttttaatagttttcggtgtttacgcgttgattgtcgtgtgtgattttagtcggcgttttaatagttttcggtgtttatgcgttgattgttatgatgattttaggtat

SEQ ID NO: 21242 - DNA, 651 bp, Artificial Sequence
  chemically treated genomic DNA (Homo sapiens) CpG-island No: 21242
atacctaaaatcatcataacaatcaacgcataaacaccgaaaactattaaaacgccgactaaaatcacacacgacaatcaacgcgtaaacaccgaaaactattaaaacgccgactaaaatcacacacgacaatcaacgcgtaaacaccgaaaactactaaaacgccgactaaaatcacacacgacaatcaacgcgtaacaccgaaaactactaaaacgccgactaaaatacacacgacaatcaacgcgtaaacaccgaaaactactaaaacgccgactaaaatcacacacgacaatcaacgcgtaaacaccgaaaactactaaaacgccgactaaaatcacacacgacaatcaacgcgtaaacaccgaaaactactaaaacgccgactaaaatcacacacgacaatcaacgcgtaaacaccgaaaactactaaaacgccgactaaaatcacacacgacaatcaacgcgtaaacaccgaaaactactaaaacgccgactaaaatcacacacgacaatcaacgcgtaaacaccgaaaactactaaaacgccgactaaaatcacacacgacaatcaacgcgtaaacactaaaaactactaaaacgccgactaaaatcacacacgacaatcaacgcgtaaacactaaaaactatt

SEQ ID NO: 21243 - DNA, 651 bp, Artificial Sequence
  chemically treated genomic DNA (Homo sapiens) CpG-island No: 21243
atatttggagttattatggtagttaacgtatggatatcggagattattgagacgtcgattggagttatatacggtagttaacgcgtggatatcggagattgttgagacgtcgattggagttatatacggtagttaacgcgtggatatcggagattgttgagacgtcgattggagttatatacggtagttaacgcgtggtatcggagattgttgagacgtcgattggagtatatacggtagttaacgcgtggatatcggagattgttgagacgtcgattggagttatatacggtagttaacgcgtggatatcggagattgttgagacgtcgattggagttatatacggtagttaacgcgtggatatcggagattgttgagacgtcgattggagttatatacggtagttaacgcgtggatatcggagattgttgagacgtcgattggagttatatacggtagttaacgcgtggatatcggagattgttgagacgtcgattggagttatatacggtagttaacgcgtggatatcggagattgttgagacgtcgattggagttatatacggtagttaacgcgtggatattggagattgttgagacgtcgattggagttatatacggtagttaacgcgtggatattggagattgtt

SEQ ID NO: 21244 - DNA, 651 bp, Artificial Sequence
  chemically treated genomic DNA (Homo sapiens) CpG-island No: 21244
aacaatctccaatatccacgcgttaactaccgtatataactccaatcgacgtctcaacaatctccaatatccacgcgttaactaccgtatataactccaatcgacgtctcaacaatctccgatatccacgcgttaactaccgtatataactccaatcgacgtctcaacaatctccgatatccacgcgttaactaccgtatataactccaatcgacgtctcaacaatctccgatatccacgcgttaactaccgtatataactccaatcgacgtctcaacaatctccgatatccacgcgttaactaccgtatataactccaatcgacgtctcaacaatctccgatatccacgcgttaactaccgtatataactccaatcgacgtctcaacaatctccgatatccacgcgttaactaccgtatatactccaatcgacgtctcaacaatctccgataccacgcgttaactaccgtatataactccaatcgacgtctcaacaatctccgatatccacgcgttaactaccgtatataactccaatcgacgtctcaacaatctccgatatccacgcgttaactaccgtatataactccaatcgacgtctcaataatctccgatatccatacgttaactaccataataactccaaatat

SEQ ID NO: 21245 - DNA, 890 bp, Artificial Sequence
  chemically treated genomic DNA (Homo sapiens) CpG-island No: 21245
tttatatatatttatatatattttcgcggaaattgagttaggtaggcggcggattaggtttcgtcgttttacggttcgcggttgggatcgaattcggattgcgagacgtttttcgtttcgtaggcgtttttttgtcgttgaggttcggttcggtttttatcgtcggagttttataaagaaagtttttcggttcgagttttttacgtatttatcggcgtcgacgtcggcggcgattttggttttcgtcgttttcggttttttgcgggggtcggtttttgggtcggttcgggcgtcggcggcggcgattgttttatttttacggggttcgggtcgcgttcgtttcgagttaacggtttcgttagttaggcgcgcgcgtcggtttcgcgcgttatgttttcgtcgtgttgcgcgtcgtcgcggcgttttttattgtttttaaatcgcgcgcgcgttttcgcgggtttatatatgtatcgcgtacgcgcgcgttcgtcgcgtttttttttcgcgcgtttcgtttcgcgttttttggagttggtcgttgtttttagtgtttcgtttattttcgtcgggttcgtcggattcggcgggtgagcgcgcggttttcggtttcgtatcgtcgtttgtttttttgtagattatttcggattcgatttttcggttatttttttatattgtcgttttcgttttttttacgacgcggggtttgggacgacggtttgggttaagaggaattttttcgtaagaagtgtcgagttaaggacgttattaagggggcgggatcgttatcgtggaggtgtgtaagtacgtgtttgcgtttcggagatagttagatttaacggagaagttgagtttaagttttatatttttattaatttttgcgtgttagg

SEQ ID NO: 21246 - DNA, 890 bp, Artificial Sequence
  chemically treated genomic DNA (Homo sapiens) CpG-island No: 21246
cctaacacgcaaaaattaataaaaatataaaacttaaactcaacttctccgttaaatctaactatctccgaaacgcaaacacgtacttacacacctccacgataacgatcccgcccccttaataacgtccttaactcgacacttcttacgaaaaaattcctcttaacccaaaccgtcgtcccaaaccccgcgtcgtaaaaaaaacgaaaacgacaatataaaaaaataaccgaaaaatcgaatccgaaataatctacaaaaaaacaaacgacgatacgaaaccgaaaaccgcgcgctcacccgccgaatccgacgaacccgacgaaaataaacgaaacactaaaaacaacgaccaactccaaaaaacgcgaaacgaaacgcgcgaaaaaaaaacgcgacgaacgcgcgcgtacgcgatacatatataaacccgcgaaaacgcgcgcgcgatttaaaaacaataaaaaacgccgcgacgacgcgcaacacgacgaaaacataacgcgcgaaaccgacgcgcgcgcctaactaacgaaaccgttaactcgaaacgaacgcgacccgaaccccgtaaaaataaaacaatcgccgccgccgacgcccgaaccgacccaaaaaccgacccccgcaaaaaaccgaaaacgacgaaaaccaaaatcgccgccgacgtcgacgccgataaatacgtaaaaaactcgaaccgaaaaactttctttataaaactccgacgataaaaaccgaaccgaacctcaacgacaaaaaaacgcctacgaaacgaaaaacgtctcgcaatccgaattcgatcccaaccgcgaaccgtaaaacgacgaaacctaatccgccgcctacctaactcaatttccgcgaaaatatatataaatatatataaa

SEQ ID NO: 21247 - DNA, 890 bp, Artificial Sequence
  chemically treated genomic DNA (Homo sapiens) CpG-island No: 21247
tttaatacgtaagggttagtggagatgtgggatttgaatttagttttttcgttgagtttggttgttttcgggacgtaggtacgtgtttgtatatttttacgatggcgatttcgtttttttagtagcgtttttaattcgatattttttgcggggaagttttttttggtttagatcgtcgttttaggtttcgcgtcgtgggggaagcgaaagcggtagtgtggggaaatggtcgaggggtcgggttcggggtggtttgtagagaggtaggcggcggtgcggagtcgggaatcgcgcgtttattcgtcgagttcgacgggttcggcgggggtgggcgagatattgggaatagcggttagttttagagggcgcgaggcggggcgcgcggggagggggcgcggcgaacgcgcgcgtgcgcggtgtatgtgtgggttcgcgggggcgcgcgcgcggtttgggggtagtgaggggcgtcgcggcggcgcgtagtacggcgggaatatggcgcgcggaatcggcgcgcgcgtttagttggcgggatcgttagttcgaggcggacgcggttcgggtttcgtggggatggagtagtcgtcgtcgtcggcgttcgagtcgatttaagggtcgattttcgtaaggagtcgaaggcggcgggagttagagtcgtcgtcggcgtcggcgtcggtgagtgcgtgaggggttcgggtcgggagattttttttgtgaaatttcggcggtgggagtcgggtcgggttttagcggtagaggagcgtttgcgaggcggaaggcgtttcgtagttcgggttcgattttagtcgcgagtcgtgaggcggcgggatttggttcgtcgtttgtttggtttagttttcgcgagagtgtgtgtggatgtgtgtggg

SEQ ID NO: 21248 - DNA, 890 bp, Artificial Sequence
  chemically treated genomic DNA (Homo sapiens) CpG-island No: 21248
cccacacacatccacacacactctcgcgaaaactaaaccaaacaaacgacgaaccaaatcccgccgcctcacgactcgcgactaaaatcgaacccgaactacgaaacgccttccgcctcgcaaacgctcctctaccgctaaaacccgacccgactcccaccgccgaaatttcacaaaaaaaatctcccgacccgaacccctcacgcactcaccgacgccgacgccgacgacgactctaactcccgccgccttcgactccttacgaaaatcgacccttaaatcgactcgaacgccgacgacgacgactactccatccccacgaaacccgaaccgcgtccgcctcgaactaacgatcccgccaactaaacgcgcgcgccgattccgcgcgccatattcccgccgtactacgcgccgccgcgacgcccctcactacccccaaaccgcgcgcgcgcccccgcgaacccacacatacaccgcgcacgcgcgcgttcgccgcgccccctccccgcgcgccccgcctcgcgccctctaaaactaaccgctattcccaatatctcgcccacccccgccgaacccgtcgaactcgacgaataaacgcgcgattcccgactccgcaccgccgcctacctctctacaaaccaccccgaacccgacccctcgaccatttccccacactaccgctttcgcttcccccacgacgcgaaacctaaaacgacgatctaaaccaaaaaaaacttccccgcaaaaaatatcgaattaaaaacgctactaaaaaaacgaaatcgccatcgtaaaaatatacaaacacgtacctacgtcccgaaaacaaccaaactcaacgaaaaaactaaattcaaatcccacatctccactaacccttacgtattaaa

SEQ ID NO: 21249 - DNA, 1153 bp, Artificial Sequence
  chemically treated genomic DNA (Homo sapiens) CpG-island No: 21249
gaggcggtcggttgttttcgtttcgtcgtgtttttttattaaggaaggttttttcgttaggggtcgttaacgttcgcggttttcggttagacggtgtatttgagagggatatttcgttttttttcgggagggattcgggtttgttgaagtgggtttaattttgtaaatcgcgttttaatttttcgcgtcgcgtcggggaatttttttttgatatttaacgtttttcgtttttatatttttaaatatagtttattttttttttcgtggcggtcgcggtaattcgagttcggttttcgtttcgtcgttagagaacgtttttttcgtcgggacgcggtgtcgagttcgttgtatatcgagcggtcgtggtataatatcgcggcgttgcgcgtataattatcgttttttaggattcgcggcgcgtatttcggtagtggggtgcgtttcgcgattttgggcgtttagggttagatatattttttgggcgtttcgcggtttttatagtgtagtttttatcgttttttttttattttcgggtatatttattcgtttttcgttttagtttattcggtttagggcgtagtcgttttttcgcgtttttttttttagtttcggtaaaggaagttttttttgcgtttttttttttagaatcgtttttagtttttcgtttttttaatcgtagtttaacggtcggcggtagtagtcggagaaggggggcggcggttcgggtttcggaaacggttcgatcgtcgggattcgggtcggatttcgtatttgggttggaagcgaggcggagatgggcggtcgggattcgcgagtgagcggggcgggcggcggtgatagttttatagttttagttgttgttgttgttgttgtcgtcgcggttgttcggggagaggggttggtattatcgcggcgcgttattgttcggttcgggggcgggggtggttaggaggagggtttaggcgagtagcggcggtagcggcggcggtgtcgcggttcggaggaagggggagggggtatcgggtacggggaggcgggaggggagcgtagggagggcgtaggtagggggagtaggaggagtagtaggaggaggtggcggaggggcgggtgagagggaggagtgggtacggggggaaggggagagaggaaaagg

SEQ ID NO: 21250 - DNA, 1153 bp, Artificial Sequence
  chemically treated genomic DNA (Homo sapiens) CpG-island No: 21250
ccttttcctctctccccttccccccgtacccactcctccctctcacccgcccctccgccacctcctcctactactcctcctactccccctacctacgccctccctacgctcccctcccgcctccccgtacccgataccccctcccccttcctccgaaccgcgacaccgccgccgctaccgccgctactcgcctaaaccctcctcctaaccacccccgcccccgaaccgaacaataacgcgccgcgataataccaacccctctccccgaacaaccgcgacgacaacaacaacaacaacaactaaaactataaaactatcaccgccgcccgccccgctcactcgcgaatcccgaccgcccatctccgcctcgcttccaacccaaatacgaaatccgacccgaatcccgacgatcgaaccgtttccgaaacccgaaccgccgccccccttctccgactactaccgccgaccgttaaactacgattaaaaaaacgaaaaactaaaaacgattctaaaaaaaaaaacgcaaaaaaaacttcctttaccgaaactaaaaaaaaaaacgcgaaaaaacgactacgccctaaaccgaataaactaaaacgaaaaacgaataaatatacccgaaaataaaaaaaaaacgataaaaactacactataaaaaccgcgaaacgcccaaaaaatatatctaaccctaaacgcccaaaatcgcgaaacgcaccccactaccgaaatacgcgccgcgaatcctaaaaaacgataattatacgcgcaacgccgcgatattataccacgaccgctcgatatacaacgaactcgacaccgcgtcccgacgaaaaaaacgttctctaacgacgaaacgaaaaccgaactcgaattaccgcgaccgccacgaaaaaaaaaataaactatatttaaaaatataaaaacgaaaaacgttaaatatcaaaaaaaaattccccgacgcgacgcgaaaaattaaaacgcgatttacaaaattaaacccacttcaacaaacccgaatccctcccgaaaaaaaacgaaatatccctctcaaatacaccgtctaaccgaaaaccgcgaacgttaacgacccctaacgaaaaaaccttccttaataaaaaaacacgacgaaacgaaaacaaccgaccgcctc

SEQ ID NO: 21251 - DNA, 1153 bp, Artificial Sequence
  chemically treated genomic DNA (Homo sapiens) CpG-island No: 21251
ttttttttttttttttttttttttcgtgtttattttttttttttattcgttttttcgttatttttttttgttgttttttttattttttttgtttgcgttttttttgcgtttttttttcgttttttcgtgttcggtgtttttttttttttttttcgggtcgcggtatcgtcgtcgttgtcgtcgttgttcgtttgggttttttttttggttattttcgttttcgggtcgggtagtgacgcgtcgcggtggtgttagttttttttttcgggtagtcgcggcggtagtagtagtagtagtagttggagttgtggggttgttatcgtcgttcgtttcgtttattcgcggatttcgatcgtttattttcgtttcgtttttagtttaggtacggagttcggttcggatttcggcgatcgggtcgttttcggggttcgggtcgtcgtttttttttttcggttgttgtcgtcggtcgttgagttgcggttaggggggcgaggggttgggggcggttttggggaggggggcgtagggggagttttttttgtcggggttgagggagggggcgcgggggagcggttgcgttttgggtcgagtgggttggggcggggggcgggtgagtgtgttcgagagtggagggggggcgatgaaggttgtattgtgggggtcgcggggcgtttaagaggtgtgtttggttttgagcgtttagggtcgcggggcgtattttattgtcggggtgcgcgtcgcgggttttggggggcggtgattgtgcgcgtagcgtcgcggtattgtgttacggtcgttcggtgtgtagcgggttcggtatcgcgtttcggcgagggaggcgttttttggcggcggggcgggggtcgggttcgggttgtcgcggtcgttacgagaagggaagtggattgtgtttggggatgtgaggacgggaagcgttgagtgttagggaggggtttttcggcgcggcgcggggagttgagacgcggtttgtagagttgagtttattttagtaggttcgggtttttttcgggaggggacggggtgttttttttaggtgtatcgtttgatcggaagtcgcgggcgttggcggtttttggcgaaggggttttttttaatgaggggatacggcggggcgggggtagtcggtcgtttt

SEQ ID NO: 21252 - DNA, 1153 bp, Artificial Sequence
  chemically treated genomic DNA (Homo sapiens) CpG-island No: 21252
aaaacgaccgactacccccgccccgccgtatcccctcattaaaaaaaaccccttcgccaaaaaccgccaacgcccgcgacttccgatcaaacgatacacctaaaaaaaacaccccgtcccctcccgaaaaaaacccgaacctactaaaataaactcaactctacaaaccgcgtctcaactccccgcgccgcgccgaaaaacccctccctaacactcaacgcttcccgtcctcacatccccaaacacaatccacttcccttctcgtaacgaccgcgacaacccgaacccgacccccgccccgccgccaaaaaacgcctccctcgccgaaacgcgataccgaacccgctacacaccgaacgaccgtaacacaataccgcgacgctacgcgcacaatcaccgccccccaaaacccgcgacgcgcaccccgacaataaaatacgccccgcgaccctaaacgctcaaaaccaaacacacctcttaaacgccccgcgacccccacaatacaaccttcatcgccccccctccactctcgaacacactcacccgccccccgccccaacccactcgacccaaaacgcaaccgctcccccgcgccccctccctcaaccccgacaaaaaaaactccccctacgcccccctccccaaaaccgcccccaacccctcgcccccctaaccgcaactcaacgaccgacgacaacaaccgaaaaaaaaaaacgacgacccgaaccccgaaaacgacccgatcgccgaaatccgaaccgaactccgtacctaaactaaaaacgaaacgaaaataaacgatcgaaatccgcgaataaacgaaacgaacgacgataacaaccccacaactccaactactactactactactaccgccgcgactacccgaaaaaaaaaactaacaccaccgcgacgcgtcactacccgacccgaaaacgaaaataaccaaaaaaaaaacccaaacgaacaacgacgacaacgacgacgataccgcgacccgaaaaaaaaaaaaaaaaacaccgaacacgaaaaaacgaaaaaaaaacgcaaaaaaaacgcaaacaaaaaaaataaaaaaaacaacaaaaaaaaataacgaaaaaacgaataaaaaaaaaaaataaacacgaaaaaaaaaaaaaaaaaaaaaaaa

SEQ ID NO: 21253 - DNA, 674 bp, Artificial Sequence
  chemically treated genomic DNA (Homo sapiens) CpG-island No: 21253
gtttttcgggtttttagggacgcgggtatttgtggggcggggttgtcgggtttcggggttcggttttttcgggcggtcggagcgagatttcgggttgggaaagttaggtacgtggtcggttttcggtcgtattttcgttttatttttacggtagggtttttagtgtttgattaagtttaagttcgagtttttcggcgcgttgtttatcggttgttttttcgcgttttttttttttttttattcgtatcgtttcgttttttattttttttttgttttttttttattatttagtttatatttttttcgttttttttttcgtttttcgcgggtattcgagtgttcgggaggcgtttatttgttcgatttaaatatttacgcgatttttagcgttcgtcgttcgcgtgttcgttttcgtttcgtcgtcggttattgtgtttcgttagtttatatcgggtcgggttttgacggcgcgcgagttatagttgtaaagtaataggataatttcggggacgtcgttttagtttagattcgggtacgtattgttcgtggagacggtatcgtcggggaggggagttacgcggattttagatgcggttttttaggcggatagatttttgttcggggcgtaggaggaggtaggattggtatcgcggggtgggagttttggatttttt

SEQ ID NO: 21254 - DNA, 674 bp, Artificial Sequence
  chemically treated genomic DNA (Homo sapiens) CpG-island No: 21254
aaaaaatccaaaactcccaccccgcgataccaatcctacctcctcctacgccccgaacaaaaatctatccgcctaaaaaaccgcatctaaaatccgcgtaactcccctccccgacgataccgtctccacgaacaatacgtacccgaatctaaactaaaacgacgtccccgaaattatcctattactttacaactataactcgcgcgccgtcaaaacccgacccgatataaactaacgaaacacaataaccgacgacgaaacgaaaacgaacacgcgaacgacgaacgctaaaaatcgcgtaaatatttaaatcgaacaaataaacgcctcccgaacactcgaatacccgcgaaaaacgaaaaaaaaaacgaaaaaaatataaactaaataataaaaaaaaaacaaaaaaaaaataaaaaacgaaacgatacgaataaaaaaaaaaaaaaaacgcgaaaaaacaaccgataaacaacgcgccgaaaaactcgaacttaaacttaatcaaacactaaaaaccctaccgtaaaaataaaacgaaaatacgaccgaaaaccgaccacgtacctaactttcccaacccgaaatctcgctccgaccgcccgaaaaaaccgaaccccgaaacccgacaaccccgccccacaaatacccgcgtccctaaaaacccgaaaaac

SEQ ID NO: 21255 - DNA, 674 bp, Artificial Sequence
  chemically treated genomic DNA (Homo sapiens) CpG-island No: 21255
gggaggtttagggtttttatttcgcgatgttagttttgtttttttttgcgtttcgggtaagggtttgttcgtttgggggatcgtatttggaattcgcgtggttttttttttcggcggtgtcgtttttacggatagtgcgtgttcgggtttgggttggagcgacgttttcgagattattttattattttataattgtggttcgcgcgtcgttaggattcggttcggtgtgggttggcggagtataatgatcggcggcggggcgggggcgggtacgcgggcggcgggcgttgggggtcgcgtagatgtttgggtcgaataggtgagcgtttttcggatattcgggtgttcgcggggggcggggaggagggcggagggggtgtaaattaagtggtgggaaagagataaaggaagagtgaagagcgagacggtgcggatggggaagggggaggggcgcggaggggtagtcggtgggtagcgcgtcgaggagttcgagtttgaatttgattaagtattgggggttttgtcgtgggggtggggcgggggtacggtcgagagtcggttacgtgtttggtttttttagttcggggtttcgtttcggtcgttcgggggagtcgaatttcgaggttcggtagtttcgttttataagtattcgcgtttttggggattcgaaagat

SEQ ID NO: 21256 - DNA, 674 bp, Artificial Sequence
  chemically treated genomic DNA (Homo sapiens) CpG-island No: 21256
atctttcgaatccccaaaaacgcgaatacttataaaacgaaactaccgaacctcgaaattcgactcccccgaacgaccgaaacgaaaccccgaactaaaaaaaccaaacacgtaaccgactctcgaccgtacccccgccccacccccacgacaaaacccccaatacttaatcaaattcaaactcgaactcctcgacgcgctacccaccgactacccctccgcgcccctcccccttccccatccgcaccgtctcgctcttcactcttcctttatctctttcccaccacttaatttacaccccctccgccctcctccccgccccccgcgaacacccgaatatccgaaaaacgctcacctattcgacccaaacatctacgcgacccccaacgcccgccgcccgcgtacccgcccccgccccgccgccgatcattatactccgccaacccacaccgaaccgaatcctaacgacgcgcgaaccacaattataaaataataaaataatctcgaaaacgtcgctccaacccaaacccgaacacgcactatccgtaaaaacgacaccgccgaaaaaaaaaaccacgcgaattccaaatacgatcccccaaacgaacaaacccttacccgaaacgcaaaaaaaaacaaaactaacatcgcgaaataaaaaccctaaacctccc

SEQ ID NO: 21257 - DNA, 609 bp, Artificial Sequence
  chemically treated genomic DNA (Homo sapiens) CpG-island No: 21257
agcgggtcgggtttaagtttaagcgggtagttttgcggatttttttttgtgttaggcgtttcgcgtcgtttcgggggcgggcgtaggtagggttcggggtagttaagggggcggtgttgggagggagatgttttcgtttcgtttcgatttcgttttcgttcggaggttcgggatttagtagtcgttttacgcggcgggagggcggggaaataagaggattggtcgttcgtgtatttagttaagtttttggcggacggatatcgtaggtttaggtatacgagggacgtgtagttgtattacgggagagtttttgggaatcgtttggggttttggcggagatatgttgtgtttcgggggtagcgtttttttttatatttaggaggtcgcgttgttcgggttatcgaaggtcgtcgtatcgacgtttcgtttttgatcgtcgatgttttttttacgtcggttgcggtcgttttcggcgttgtttgagagagtttgcgggattttaagggtgatttgatttcgtttgattttggtcggtagggtggggttttttggtattttttaggtcgggggatgcgacgtttgggtgtggaggtgatgagttaggggttt

SEQ ID NO: 21258 - DNA, 609 bp, Artificial Sequence
  chemically treated genomic DNA (Homo sapiens) CpG-island No: 21258
aaacccctaactcatcacctccacacccaaacgtcgcatcccccgacctaaaaaataccaaaaaaccccaccctaccgaccaaaatcaaacgaaatcaaatcacccttaaaatcccgcaaactctctcaaacaacgccgaaaacgaccgcaaccgacgtaaaaaaaacatcgacgatcaaaaacgaaacgtcgatacgacgaccttcgataacccgaacaacgcgacctcctaaatataaaaaaaaacgctacccccgaaacacaacatatctccgccaaaaccccaaacgattcccaaaaactctcccgtaatacaactacacgtccctcgtatacctaaacctacgatatccgtccgccaaaaacttaactaaatacacgaacgaccaatcctcttatttccccgccctcccgccgcgtaaaacgactactaaatcccgaacctccgaacgaaaacgaaatcgaaacgaaacgaaaacatctccctcccaacaccgcccccttaactaccccgaaccctacctacgcccgcccccgaaacgacgcgaaacgcctaacacaaaaaaaaatccgcaaaactacccgcttaaacttaaacccgacccgct

SEQ ID NO: 21259 - DNA, 609 bp, Artificial Sequence
  chemically treated genomic DNA (Homo sapiens) CpG-island No: 21259
gaatttttagtttattatttttatatttagacgtcgtatttttcggtttgaggaatgttaagaaattttattttgtcgattaggattaggcgaaattaagttatttttgaaatttcgtaaatttttttaggtagcgtcgagggcgatcgtagtcggcgtgggaggggtatcggcggttaggggcggggcgtcggtgcggcggttttcggtaattcgggtaacgcggttttttggatgtaggaaggggcgttgttttcgaaatataatatgttttcgttaagattttagacggtttttaaaggttttttcgtgatgtaattgtacgtttttcgtatgtttgggtttgcgatattcgttcgttaggagtttggttggatgtacgggcggttagtttttttattttttcgttttttcgtcgcgtggagcggttgttgggtttcgagttttcgggcgggggcggaatcggggcggggcggaggtattttttttttagtatcgtttttttagttgtttcgagttttgtttgcgttcgttttcgaagcggcgcgggacgtttggtataaaaaaagattcgtagggttgttcgtttaggtttaggttcggttcgtt

SEQ ID NO: 21260 - DNA, 609 bp, Artificial Sequence
  chemically treated genomic DNA (Homo sapiens) CpG-island No: 21260
aacgaaccgaacctaaacctaaacgaacaaccctacgaatctttttttataccaaacgtcccgcgccgcttcgaaaacgaacgcaaacaaaactcgaaacaactaaaaaaacgatactaaaaaaaaaatacctccgccccgccccgattccgcccccgcccgaaaactcgaaacccaacaaccgctccacgcgacgaaaaaacgaaaaaataaaaaaactaaccgcccgtacatccaaccaaactcctaacgaacgaatatcgcaaacccaaacatacgaaaaacgtacaattacatcacgaaaaaacctttaaaaaccgtctaaaatcttaacgaaaacatattatatttcgaaaacaacgccccttcctacatccaaaaaaccgcgttacccgaattaccgaaaaccgccgcaccgacgccccgcccctaaccgccgatacccctcccacgccgactacgatcgccctcgacgctacctaaaaaaatttacgaaatttcaaaaataacttaatttcgcctaatcctaatcgacaaaataaaatttcttaacattcctcaaaccgaaaaatacgacgtctaaatataaaaataataaactaaaaattc

SEQ ID NO: 21261 - DNA, 560 bp, Artificial Sequence
  chemically treated genomic DNA (Homo sapiens) CpG-island No: 21261
acgtcgtttaggcgtttagcgacgcgcggtaggtggtagtagttcgggttttcgtcgtattttaggcgttcgtagcgttcgttttgacgcggtcgttatggcgtaggagaacgcggttttttcgttcgggtaggaggagtcgtcgcggcgtcgcggtcgttagcgttacgtggagaaggatggtcggtgtaacgtgtagtagggtaacgtgcgcgagatatatcgttatttgacggatttgtttattacgttggtggatttgtagtggcgttttagtttgttgtttttcgttttggtttacgcgtttatttggttttttttcggcgttatttggtggttgatcgtttacggtcgcggcgatttggagtatttggaggatatcgcgtggacgtcgtgcgttaataattttaacggtttcgtggtcgttttttttttttttatcgagatcgagattattatcggttacgggtatcgcgttattatcgattagtgtttcgagggtatcgtgttgttgttgttgtaggttattttgggttttatggtgaacgtttttatggtgg

SEQ ID NO: 21262 - DNA, 560 bp, Artificial Sequence
  chemically treated genomic DNA (Homo sapiens) CpG-island No: 21262
ccaccataaaaacgttcaccataaaacccaaaataacctacaacaacaacaacacgataccctcgaaacactaatcgataataacgcgatacccgtaaccgataataatctcgatctcgataaaaaaaaaaaaaacgaccacgaaaccgttaaaattattaacgcacgacgtccacgcgatatcctccaaatactccaaatcgccgcgaccgtaaacgatcaaccaccaaataacgccgaaaaaaaaccaaataaacgcgtaaaccaaaacgaaaaacaacaaactaaaacgccactacaaatccaccaacgtaataaacaaatccgtcaaataacgatatatctcgcgcacgttaccctactacacgttacaccgaccatccttctccacgtaacgctaacgaccgcgacgccgcgacgactcctcctacccgaacgaaaaaaccgcgttctcctacgccataacgaccgcgtcaaaacgaacgctacgaacgcctaaaatacgacgaaaacccgaactactaccacctaccgcgcgtcgctaaacgcctaaacgacgt

SEQ ID NO: 21263 - DNA, 560 bp, Artificial Sequence
  chemically treated genomic DNA (Homo sapiens) CpG-island No: 21263
ttattatgaaggcgtttattatggagtttaggatggtttgtagtagtagtagtacgatgttttcggggtattggtcggtgatgacgcggtgttcgtagtcgatggtggtttcggtttcgatggagaagaggaaggcggttacgaagtcgttgaggttgttgacgtacggcgtttacgcggtgttttttaggtgttttaggtcgtcgcggtcgtaggcgattagttattagatggcgtcgaagaagagttaggtgagcgcgtaggttaggacgaagaataataggttgaggcgttattgtaggtttattagcgtggtgaataggttcgttaggtagcggtatgtttcgcgtacgttgttttgttgtacgttgtatcggttatttttttttacgtagcgttggcggtcgcggcgtcgcggcggttttttttgttcgggcgagaaggtcgcgtttttttgcgttatggcggtcgcgttagggcgagcgttgcgggcgtttggagtgcggcgggggttcgagttgttgttatttgtcgcgcgtcgttgggcgtttaggcggcgt

SEQ ID NO: 21264 - DNA, 560 bp, Artificial Sequence
  chemically treated genomic DNA (Homo sapiens) CpG-island No: 21264
acgccgcctaaacgcccaacgacgcgcgacaaataacaacaactcgaacccccgccgcactccaaacgcccgcaacgctcgccctaacgcgaccgccataacgcaaaaaaacgcgaccttctcgcccgaacaaaaaaaaccgccgcgacgccgcgaccgccaacgctacgtaaaaaaaaataaccgatacaacgtacaacaaaacaacgtacgcgaaacataccgctacctaacgaacctattcaccacgctaataaacctacaataacgcctcaacctattattcttcgtcctaacctacgcgctcacctaactcttcttcgacgccatctaataactaatcgcctacgaccgcgacgacctaaaacacctaaaaaacaccgcgtaaacgccgtacgtcaacaacctcaacgacttcgtaaccgccttcctcttctccatcgaaaccgaaaccaccatcgactacgaacaccgcgtcatcaccgaccaataccccgaaaacatcgtactactactactacaaaccatcctaaactccataataaacgccttcataataa

SEQ ID NO: 21265 - DNA, 571 bp, Artificial Sequence
  chemically treated genomic DNA (Homo sapiens) CpG-island No: 21265
tcggtttcgtttttcgttgcgttgcgaaggcggggaaggcgaggcgggttttacggtagtcgcgttgcggcggggcggggcgtcgggcggtcggcgcgtttggcggtagtcgtgggaggtaggtcggtaggtagacggattcgtaggcgtgtggcggcggtcgtgtttgttagtgagggcgggagggagtgatttattgagcgtgtgtgagggagggagcgagcgagcgaacgagtagtcggcgtcgttttttcgtagtattagttaggttacgtcgtcgtttttttttttgcgtttcgcgtttaggtcgggtcgagtcgagtcgagtcgggtcgggttcgggttatgttgtttatcgtgtattgtgtgcggagggattttttcgaggtgattttttttttttaggtcgacgtcgatttcgagttgtataattttcgcgcgttgtgcgagttcgagtttggtattttcgtagtcgagagttaggtacgtcgggtagcgagtcgggtttgtttcggagttaagtttttttcggttcggggttttattttttttttttgttattggtgaagaa

SEQ ID NO: 21266 - DNA, 571 bp, Artificial Sequence
  chemically treated genomic DNA (Homo sapiens) CpG-island No: 21266
ttcttcaccaataacaaaaaaaaaaaataaaaccccgaaccgaaaaaaacttaactccgaaacaaacccgactcgctacccgacgtacctaactctcgactacgaaaataccaaactcgaactcgcacaacgcgcgaaaattatacaactcgaaatcgacgtcgacctaaaaaaaaaaaatcacctcgaaaaaatccctccgcacacaatacacgataaacaacataacccgaacccgacccgactcgactcgactcgacccgacctaaacgcgaaacgcaaaaaaaaaaacgacgacgtaacctaactaatactacgaaaaaacgacgccgactactcgttcgctcgctcgctccctccctcacacacgctcaataaatcactccctcccgccctcactaacaaacacgaccgccgccacacgcctacgaatccgtctacctaccgacctacctcccacgactaccgccaaacgcgccgaccgcccgacgccccgccccgccgcaacgcgactaccgtaaaacccgcctcgccttccccgccttcgcaacgcaacgaaaaacgaaaccga

SEQ ID NO: 21267 - DNA, 571 bp, Artificial Sequence
  chemically treated genomic DNA (Homo sapiens) CpG-island No: 21267
ttttttattagtagtaaagggagggagtgaggtttcgagtcggggagggtttagtttcggggtaggttcggttcgttgttcggcgtatttggttttcggttgcggggatgttagattcgagttcgtatagcgcgcggaagttgtgtagttcgaagtcggcgtcgatttggagggaaaaggttatttcggagaggttttttcgtatatagtatacggtgagtagtatggttcgggttcgattcggttcggttcggttcggttcggtttgggcgcggggcgtaggggaagaggcggcggcgtggtttggttggtgttgcgggaggacggcgtcggttgttcgttcgttcgttcgtttttttttttatatacgtttagtgagttattttttttcgtttttattagtaagtacggtcgtcgttatacgtttgcgagttcgtttgtttgtcggtttgttttttacggttgtcgttaagcgcgtcggtcgttcggcgtttcgtttcgtcgtaacgcggttgtcgtaaagttcgtttcgtttttttcgttttcgtaacgtagcggggggcggggtcgg

SEQ ID NO: 21268 - DNA, 571 bp, Artificial Sequence
  chemically treated genomic DNA (Homo sapiens) CpG-island No: 21268
ccgaccccgccccccgctacgttacgaaaacgaaaaaaacgaaacgaactttacgacaaccgcgttacgacgaaacgaaacgccgaacgaccgacgcgcttaacgacaaccgtaaaaaacaaaccgacaaacaaacgaactcgcaaacgtataacgacgaccgtacttactaataaaaacgaaaaaaaataactcactaaacgtatataaaaaaaaaaacgaacgaacgaacgaacaaccgacgccgtcctcccgcaacaccaaccaaaccacgccgccgcctcttcccctacgccccgcgcccaaaccgaaccgaaccgaaccgaaccgaatcgaacccgaaccatactactcaccgtatactatatacgaaaaaacctctccgaaataaccttttccctccaaatcgacgccgacttcgaactacacaacttccgcgcgctatacgaactcgaatctaacatccccgcaaccgaaaaccaaatacgccgaacaacgaaccgaacctaccccgaaactaaaccctccccgactcgaaacctcactccctccctttactactaataaaaaa

SEQ ID NO: 21269 - DNA, 617 bp, Artificial Sequence
  chemically treated genomic DNA (Homo sapiens) CpG-island No: 21269
  misc_feature (523)..(523): n is either a, c, g or t
acgtagagcgaataaagagaaagataataaggtaaaacgggagcgcgtaagcgcgattataagcgtaataggacgaaaaagatcgcggaatcgacgtcgaaaggcgttagaaacgtatagatacggataaaagaaaaacgcgcgtacgaaaaatatcgagcgggaagagaaggggatcgagaaaaaagagaacgaggttaagggtcgcgggggagggataagggataaaggggggaaattattagcgcgtaagtaatataattatacggatcggaaaattaaaacgattatacggtcgttaagtaataaggggggaggcggaaacgacgagaaaatacgcggtaaagggaaaggcgaaaattagtaacggggggtcggacggaaaagggggaggcgtagggacgagaaagaaatataataatcgcgtaaaatagggcggggttaaaatatataggcgcggagaaagcgttattaattataaggtttagtagatagaaagaaattcgcgaagtcggcgtaattnaatacggatagcgggttattacgaaggcgcggcggcgttatacgaagacgaggaaatcgaaggtaaataaaattataattacgttttcggcgat

SEQ ID NO: 21270 - DNA, 617 bp, Artificial Sequence
  chemically treated genomic DNA (Homo sapiens) CpG-island No: 21270
  misc_feature (95)..(95): n is either a, c, g or t
atcgccgaaaacgtaattataattttatttaccttcgatttcctcgtcttcgtataacgccgccgcgccttcgtaataacccgctatccgtattnaattacgccgacttcgcgaatttctttctatctactaaaccttataattaataacgctttctccgcgcctatatattttaaccccgccctattttacgcgattattatatttctttctcgtccctacgcctcccccttttccgtccgaccccccgttactaattttcgcctttccctttaccgcgtattttctcgtcgtttccgcctccccccttattacttaacgaccgtataatcgttttaattttccgatccgtataattatattacttacgcgctaataatttcccccctttatcccttatccctcccccgcgacccttaacctcgttctcttttttctcgatccccttctcttcccgctcgatatttttcgtacgcgcgtttttcttttatccgtatctatacgtttctaacgcctttcgacgtcgattccgcgatctttttcgtcctattacgcttataatcgcgcttacgcgctcccgttttaccttattatctttctctttattcgctctacgt

SEQ ID NO: 21271 - DNA, 617 bp, Artificial Sequence
  chemically treated genomic DNA (Homo sapiens) CpG-island No: 21271
  misc_feature (95)..(95): n is either a, c, g or t
gtcgtcgggggcgtggttgtggttttgtttgttttcggttttttcgttttcgtgtggcgtcgtcgcgttttcgtggtggttcgttgttcgtgttnggttgcgtcggtttcgcgggtttttttttgtttgttgggttttgtggttggtggcgtttttttcgcgtttgtgtgttttggtttcgttttgttttgcgcggttgttgtgtttttttttcgtttttgcgtttttttttttttcgttcggtttttcgttgttggttttcgtttttttttttgtcgcgtgttttttcgtcgttttcgtttttttttttgttgtttggcggtcgtgtggtcgttttggtttttcggttcgtgtggttgtgttgtttgcgcgttggtggttttttttttttgttttttgtttttttttcgcggtttttggtttcgtttttttttttttcggttttttttttttttcgttcggtgtttttcgtgcgcgcgttttttttttgttcgtgtttgtgcgtttttggcgtttttcggcgtcggtttcgcggtttttttcgttttgttgcgtttgtggtcgcgtttgcgcgttttcgttttgttttgttgtttttttttttgttcgttttgcgt

SEQ ID NO: 21272 - DNA, 617 bp, Artificial Sequence
  chemically treated genomic DNA (Homo sapiens) CpG-island No: 21272
  misc_feature (523)..(523): n is either a, c, g or t
acgcaaaacgaacaaaaaaaaaaacaacaaaacaaaacgaaaacgcgcaaacgcgaccacaaacgcaacaaaacgaaaaaaaccgcgaaaccgacgccgaaaaacgccaaaaacgcacaaacacgaacaaaaaaaaaacgcgcgcacgaaaaacaccgaacgaaaaaaaaaaaaaaccgaaaaaaaaaaaaacgaaaccaaaaaccgcgaaaaaaaaacaaaaaacaaaaaaaaaaaaccaccaacgcgcaaacaacacaaccacacgaaccgaaaaaccaaaacgaccacacgaccgccaaacaacaaaaaaaaaaacgaaaacgacgaaaaaacacgcgacaaaaaaaaaaacgaaaaccaacaacgaaaaaccgaacgaaaaaaaaaaaaacgcaaaaacgaaaaaaaaacacaacaaccgcgcaaaacaaaacgaaaccaaaacacacaaacgcgaaaaaaacgccaccaaccacaaaacccaacaaacaaaaaaaaacccgcgaaaccgacgcaaccnaacacgaacaacgaaccaccacgaaaacgcgacgacgccacacgaaaacgaaaaaaccgaaaacaaacaaaaccacaaccacgcccccgacgac

SEQ ID NO: 21273 - DNA, 1017 bp, Artificial Sequence
  chemically treated genomic DNA (Homo sapiens) CpG-island No: 21273
  misc_feature (416)..(416): n is either a, c, g or t
gacgtcgtcgaagggggatggttttattcggagatatttttgcggcgaggcggtcgtagcggagaaggaggcggcggtggtcgcggtcgtcgataacggggaggtagcggtcgaggtgggcgtcgataatggcgtatatcgtttgcgtttcggggacgtcgggtttaatagcgggtcgaaatttagagttttttttagagtggtttcgtacgttatggtcgggggtagttgaggcgtcgggttcgggtggggtcggggacgggtgacgaaagaagagggtgagggaaggggtgaagagcggaattcgaggagagtttattcgacgggtttaggagttaagcgggtcgcggagcgtcgtttgtgaaaaggagagtcgttgcgttgttgttcggtgttaggggtagtgttagggacgntcgggtgaaagcgagaggacgtgggggtaagaagtatacgttagtcgcgttaggggggtttttcgtttttttaggcgcggtttttcgagagaagtttcgtcgtttcgtcgttcgttcgagtttgcgtcgcgtttgaggcgtttttgtgttgagattagattttttttgaagtcgaaaatagtatcgtggggtgtgaggttggaacgcggtttttaatacgatcgagtacggttagtagtttgcgagcggcgatcgatgtagagagattgcgaggtagttgtcgtagtaggaatattagcgaatacgtttattcgttttttttttttcgtataatttttttagtcgtcgtcggttttaatatggcgttaataaaacgttagtcgatttaaattcgtcggttttagagcgtttgcgtacggggtcgggttaaatcgggaatgtattttgggagttgtagtttttaggtatcgggaggaatcggtttgaaaggcgggaagggaggagttatagaaattacgattttcgttatgtaaggcgcgcgatttcgagtttcgggttggaatttaaatttttttatatagtttgagtgtaagagggaatt

SEQ ID NO: 21274 - DNA, 1017 bp, Artificial Sequence
  chemically treated genomic DNA (Homo sapiens) CpG-island No: 21274
  misc_feature (602)..(602): n is either a, c, g or t
aattccctcttacactcaaactatataaaaaaatttaaattccaacccgaaactcgaaatcgcgcgccttacataacgaaaatcgtaatttctataactcctcccttcccgcctttcaaaccgattcctcccgatacctaaaaactacaactcccaaaatacattcccgatttaacccgaccccgtacgcaaacgctctaaaaccgacgaatttaaatcgactaacgttttattaacgccatattaaaaccgacgacgactaaaaaaattatacgaaaaaaaaaaaacgaataaacgtattcgctaatattcctactacgacaactacctcgcaatctctctacatcgatcgccgctcgcaaactactaaccgtactcgatcgtattaaaaaccgcgttccaacctcacaccccacgatactattttcgacttcaaaaaaaatctaatctcaacacaaaaacgcctcaaacgcgacgcaaactcgaacgaacgacgaaacgacgaaacttctctcgaaaaaccgcgcctaaaaaaacgaaaaacccccctaacgcgactaacgtatacttcttacccccacgtcctctcgctttcacccgancgtccctaacactacccctaacaccgaacaacaacgcaacgactctccttttcacaaacgacgctccgcgacccgcttaactcctaaacccgtcgaataaactctcctcgaattccgctcttcaccccttccctcaccctcttctttcgtcacccgtccccgaccccacccgaacccgacgcctcaactacccccgaccataacgtacgaaaccactctaaaaaaaactctaaatttcgacccgctattaaacccgacgtccccgaaacgcaaacgatatacgccattatcgacgcccacctcgaccgctacctccccgttatcgacgaccgcgaccaccgccgcctccttctccgctacgaccgcctcgccgcaaaaatatctccgaataaaaccatcccccttcgacgacgtc

SEQ ID NO: 21275 - DNA, 1017 bp, Artificial Sequence
  chemically treated genomic DNA (Homo sapiens) CpG-island No: 21275
  misc_feature (602)..(602): n is either a, c, g or t
agtttttttttatatttaagttgtgtagggggatttaaattttaattcggaattcggaatcgcgcgttttgtatgacggaagtcgtagtttttgtgattttttttttttcgttttttaagtcgatttttttcggtatttaaaaattataatttttaaaatgtattttcggtttggttcgatttcgtgcgtaagcgttttgaggtcgacggatttgaatcggttggcgttttattgacgttatattggggtcggcggcggttgggagagttatacgagggaggggaagcggatggacgtgttcgttagtgtttttgttgcggtagttatttcgtaatttttttgtatcgatcgtcgttcgtaagttattgatcgtattcggtcgtattaggagtcgcgttttagttttatattttacggtgttgttttcgattttagaaaggatttagttttagtatagaagcgttttaggcgcggcgtaagttcgagcggacggcggggcgacggagtttttttcggggagtcgcgtttgagaggacgaagaatttttttgacgcgattggcgtgtgttttttgtttttacgttttttcgtttttattcggncgtttttggtattgtttttgatatcgagtagtagcgtagcggtttttttttttatagacggcgtttcgcgattcgtttggtttttgagttcgtcgggtaggtttttttcgagtttcgttttttatttttttttttatttttttttttcgttattcgttttcgattttattcgagttcggcgttttagttgttttcggttatggcgtgcggagttattttgaaaaggattttggatttcgattcgttgttgagttcggcgttttcgaagcgtaggcgatgtgcgttattgtcggcgtttatttcggtcgttgttttttcgttgtcggcggtcgcggttatcgtcgttttttttttcgttgcggtcgtttcgtcgtagaagtattttcgaatggagttattttttttcggcgacgtt

SEQ ID NO: 21276 - DNA, 1017 bp, Artificial Sequence
  chemically treated genomic DNA (Homo sapiens) CpG-island No: 21276
  misc_feature (416)..(416): n is either a, c, g or t
aacgtcgccgaaaaaaaataactccattcgaaaatacttctacgacgaaacgaccgcaacgaaaaaaaaaacgacgataaccgcgaccgccgacaacgaaaaaacaacgaccgaaataaacgccgacaataacgcacatcgcctacgcttcgaaaacgccgaactcaacaacgaatcgaaatccaaaatccttttcaaaataactccgcacgccataaccgaaaacaactaaaacgccgaactcgaataaaatcgaaaacgaataacgaaaaaaaaaaataaaaaaaaaaataaaaaacgaaactcgaaaaaaacctacccgacgaactcaaaaaccaaacgaatcgcgaaacgccgtctataaaaaaaaaaaccgctacgctactactcgatatcaaaaacaataccaaaaacgnccgaataaaaacgaaaaaacgtaaaaacaaaaaacacacgccaatcgcgtcaaaaaaattcttcgtcctctcaaacgcgactccccgaaaaaaactccgtcgccccgccgtccgctcgaacttacgccgcgcctaaaacgcttctatactaaaactaaatcctttctaaaatcgaaaacaacaccgtaaaatataaaactaaaacgcgactcctaatacgaccgaatacgatcaataacttacgaacgacgatcgatacaaaaaaattacgaaataactaccgcaacaaaaacactaacgaacacgtccatccgcttcccctccctcgtataactctcccaaccgccgccgaccccaatataacgtcaataaaacgccaaccgattcaaatccgtcgacctcaaaacgcttacgcacgaaatcgaaccaaaccgaaaatacattttaaaaattataatttttaaataccgaaaaaaatcgacttaaaaaacgaaaaaaaaaaaatcacaaaaactacgacttccgtcatacaaaacgcgcgattccgaattccgaattaaaatttaaatccccctacacaacttaaatataaaaaaaaact

SEQ ID NO: 21277 - DNA, 680 bp, Artificial Sequence
  chemically treated genomic DNA (Homo sapiens) CpG-island No: 21277
tcgtcggtttttatttttttcgcgcggcgttcggggttcggcgcggtgggttcgggtttgttgtttcgcgattttcgttgggtttttttcgcgggttggcggggtttttcgggtgtcgggcgcggcgggtggcggcggttttttttttttaggggcgggaggaggggattcggcggtttagaatcgtttttcggtaggaaattaatcgcggtttcgttttttttgcgcgtttgatttcgttttcgaggtcgtcgtcgtttttttttttcggaaacgtatttttttttcgtcgcgttagttcggttcggggttaggaggaggcggaggatggggtaggaagtgcgatcgggataaaggaatcggttgcgcgggagcgcgtttgagggaggtcgcggggggtagggtcgggattgcgttgagatagtcgtcgtgttttagtttttttttttgcgaagggcgggaggagtcggacgcgttttagagtttcgcgcgtttttggtgtagtttgttgggttcgtgttttttaagtttttttttttcggagtcgcgcgttcgattttcgttttcgtttgtttattgatgtttcgtttcgagttcgggagattttgtatttcggaagttttttgagtttcgaggtaaatcgggatcgtgagtttttttattttgtagggttttatggg

SEQ ID NO: 21278 - DNA, 680 bp, Artificial Sequence
  chemically treated genomic DNA (Homo sapiens) CpG-island No: 21278
cccataaaaccctacaaaataaaaaaactcacgatcccgatttacctcgaaactcaaaaaacttccgaaatacaaaatctcccgaactcgaaacgaaacatcaataaacaaacgaaaacgaaaatcgaacgcgcgactccgaaaaaaaaaaacttaaaaaacacgaacccaacaaactacaccaaaaacgcgcgaaactctaaaacgcgtccgactcctcccgcccttcgcaaaaaaaaaaactaaaacacgacgactatctcaacgcaatcccgaccctaccccccgcgacctccctcaaacgcgctcccgcgcaaccgattcctttatcccgatcgcacttcctaccccatcctccgcctcctcctaaccccgaaccgaactaacgcgacgaaaaaaaaatacgtttccgaaaaaaaaaaacgacgacgacctcgaaaacgaaatcaaacgcgcaaaaaaaacgaaaccgcgattaatttcctaccgaaaaacgattctaaaccgccgaatcccctcctcccgcccctaaaaaaaaaaaaccgccgccacccgccgcgcccgacacccgaaaaaccccgccaacccgcgaaaaaaacccaacgaaaatcgcgaaacaacaaacccgaacccaccgcgccgaaccccgaacgccgcgcgaaaaaaataaaaaccgacga

SEQ ID NO: 21279 - DNA, 680 bp, Artificial Sequence
  chemically treated genomic DNA (Homo sapiens) CpG-island No: 21279
tttatggagttttgtagggtaggggggtttacggtttcgatttgtttcgggatttagggggttttcgagatgtaggatttttcgggttcgaaacgggatattagtggataaacgggagcgagggtcgaacgcgcggtttcgaggaagaggaatttaaagaatacgggtttagtaggttatattaggaacgcgcggggttttagggcgcgttcgatttttttcgtttttcgtagaggaggaaattgaggtacggcgattgttttaacgtagtttcggttttgtttttcgcggttttttttaggcgcgttttcgcgtagtcggtttttttgtttcggtcgtattttttgttttatttttcgtttttttttagtttcgggtcgggttgacgcggcgggagaggaatgcgttttcggagggagagggcggcggcggtttcgggagcgggattagacgcgtagaggaggcggggtcgcggttggttttttgtcggggggcggttttgggtcgtcgagtttttttttttcgtttttgaggaggaggagtcgtcgttattcgtcgcgttcgatattcgggaggtttcgttagttcgcgggagaggtttaacgggagtcgcggaatagtaggttcgagtttatcgcgtcgggtttcggacgtcgcgcggaaaaggtaggggtcggcgg

SEQ ID NO: 21280 - DNA, 680 bp, Artificial Sequence
  chemically treated genomic DNA (Homo sapiens) CpG-island No: 21280
ccgccgacccctaccttttccgcgcgacgtccgaaacccgacgcgataaactcgaacctactattccgcgactcccgttaaacctctcccgcgaactaacgaaacctcccgaatatcgaacgcgacgaataacgacgactcctcctcctcaaaaacgaaaaaaaaaaactcgacgacccaaaaccgccccccgacaaaaaaccaaccgcgaccccgcctcctctacgcgtctaatcccgctcccgaaaccgccgccgccctctccctccgaaaacgcattcctctcccgccgcgtcaacccgacccgaaactaaaaaaaaacgaaaaataaaacaaaaaatacgaccgaaacaaaaaaaccgactacgcgaaaacgcgcctaaaaaaaaccgcgaaaaacaaaaccgaaactacgttaaaacaatcgccgtacctcaatttcctcctctacgaaaaacgaaaaaaatcgaacgcgccctaaaaccccgcgcgttcctaatataacctactaaacccgtattctttaaattcctcttcctcgaaaccgcgcgttcgaccctcgctcccgtttatccactaatatcccgtttcgaacccgaaaaatcctacatctcgaaaaccccctaaatcccgaaacaaatcgaaaccgtaaacccccctaccctacaaaactccataaa

SEQ ID NO: 21281 - DNA, 502 bp, Artificial Sequence
  chemically treated genomic DNA (Homo sapiens) CpG-island No: 21281
ttttagatgagtggtgtatcgggcgcgtagttatttttgggaaaaagacgtaggagcgttagttttcggcgtcgtcggggtttttaagtttttgtatcgcggatgtaattaattttaaaattatttgaaaggcggggacggggaagaaaagataaaagggtagcgcgcgtcgcggggaagtggagtgcgggagagtttcggtcggagtaggatcgtgcgtcggttagggagggaggcgacgcgatagttttggaggagttcggatttttttcgtttttcgcgcgttttgcggggcgttttcgaggtaattttttatttacggggattacggttataggttgtggggatcgtagcggggcgagcggttttagttaaagttgtttttaagttttcgagcgatatttatcgattgtaagaagcgtaaggtgtttacgtagtttttttcggtgtttaagatttcgttgaggacgtagaggcggaggcgtagttggcgttgggattt

SEQ ID NO: 21282 - DNA, 502 bp, Artificial Sequence
  chemically treated genomic DNA (Homo sapiens) CpG-island No: 21282
aaatcccaacgccaactacgcctccgcctctacgtcctcaacgaaatcttaaacaccgaaaaaaactacgtaaacaccttacgcttcttacaatcgataaatatcgctcgaaaacttaaaaacaactttaactaaaaccgctcgccccgctacgatccccacaacctataaccgtaatccccgtaaataaaaaattacctcgaaaacgccccgcaaaacgcgcgaaaaacgaaaaaaatccgaactcctccaaaactatcgcgtcgcctccctccctaaccgacgcacgatcctactccgaccgaaactctcccgcactccacttccccgcgacgcgcgctacccttttatcttttcttccccgtccccgcctttcaaataattttaaaattaattacatccgcgatacaaaaacttaaaaaccccgacgacgccgaaaactaacgctcctacgtctttttcccaaaaataactacgcgcccgatacaccactcatctaaaa

SEQ ID NO: 21283 - DNA, 502 bp, Artificial Sequence
  chemically treated genomic DNA (Homo sapiens) CpG-island No: 21283
gagttttagcgttagttgcgttttcgtttttgcgtttttaacgagattttgggtatcgagagggattacgtgggtattttgcgttttttgtagtcggtgagtgtcgttcgggagtttggggatagttttggttggagtcgttcgtttcgttgcggtttttataatttgtggtcgtggttttcgtgggtggagaattgtttcgggggcgtttcgtagggcgcgcggaaagcgggggggattcgagtttttttagagttgtcgcgtcgtttttttttttggtcggcgtacggttttgtttcgatcggggttttttcgtattttattttttcgcggcgcgcgttgtttttttgttttttttttttcgttttcgttttttaaatagttttaaaattagttatattcgcgatgtaggggtttggggatttcggcggcgtcgggagttggcgtttttgcgttttttttttaggaataattacgcgttcggtgtattatttatttagga

SEQ ID NO: 21284 - DNA, 502 bp, Artificial Sequence
  chemically treated genomic DNA (Homo sapiens) CpG-island No: 21284
tcctaaataaataatacaccgaacgcgtaattattcctaaaaaaaaaacgcaaaaacgccaactcccgacgccgccgaaatccccaaacccctacatcgcgaatataactaattttaaaactatttaaaaaacgaaaacgaaaaaaaaaaaacaaaaaaacaacgcgcgccgcgaaaaaataaaatacgaaaaaaccccgatcgaaacaaaaccgtacgccgaccaaaaaaaaaaacgacgcgacaactctaaaaaaactcgaatcccccccgctttccgcgcgccctacgaaacgcccccgaaacaattctccacccacgaaaaccacgaccacaaattataaaaaccgcaacgaaacgaacgactccaaccaaaactatccccaaactcccgaacgacactcaccgactacaaaaaacgcaaaatacccacgtaatccctctcgatacccaaaatctcgttaaaaacgcaaaaacgaaaacgcaactaacgctaaaactc

SEQ ID NO: 21285 - DNA, 592 bp, Artificial Sequence
  chemically treated genomic DNA (Homo sapiens) CpG-island No: 21285
tcggagttattttgttttaggagcggtcgtggagaaagtaattagtcgagagttcgcgttttagggagggaagcgggtatagggtcgtttagcgttatttatttgtgagtttttcgcgggttttgtaggcggagtttcggtacgacgttttttcgattgggcgcggtttaaagtttcggggcgggtattagaggtcgagcgttttaggggattggttattttggcggacggacgtgttgttgatcgagttggttcgttttcggttcggttcgtggagagtcggttttttcgtgagttttttgttagttattggttttttgcggtttttttggggacgtggcgtcgtcgtcggtcgggtttttttttcggttgggtaaggggtcgcggggagtagttcgggattgaatcgagaggtgtcgaaggaatcggcgggtcgtttgatttcgtgagtgtgggcgcgagagggttgtgggattcggagggacggggagaggaagcgggatttatatttcgttatttggggacgatcggtttttagaggatagagttggtttacgagaacgtttcgtttttaggatgttcgggtagggtt

SEQ ID NO: 21286 - DNA, 592 bp, Artificial Sequence
  chemically treated genomic DNA (Homo sapiens) CpG-island No: 21286
aaccctacccgaacatcctaaaaacgaaacgttctcgtaaaccaactctatcctctaaaaaccgatcgtccccaaataacgaaatataaatcccgcttcctctccccgtccctccgaatcccacaaccctctcgcgcccacactcacgaaatcaaacgacccgccgattccttcgacacctctcgattcaatcccgaactactccccgcgaccccttacccaaccgaaaaaaaaacccgaccgacgacgacgccacgtccccaaaaaaaccgcaaaaaaccaataactaacaaaaaactcacgaaaaaaccgactctccacgaaccgaaccgaaaacgaaccaactcgatcaacaacacgtccgtccgccaaaataaccaatcccctaaaacgctcgacctctaatacccgccccgaaactttaaaccgcgcccaatcgaaaaaacgtcgtaccgaaactccgcctacaaaacccgcgaaaaactcacaaataaataacgctaaacgaccctatacccgcttccctccctaaaacgcgaactctcgactaattactttctccacgaccgctcctaaaacaaaataactccga

SEQ ID NO: 21287 - DNA, 592 bp, Artificial Sequence
  chemically treated genomic DNA (Homo sapiens) CpG-island No: 21287
gattttattcgggtattttgggagcggggcgttttcgtgggttagttttgttttttaggaatcggtcgtttttaggtggcggggtgtgggtttcgtttttttttttcgttttttcgggttttatagttttttcgcgtttatatttacgggattaagcggttcgtcggttttttcggtatttttcggtttagtttcgagttgtttttcgcggttttttgtttagtcggaaggagggttcggtcggcggcggcgttacgtttttaaggaaatcgtagggagttaatgattgatagaagatttacggaggggtcggttttttacgagtcgaatcgggggcgaattagttcggttagtagtacgttcgttcgttagggtggttaattttttagagcgttcggtttttgatgttcgtttcgggattttgagtcgcgtttaatcggaaaggcgtcgtatcgaggtttcgtttgtagggttcgcggagagtttataggtgagtggcgttgggcggttttgtgttcgtttttttttttggggcgcgaattttcggttggttgttttttttacggtcgtttttgggatagagtagtttcgg

SEQ ID NO: 21288 - DNA, 592 bp, Artificial Sequence
  chemically treated genomic DNA (Homo sapiens) CpG-island No: 21288
ccgaaactactctatcccaaaaacgaccgtaaaaaaaacaaccaaccgaaaattcgcgccccaaaaaaaaaaacgaacacaaaaccgcccaacgccactcacctataaactctccgcgaaccctacaaacgaaacctcgatacgacgcctttccgattaaacgcgactcaaaatcccgaaacgaacatcaaaaaccgaacgctctaaaaaattaaccaccctaacgaacgaacgtactactaaccgaactaattcgcccccgattcgactcgtaaaaaaccgacccctccgtaaatcttctatcaatcattaactccctacgatttccttaaaaacgtaacgccgccgccgaccgaaccctccttccgactaaacaaaaaaccgcgaaaaacaactcgaaactaaaccgaaaaataccgaaaaaaccgacgaaccgcttaatcccgtaaatataaacgcgaaaaaactataaaacccgaaaaaacgaaaaaaaaaaacgaaacccacaccccgccacctaaaaacgaccgattcctaaaaaacaaaactaacccacgaaaacgccccgctcccaaaatacccgaataaaatc

SEQ ID NO: 21289 - DNA, 1077 bp, Artificial Sequence
  chemically treated genomic DNA (Homo sapiens) CpG-island No: 21289
tcgttcgttagttcgcgtgggtcgtttttttaggcggtggtaacggtcgtaaggttgtagtttttttcggagaagtttaggcggcgaggatgaagggttgggtcgtttttcgggaggaacgttgtagttgcggcgggaggtatcgaggttttcggaattttttcggcgggcgtttttttttttatttttttaagtattttttgggtatcgcggaagcgttaggttttgttaaggggcgttttgggtttcgatttcggttttcgaggggcggttaacgggcggggagcgcgagtttcgcggtttttaggcgttttttttcgtttcgcgttttgcggagttcgttggcggttttttcggagttttttgggcgttagcgatcgttcgttgggtcggattcgcgcggggtgtagggggcgttgagatatttcggcgttatcgatttttttaacggggtttcgttagtttttttagttttttaacgcgtagtaaagggagtttttttaatttgaaaagcgaagttaagtcgttttattcgagcggagattagcgtagtcgggtaggttcgagacgcgttacgcgttcgcggggtagttttcggtttttttttattggggtttcgatttcgttcggtcgggtatttttgcgtttgggattcgaggttcggggtttttattcggttttcgcggtttttttgttttcgttcgcgttttttttatttcgggcgtttatttgtttcggtcgtgaggagaggagaagttcgcggcgtcgcggttgttagcgattggttcggaggataggcgacgcgcggggtcgagggggagggacgcggggcggggaagggaagcggcggcgttcgcgggcggaggtcggcgcggggattaattgtcgcgcggttcggcgtatattttgtgttttcggcgggcggtcggtcgaggtttaagttaaagggtgtagcgttgttaagtagggtcgggaatgagttatcggaaaaaacgagttgagattcgtttgaatatttgtattagttgatatcgtttgcgggtgttatcgttttttgacgtggtttattgattgtaa

SEQ ID NO: 21290 - DNA, 1077 bp, Artificial Sequence
  chemically treated genomic DNA (Homo sapiens) CpG-island No: 21290
ttacaatcaataaaccacgtcaaaaaacgataacacccgcaaacgatatcaactaatacaaatattcaaacgaatctcaactcgttttttccgataactcattcccgaccctacttaacaacgctacaccctttaacttaaacctcgaccgaccgcccgccgaaaacacaaaatatacgccgaaccgcgcgacaattaatccccgcgccgacctccgcccgcgaacgccgccgcttcccttccccgccccgcgtccctccccctcgaccccgcgcgtcgcctatcctccgaaccaatcgctaacaaccgcgacgccgcgaacttctcctctcctcacgaccgaaacaaataaacgcccgaaataaaaaaaacgcgaacgaaaacaaaaaaaccgcgaaaaccgaataaaaaccccgaacctcgaatcccaaacgcaaaaatacccgaccgaacgaaatcgaaaccccaataaaaaaaaaccgaaaactaccccgcgaacgcgtaacgcgtctcgaacctacccgactacgctaatctccgctcgaataaaacgacttaacttcgcttttcaaattaaaaaaactccctttactacgcgttaaaaaactaaaaaaactaacgaaaccccgttaaaaaaatcgataacgccgaaatatctcaacgccccctacaccccgcgcgaatccgacccaacgaacgatcgctaacgcccaaaaaactccgaaaaaaccgccaacgaactccgcaaaacgcgaaacgaaaaaaaacgcctaaaaaccgcgaaactcgcgctccccgcccgttaaccgcccctcgaaaaccgaaatcgaaacccaaaacgccccttaacaaaacctaacgcttccgcgatacccaaaaaatacttaaaaaaataaaaaaaaaaacgcccgccgaaaaaattccgaaaacctcgatacctcccgccgcaactacaacgttcctcccgaaaaacgacccaacccttcatcctcgccgcctaaacttctccgaaaaaaactacaaccttacgaccgttaccaccgcctaaaaaaacgacccacgcgaactaacgaacga

SEQ ID NO: 21291 - DNA, 1077 bp, Artificial Sequence
  chemically treated genomic DNA (Homo sapiens) CpG-island No: 21291
ttatagttaatgagttacgttagggagcgatggtattcgtaggcggtattaattgatgtaagtgtttaagcgaattttaattcgtttttttcggtgatttattttcggttttgtttggtagcgttgtattttttaatttaaatttcggtcggtcgttcgtcgggggtatagagtgtgcgtcgggtcgcgcggtaattggttttcgcgtcgattttcgttcgcgagcgtcgtcgtttttttttttcgtttcgcgtttttttttttcggtttcgcgcgtcgtttgtttttcgagttagtcgttgatagtcgcggcgtcgcgagttttttttttttttacgatcgaggtaggtaaacgttcggggtgggaggaacgcgggcgggggtaggggagtcgcgggggtcgagtgaggatttcgggtttcgggttttaggcgtaagggtgttcggtcgggcggggtcgggattttagtgaggaggggtcgggggttgtttcgcgggcgcgtgacgcgtttcgggtttgttcggttgcgttggttttcgttcgggtgaggcggtttggtttcgttttttaggttaggaaagttttttttattgcgcgttggggggttgggggagttggcggagtttcgttagggaggtcggtggcgtcggggtgttttagcgttttttgtatttcgcgcgggttcggtttagcgggcgatcgttggcgtttagggaatttcgggagggtcgttagcgggtttcgtagggcgcggggcggggaggggcgtttgggggtcgcggggttcgcgtttttcgttcgttggtcgtttttcggaggtcgagatcggggtttagaacgttttttggtaaggtttggcgttttcgcgatgtttagagggtgtttggggggatggagagaggggcgttcgtcgggggagtttcgggagtttcggtgtttttcgtcgtagttgtagcgtttttttcgggaggcggtttagttttttattttcgtcgtttgagttttttcgaggggggttgtagttttgcggtcgttgttatcgtttggagaagcggtttacgcggattgacgggcgg

SEQ ID NO: 21292 - DNA, 1077 bp, Artificial Sequence
  chemically treated genomic DNA (Homo sapiens) CpG-island No: 21292
ccgcccgtcaatccgcgtaaaccgcttctccaaacgataacaacgaccgcaaaactacaacccccctcgaaaaaactcaaacgacgaaaataaaaaactaaaccgcctcccgaaaaaaacgctacaactacgacgaaaaacaccgaaactcccgaaactcccccgacgaacgcccctctctccatccccccaaacaccctctaaacatcgcgaaaacgccaaaccttaccaaaaaacgttctaaaccccgatctcgacctccgaaaaacgaccaacgaacgaaaaacgcgaaccccgcgacccccaaacgcccctccccgccccgcgccctacgaaacccgctaacgaccctcccgaaattccctaaacgccaacgatcgcccgctaaaccgaacccgcgcgaaatacaaaaaacgctaaaacaccccgacgccaccgacctccctaacgaaactccgccaactcccccaaccccccaacgcgcaataaaaaaaactttcctaacctaaaaaacgaaaccaaaccgcctcacccgaacgaaaaccaacgcaaccgaacaaacccgaaacgcgtcacgcgcccgcgaaacaacccccgacccctcctcactaaaatcccgaccccgcccgaccgaacacccttacgcctaaaacccgaaacccgaaatcctcactcgacccccgcgactcccctacccccgcccgcgttcctcccaccccgaacgtttacctacctcgatcgtaaaaaaaaaaaaaactcgcgacgccgcgactatcaacgactaactcgaaaaacaaacgacgcgcgaaaccgaaaaaaaaaaacgcgaaacgaaaaaaaaaaacgacgacgctcgcgaacgaaaatcgacgcgaaaaccaattaccgcgcgacccgacgcacactctatacccccgacgaacgaccgaccgaaatttaaattaaaaaatacaacgctaccaaacaaaaccgaaaataaatcaccgaaaaaaacgaattaaaattcgcttaaacacttacatcaattaataccgcctacgaataccatcgctccctaacgtaactcattaactataa

SEQ ID NO: 21293 - DNA, 595 bp, Artificial Sequence
  chemically treated genomic DNA (Homo sapiens) CpG-island No: 21293
  misc_feature (290)..(290): n is either a, c, g or t
tgtttacgttaagttcgtcgattattagtattttgaagaggtgttcgcgggtttcgggcgttggggcggcggtcgtttttaggtcggggttttcggttttttcgttcgttatgagcgttgcggttgtcgggcgcgtttcgatttcgagtttggttttttgttcggtttcgcgttttgtcgtcgcgttttcggcggtcgcggaaattttttcgaggtcggttagtttttcgtcgcgttcgttgacgtcgtttgatcggttataggatttagaattcgttagtgttcgcggntcgggcggggttagacgagggtagggtcggacgagggtagggtttggcgtcggtttggggaggattttgcgcgaggcggttttcgttttgcgtttttgaagttcggtcgggtttaattggattttttttttcgggcggcgttttcgaagttcggtcgggtttagttggattttttttttcgggcggcgttttttggcggtcgcggcgcggagggaggtttagacgttcgttggtgggttttcggggagtcggtttggagtttttatgggtttcgaaggtttattgggggtttgaggaggcgtcga

SEQ ID NO: 21294 - DNA, 595 bp, Artificial Sequence
  chemically treated genomic DNA (Homo sapiens) CpG-island No: 21294
  misc_feature (306)..(306): n is either a, c, g or t
tcgacgcctcctcaaacccccaataaaccttcgaaacccataaaaactccaaaccgactccccgaaaacccaccaacgaacgtctaaacctccctccgcgccgcgaccgccaaaaaacgccgcccgaaaaaaaaaatccaactaaacccgaccgaacttcgaaaacgccgcccgaaaaaaaaaatccaattaaacccgaccgaacttcaaaaacgcaaaacgaaaaccgcctcgcgcaaaatcctccccaaaccgacgccaaaccctaccctcgtccgaccctaccctcgtctaaccccgcccganccgcgaacactaacgaattctaaatcctataaccgatcaaacgacgtcaacgaacgcgacgaaaaactaaccgacctcgaaaaaatttccgcgaccgccgaaaacgcgacgacaaaacgcgaaaccgaacaaaaaaccaaactcgaaatcgaaacgcgcccgacaaccgcaacgctcataacgaacgaaaaaaccgaaaaccccgacctaaaaacgaccgccgccccaacgcccgaaacccgcgaacacctcttcaaaatactaataatcgacgaacttaacgtaaaca

SEQ ID NO: 21295 - DNA, 595 bp, Artificial Sequence
  chemically treated genomic DNA (Homo sapiens) CpG-island No: 21295
  misc_feature (306)..(306): n is either a, c, g or t
tcggcgtttttttaggtttttagtgaattttcggggtttataaaggttttaggtcggtttttcggaggtttattagcgggcgtttgggttttttttcgcgtcgcgatcgttaggaggcgtcgttcgggagaggaagtttagttgggttcggtcgggtttcggaggcgtcgttcgggagaggaagtttagttgggttcggtcgggttttagaggcgtagggcgggagtcgtttcgcgtagggttttttttaagtcggcgttaggttttgttttcgttcggttttgttttcgtttggtttcgttcggntcgcgagtattggcgggttttgggttttgtgatcggttaggcggcgttagcgggcgcggcggagggttggtcggtttcgggggagttttcgcggtcgtcgggggcgcggcggtagagcgcgaggtcgggtagggggttagattcggagtcgaggcgcgttcgatagtcgtagcgtttatggcgggcggaggagtcggggatttcggtttgggggcggtcgtcgttttagcgttcgagattcgcgagtatttttttaaggtgttggtgatcggcgagtttggcgtgggta

SEQ ID NO: 21296 - DNA, 595 bp, Artificial Sequence
  chemically treated genomic DNA (Homo sapiens) CpG-island No: 21296
  misc_feature (290)..(290): n is either a, c, g or t
tacccacgccaaactcgccgatcaccaacaccttaaaaaaatactcgcgaatctcgaacgctaaaacgacgaccgcccccaaaccgaaatccccgactcctccgcccgccataaacgctacgactatcgaacgcgcctcgactccgaatctaaccccctacccgacctcgcgctctaccgccgcgcccccgacgaccgcgaaaactcccccgaaaccgaccaaccctccgccgcgcccgctaacgccgcctaaccgatcacaaaacccaaaacccgccaatactcgcganccgaacgaaaccaaacgaaaacaaaaccgaacgaaaacaaaacctaacgccgacttaaaaaaaaccctacgcgaaacgactcccgccctacgcctctaaaacccgaccgaacccaactaaacttcctctcccgaacgacgcctccgaaacccgaccgaacccaactaaacttcctctcccgaacgacgcctcctaacgatcgcgacgcgaaaaaaaacccaaacgcccgctaataaacctccgaaaaaccgacctaaaacctttataaaccccgaaaattcactaaaaacctaaaaaaacgccga

SEQ ID NO: 21297 - DNA, 660 bp, Artificial Sequence
  chemically treated genomic DNA (Homo sapiens) CpG-island No: 21297
gggagcgaagaggagggtaaaaaagaagttatatttattcggagtttagttgatttttcggtagaataagtgttaacgtttttaaagggcgcggtttgttttagttacgaaaacgtatcggttggtaaggtaggcggttgggggttgtttattcggaagtcgggtggggtgggggcgggaatattttcgaatttcgatttcgcggtcgtcgtttaggcgcgtcgttttttttttcgcgttcgtttttatcgcgggaaagggtatttcgggttcgagtcgtcgggtagtcgacgtcggcgagacggtagggcgtcggagcggaggtaaatttagcgcgaacgagggaagacgttattttgtttattttattttttatggtggttgaaggcgaacgttagcgtttcggtcgtgtggtcgtaggcgtattatggtatgttatagggaggaggagcggcggggcgggcggggaggaggcgcgcgggagggattgagtgttcgtagtgttaataagttagcggtagggatcggtcgggtaatttagggcgttttagagattcggcgtggagggtagggttttttgtgcggcggtttagggtatcgagttcgaattcgtaattatgttatagttgttttttgtgtgaaattgttattcgtttataa

SEQ ID NO: 21298 - DNA, 660 bp, Artificial Sequence
  chemically treated genomic DNA (Homo sapiens) CpG-island No: 21298
ttataaacgaataacaatttcacacaaaaaacaactataacataattacgaattcgaactcgataccctaaaccgccgcacaaaaaaccctaccctccacgccgaatctctaaaacgccctaaattacccgaccgatccctaccgctaacttattaacactacgaacactcaatccctcccgcgcgcctcctccccgcccgccccgccgctcctcctccctataacataccataatacgcctacgaccacacgaccgaaacgctaacgttcgccttcaaccaccataaaaaataaaataaacaaaataacgtcttccctcgttcgcgctaaatttacctccgctccgacgccctaccgtctcgccgacgtcgactacccgacgactcgaacccgaaataccctttcccgcgataaaaacgaacgcgaaaaaaaaaacgacgcgcctaaacgacgaccgcgaaatcgaaattcgaaaatattcccgcccccaccccacccgacttccgaataaacaacccccaaccgcctaccttaccaaccgatacgttttcgtaactaaaacaaaccgcgccctttaaaaacgttaacacttattctaccgaaaaatcaactaaactccgaataaatataacttcttttttaccctcctcttcgctccc

SEQ ID NO: 21299 - DNA, 660 bp, Artificial Sequence
  chemically treated genomic DNA (Homo sapiens) CpG-island No: 21299
ttgtgagcgaataataattttatataggaaatagttatgatatgattacgaattcgagttcggtattttaggtcgtcgtatagaaagttttgttttttacgtcgggtttttggagcgttttgggttgttcggtcggtttttgtcgttgatttgttgatattgcgagtatttagtttttttcgcgcgtttttttttcgttcgtttcgtcgttttttttttttgtaatatgttatagtgcgtttgcgattatacggtcggggcgttagcgttcgtttttagttattatggggaatgggatgaataaggtaacgttttttttcgttcgcgttgggtttgttttcgtttcgacgttttgtcgtttcgtcggcgtcggttgttcgacgattcgagttcggggtgttttttttcgcggtggggacgggcgcggagggaggggcggcgcgtttgggcggcgatcgcggagtcggggttcggaggtgttttcgtttttattttattcggttttcgggtaggtagtttttagtcgtttgttttgttagtcggtgcgttttcgtggttgaaataagtcgcgttttttgaaagcgttgatatttgttttgtcgagaggttagttgagtttcgaatggatgtggttttttttttgttttttttttcgttttt

SEQ ID NO: 21300 - DNA, 660 bp, Artificial Sequence
  chemically treated genomic DNA (Homo sapiens) CpG-island No: 21300
aaaaacgaaaaaaaaaacaaaaaaaaaaccacatccattcgaaactcaactaacctctcgacaaaacaaatatcaacgctttcaaaaaacgcgacttatttcaaccacgaaaacgcaccgactaacaaaacaaacgactaaaaactacctacccgaaaaccgaataaaataaaaacgaaaacacctccgaaccccgactccgcgatcgccgcccaaacgcgccgcccctccctccgcgcccgtccccaccgcgaaaaaaaacaccccgaactcgaatcgtcgaacaaccgacgccgacgaaacgacaaaacgtcgaaacgaaaacaaacccaacgcgaacgaaaaaaaacgttaccttattcatcccattccccataataactaaaaacgaacgctaacgccccgaccgtataatcgcaaacgcactataacatattacaaaaaaaaaaaacgacgaaacgaacgaaaaaaaaacgcgcgaaaaaaactaaatactcgcaatatcaacaaatcaacgacaaaaaccgaccgaacaacccaaaacgctccaaaaacccgacgtaaaaaacaaaactttctatacgacgacctaaaataccgaactcgaattcgtaatcatatcataactatttcctatataaaattattattcgctcacaa

SEQ ID NO: 21301 - DNA, 1202 bp, Artificial Sequence
  chemically treated genomic DNA (Homo sapiens) CpG-island No: 21301
ttcggtcgcggggttcggggcgagcgcggcgtcggttagggagacggtgttcgcgtttcgattcgtagttgttttattttgtttagtagggttttcgttttggcgttatttttatgaaattttacgaatttaaagaggcggttgtggagatagatatagtttattcgttaacgtttagggaacgttatcgattcgtttttgttcgagttcgaggttttagcggaggcggcgcgaagagcgttaaatcgaggtgttcgtttcgtcgtcgttagagataagtcgcgttcggttttttcgggagagcggttattgttcgttcggagtcgatcgggcgagtgacggcggttcgtatttgtttagttcgtcgagcgttttttttttttcggttgttaggttgggggacgttttttcgttttcgtcgttcgtttttttcgtcgttatttttttttttttattatcgaaagcggcggcggtagcggcggcggtagcgagcgatatttcgtaggattttatggaaacgtagcgaatttataattttaacgtcgatattttttttcggatcggggttcgtagtgacgtttttaatttgcgcgcgggattagtatattaattttatcgtcgttttttttttcgtcgcgggcggcggcgacgaaaaattttaacgcggcggcggtgaaggcggcggcggcggcggtaggggttgcggagttttcgggtcggtagcggcggttttcggttgtagggttatatcgcggggttgggtagggggtagttataggcggggacggcgggaacggtcggagcgcgcggggttggggagtattgaggggattcgttggagatataaattttttcggtattagtataaagttgttgtaattgtgttatatagcgaattttacgtcgtcgtcgtgatttttttttttcgttcggttggcgttattaatcggcgcggttcgtacgttttacgtgatttttgttgatttacgttagtcgtggttttatttaatttgttagttgttcgagtttcgtttatcgaggtcgttatcgagatgggagcgggacgtaggttaattttagtcggtggttggttgttgggcgcgtttgtcgggggaagggttgttatcgagagggagttttttgttaggttgtgttggttaaatatattggggtagagaatggagggttcgggtcgtgttatt

SEQ ID NO: 21302 - DNA, 1202 bp, Artificial Sequence
  chemically treated genomic DNA (Homo sapiens) CpG-island No: 21302
aataacacgacccgaaccctccattctctaccccaatatatttaaccaacacaacctaacaaaaaactccctctcgataacaacccttcccccgacaaacgcgcccaacaaccaaccaccgactaaaattaacctacgtcccgctcccatctcgataacgacctcgataaacgaaactcgaacaactaacaaattaaataaaaccacgactaacgtaaatcaacaaaaatcacgtaaaacgtacgaaccgcgccgattaataacgccaaccgaacgaaaaaaaaaaatcacgacgacgacgtaaaattcgctatataacacaattacaacaactttatactaataccgaaaaaatttatatctccaacgaatcccctcaatactccccaaccccgcgcgctccgaccgttcccgccgtccccgcctataactaccccctacccaaccccgcgatataaccctacaaccgaaaaccgccgctaccgacccgaaaactccgcaacccctaccgccgccgccgccgccttcaccgccgccgcgttaaaatttttcgtcgccgccgcccgcgacgaaaaaaaaaacgacgataaaattaatatactaatcccgcgcgcaaattaaaaacgtcactacgaaccccgatccgaaaaaaaatatcgacgttaaaattataaattcgctacgtttccataaaatcctacgaaatatcgctcgctaccgccgccgctaccgccgccgctttcgataataaaaaaaaaaaaataacgacgaaaaaaacgaacgacgaaaacgaaaaaacgtcccccaacctaacaaccgaaaaaaaaaaaacgctcgacgaactaaacaaatacgaaccgccgtcactcgcccgatcgactccgaacgaacaataaccgctctcccgaaaaaaccgaacgcgacttatctctaacgacgacgaaacgaacacctcgatttaacgctcttcgcgccgcctccgctaaaacctcgaactcgaacaaaaacgaatcgataacgttccctaaacgttaacgaataaactatatctatctccacaaccgcctctttaaattcgtaaaatttcataaaaataacgccaaaacgaaaaccctactaaacaaaataaaacaactacgaatcgaaacgcgaacaccgtctccctaaccgacgccgcgctcgccccgaaccccgcgaccgaa

SEQ ID NO: 21303 - DNA, 1202 bp, Artificial Sequence
  chemically treated genomic DNA (Homo sapiens) CpG-island No: 21303
ggtgatacggttcggattttttattttttgttttagtgtatttaattagtataatttaataggaagttttttttcggtgataatttttttttcgatagacgcgtttagtagttaattatcggttagaattggtttgcgtttcgtttttatttcggtggcggtttcggtgggcggggttcgggtagttagtaagttaagtggagttacggttgacgtgagttaataaaggttacgtgaggcgtgcgggtcgcgtcgattggtggcgttagtcgggcggggagggggggttacggcggcggcgtggggttcgttgtgtgatataattataataattttgtgttggtgtcggggaagtttgtgtttttaacgaatttttttagtgttttttagtttcgcgcgtttcggtcgttttcgtcgttttcgtttgtggttgttttttgtttaatttcgcgatgtgattttatagtcgaaagtcgtcgttgtcgattcgggggtttcgtagtttttgtcgtcgtcgtcgtcgtttttatcgtcgtcgcgttgggatttttcgtcgtcgtcgttcgcggcggaggaggaggcggcgataaagttggtgtgttggtttcgcgcgtagattgggggcgttattgcgggtttcggttcgagggggggtgtcggcgttggagttgtgaattcgttgcgtttttatgaaattttgcggagtgtcgttcgttatcgtcgtcgttgtcgtcgtcgttttcggtgatgaggaaaagaaaatggcggcgggaaaagcgagcggcgagagcgaggaggcgttttttagtttgatagtcgaggagagggaggcgttcggcggattggataggtacgggtcgtcgttattcgttcggtcggtttcggacgggtagtagtcgttttttcgggaggatcgagcgcggtttgtttttggcggcggcggggcgggtatttcggtttggcgtttttcgcgtcgttttcgttggggtttcgggttcgggtagggacgggtcggtggcgttttttgagcgttaacgagtaaattgtgtttgtttttatagtcgtttttttgggttcgtgagattttatgaagatggcgttaggacgaaggttttattgggtaaggtaaggtagttgcgagtcggagcgcggatatcgtttttttggtcggcgtcgcgttcgtttcgggtttcgcggtcggg

SEQ ID NO: 21304 - DNA, 1202 bp, Artificial Sequence
  chemically treated genomic DNA (Homo sapiens) CpG-island No: 21304
cccgaccgcgaaacccgaaacgaacgcgacgccgaccaaaaaaacgatatccgcgctccgactcgcaactaccttaccttacccaataaaaccttcgtcctaacgccatcttcataaaatctcacgaacccaaaaaaacgactataaaaacaaacacaatttactcgttaacgctcaaaaaacgccaccgacccgtccctacccgaacccgaaaccccaacgaaaacgacgcgaaaaacgccaaaccgaaatacccgccccgccgccgccaaaaacaaaccgcgctcgatcctcccgaaaaaacgactactacccgtccgaaaccgaccgaacgaataacgacgacccgtacctatccaatccgccgaacgcctccctctcctcgactatcaaactaaaaaacgcctcctcgctctcgccgctcgcttttcccgccgccattttcttttcctcatcaccgaaaacgacgacgacaacgacgacgataacgaacgacactccgcaaaatttcataaaaacgcaacgaattcacaactccaacgccgacaccccccctcgaaccgaaacccgcaataacgcccccaatctacgcgcgaaaccaacacaccaactttatcgccgcctcctcctccgccgcgaacgacgacgacgaaaaatcccaacgcgacgacgataaaaacgacgacgacgacgacaaaaactacgaaacccccgaatcgacaacgacgactttcgactataaaatcacatcgcgaaattaaacaaaaaacaaccacaaacgaaaacgacgaaaacgaccgaaacgcgcgaaactaaaaaacactaaaaaaattcgttaaaaacacaaacttccccgacaccaacacaaaattattataattatatcacacaacgaaccccacgccgccgccgtaaccccccctccccgcccgactaacgccaccaatcgacgcgacccgcacgcctcacgtaacctttattaactcacgtcaaccgtaactccacttaacttactaactacccgaaccccgcccaccgaaaccgccaccgaaataaaaacgaaacgcaaaccaattctaaccgataattaactactaaacgcgtctatcgaaaaaaaaattatcaccgaaaaaaaacttcctattaaattatactaattaaatacactaaaacaaaaaataaaaaatccgaaccgtatcacc

SEQ ID NO: 21305 - DNA, 836 bp, Artificial Sequence
  chemically treated genomic DNA (Homo sapiens) CpG-island No: 21305
gtatttcggtatttaatcgtcgtcgtcgtcgtttttttttttttttcgttttcgtcgtcgtcgttttcgtcgtataagttgtcggttagcggtggttttcgagatgggttttgtaggttcggtttattgtttttttttttagtcgtcgtagtcgtttgggttttttgtttttcgtttgtcgtcgtcgtttttgttttcgtttttcgttatagcgtcgtcgtcgtcgtattcgggtagtttttggtcgtcgtcggtattttacgttttggggtcgttttatcgggttcgttcgggtttcgttcgaggtcgggattattttttcgcggttttttgcggagcggtttttcggcgggggacgacgcggtttttttgtcggttttcgtcgtcgagggggagtcgtcgggttgaagggcgagggtcgtttcgttcgttattttttaattgtttttttggtttttttttttcgttttttttgttttcgttcgacgcgcggtattggcgttttcgcggtttcggttgcgggagatttaaattttattacgtgattcgttttatcgtcgttttcgttttttcggcgttttcgttatttacgcgggttagattataatattacgggttacgtggcgggcggaggttgttgcgtttatcgtttcgtttgggttggaagcgtattcggtttcggcggtcggcggttttttttttttgtggcgagcgtgtagtgtagttaaattcgtttttcggtcgtttttttaattttttttttaaattgattttaaattattatcgtcggaatagtttaagttttggttcgttttgggaatttttacgtttttttg

SEQ ID NO: 21306 - DNA, 836 bp, Artificial Sequence
  chemically treated genomic DNA (Homo sapiens) CpG-island No: 21306
caaaaaaacgtaaaaattcccaaaacgaaccaaaacttaaactattccgacgataataatttaaaatcaatttaaaaaaaaaattaaaaaaacgaccgaaaaacgaatttaactacactacacgctcgccacaaaaaaaaaaaaccgccgaccgccgaaaccgaatacgcttccaacccaaacgaaacgataaacgcaacaacctccgcccgccacgtaacccgtaatattataatctaacccgcgtaaataacgaaaacgccgaaaaaacgaaaacgacgataaaacgaatcacgtaataaaatttaaatctcccgcaaccgaaaccgcgaaaacgccaataccgcgcgtcgaacgaaaacaaaaaaaacgaaaaaaaaaaaccaaaaaaacaattaaaaaataacgaacgaaacgaccctcgcccttcaacccgacgactccccctcgacgacgaaaaccgacaaaaaaaccgcgtcgtcccccgccgaaaaaccgctccgcaaaaaaccgcgaaaaaataatcccgacctcgaacgaaacccgaacgaacccgataaaacgaccccaaaacgtaaaataccgacgacgaccaaaaactacccgaatacgacgacgacgacgctataacgaaaaacgaaaacaaaaacgacgacgacaaacgaaaaacaaaaaacccaaacgactacgacgactaaaaaaaaaaacaataaaccgaacctacaaaacccatctcgaaaaccaccgctaaccgacaacttatacgacgaaaacgacgacgacgaaaacgaaaaaaaaaaaaaaacgacgacgacgacgattaaataccgaaatac

SEQ ID NO: 21307 - DNA, 836 bp, Artificial Sequence
  chemically treated genomic DNA (Homo sapiens) CpG-island No: 21307
taggaagacgtggaaatttttagggcggattaaaatttgagttgtttcggcggtagtgatttgaggttagtttgaaagagaagttgagaaagcggtcgaggggcgaatttggttgtattatacgttcgttataaagaggaagggtcgtcggtcgtcggggtcgagtgcgtttttagtttaggcggagcggtagacgtaatagttttcgttcgttacgtgattcgtagtgttgtggtttggttcgcgtgggtggcgggagcgtcgagagggcgggggcggcgatggggcgggttacgtgatggggtttaaatttttcgtagtcggagtcgcgggggcgttagtgtcgcgcgtcgagcgggagtagaggaggcgagggaggagggttagagaggtagttggaagatggcggacgaggcggttttcgttttttagttcggcggttttttttcggcggcgggggtcgatagggaggtcgcgtcgtttttcgtcggggagtcgtttcgtaagaggtcgcggagagatggtttcggtttcgagcggagttcgggcgagttcggtggggcggttttagagcgtgaggtgtcggcggcggttaggggttgttcgggtgcggcggcggcggcgttgtggcgggaggcggaggtagaggcggcggcggtaggcggggagtaagaggtttaggcgattgcggcggttggggaaggagataatgggtcgggtttgtagggtttatttcgggagttatcgttggtcgataatttgtacgacgaagacgacgacgacgagggcgaggaggaggaagaggcggcggcggcggcgattgggtatcgaggtgt

SEQ ID NO: 21308 - DNA, 836 bp, Artificial Sequence
  chemically treated genomic DNA (Homo sapiens) CpG-island No: 21308
acacctcgatacccaatcgccgccgccgccgcctcttcctcctcctcgccctcgtcgtcgtcgtcttcgtcgtacaaattatcgaccaacgataactcccgaaataaaccctacaaacccgacccattatctccttccccaaccgccgcaatcgcctaaacctcttactccccgcctaccgccgccgcctctacctccgcctcccgccacaacgccgccgccgccgcacccgaacaacccctaaccgccgccgacacctcacgctctaaaaccgccccaccgaactcgcccgaactccgctcgaaaccgaaaccatctctccgcgacctcttacgaaacgactccccgacgaaaaacgacgcgacctccctatcgacccccgccgccgaaaaaaaaccgccgaactaaaaaacgaaaaccgcctcgtccgccatcttccaactacctctctaaccctcctccctcgcctcctctactcccgctcgacgcgcgacactaacgcccccgcgactccgactacgaaaaatttaaaccccatcacgtaacccgccccatcgccgcccccgccctctcgacgctcccgccacccacgcgaaccaaaccacaacactacgaatcacgtaacgaacgaaaactattacgtctaccgctccgcctaaactaaaaacgcactcgaccccgacgaccgacgacccttcctctttataacgaacgtataatacaaccaaattcgcccctcgaccgctttctcaacttctctttcaaactaacctcaaatcactaccgccgaaacaactcaaattttaatccgccctaaaaatttccacgtcttccta

SEQ ID NO: 21309 - DNA, 868 bp, Artificial Sequence
  chemically treated genomic DNA (Homo sapiens) CpG-island No: 21309
aggcgcgcggtttaggttaggtgcgtttgagttcgggttgtattgtagtttgcgttttggtttttgcgagtcgttggcgcggttattttgggtttcgttgggtcgatacgtgtcgttgtttcgcgttttttttggcgattgagtgggattcggggtagcggggagcggggtcgtttacgagttgcgggagatgttcggtattatcgtggcgtacgtttttttttagatcgtagggttattatgaagtttatttcgttgtagggtttaggttgcggcgataaggcgtttcgaaatgttagtttatttcgcgaggtttaatttttttttcgtttacgaatttcgcgtttttgagttttcgggtatcgtcgtttttatttaaaattttcgcgcgtcgtacgtttttttaagcggaggcggcgaggattttgtttttcgttcggcggtcgttcggttgtttagtaaattcgttcgtagaaaggatgggaaggaagggggttagtgtatcgagtagcggtcgcggcggcggcgtcggaattcggtttttcgattttttacgtcgcgtttttcgtagcggataacgtgggttttttgttgcgcgttcggtttaggtattttattttagtttcgggatttttcgtttcgacgtaatcgataggttggtagttaatggggacgcgaagttcgcgggttatttaaatagtttcgtttttttttttattttttttttttcgagaggcgtcgttttcgtcgcgcgtaggttttaagattcgggaatttttgtaggtatgcgaagagtcgcgaggtgttaaaggcgaagaggttatcgttagtaagaatgatttgattaatatttcgatttgaagttttt

SEQ ID NO: 21310 - DNA, 868 bp, Artificial Sequence
  chemically treated genomic DNA (Homo sapiens) CpG-island No: 21310
aaaaacttcaaatcgaaatattaatcaaatcattcttactaacgataacctcttcgcctttaacacctcgcgactcttcgcatacctacaaaaattcccgaatcttaaaacctacgcgcgacgaaaacgacgcctctcgaaaaaaaaaaaataaaaaaaaaaacgaaactatttaaataacccgcgaacttcgcgtccccattaactaccaacctatcgattacgtcgaaacgaaaaatcccgaaactaaaataaaatacctaaaccgaacgcgcaacaaaaaacccacgttatccgctacgaaaaacgcgacgtaaaaaatcgaaaaaccgaattccgacgccgccgccgcgaccgctactcgatacactaacccccttccttcccatcctttctacgaacgaatttactaaacaaccgaacgaccgccgaacgaaaaacaaaatcctcgccgcctccgcttaaaaaaacgtacgacgcgcgaaaattttaaataaaaacgacgatacccgaaaactcaaaaacgcgaaattcgtaaacgaaaaaaaaattaaacctcgcgaaataaactaacatttcgaaacgccttatcgccgcaacctaaaccctacaacgaaataaacttcataataaccctacgatctaaaaaaaaacgtacgccacgataataccgaacatctcccgcaactcgtaaacgaccccgctccccgctaccccgaatcccactcaatcgccaaaaaaaacgcgaaacaacgacacgtatcgacccaacgaaacccaaaataaccgcgccaacgactcgcaaaaaccaaaacgcaaactacaatacaacccgaactcaaacgcacctaacctaaaccgcgcgcct

SEQ ID NO: 21311 - DNA, 868 bp, Artificial Sequence
  chemically treated genomic DNA (Homo sapiens) CpG-island No: 21311
gaaagttttagatcggggtattggttagattatttttattagcgatgattttttcgtttttggtatttcgcggtttttcgtatgtttataagaattttcgggttttgaaatttacgcgcggcggaagcgacgtttttcgggagagggagggtgaaagaaggggcggggttatttaaatagttcgcgagtttcgcgtttttattggttgttagtttgtcggttacgtcggggcgggaagtttcggggttgaagtgaggtatttgagtcgggcgcgtagtagaaagtttacgttgttcgttgcggggagcgcggcgtggaaagtcgggagatcgaatttcggcgtcgtcgtcgcggtcgttgttcggtgtattagttttttttttttttattttttttgcgagcgggtttgttgggtagtcgggcgatcgtcgaacggaaagtaagattttcgtcgttttcgtttgaggaggcgtgcggcgcgcggagattttgagtgggagcgacggtgttcgagagtttaggggcgcggagttcgtgagcgagaaggaagttaaatttcgcggaatagattggtatttcgggacgttttgtcgtcgtagtttgggttttgtaacggggtaaattttatggtggttttgcgatttggggaggggcgtgcgttacggtgatgtcgggtatttttcgtagttcgtgagcggtttcgtttttcgttgtttcgggttttatttagtcgttagggagagcgcggggtagcggtacgtgtcggtttagcgaggtttagagtgatcgcgttagcgattcgtaggagttagggcgtaggttgtagtgtagttcggatttagacgtatttggtttggatcgcgcgttt

SEQ ID NO: 21312 - DNA, 868 bp, Artificial Sequence
  chemically treated genomic DNA (Homo sapiens) CpG-island No: 21312
aaacgcgcgatccaaaccaaatacgtctaaatccgaactacactacaacctacgccctaactcctacgaatcgctaacgcgatcactctaaacctcgctaaaccgacacgtaccgctaccccgcgctctccctaacgactaaataaaacccgaaacaacgaaaaacgaaaccgctcacgaactacgaaaaatacccgacatcaccgtaacgcacgcccctccccaaatcgcaaaaccaccataaaatttaccccgttacaaaacccaaactacgacgacaaaacgtcccgaaataccaatctattccgcgaaatttaacttccttctcgctcacgaactccgcgcccctaaactctcgaacaccgtcgctcccactcaaaatctccgcgcgccgcacgcctcctcaaacgaaaacgacgaaaatcttactttccgttcgacgatcgcccgactacccaacaaacccgctcgcaaaaaaaataaaaaaaaaaaaaactaatacaccgaacaacgaccgcgacgacgacgccgaaattcgatctcccgactttccacgccgcgctccccgcaacgaacaacgtaaactttctactacgcgcccgactcaaatacctcacttcaaccccgaaacttcccgccccgacgtaaccgacaaactaacaaccaataaaaacgcgaaactcgcgaactatttaaataaccccgccccttctttcaccctccctctcccgaaaaacgtcgcttccgccgcgcgtaaatttcaaaacccgaaaattcttataaacatacgaaaaaccgcgaaataccaaaaacgaaaaaatcatcgctaataaaaataatctaaccaataccccgatctaaaactttc

SEQ ID NO: 21313 - DNA, 692 bp, Artificial Sequence
  chemically treated genomic DNA (Homo sapiens) CpG-island No: 21313
tcgtcgcgcgttttgtgtaggtgatcggggtgcgcgcggggcgtgtgtcgagcgcgtaggcgtagcgcgtagacgttggggtacgagcgatcgtcggagtcgtagacggtgtcgcgttgcgcgtatacgtagagttcggtgttttcgggcgttgttttagcggtttggttcgcgtatattaggtcggggttatagcgttcgtcggcgcggttttcgtagttcgcgttttcggtttttaggtagcgggcgtagtagtcgtattcgtcgagcgtcgagatttcgggcgtcgggtagggcgtaggcgtcgggtagttttttggtcggtacggattatatttggggcgtcgatcgtttacgtcgcggattttaaggttcggggatagcggcggtagtagcggtagtagtagtagaagtagtagcggtaagagtagagataagcgcggtatggtttgtttcgggatagcggcggcgtttttgtttcgcgtttcgtttcgcgttcgtcgagtagttatcgttttcgtttcgcggtcgttgattggtcgggtttgtatcgcggggcgttcgtagatcgttgttttagttcgggattcgcgcggtgttcgcggttcgggttttcgagttggagggtcgtttcgagagtagtttttcgattttcgattggatttttgagggaatcgagatttagtcggggt

SEQ ID NO: 21314 - DNA, 692 bp, Artificial Sequence
  chemically treated genomic DNA (Homo sapiens) CpG-island No: 21314
accccgactaaatctcgattccctcaaaaatccaatcgaaaatcgaaaaactactctcgaaacgaccctccaactcgaaaacccgaaccgcgaacaccgcgcgaatcccgaactaaaacaacgatctacgaacgccccgcgatacaaacccgaccaatcaacgaccgcgaaacgaaaacgataactactcgacgaacgcgaaacgaaacgcgaaacaaaaacgccgccgctatcccgaaacaaaccataccgcgcttatctctactcttaccgctactacttctactactactaccgctactaccgccgctatccccgaaccttaaaatccgcgacgtaaacgatcgacgccccaaatataatccgtaccgaccaaaaaactacccgacgcctacgccctacccgacgcccgaaatctcgacgctcgacgaatacgactactacgcccgctacctaaaaaccgaaaacgcgaactacgaaaaccgcgccgacgaacgctataaccccgacctaatatacgcgaaccaaaccgctaaaacaacgcccgaaaacaccgaactctacgtatacgcgcaacgcgacaccgtctacgactccgacgatcgctcgtaccccaacgtctacgcgctacgcctacgcgctcgacacacgccccgcgcgcaccccgatcacctacacaaaacgcgcgacga

SEQ ID NO: 21315 - DNA, 692 bp, Artificial Sequence
  chemically treated genomic DNA (Homo sapiens) CpG-island No: 21315
gtttcgattgggtttcggtttttttaagagtttaatcggaggtcggagagttgttttcggggcgattttttagttcggagattcgggtcgcgggtatcgcgcgggtttcgggttggagtagcggtttgcgggcgtttcgcggtgtaggttcggttaattagcggtcgcggggcgggagcggtgattgttcggcgggcgcggagcggagcgcgaagtagaggcgtcgtcgttgtttcggagtaagttatgtcgcgtttgtttttgtttttgtcgttgttgtttttgttgttgttgtcgttgttgtcgtcgttgttttcgagttttgggattcgcgacgtgggcggtcggcgttttaagtgtggttcgtgtcggttagagggttgttcggcgtttgcgttttgttcggcgttcgggatttcggcgttcgacgagtgcggttgttgcgttcgttgtttgggagtcgagggcgcgagttgcgggggtcgcgtcggcgggcgttgtggtttcggtttggtatgcgcgagttaggtcgttggggtagcgttcgagggtatcgggttttgcgtgtgcgcgtagcgcggtatcgtttgcggtttcgacggtcgttcgtattttagcgtttgcgcgttgcgtttgcgcgttcggtatacgtttcgcgcgtatttcggttatttgtataaggcgcgcgacgg

SEQ ID NO: 21316 - DNA, 692 bp, Artificial Sequence
  chemically treated genomic DNA (Homo sapiens) CpG-island No: 21316
ccgtcgcgcgccttatacaaataaccgaaatacgcgcgaaacgtataccgaacgcgcaaacgcaacgcgcaaacgctaaaatacgaacgaccgtcgaaaccgcaaacgataccgcgctacgcgcacacgcaaaacccgataccctcgaacgctaccccaacgacctaactcgcgcataccaaaccgaaaccacaacgcccgccgacgcgacccccgcaactcgcgccctcgactcccaaacaacgaacgcaacaaccgcactcgtcgaacgccgaaatcccgaacgccgaacaaaacgcaaacgccgaacaaccctctaaccgacacgaaccacacttaaaacgccgaccgcccacgtcgcgaatcccaaaactcgaaaacaacgacgacaacaacgacaacaacaacaaaaacaacaacgacaaaaacaaaaacaaacgcgacataacttactccgaaacaacgacgacgcctctacttcgcgctccgctccgcgcccgccgaacaatcaccgctcccgccccgcgaccgctaattaaccgaacctacaccgcgaaacgcccgcaaaccgctactccaacccgaaacccgcgcgatacccgcgacccgaatctccgaactaaaaaatcgccccgaaaacaactctccgacctccgattaaactcttaaaaaaaccgaaacccaatcgaaac

SEQ ID NO: 21317 - DNA, 693 bp, Artificial Sequence
  chemically treated genomic DNA (Homo sapiens) CpG-island No: 21317
aaggtcgcggtggtggttgtgtttagtttcggggttatagaggtttacgtttcgcggatcggggtcggaaggcgtcgtgggtttttcgcggttagttttcgaagtttttttacgttcgtaggttttattttgagtgtttcgtaggcggttgttattagtaggaaagttttttcggcgttttgcggcgttcgttcggggttttcgttttcgggttggggtcggtagcggttagggtggtagcgtcgggttagttggcggtaggttcgcgcgattttcgttttgttcgtcgagcggtttacgtttagtatttcgtagtagtttcgcgtgtcgtagtagagtttttttattagggttttcgcgggtcgtattagtagtagcgtcggtagtaggggcgttagtagtatttattagcgtcggtcggtagtttcggttttttagtcgggagagagtagcggcgtttttatttttagtttcgttggcggttttgttattttagcgattttgtagtatttagtcgcgcgttcggttagtttcgtttggttttagttatacgttagtagtcgacgttttcgcgtaggcgtatagggcgcggttatagtaattatttttttcgtaattcgttggtagggagaaggacgttttagttattaggttgttttcggtgtgttattgaatatttttttcgtattagta

SEQ ID NO: 21318 - DNA, 693 bp, Artificial Sequence
  chemically treated genomic DNA (Homo sapiens) CpG-island No: 21318
tactaatacgaaaaaaatattcaataacacaccgaaaacaacctaataactaaaacgtccttctccctaccaacgaattacgaaaaaaataattactataaccgcgccctatacgcctacgcgaaaacgtcgactactaacgtataactaaaaccaaacgaaactaaccgaacgcgcgactaaatactacaaaatcgctaaaataacaaaaccgccaacgaaactaaaaataaaaacgccgctactctctcccgactaaaaaaccgaaactaccgaccgacgctaataaatactactaacgcccctactaccgacgctactactaatacgacccgcgaaaaccctaataaaaaaactctactacgacacgcgaaactactacgaaatactaaacgtaaaccgctcgacgaacaaaacgaaaatcgcgcgaacctaccgccaactaacccgacgctaccaccctaaccgctaccgaccccaacccgaaaacgaaaaccccgaacgaacgccgcaaaacgccgaaaaaactttcctactaataacaaccgcctacgaaacactcaaaataaaacctacgaacgtaaaaaaacttcgaaaactaaccgcgaaaaacccacgacgccttccgaccccgatccgcgaaacgtaaacctctataaccccgaaactaaacacaaccaccaccgcgacctt

SEQ ID NO: 21319 - DNA, 693 bp, Artificial Sequence
  chemically treated genomic DNA (Homo sapiens) CpG-island No: 21319
tgttggtacggggaaggtgtttagtgatatatcggaagtagtttagtggttgaggcgtttttttttttattaacgggttgcgaaggaagtagttgttgtagtcgcgttttgtgcgtttgcgcggaggcgtcggttgttgacgtgtagttggggttagacgggattagtcgggcgcgcggttgagtgttgtagaatcgttggggtggtagagtcgttagcgaggttggggatgggggcgtcgttgttttttttcggttggggagtcggggttgtcggtcggcgttggtggatgttgttggcgtttttgttgtcggcgttgttgttggtgcggttcgcgggggttttggtggaggggttttattgcggtacgcgggattgttacgaggtgttgggcgtgagtcgttcggcgggtaaggcggagatcgcgcgggtttatcgttagttggttcggcgttattattttgatcgttatcggttttagttcggagacgagggtttcgggcggacgtcgtagagcgtcgaggaggtttttttgttggtggtaatcgtttacgagatatttaaggtgaggtttgcgggcgtggaggggtttcgaagattggtcgcgggaagtttacggcgtttttcgatttcggttcgcggagcgtgggtttttgtgatttcgaaattgagtatagttattatcgcgatttt

SEQ ID NO: 21320 - DNA, 693 bp, Artificial Sequence
  chemically treated genomic DNA (Homo sapiens) CpG-island No: 21320
aaaatcgcgataataactatactcaatttcgaaatcacaaaaacccacgctccgcgaaccgaaatcgaaaaacgccgtaaacttcccgcgaccaatcttcgaaacccctccacgcccgcaaacctcaccttaaatatctcgtaaacgattaccaccaacaaaaaaacctcctcgacgctctacgacgtccgcccgaaaccctcgtctccgaactaaaaccgataacgatcaaaataataacgccgaaccaactaacgataaacccgcgcgatctccgccttacccgccgaacgactcacgcccaacacctcgtaacaatcccgcgtaccgcaataaaacccctccaccaaaacccccgcgaaccgcaccaacaacaacgccgacaacaaaaacgccaacaacatccaccaacgccgaccgacaaccccgactccccaaccgaaaaaaaacaacgacgcccccatccccaacctcgctaacgactctaccaccccaacgattctacaacactcaaccgcgcgcccgactaatcccgtctaaccccaactacacgtcaacaaccgacgcctccgcgcaaacgcacaaaacgcgactacaacaactacttccttcgcaacccgttaataaaaaaaaaaacgcctcaaccactaaactacttccgatatatcactaaacaccttccccgtaccaaca

SEQ ID NO: 21321 - DNA, 600 bp, Artificial Sequence
  chemically treated genomic DNA (Homo sapiens) CpG-island No: 21321
cggtattttttgcgtttttcgaggaattgattacggtcgttttttggagtgggcgtatttttagggatcgggatcgattacgatcgcggggttttttaggcgcggttttttttcgttaggttcgggttttcggtttgtttcgcgtttttttttatcgcggattttatcgttttcgcgtttcgtcgaggtttcgtcgtcgttatcgagtttttcgttggcgttcggttcgggtcgtcggttttttttttttacgtttcgcgggcggaaggatcggagcgtgggtattcggggttcgtattttgattttttttacgttagtttttaatttgagttgttttattaagcgttgtagggcgttcgcgttagtttcggaggatatggcggcggcgttgggtttttaggggttgttgggttcggtcgggcggggaggagtcgttagtttcgagcgcgggtgtcgtttcggggcggggaagtagttgcgttcgtttcgtcgttttagtttattcggcgcggagtcgtttgttagagatagcggggattttagcgagttggtagtgtttttcgttttttagcgtttgaaatttgggtggtatttgtagt

SEQ ID NO: 21322 - DNA, 600 bp, Artificial Sequence
  chemically treated genomic DNA (Homo sapiens) CpG-island No: 21322
actacaaataccacccaaatttcaaacgctaaaaaacgaaaaacactaccaactcgctaaaatccccgctatctctaacaaacgactccgcgccgaataaactaaaacgacgaaacgaacgcaactacttccccgccccgaaacgacacccgcgctcgaaactaacgactcctccccgcccgaccgaacccaacaacccctaaaaacccaacgccgccgccatatcctccgaaactaacgcgaacgccctacaacgcttaataaaacaactcaaattaaaaactaacgtaaaaaaaatcaaaatacgaaccccgaatacccacgctccgatccttccgcccgcgaaacgtaaaaaaaaaaaaccgacgacccgaaccgaacgccaacgaaaaactcgataacgacgacgaaacctcgacgaaacgcgaaaacgataaaatccgcgataaaaaaaaacgcgaaacaaaccgaaaacccgaacctaacgaaaaaaaaccgcgcctaaaaaaccccgcgatcgtaatcgatcccgatccctaaaaatacgcccactccaaaaaacgaccgtaatcaattcctcgaaaaacgcaaaaaataccg

SEQ ID NO: 21323 - DNA, 600 bp, Artificial Sequence
  chemically treated genomic DNA (Homo sapiens) CpG-island No: 21323
gttgtaggtgttatttaggttttaggcgttgaggagcggagagtattgttagttcgttggggttttcgttgtttttggtaagcggtttcgcgtcgggtgggttggggcggcggggcgggcgtagttgttttttcgtttcggggcggtattcgcgttcggggttggcggttttttttcgttcggtcgggtttagtagtttttaggagtttagcgtcgtcgttatgtttttcggggttagcgcgagcgttttgtagcgtttggtagagtagtttaagttggaggttggcgtggagaggattaaggtgcgggtttcgggtatttacgtttcggttttttcgttcgcggggcgtgagaagaggaggtcggcggttcggatcgggcgttagcgggggattcggtggcggcggcgaggtttcggcggggcgcgggggcggtggggttcgcggtgagggagggcgcggggtaagtcgggggttcgggtttgacgggaggaagtcgcgtttggggggtttcgcggtcgtggtcggtttcggtttttgggggtgcgtttattttagaaggcggtcgtggttagtttttcggagggcgtaagggatgtcg

SEQ ID NO: 21324 - DNA, 600 bp, Artificial Sequence
  chemically treated genomic DNA (Homo sapiens) CpG-island No: 21324
cgacatcccttacgccctccgaaaaactaaccacgaccgccttctaaaataaacgcacccccaaaaaccgaaaccgaccacgaccgcgaaaccccccaaacgcgacttcctcccgtcaaacccgaacccccgacttaccccgcgccctccctcaccgcgaaccccaccgcccccgcgccccgccgaaacctcgccgccgccaccgaatcccccgctaacgcccgatccgaaccgccgacctcctcttctcacgccccgcgaacgaaaaaaccgaaacgtaaatacccgaaacccgcaccttaatcctctccacgccaacctccaacttaaactactctaccaaacgctacaaaacgctcgcgctaaccccgaaaaacataacgacgacgctaaactcctaaaaactactaaacccgaccgaacgaaaaaaaaccgccaaccccgaacgcgaataccgccccgaaacgaaaaaacaactacgcccgccccgccgccccaacccacccgacgcgaaaccgcttaccaaaaacaacgaaaaccccaacgaactaacaatactctccgctcctcaacgcctaaaacctaaataacacctacaac

SEQ ID NO: 21325 - DNA, 858 bp, Artificial Sequence
  chemically treated genomic DNA (Homo sapiens) CpG-island No: 21325
tagggcgcgaggcgttgggtgtaggggaatttagtagttgcgtttattttcggttgtttgtagaacgttgatttttagttttttaaacgttttgttggcgagtttttttagcgcgtatagcggcgaggtttgcgagagtagcgcgcggttcgttaggggtaagtcgttttgcgcgtgtttgttcgcggcggttagtaggtgcgtcgtttcgtatagcgagtaattttttcgtatagacggtttgttgaggatgttttcgatgttgaacggcgttagtggtttgttggagttggtaggcggaggtaggtggtttagcgggttgcgtcgtcgtttttttttcggcgtcgttttgtcgttttttttggaagttatttcggttttgttcggggtttcggtcggggcggttcgggtcgcggggatttagttcgcgggtagttcgggcgtcggacggcgcgggtaggtagcggcgggtggaaaggaggtcgtattgggtagggcgcgggtcgggcgcggggtcgattagcgcggcggttgaggaggggagaatagcgcggggtttcgggaagagggcgttgacgcgggcgtcgttgttgttggggtttttagtaattcggggtcggagtcggggcgcgttgcgcggggttttagtttcgttaatttcggtgttatttaaaggtgttaggtggttcggtagtggtttttggtttcgggttttggcggtcgtagttggaagagtcgaggcgagggcgttcgattttcggattgcgagggaggcggagagacggggtaattgattattgttaataagttagttttgatcgcggtgtaattaattatttgtagcggtatttttttttt

SEQ ID NO: 21326 - DNA, 858 bp, Artificial Sequence
  chemically treated genomic DNA (Homo sapiens) CpG-island No: 21326
aaaaaaaaaataccgctacaaataattaattacaccgcgatcaaaactaacttattaacaataatcaattaccccgtctctccgcctccctcgcaatccgaaaatcgaacgccctcgcctcgactcttccaactacgaccgccaaaacccgaaaccaaaaaccactaccgaaccacctaacacctttaaataacaccgaaattaacgaaactaaaaccccgcgcaacgcgccccgactccgaccccgaattactaaaaaccccaacaacaacgacgcccgcgtcaacgccctcttcccgaaaccccgcgctattctcccctcctcaaccgccgcgctaatcgaccccgcgcccgacccgcgccctacccaatacgacctcctttccacccgccgctacctacccgcgccgtccgacgcccgaactacccgcgaactaaatccccgcgacccgaaccgccccgaccgaaaccccgaacaaaaccgaaataacttccaaaaaaaacgacaaaacgacgccgaaaaaaaaacgacgacgcaacccgctaaaccacctacctccgcctaccaactccaacaaaccactaacgccgttcaacatcgaaaacatcctcaacaaaccgtctatacgaaaaaattactcgctatacgaaacgacgcacctactaaccgccgcgaacaaacacgcgcaaaacgacttacccctaacgaaccgcgcgctactctcgcaaacctcgccgctatacgcgctaaaaaaactcgccaacaaaacgtttaaaaaactaaaaatcaacgttctacaaacaaccgaaaataaacgcaactactaaattcccctacacccaacgcctcgcgcccta

SEQ ID NO: 21327 - DNA, 858 bp, Artificial Sequence
  chemically treated genomic DNA (Homo sapiens) CpG-island No: 21327
gagaaagaagtgtcgttgtagataattgattatatcgcgattaaggttaatttgttagtaatagttaattgtttcgttttttcgtttttttcgtagttcggggatcgggcgttttcgtttcggtttttttaattgcggtcgttaggattcggggttaggagttattgtcgagttatttgatatttttaaatagtatcggggttggcgaaattggagtttcgcgtagcgcgtttcggtttcggtttcggattgttggaagttttagtagtagcggcgttcgcgttagcgtttttttttcggggtttcgcgttgtttttttttttttagtcgtcgcgttaatcggtttcgcgttcggttcgcgttttgtttagtgcggttttttttttattcgtcgttgtttgttcgcgtcgttcggcgttcgagttgttcgcgggttgggttttcgcggttcgagtcgtttcggtcgggatttcgaataaggtcgagatgatttttaaggaggacggtaaggcggcgtcgggggaggagcggcggcgtagttcgttggattatttgttttcgtttgttaattttaataagttattgacgtcgtttagtatcgaggatatttttaataagtcgtttgtgcggagaagttattcgttgtgcggggcggcgtatttgttggtcgtcgcggataagtacgcgtagggcggtttgtttttggcgggtcgcgcgttgttttcgtagatttcgtcgttgtgcgcgttggaggagttcgttagtaagacgtttaaggggttggaggttagcgttttgtaggtagtcgaaggtaggcgtagttgttgggtttttttgtatttagcgtttcgcgttttg

SEQ ID NO: 21328 - DNA, 858 bp, Artificial Sequence
  chemically treated genomic DNA (Homo sapiens) CpG-island No: 21328
caaaacgcgaaacgctaaatacaaaaaaacccaacaactacgcctaccttcgactacctacaaaacgctaacctccaaccccttaaacgtcttactaacgaactcctccaacgcgcacaacgacgaaatctacgaaaacaacgcgcgacccgccaaaaacaaaccgccctacgcgtacttatccgcgacgaccaacaaatacgccgccccgcacaacgaataacttctccgcacaaacgacttattaaaaatatcctcgatactaaacgacgtcaataacttattaaaattaacaaacgaaaacaaataatccaacgaactacgccgccgctcctcccccgacgccgccttaccgtcctccttaaaaatcatctcgaccttattcgaaatcccgaccgaaacgactcgaaccgcgaaaacccaacccgcgaacaactcgaacgccgaacgacgcgaacaaacaacgacgaataaaaaaaaaaccgcactaaacaaaacgcgaaccgaacgcgaaaccgattaacgcgacgactaaaaaaaaaaaaacaacgcgaaaccccgaaaaaaaaacgctaacgcgaacgccgctactactaaaacttccaacaatccgaaaccgaaaccgaaacgcgctacgcgaaactccaatttcgccaaccccgatactatttaaaaatatcaaataactcgacaataactcctaaccccgaatcctaacgaccgcaattaaaaaaaccgaaacgaaaacgcccgatccccgaactacgaaaaaaacgaaaaaacgaaacaattaactattactaacaaattaaccttaatcgcgatataatcaattatctacaacgacacttctttctc

SEQ ID NO: 21329 - DNA, 511 bp, Artificial Sequence
  chemically treated genomic DNA (Homo sapiens) CpG-island No: 21329
atgagcgtgttgggcgggcggtttggggtttcgggcgcggggcgggggtcgagtgggggggtgcgtacggcgggcgtagatgttcgggtgatcgattcgtcgtggtttttgcgtcgtttttgtgtcgaggaggcgcgcgcggggatttaatttattaaattgtttataaattgtgaagaaaatttaaaaattatatggtcgttagcgtcggcgcgttttgggttgcggagggtcgcggtcgtgttcgtatcgggagtcgcggggggttgggttcggttattgtcgtttgttagcggtcgtttaggtttattcgtttcggtttttatggttcgcgtttcgaattatagatttatttattttaagagagggtaatttttgtcgttcgggaggaattagtcgtacgtttgtttcgttgttttgtcgtttttttttttttttgttttttttttttttttttttttttttttattttttttttttttttttgtttttgttttttttttttcgtttt

SEQ ID NO: 21330 - DNA, 511 bp, Artificial Sequence
  chemically treated genomic DNA (Homo sapiens) CpG-island No: 21330
aaaacgaaaaaaaaaaaacaaaaacaaaaaaaaaaaaaaaaaataaaaaaaaaaaaaaaaaaaaaaaaaaaacaaaaaaaaaaaaaaacgacaaaacaacgaaacaaacgtacgactaattcctcccgaacgacaaaaattaccctctcttaaaataaataaatctataattcgaaacgcgaaccataaaaaccgaaacgaataaacctaaacgaccgctaacaaacgacaataaccgaacccaaccccccgcgactcccgatacgaacacgaccgcgaccctccgcaacccaaaacgcgccgacgctaacgaccatataatttttaaattttcttcacaatttataaacaatttaataaattaaatccccgcgcgcgcctcctcgacacaaaaacgacgcaaaaaccacgacgaatcgatcacccgaacatctacgcccgccgtacgcacccccccactcgacccccgccccgcgcccgaaaccccaaaccgcccgcccaacacgctcat

SEQ ID NO: 21331 - DNA, 511 bp, Artificial Sequence
  chemically treated genomic DNA (Homo sapiens) CpG-island No: 21331
gaaacggagaaagggagatagagatagagggagaaaaaaagaatgggaagagaggagaagagagagaaggagtagagaaggaaggagacggtagggtagcggggtaggcgtgcggttggtttttttcgggcgataaaaattgtttttttttaggatggatgggtttgtaattcggagcgcggattatgaaggtcgggacgaatgggtttgggcggtcgttgataggcgataatagtcgggtttagtttttcgcggttttcggtgcgggtacggtcgcggtttttcgtagtttagagcgcgtcggcgttggcgattatatggtttttgaattttttttataatttgtagataatttgatggattaggttttcgcgcgcgttttttcggtataaaggcggcgtagggattacggcgggtcggttattcgggtatttgcgttcgtcgtgcgtatttttttattcggttttcgtttcgcgttcgaagttttaggtcgttcgtttaatacgtttat

SEQ ID NO: 21332 - DNA, 511 bp, Artificial Sequence
  chemically treated genomic DNA (Homo sapiens) CpG-island No: 21332
ataaacgtattaaacgaacgacctaaaacttcgaacgcgaaacgaaaaccgaataaaaaaatacgcacgacgaacgcaaatacccgaataaccgacccgccgtaatccctacgccgcctttataccgaaaaaacgcgcgcgaaaacctaatccatcaaattatctacaaattataaaaaaaattcaaaaaccatataatcgccaacgccgacgcgctctaaactacgaaaaaccgcgaccgtacccgcaccgaaaaccgcgaaaaactaaacccgactattatcgcctatcaacgaccgcccaaacccattcgtcccgaccttcataatccgcgctccgaattacaaacccatccatcctaaaaaaaaacaatttttatcgcccgaaaaaaaccaaccgcacgcctaccccgctaccctaccgtctccttccttctctactccttctctctcttctcctctcttcccattctttttttctccctctatctctatctccctttctccgtttc

SEQ ID NO: 21333 - DNA, 671 bp, Artificial Sequence
  chemically treated genomic DNA (Homo sapiens) CpG-island No: 21333
  misc_feature (389)..(389): n is either a, c, g or t
cggaggtcgttggtggcggtcggttcggtcggttagtttgggtttattgtttcgagagggaagaggcggttgttaggagtcgagttcggggtcggggataggggaggaggcgggagttggtagaggaggttttagtttttttcggcggttcggttcgggaggcgttgggttttcgagcgttaggagtttagggcggcggaagattcggggcgtcgtttaatcgtttacgtcgattttttcgtttttttcgtttttcgagtagttttggttgttggtcggttggttcgtgagcggagaggtaggcgagagttgtagggcgttagcgttcggggttttcggggcgtttggggggaggatcggagagtcggttttcgatttggttttgtcgnagacgtcgttatcgtcggttgtggtttttaagttttgttcgagttcgaatagcgttacgatgtttatttgttcgttggggtttagttttttggcggattttacgtcggtttttattttttttaggtttcgtttgagtttagcgcgtcgattttggaattaggtgatgatttgcgcgttggtgaggtttagttgttgcgcgatttggtcgcgatcggcgggggataggtatttttggtatagaaagcgtttttttaatttataaatattggtggttggtgaag

SEQ ID NO: 21334 - DNA, 671 bp, Artificial Sequence
  chemically treated genomic DNA (Homo sapiens) CpG-island No: 21334
  misc_feature (283)..(283): n is either a, c, g or t
cttcaccaaccaccaatatttataaattaaaaaaacgctttctataccaaaaatacctatcccccgccgatcgcgaccaaatcgcgcaacaactaaacctcaccaacgcgcaaatcatcacctaattccaaaatcgacgcgctaaactcaaacgaaacctaaaaaaaataaaaaccgacgtaaaatccgccaaaaaactaaaccccaacgaacaaataaacatcgtaacgctattcgaactcgaacaaaacttaaaaaccacaaccgacgataacgacgtctncgacaaaaccaaatcgaaaaccgactctccgatcctccccccaaacgccccgaaaaccccgaacgctaacgccctacaactctcgcctacctctccgctcacgaaccaaccgaccaacaaccaaaactactcgaaaaacgaaaaaaacgaaaaaatcgacgtaaacgattaaacgacgccccgaatcttccgccgccctaaactcctaacgctcgaaaacccaacgcctcccgaaccgaaccgccgaaaaaaactaaaacctcctctaccaactcccgcctcctcccctatccccgaccccgaactcgactcctaacaaccgcctcttccctctcgaaacaataaacccaaactaaccgaccgaaccgaccgccaccaacgacctccg

SEQ ID NO: 21335 - DNA, 671 bp, Artificial Sequence
  chemically treated genomic DNA (Homo sapiens) CpG-island No: 21335
  misc_feature (283)..(283): n is either a, c, g or t
ttttattaattattagtatttatgaattggaaaagcgttttttatattagaagtatttgtttttcgtcgatcgcgattaaatcgcgtagtagttgggttttattaacgcgtaagttattatttggttttagaatcggcgcgttaagtttaagcgggatttggaggagatgaaggtcgacgtagagttcgttaagaaattgggttttagcgggtagatggatatcgtggcgttgttcgaattcgagtagaatttggaggttatagtcggcggtggcggcgtttncggtagggttaagtcgaggatcggtttttcggttttttttttaggcgtttcgaaggtttcgggcgttggcgttttgtagttttcgtttgttttttcgtttacggattagtcggttagtagttaggattgttcggaggacgaggaagacgaagagatcgacgtggacgattgagcggcgtttcgggtttttcgtcgttttgggtttttagcgttcgaaagtttaacgtttttcggatcggatcgtcgaggggagttgggattttttttgttaattttcgtttttttttttgttttcggtttcggattcggtttttggtagtcgttttttttttttcgaagtaataaatttaggttggtcggtcgggtcggtcgttattagcggttttcg

SEQ ID NO: 21336 - DNA, 671 bp, Artificial Sequence
  chemically treated genomic DNA (Homo sapiens) CpG-island No: 21336
  misc_feature (389)..(389): n is either a, c, g or t
cgaaaaccgctaataacgaccgacccgaccgaccaacctaaatttattacttcgaaaaaaaaaaaacgactaccaaaaaccgaatccgaaaccgaaaacaaaaaaaaaaacgaaaattaacaaaaaaaatcccaactcccctcgacgatccgatccgaaaaacgttaaactttcgaacgctaaaaacccaaaacgacgaaaaacccgaaacgccgctcaatcgtccacgtcgatctcttcgtcttcctcgtcctccgaacaatcctaactactaaccgactaatccgtaaacgaaaaaacaaacgaaaactacaaaacgccaacgcccgaaaccttcgaaacgcctaaaaaaaaaaccgaaaaaccgatcctcgacttaaccctaccgnaaacgccgccaccgccgactataacctccaaattctactcgaattcgaacaacgccacgatatccatctacccgctaaaacccaatttcttaacgaactctacgtcgaccttcatctcctccaaatcccgcttaaacttaacgcgccgattctaaaaccaaataataacttacgcgttaataaaacccaactactacgcgatttaatcgcgatcgacgaaaaacaaatacttctaatataaaaaacgcttttccaattcataaatactaataattaataaaa

SEQ ID NO: 21337 - DNA, 741 bp, Artificial Sequence
  chemically treated genomic DNA (Homo sapiens) CpG-island No: 21337
acgttttttacgtcggagaaagttgttattgtcgaatatgttttgggaggcggggtttaggttttagtagttgtttttgtttgggcggttcggttcgcgggggattttgacgaagtagtcgtttagcgagaggttgtggcggatgttgttttgttaggcggggaatttgcggcggtagtaggggaagcggttattaatgaaggcgtagatgtcgttgagcgtgaggcgtttgtgcgggttttgtaggatggttatggtgatgagcgcgatgtacgagtaggggggttttgtcggttgtcgggtatttttagaggtcgtcgtagattttggcggtgttttgaattcggtgttaaattttgaggggtcgttcgggtcgtcgtcgttttcgatgtgttttcggggaagcgtaatttcgttttatcgggttatttgtagtttcggttggagcgattgttttaggaattgttggttcgttttttttttttcgttttttatttcgtttttatttttttttttttttaggatatcgattttatcgttttttttatcggagtttcggaggttgcgttgcggtgtggagcgaaggcgtttagtttttggtaagtttatggcggagtaggtgttttagtcgtaggggatgtggcggtcgattatttggttcggggcgggttgagttggaagttcgggatgaatgttgtaagaagtaggaacgttagtggttattttttgggatgttttttt

SEQ ID NO: 21338 - DNA, 741 bp, Artificial Sequence
  chemically treated genomic DNA (Homo sapiens) CpG-island No: 21338
aaaaaaacatcccaaaaaataaccactaacgttcctacttcttacaacattcatcccgaacttccaactcaacccgccccgaaccaaataatcgaccgccacatcccctacgactaaaacacctactccgccataaacttaccaaaaactaaacgccttcgctccacaccgcaacgcaacctccgaaactccgataaaaaaaacgataaaatcgatatcctaaaaaaaaaaaaaaataaaaacgaaataaaaaacgaaaaaaaaaaaacgaaccaacaattcctaaaacaatcgctccaaccgaaactacaaataacccgataaaacgaaattacgcttccccgaaaacacatcgaaaacgacgacgacccgaacgacccctcaaaatttaacaccgaattcaaaacaccgccaaaatctacgacgacctctaaaaatacccgacaaccgacaaaacccccctactcgtacatcgcgctcatcaccataaccatcctacaaaacccgcacaaacgcctcacgctcaacgacatctacgccttcattaataaccgcttcccctactaccgccgcaaattccccgcctaacaaaacaacatccgccacaacctctcgctaaacgactacttcgtcaaaatcccccgcgaaccgaaccgcccaaacaaaaacaactactaaaacctaaaccccgcctcccaaaacatattcgacaataacaactttctccgacgtaaaaaacgt

SEQ ID NO: 21339 - DNA, 741 bp, Artificial Sequence
  chemically treated genomic DNA (Homo sapiens) CpG-island No: 21339
aggaaaatattttaaagggtaattattagcgtttttgttttttgtaatatttatttcgggtttttagtttagttcgtttcgggttaggtgatcggtcgttatattttttgcgattgaagtatttgtttcgttatgaatttgttaagagttgagcgttttcgttttatatcgtagcgtagttttcgggatttcgatggggaagacggtaaaatcgatgttttgggagaggaggaagatgaagacgaggtggaagacgaggaggaggaggcgagttagtagtttttagagtagtcgttttagtcggggttgtaggtggttcggtggggcggggttgcgttttttcgagagtatatcgagggcggcggcggttcgagcgattttttagagtttggtatcgagtttagggtatcgttaaggtttgcggcggtttttgaagatgttcggtagtcggtaaagtttttttattcgtatatcgcgtttattattatggttattttgtaaagttcgtataagcgttttacgtttagcggtatttgcgtttttattagtggtcgttttttttattatcgtcgtaagtttttcgtttggtagaatagtattcgttataatttttcgttgaacgattgtttcgttaagatttttcgcgagtcgggtcgtttaggtaagggtaattattggagtttggatttcgttttttaggatatgttcgataatggtagtttttttcggcgtaggaagcgt

SEQ ID NO: 21340 - DNA, 741 bp, Artificial Sequence
  chemically treated genomic DNA (Homo sapiens) CpG-island No: 21340
acgcttcctacgccgaaaaaaactaccattatcgaacatatcctaaaaaacgaaatccaaactccaataattacccttacctaaacgacccgactcgcgaaaaatcttaacgaaacaatcgttcaacgaaaaattataacgaatactattctaccaaacgaaaaacttacgacgataataaaaaaaacgaccactaataaaaacgcaaataccgctaaacgtaaaacgcttatacgaactttacaaaataaccataataataaacgcgatatacgaataaaaaaactttaccgactaccgaacatcttcaaaaaccgccgcaaaccttaacgataccctaaactcgataccaaactctaaaaaatcgctcgaaccgccgccgccctcgatatactctcgaaaaaacgcaaccccgccccaccgaaccacctacaaccccgactaaaacgactactctaaaaactactaactcgcctcctcctcctcgtcttccacctcgtcttcatcttcctcctctcccaaaacatcgattttaccgtcttccccatcgaaatcccgaaaactacgctacgatataaaacgaaaacgctcaactcttaacaaattcataacgaaacaaatacttcaatcgcaaaaaatataacgaccgatcacctaacccgaaacgaactaaactaaaaacccgaaataaatattacaaaaaacaaaaacgctaataattaccctttaaaatattttcct

SEQ ID NO: 21341 - DNA, 517 bp, Artificial Sequence
  chemically treated genomic DNA (Homo sapiens) CpG-island No: 21341
tcgagcgcggagggtcgggaggcgcggggaggttttttattcgttttattgtttttttcgttaatgacgtcgatgatagcgatagcgtcggtcgagtgttttttttttgtttcgggttcgttaggtatcgggtttttttttagtattcgtagtacgtattgaagaagacgttacggaagttttcgttttttagattcgggggaattaggaaacgcgttcggcgattttcgggtagtagtatcgggttaggtttgttttcggaatcgttgattttattcgtcgtttttttcgtttgggtttttcgcgggtcgtaggggtggaagttcgatttgggttagggttcggatttttttttttcggtttttgcgttatcgttttcggtgtaggacgcgttttgttttcgtcgagatttagacgcgtcgaaagtttcgcgcgggtagtttttcgttttacgtttcgggttgcgcgttttttcgcgaagtttttgtcgagtgcgcgtaacggcgtcgacggattt

SEQ ID NO: 21342 - DNA, 517 bp, Artificial Sequence
  chemically treated genomic DNA (Homo sapiens) CpG-island No: 21342
aaatccgtcgacgccgttacgcgcactcgacaaaaacttcgcgaaaaaacgcgcaacccgaaacgtaaaacgaaaaactacccgcgcgaaactttcgacgcgtctaaatctcgacgaaaacaaaacgcgtcctacaccgaaaacgataacgcaaaaaccgaaaaaaaaaaatccgaaccctaacccaaatcgaacttccacccctacgacccgcgaaaaacccaaacgaaaaaaacgacgaataaaatcaacgattccgaaaacaaacctaacccgatactactacccgaaaatcgccgaacgcgtttcctaattcccccgaatctaaaaaacgaaaacttccgtaacgtcttcttcaatacgtactacgaatactaaaaaaaaacccgatacctaacgaacccgaaacaaaaaaaaaacactcgaccgacgctatcgctatcatcgacgtcattaacgaaaaaaacaataaaacgaataaaaaacctccccgcgcctcccgaccctccgcgctcga

SEQ ID NO: 21343 - DNA, 517 bp, Artificial Sequence
  chemically treated genomic DNA (Homo sapiens) CpG-island No: 21343
gagttcgtcggcgtcgttgcgcgtattcgatagaggtttcgcgggagaacgcgtagttcggggcgtggggcggggaattgttcgcgcgaggttttcggcgcgtttgggtttcggcgagagtaaagcgcgttttgtatcgggggcggtggcgtagaggtcgggaggaagaaattcgggttttggtttaggtcgggtttttatttttgcgattcgcgagaggtttaggcgggaaaggcggcgagtggagttagcggtttcgaaagtaaatttggttcggtgttattgttcgagggtcgtcgggcgcgttttttaattttttcgagtttggaaaacggagattttcgtagcgttttttttagtgcgtgttgcgagtgttgaaggaggattcggtgtttggcggattcggagtaggggggaagtattcggtcgacgttgtcgttgttatcggcgttattggcggggaggatagtggggcgggtaaggggttttttcgcgtttttcggtttttcgcgttcgg

SEQ ID NO: 21344 - DNA, 517 bp, Artificial Sequence
  chemically treated genomic DNA (Homo sapiens) CpG-island No: 21344
ccgaacgcgaaaaaccgaaaaacgcgaaaaaaccccttacccgccccactatcctccccgccaataacgccgataacaacgacaacgtcgaccgaatacttcccccctactccgaatccgccaaacaccgaatcctccttcaacactcgcaacacgcactaaaaaaaacgctacgaaaatctccgttttccaaactcgaaaaaattaaaaaacgcgcccgacgaccctcgaacaataacaccgaaccaaatttactttcgaaaccgctaactccactcgccgcctttcccgcctaaacctctcgcgaatcgcaaaaataaaaacccgacctaaaccaaaacccgaatttcttcctcccgacctctacgccaccgcccccgatacaaaacgcgctttactctcgccgaaacccaaacgcgccgaaaacctcgcgcgaacaattccccgccccacgccccgaactacgcgttctcccgcgaaacctctatcgaatacgcgcaacgacgccgacgaactc

SEQ ID NO: 21345 - DNA, 590 bp, Artificial Sequence
  chemically treated genomic DNA (Homo sapiens) CpG-island No: 21345
ggcggcgggggcgttttttttgtggcgcggggttggtcggttgtcggggttcggattttttcgggtgttcgggcgtcgtcgtcgtcgtcgtcgtcgtcgtcgtttttgcgttttcgtttgtttcggcgtttcgtcggcgagttcgttttttcgcgtttaaggatagttatcgcgttttttttaaacgttaaagagagagagcgaattatcgggttgcgggcgcgtcgcggtcgaggcgggggtcggggcgcgtagtttggttttaggcggttgtagttgttgttgttgtttaggatttaattttttatttcggtttcgtcgtcgttatcgttcggtttttttcgcgcgttgtcgtcggtttcgcgtcgttcgcggggatggtgtgcgttcgttcggtcgttcggagtttttcgtattttcggttcgggtcgcggcgcgttgttcgtcgtcgagggtagagagggggcggcggtttaggggcggggaggggatcgtgcgttttttttcgggtttttttttttttcgggaaggtttattttcgtttagtttttttttgtttttggttttatttttttttttttgattacgat

SEQ ID NO: 21346 - DNA, 590 bp, Artificial Sequence
  chemically treated genomic DNA (Homo sapiens) CpG-island No: 21346
atcgtaatcaaaaaaaaaaaaataaaaccaaaaacaaaaaaaaactaaacgaaaataaaccttcccgaaaaaaaaaaaaacccgaaaaaaaacgcacgatcccctccccgcccctaaaccgccgccccctctctaccctcgacgacgaacaacgcgccgcgacccgaaccgaaaatacgaaaaactccgaacgaccgaacgaacgcacaccatccccgcgaacgacgcgaaaccgacgacaacgcgcgaaaaaaaccgaacgataacgacgacgaaaccgaaataaaaaattaaatcctaaacaacaacaacaactacaaccgcctaaaaccaaactacgcgccccgacccccgcctcgaccgcgacgcgcccgcaacccgataattcgctctctctctttaacgtttaaaaaaaacgcgataactatccttaaacgcgaaaaaacgaactcgccgacgaaacgccgaaacaaacgaaaacgcaaaaacgacgacgacgacgacgacgacgacgacgcccgaacacccgaaaaaatccgaaccccgacaaccgaccaaccccgcgccacaaaaaaaacgcccccgccgcc

SEQ ID NO: 21347 - DNA, 590 bp, Artificial Sequence
  chemically treated genomic DNA (Homo sapiens) CpG-island No: 21347
atcgtgattaggaaaaaggaaatgaaattagagatagagggaagttgagcgaaaatagattttttcgagagaggaggaagttcggagagagacgtacggtttttttttcgtttttaggtcgtcgttttttttttgttttcggcggcgagtagcgcgtcgcgattcgggtcgaaggtgcgaggggtttcgggcggtcgggcgggcgtatattattttcgcgggcggcgcggagtcggcgatagcgcgcgagagggatcgggcggtggcggcggcgggatcgggatggaaggttaagttttgagtagtagtagtagttgtagtcgtttggagttaggttgcgcgtttcggttttcgtttcggtcgcggcgcgttcgtagttcggtgattcgttttttttttttggcgtttgaagggagcgcggtgattgtttttgagcgcggaggggcgagttcgtcggcggagcgtcggagtaagcggaggcgtaggagcggcggcgacggcggcggcggcggcggcgttcgagtattcgagggggttcgagtttcggtagtcggttagtttcgcgttataaagggagcgttttcgtcgtt

SEQ ID NO: 21348 - DNA, 590 bp, Artificial Sequence
  chemically treated genomic DNA (Homo sapiens) CpG-island No: 21348
aacgacgaaaacgctccctttataacgcgaaactaaccgactaccgaaactcgaaccccctcgaatactcgaacgccgccgccgccgccgccgtcgccgccgctcctacgcctccgcttactccgacgctccgccgacgaactcgcccctccgcgctcaaaaacaatcaccgcgctcccttcaaacgccaaaaaaaaaaaacgaatcaccgaactacgaacgcgccgcgaccgaaacgaaaaccgaaacgcgcaacctaactccaaacgactacaactactactactactcaaaacttaaccttccatcccgatcccgccgccgccaccgcccgatccctctcgcgcgctatcgccgactccgcgccgcccgcgaaaataatatacgcccgcccgaccgcccgaaacccctcgcaccttcgacccgaatcgcgacgcgctactcgccgccgaaaacaaaaaaaaaacgacgacctaaaaacgaaaaaaaaaccgtacgtctctctccgaacttcctcctctctcgaaaaaatctattttcgctcaacttccctctatctctaatttcatttcctttttcctaatcacgat

SEQ ID NO: 21349 - DNA, 1022 bp, Artificial Sequence
  chemically treated genomic DNA (Homo sapiens) CpG-island No: 21349
cgtttaaagatcggttcggcgtatgttgcgttaggtcgcgcgttcggttttataaaaaaggtatcgtcgcgggggcggggtttgcgcgatagtgagaagtggtttcgtttttcgtttcgtttttcgtttcgtttcggtcgtttcgcggtttgttggcggttacgttgtttgcggcgggcggttttgtttttattgagagggcgagtttcgggcgggggcgcgaggatcgttcggggacggtttggcgtagggtcgttattagtttttatcggtttttggggtaggagagagagaacgcgtcggcggagggcgcggggagggtcggagagttcggggtagttttttattttttttatttatttcgtcgtcggagaaagtcgggttcgtagcgtcgaagcgtttttcggcgggtgcgcggcggttacggtggtttcgtttattgtttttgtagatatttttttttcggttaggcgtcgttttgcggtcggatttttatttttttttttaattcgagtcggcggtgcgcgttatttttcggggtttatttttggggcgtaggtttgcgcgcgcgatttcgttcgttaggttttttcgttttcgtcgtcgggatttcggtttcgagaatttcgacgaaagtcggtttttgtttttaagtcgttttggggaagtgagttaagtttttagcggggtcggcggcggcgtttatttagttcgtttagtaggaaggattcgttttttttttgcgtttcggttttttttttgtggcggggtcgtagtagggattcgagtcgggttttggttagcgcgttttgtattttttttatgggtagcgggcggcggggcgcgcggtagacgagagcgatcggcgagtattgacgtttttttgaaggagtcgtcgtgatttaggtcgggtaagattttttgtttcgagttttaaaataaataaatggtttttgtgtacggtcgggtcgttttcgaaaacgttttttttgtgtttttggttaaaattaagtaaggttgaa

SEQ ID NO: 21350 - DNA, 1022 bp, Artificial Sequence
  chemically treated genomic DNA (Homo sapiens) CpG-island No: 21350
ttcaaccttacttaattttaaccaaaaacacaaaaaaaacgttttcgaaaacgacccgaccgtacacaaaaaccatttatttattttaaaactcgaaacaaaaaatcttacccgacctaaatcacgacgactccttcaaaaaaacgtcaatactcgccgatcgctctcgtctaccgcgcgccccgccgcccgctacccataaaaaaaatacaaaacgcgctaaccaaaacccgactcgaatccctactacgaccccgccacaaaaaaaaaaccgaaacgcaaaaaaaaaacgaatccttcctactaaacgaactaaataaacgccgccgccgaccccgctaaaaacttaactcacttccccaaaacgacttaaaaacaaaaaccgactttcgtcgaaattctcgaaaccgaaatcccgacgacgaaaacgaaaaaacctaacgaacgaaatcgcgcgcgcaaacctacgccccaaaaataaaccccgaaaaataacgcgcaccgccgactcgaattaaaaaaaaaaataaaaatccgaccgcaaaacgacgcctaaccgaaaaaaaaatatctacaaaaacaataaacgaaaccaccgtaaccgccgcgcacccgccgaaaaacgcttcgacgctacgaacccgactttctccgacgacgaaataaataaaaaaaataaaaaactaccccgaactctccgaccctccccgcgccctccgccgacgcgttctctctctcctaccccaaaaaccgataaaaactaataacgaccctacgccaaaccgtccccgaacgatcctcgcgcccccgcccgaaactcgccctctcaataaaaacaaaaccgcccgccgcaaacaacgtaaccgccaacaaaccgcgaaacgaccgaaacgaaacgaaaaacgaaacgaaaaacgaaaccacttctcactatcgcgcaaaccccgcccccgcgacgataccttttttataaaaccgaacgcgcgacctaacgcaacatacgccgaaccgatctttaaacg

SEQ ID NO: 21351 - DNA, 1022 bp, Artificial Sequence
  chemically treated genomic DNA (Homo sapiens) CpG-island No: 21351
tttagttttgtttggttttggttaaaagtataaaaaaggcgttttcggaagcgattcgatcgtgtataagggttatttgtttgttttgggattcggggtaggaaattttgttcggtttgagttacggcggtttttttaaggaaacgttagtgttcgtcggtcgttttcgtttgtcgcgcgtttcgtcgttcgttgtttatgggggagatgtagggcgcgttggttagagttcggttcgagtttttgttgcggtttcgttataaaaagagggtcgaggcgtagaaaaggagcgagttttttttgttgagcggattgggtaagcgtcgtcgtcggtttcgttgggggtttggtttatttttttagagcggtttggaggtaggggtcggttttcgtcggagttttcggggtcggggtttcggcggcgggaacgggaggatttggcgggcgaggtcgcgcgcgtaggtttgcgttttagggataaatttcggagggtggcgcgtatcgtcggttcgggttggggaggagggtgggagttcggtcgtaggacggcgtttggtcggggagagggtatttgtagggatagtgagcgaagttatcgtggtcgtcgcgtattcgtcgggaagcgtttcggcgttgcgaattcggtttttttcggcggcggaataaatgagagaggtggaaaattatttcgggtttttcggtttttttcgcgtttttcgtcggcgcgtttttttttttttgttttaggagtcgatggagattgataacggttttgcgttaggtcgttttcgggcggttttcgcgttttcgttcggggttcgtttttttaatggggatagaatcgttcgtcgtaggtagcgtagtcgttagtaaatcgcgaggcggtcggggcggggcgaggggcgaggcgaagggcggggttattttttattgtcgcgtaggtttcgttttcgcggcggtgttttttttataaggtcgagcgcgcggtttggcgtagtatacgtcgagtcggtttttgagcg

SEQ ID NO: 21352 - DNA, 1022 bp, Artificial Sequence
  chemically treated genomic DNA (Homo sapiens) CpG-island No: 21352
cgctcaaaaaccgactcgacgtatactacgccaaaccgcgcgctcgaccttataaaaaaaacaccgccgcgaaaacgaaacctacgcgacaataaaaaataaccccgcccttcgcctcgcccctcgccccgccccgaccgcctcgcgatttactaacgactacgctacctacgacgaacgattctatccccattaaaaaaacgaaccccgaacgaaaacgcgaaaaccgcccgaaaacgacctaacgcaaaaccgttatcaatctccatcgactcctaaaacaaaaaaaaaaaaacgcgccgacgaaaaacgcgaaaaaaaccgaaaaacccgaaataattttccacctctctcatttattccgccgccgaaaaaaaccgaattcgcaacgccgaaacgcttcccgacgaatacgcgacgaccacgataacttcgctcactatccctacaaataccctctccccgaccaaacgccgtcctacgaccgaactcccaccctcctccccaacccgaaccgacgatacgcgccaccctccgaaatttatccctaaaacgcaaacctacgcgcgcgacctcgcccgccaaatcctcccgttcccgccgccgaaaccccgaccccgaaaactccgacgaaaaccgacccctacctccaaaccgctctaaaaaaataaaccaaacccccaacgaaaccgacgacgacgcttacccaatccgctcaacaaaaaaaactcgctccttttctacgcctcgaccctctttttataacgaaaccgcaacaaaaactcgaaccgaactctaaccaacgcgccctacatctcccccataaacaacgaacgacgaaacgcgcgacaaacgaaaacgaccgacgaacactaacgtttccttaaaaaaaccgccgtaactcaaaccgaacaaaatttcctaccccgaatcccaaaacaaacaaataacccttatacacgatcgaatcgcttccgaaaacgccttttttatacttttaaccaaaaccaaacaaaactaaa

SEQ ID NO: 21353 - DNA, 876 bp, Artificial Sequence
  chemically treated genomic DNA (Homo sapiens) CpG-island No: 21353
ggcgcggggcggatttttttaatttttttttcgcgttttcgaaagagcggcgtattagtagtcgaattgtcggcgtttaggttttttggttcggtcgggatgcggtcggtattcgtttttcgtcgggaataatttttttattttttttgtagggagttggtgttagtcgatagtcgcgttagggtcgtttcgggtattagggtcggatcgggtgacgtcgcgaatttgcgtttggtcgttaagtcggtttttaggttgaagaaggattcgtttcggttttgattcgggtttcgtttttttagtcggggtatcgagtttcggttttagttgttcgtttttattcgtcggtattcgttcggttcgttcgttttcgtatttagtttacgcgttatagttatgtgttttcgagtcgcgcgggcgttcgcgacgttatttttcgttttgggcgcggtgttgtggtttgcggttggcgtttgggagtttacgattttgtatattaacgacgtgtatagtcggttggagtagattagcgaggattttagtaagtgcgttaacgttagtcgttgtatgggtggcgtggttcggttttttattaaggtttagtagattcgtcgcgtcgaatttaacgtgttgttgttggacgtcggcgattagtattagggtattatttggtttatcgtgtataagggcgtcgaggtggcgtattttatgaacgttttgcgttacgatgttatggtaagattcgagttcgcgttcgggatagtagtttcggattgagagaggagtcgggttggaaaagtagcggatggtagagtgtggtaagtttaggtttagggcgcggagagatgtggggataaagtgagatttcggttagtg

SEQ ID NO: 21354 - DNA, 876 bp, Artificial Sequence
  chemically treated genomic DNA (Homo sapiens) CpG-island No: 21354
cactaaccgaaatctcactttatccccacatctctccgcgccctaaacctaaacttaccacactctaccatccgctacttttccaacccgactcctctctcaatccgaaactactatcccgaacgcgaactcgaatcttaccataacatcgtaacgcaaaacgttcataaaatacgccacctcgacgcccttatacacgataaaccaaataataccctaatactaatcgccgacgtccaacaacaacacgttaaattcgacgcgacgaatctactaaaccttaataaaaaaccgaaccacgccacccatacaacgactaacgttaacgcacttactaaaatcctcgctaatctactccaaccgactatacacgtcgttaatatacaaaatcgtaaactcccaaacgccaaccgcaaaccacaacaccgcgcccaaaacgaaaaataacgtcgcgaacgcccgcgcgactcgaaaacacataactataacgcgtaaactaaatacgaaaacgaacgaaccgaacgaataccgacgaataaaaacgaacaactaaaaccgaaactcgataccccgactaaaaaaacgaaacccgaatcaaaaccgaaacgaatccttcttcaacctaaaaaccgacttaacgaccaaacgcaaattcgcgacgtcacccgatccgaccctaatacccgaaacgaccctaacgcgactatcgactaacaccaactccctacaaaaaaaataaaaaaattattcccgacgaaaaacgaataccgaccgcatcccgaccgaaccaaaaaacctaaacgccgacaattcgactactaatacgccgctctttcgaaaacgcgaaaaaaaaattaaaaaaatccgccccgcgcc

SEQ ID NO: 21355 - DNA, 876 bp, Artificial Sequence
  chemically treated genomic DNA (Homo sapiens) CpG-island No: 21355
tattggtcggagttttattttatttttatattttttcgcgttttggatttaggtttgttatattttgttattcgttgtttttttagttcggttttttttttagttcgggattattatttcgggcgcgggttcgggttttattatggtatcgtagcgtagggcgtttatgaagtgcgttatttcggcgtttttgtatacggtgaattagatagtgttttggtattggtcgtcggcgtttagtagtagtacgttgggttcggcgcggcggatttgttgaattttggtgaagagtcgagttacgttatttatgtagcggttggcgttgacgtatttgttggagttttcgttggtttgttttagtcggttgtgtacgtcgttggtgtgtaaaatcgtaagtttttaggcgttagtcgtaggttatagtatcgcgtttagggcgaggagtagcgtcgcgggcgttcgcgcggttcggggatatatagttgtggcgcgtgaattgggtgcgaaagcgggcgagtcgggcgagtgtcggcgagtaggggcgagtagttagggtcggggttcggtgtttcggttggaggggcggggttcgggttaaggtcggggcgggtttttttttagtttggaggtcggtttggcggttaggcgtaagttcgcgacgttattcgattcgattttggtattcggagcggttttggcgcggttgtcggttggtattagttttttgtaggaagagtggagaggttgttttcggcggggagcgggtatcggtcgtatttcggtcggattagggagtttgggcgtcggtagttcggttgttggtgcgtcgttttttcgggggcgcgaggaaggaattggaggggttcgtttcgcgtt

SEQ ID NO: 21356 - DNA, 876 bp, Artificial Sequence
  chemically treated genomic DNA (Homo sapiens) CpG-island No: 21356
aacgcgaaacgaacccctccaattccttcctcgcgcccccgaaaaaacgacgcaccaacaaccgaactaccgacgcccaaactccctaatccgaccgaaatacgaccgatacccgctccccgccgaaaacaacctctccactcttcctacaaaaaactaataccaaccgacaaccgcgccaaaaccgctccgaataccaaaatcgaatcgaataacgtcgcgaacttacgcctaaccgccaaaccgacctccaaactaaaaaaaaacccgccccgaccttaacccgaaccccgcccctccaaccgaaacaccgaaccccgaccctaactactcgcccctactcgccgacactcgcccgactcgcccgctttcgcacccaattcacgcgccacaactatatatccccgaaccgcgcgaacgcccgcgacgctactcctcgccctaaacgcgatactataacctacgactaacgcctaaaaacttacgattttacacaccaacgacgtacacaaccgactaaaacaaaccaacgaaaactccaacaaatacgtcaacgccaaccgctacataaataacgtaactcgactcttcaccaaaattcaacaaatccgccgcgccgaacccaacgtactactactaaacgccgacgaccaataccaaaacactatctaattcaccgtatacaaaaacgccgaaataacgcacttcataaacgccctacgctacgataccataataaaacccgaacccgcgcccgaaataataatcccgaactaaaaaaaaaaccgaactaaaaaaacaacgaataacaaaatataacaaacctaaatccaaaacgcgaaaaaatataaaaataaaataaaactccgaccaata

SEQ ID NO: 21357 - DNA, 1400 bp, Artificial Sequence
  chemically treated genomic DNA (Homo sapiens) CpG-island No: 21357
gagtattttcggtagttttttttttttttcgtttcggggatgtttcgattcggcgtttagttatttattaatcggtttatatcggcggcggtcgtcgcggagtgacgttcggagggggcgggttttcgttttcgtttgtcggtttttggttcgcggttttaggtcgcgattggtggttggagggttgtacgtcgcgtcggttataaaggggagggtttgtgacgtaagggcgtttcggcgcgtgtattggttttttcggttgcgggtcggttcggttacgcgttttgtttcgagtcgtttattgtatggtagagtttggtgttttcgtcgtcgtttgtatcgtcgttatcgtcgtttcgttacgattatcgtcgttttttgttttgtagttatcgttatcgtttgtgtcgtcgtcgtttcgggatcggttgtatgattaggttataatttttaatgagtaaatatatttttgtgagtagtcgtcgtatcgtcgtttttcgggttgggaatttacgatcggttttttattttcgttgtcgtttttgttcggagttcggcgttttttttaggttgtttcgggttgcggtttcggtgggtttcgggtgggagcgggcgggttatggttttgtggtcggtcgattgcggtcggttgtgcggaggtagatgtcgggtttttcggggttgcggggtggcggttggtcgtcggaggtatcggtttttgagtttttttcgagttcggagcgacgggggcggcgcggttcggtttttgcggcggtcgggggtagtttcggttttcgtagcgggtcgggtgggtggtataaaagtcgttttgtgatcgtcgttttcgtttttggttttttggtttggcgcgattcgttcgggtatggtaggtttcgcggcgtttcggggtttttttgttcggtcggaggagagtggttgtattgggagcgggagacgtggttcggggtggggcgagggttgcgcgtgttattgcggagtcggatacggggagggcgcggcggtggcgggttcgtttttagattcgggcgggcgtggggtaggtcggatagttaggtacgggtggtaacgatttggttttagagtttttcggagtttcggggtgggcgcgggatagttattgggtgtagttatatttttgtgttcgacggtcgggattcgagttttagataaaatggtttcggcgttcgcgtttgattgaaggcgcggcgcgaattcgtgattgcggcgcggagagggggcgtagcgggcgtgttcgggcgtatatagtcgcgtgcgcggggcggcggttttttggggtatttcgcgagttgtatttttgttcgggttagagtggggttttgttaggtgagaatttcggtcgttcgtttcgtttttttttt

SEQ ID NO: 21358 - DNA, 1400 bp, Artificial Sequence
  chemically treated genomic DNA (Homo sapiens) CpG-island No: 21358
aaaaaaaaaacgaaacgaacgaccgaaattctcacctaacaaaaccccactctaacccgaacaaaaatacaactcgcgaaataccccaaaaaaccgccgccccgcgcacgcgactatatacgcccgaacacgcccgctacgccccctctccgcgccgcaatcacgaattcgcgccgcgccttcaatcaaacgcgaacgccgaaaccattttatctaaaactcgaatcccgaccgtcgaacacaaaaatataactacacccaataactatcccgcgcccaccccgaaactccgaaaaactctaaaaccaaatcgttaccacccgtacctaactatccgacctaccccacgcccgcccgaatctaaaaacgaacccgccaccgccgcgccctccccgtatccgactccgcaataacacgcgcaaccctcgccccaccccgaaccacgtctcccgctcccaatacaaccactctcctccgaccgaacaaaaaaaccccgaaacgccgcgaaacctaccatacccgaacgaatcgcgccaaaccaaaaaaccaaaaacgaaaacgacgatcacaaaacgacttttataccacccacccgacccgctacgaaaaccgaaactacccccgaccgccgcaaaaaccgaaccgcgccgcccccgtcgctccgaactcgaaaaaaactcaaaaaccgatacctccgacgaccaaccgccaccccgcaaccccgaaaaacccgacatctacctccgcacaaccgaccgcaatcgaccgaccacaaaaccataacccgcccgctcccacccgaaacccaccgaaaccgcaacccgaaacaacctaaaaaaaacgccgaactccgaacaaaaacgacaacgaaaataaaaaaccgatcgtaaattcccaacccgaaaaacgacgatacgacgactactcacaaaaatatatttactcattaaaaattataacctaatcatacaaccgatcccgaaacgacgacgacacaaacgataacgataactacaaaacaaaaaacgacgataatcgtaacgaaacgacgataacgacgatacaaacgacgacgaaaacaccaaactctaccatacaataaacgactcgaaacaaaacgcgtaaccgaaccgacccgcaaccgaaaaaaccaatacacgcgccgaaacgcccttacgtcacaaaccctcccctttataaccgacgcgacgtacaaccctccaaccaccaatcgcgacctaaaaccgcgaaccaaaaaccgacaaacgaaaacgaaaacccgccccctccgaacgtcactccgcgacgaccgccgccgatataaaccgattaataaataactaaacgccgaatcgaaacatccccgaaacgaaaaaaaaaaaaaactaccgaaaatactc

SEQ ID NO: 21359 - DNA, 1400 bp, Artificial Sequence
  chemically treated genomic DNA (Homo sapiens) CpG-island No: 21359
gggaggagggcggggcggacggtcgaagtttttatttagtagaattttattttggttcgggtaggggtgtagttcgcggaatgttttagagggtcgtcgtttcgcgtacgcggttgtgtgcgttcgagtacgttcgttgcgtttttttttcgcgtcgtaattacgggttcgcgtcgcgtttttagttaggcgcgggcgtcgaggttattttgtttgaggttcgggtttcggtcgtcgagtataagagtgtagttgtatttagtggttgtttcgcgtttatttcggagtttcgagaagttttggaattagatcgttattattcgtgtttggttgttcggtttattttacgttcgttcggatttggaggcgaattcgttatcgtcgcgtttttttcgtattcggtttcgtagtgatacgcgtagttttcgttttatttcgggttacgtttttcgtttttagtgtagttattttttttcggtcgaataaagaggtttcgggacgtcgcggagtttgttatgttcggacgggtcgcgttagattaaagggttaagggcggaggcggcggttataaagcggtttttgtgttatttattcggttcgttgcggaagtcgaaattgttttcggtcgtcgtagaagtcggatcgcgtcgttttcgtcgtttcgggttcgggagggatttaaaagtcggtgttttcggcggttaatcgttatttcgtagtttcgaggggttcggtatttgttttcgtatagtcggtcgtaatcggtcggttatagggttataattcgttcgtttttattcgggatttatcggaatcgtaattcggggtaatttggaggagacgtcgggtttcgaataaaggcgatagcggggatggggggtcggtcgtggatttttagttcgagaggcgacgatgcgacggttatttataggaatatgtttatttattgaagattgtggtttaattatatagtcggtttcgaggcggcggcgatataggcggtggcggtggttgtagggtaggaggcggcggtggtcgtggcggagcggcggtggcggcgatgtaggcggcggcgggggtattagattttattatgtagtgagcggttcggagtagagcgcgtagtcgagtcggttcgtagtcgaaggagttaatatacgcgtcgaggcgtttttgcgttataagtttttttttttatagtcggcgcgacgtgtaattttttagttattaatcgcggtttggaatcgcgggttaggagtcgataggcgggggcggaggttcgtttttttcggacgttatttcgcggcggtcgtcgtcggtgtgaatcggttgatgaatggttaagcgtcgagtcggagtattttcggggcgggggagggaaggggttgtcgggagtgttt

SEQ ID NO: 21360 - DNA, 1400 bp, Artificial Sequence
  chemically treated genomic DNA (Homo sapiens) CpG-island No: 21360
aaacactcccgacaaccccttccctcccccgccccgaaaatactccgactcgacgcttaaccattcatcaaccgattcacaccgacgacgaccgccgcgaaataacgtccgaaaaaaacgaacctccgcccccgcctatcgactcctaacccgcgattccaaaccgcgattaataactaaaaaattacacgtcgcgccgactataaaaaaaaaaacttataacgcaaaaacgcctcgacgcgtatattaactccttcgactacgaaccgactcgactacgcgctctactccgaaccgctcactacataataaaatctaatacccccgccgccgcctacatcgccgccaccgccgctccgccacgaccaccgccgcctcctaccctacaaccaccgccaccgcctatatcgccgccgcctcgaaaccgactatataattaaaccacaatcttcaataaataaacatattcctataaataaccgtcgcatcgtcgcctctcgaactaaaaatccacgaccgaccccccatccccgctatcgcctttattcgaaacccgacgtctcctccaaattaccccgaattacgattccgataaatcccgaataaaaacgaacgaattataaccctataaccgaccgattacgaccgactatacgaaaacaaataccgaacccctcgaaactacgaaataacgattaaccgccgaaaacaccgacttttaaatccctcccgaacccgaaacgacgaaaacgacgcgatccgacttctacgacgaccgaaaacaatttcgacttccgcaacgaaccgaataaataacacaaaaaccgctttataaccgccgcctccgcccttaaccctttaatctaacgcgacccgtccgaacataacaaactccgcgacgtcccgaaacctctttattcgaccgaaaaaaaataactacactaaaaacgaaaaacgtaacccgaaataaaacgaaaactacgcgtatcactacgaaaccgaatacgaaaaaaacgcgacgataacgaattcgcctccaaatccgaacgaacgtaaaataaaccgaacaaccaaacacgaataataacgatctaattccaaaacttctcgaaactccgaaataaacgcgaaacaaccactaaatacaactacactcttatactcgacgaccgaaacccgaacctcaaacaaaataacctcgacgcccgcgcctaactaaaaacgcgacgcgaacccgtaattacgacgcgaaaaaaaaacgcaacgaacgtactcgaacgcacacaaccgcgtacgcgaaacgacgaccctctaaaacattccgcgaactacacccctacccgaaccaaaataaaattctactaaataaaaacttcgaccgtccgccccgccctcctccc

SEQ ID NO: 21361 - DNA, 618 bp, Artificial Sequence
  chemically treated genomic DNA (Homo sapiens) CpG-island No: 21361
aaggtttaatttttttttagcggtttaatattcgattttcgtttttcgttttcgcgttttttttatcggttatttaattggataaaaatgtcgatttcgtttttttttcggagttttattttcgttatagttttgtttttttttttgttgtttttgtttttttttttttttcgtcgtgtttcgcggtcgggtcggggtagtcgggaagcgggtggggtggtgtgttatttagtagtttttgggatatcgttcgggtacgttttacgtcgtcgtagttattgttgtggtcgtcggtcggtcgaggggtcgcgatattggttgttcgcggtgtaagtagaattcgacgtgtatcgttgtcgttaagatggaggggtttttgttcgtgttcggtgatcgtagtattggggaaacgattcgtttttaaaacggtaagggcgggtcgggtttgggtcgggtttgcggtcggggagggtcgagttttatcgcgatcggatttcggttgttttcgttttttttttttattttcgtagaaagggtttcggggtttcgtagtcggatttagtttattcgtcgttttttggggtagggcgttgtggttttattttttttatagcgagg

SEQ ID NO: 21362 - DNA, 618 bp, Artificial Sequence
  chemically treated genomic DNA (Homo sapiens) CpG-island No: 21362
cctcgctataaaaaaaataaaaccacaacgccctaccccaaaaaacgacgaataaactaaatccgactacgaaaccccgaaaccctttctacgaaaataaaaaaaaaaaacgaaaacaaccgaaatccgatcgcgataaaactcgaccctccccgaccgcaaacccgacccaaacccgacccgcccttaccgttttaaaaacgaatcgtttccccaatactacgatcaccgaacacgaacaaaaacccctccatcttaacgacaacgatacacgtcgaattctacttacaccgcgaacaaccaatatcgcgacccctcgaccgaccgacgaccacaacaataactacgacgacgtaaaacgtacccgaacgatatcccaaaaactactaaataacacaccaccccacccgcttcccgactaccccgacccgaccgcgaaacacgacgaaaaaaaaaaaaaaacaaaaacaacaaaaaaaaaaacaaaactataacgaaaataaaactccgaaaaaaaaacgaaatcgacatttttatccaattaaataaccgataaaaaaaacgcgaaaacgaaaaacgaaaatcgaatattaaaccgctaaaaaaaaattaaacctt

SEQ ID NO: 21363 - DNA, 618 bp, Artificial Sequence
  chemically treated genomic DNA (Homo sapiens) CpG-island No: 21363
tttcgttgtgggaaaagtggggttatagcgttttgttttagagaacggcgggtgggttgggttcggttgcggggtttcgaggttttttttgcggaggtaaaggagagaaacgagggtagtcggggttcggtcgcggtgggattcggtttttttcggtcgtaaattcgatttaggttcggttcgtttttatcgttttgggagcggatcgtttttttagtgttgcggttatcgaatacggataaaggtttttttattttgacggtagcgatatacgtcgaattttgtttatatcgcgggtaattagtatcgcggtttttcggtcgatcggcgattatagtagtggttgcgacggcgtggagcgtattcgagcgatgttttaggagttattgggtaatatattattttattcgtttttcggttgtttcggttcggtcgcggggtacggcgggaaggaaaaagaggtagggataatagggagagaaataggattgtgacggaagtgaggtttcggggaaggggcggggtcggtatttttgtttaattagatagtcgatgggaagggcgcgaaagcggagaacggaagtcggatgttggatcgttgggaagaggttgaatttt

SEQ ID NO: 21364 - DNA, 618 bp, Artificial Sequence
  chemically treated genomic DNA (Homo sapiens) CpG-island No: 21364
aaaattcaacctcttcccaacgatccaacatccgacttccgttctccgctttcgcgcccttcccatcgactatctaattaaacaaaaataccgaccccgccccttccccgaaacctcacttccgtcacaatcctatttctctccctattatccctacctctttttccttcccgccgtaccccgcgaccgaaccgaaacaaccgaaaaacgaataaaataatatattacccaataactcctaaaacatcgctcgaatacgctccacgccgtcgcaaccactactataatcgccgatcgaccgaaaaaccgcgatactaattacccgcgatataaacaaaattcgacgtatatcgctaccgtcaaaataaaaaaacctttatccgtattcgataaccgcaacactaaaaaaacgatccgctcccaaaacgataaaaacgaaccgaacctaaatcgaatttacgaccgaaaaaaaccgaatcccaccgcgaccgaaccccgactaccctcgtttctctcctttacctccgcaaaaaaaacctcgaaaccccgcaaccgaacccaacccacccgccgttctctaaaacaaaacgctataaccccacttttcccacaacgaaa

SEQ ID NO: 21365 - DNA, 1036 bp, Artificial Sequence
  chemically treated genomic DNA (Homo sapiens) CpG-island No: 21365
gcggatatagcgtaattttcgacgttagagaataatagtttttcgatgcgtttttagagatgttaaggaggaacgaatttagcggttaggagattgcgttttacgattgatgagagggaaggtatcggtttttaagtttttaaaatttataggtgagtttttgttaagagtaaacgttcgcggttcgtcgtttacggtttatattttgaggtggtatttggtttttcgatacgttgaagtattaacggatgagcgttacgaatatagagcggttaattacgcgtcgttttcgtttagattttttcgtacgaggtagtttcgtagtcgtaggtggtttcggcgagtatttttatttttttttttcgtgatgttttggggttgattttcgatttcgttggttcgttttttttttcggtcgttttttttattgagtttgttgagtttcggggttcgcggagttcgcgttaggtttttgggaaaggacggggagtgttatcggggagtagttgttttattgtgtttcgaggtttcgatcgggttaggtcgacggtttttttttttttatttttttttttttggcggggttcggcggcgggcgagtgattgcggttacgtttgaaaggcgatttttttgtgagtgggttagaaggcgaatatggcggagcggggaggttggcgggaggcgggaggcgggaggcgggaggtagtggcgttggtttgcggcgcgttcggatcggttgtggggcggggtagggcggagcggagtcgtgcggcggggcggggtcgggcggcggggtttggtttttttttttagcgttattttgtggtagcgagatttataaataaaggggagcgtaggggttgcggcgggattaggagcgcggcggggtcggcggtaaagttgttcggttgcgcggtggttcggggggttcgggcggtagggtaagtagcgcggtttcggtttatgcgatcggtggcgtcggcgcggtttttgtttggagaggtaggcgcgggtcggttggcgggagcggacgcg

SEQ ID NO: 21366 - DNA, 1036 bp, Artificial Sequence
  chemically treated genomic DNA (Homo sapiens) CpG-island No: 21366
cgcgtccgctcccgccaaccgacccgcgcctacctctccaaacaaaaaccgcgccgacgccaccgatcgcataaaccgaaaccgcgctacttaccctaccgcccgaaccccccgaaccaccgcgcaaccgaacaactttaccgccgaccccgccgcgctcctaatcccgccgcaacccctacgctcccctttatttataaatctcgctaccacaaaataacgctaaaaaaaaaaaccaaaccccgccgcccgaccccgccccgccgcacgactccgctccgccctaccccgccccacaaccgatccgaacgcgccgcaaaccaacgccactacctcccgcctcccgcctcccgcctcccgccaacctccccgctccgccatattcgccttctaacccactcacaaaaaaatcgcctttcaaacgtaaccgcaatcactcgcccgccgccgaaccccgccaaaaaaaaaaaaataaaaaaaaaaaaaccgtcgacctaacccgatcgaaacctcgaaacacaataaaacaactactccccgataacactccccgtcctttcccaaaaacctaacgcgaactccgcgaaccccgaaactcaacaaactcaataaaaaaaacgaccgaaaaaaaaaacgaaccaacgaaatcgaaaatcaaccccaaaacatcacgaaaaaaaaaaataaaaatactcgccgaaaccacctacgactacgaaactacctcgtacgaaaaaatctaaacgaaaacgacgcgtaattaaccgctctatattcgtaacgctcatccgttaatacttcaacgtatcgaaaaaccaaataccacctcaaaatataaaccgtaaacgacgaaccgcgaacgtttactcttaacaaaaactcacctataaattttaaaaacttaaaaaccgataccttccctctcatcaatcgtaaaacgcaatctcctaaccgctaaattcgttcctccttaacatctctaaaaacgcatcgaaaaactattattctctaacgtcgaaaattacgctatatccgc

SEQ ID NO: 21367 - DNA, 1036 bp, Artificial Sequence
  chemically treated genomic DNA (Homo sapiens) CpG-island No: 21367
cgcgttcgttttcgttagtcggttcgcgtttatttttttaggtagaagtcgcgtcggcgttatcggtcgtataggtcgaggtcgcgttgtttgttttgtcgttcgggtttttcgggttatcgcgtagtcggatagttttgtcgtcggtttcgtcgcgtttttagtttcgtcgtaatttttgcgtttttttttatttgtgggtttcgttgttataaaatggcgttgagggaggaaattaggtttcgtcgttcggtttcgtttcgtcgtacggtttcgtttcgttttgtttcgttttatagtcggttcgaacgcgtcgtaggttagcgttattgtttttcgtttttcgtttttcgtttttcgttagttttttcgtttcgttatgttcgttttttggtttatttataggagagtcgttttttaggcgtggtcgtagttattcgttcgtcgtcgaatttcgttaggagaggaaaggtgaagggagggaggtcgtcggtttagttcgatcggggtttcgaggtataatggagtagttgtttttcggtaatatttttcgtttttttttaggagtttggcgcgagtttcgcgggtttcggagtttagtaagtttagtaagggaagcggtcgaggggaggggcgggttagcgaggtcggaggttagttttagggtattacgggaagggaaggtggaagtattcgtcggggttatttgcggttgcggggttgtttcgtgcggagggatttgggcgaaggcggcgcgtgattggtcgttttgtgttcgtgacgtttattcgttgatgttttagcgtgtcggaggattaggtgttattttaagatataggtcgtgggcggcgagtcgcgggcgtttatttttagtagaagtttatttgtaagttttgagaatttagaaatcgatgtttttttttttattagtcgtgaggcgtagttttttggtcgttgggttcgtttttttttgatatttttggagacgtatcgaggagttattgttttttggcgtcggaggttgcgttgtgttcgt

SEQ ID NO: 21368 - DNA, 1036 bp, Artificial Sequence
  chemically treated genomic DNA (Homo sapiens) CpG-island No: 21368
acgaacacaacgcaacctccgacgccaaaaaacaataactcctcgatacgtctccaaaaatatcaaaaaaaaacgaacccaacgaccaaaaaactacgcctcacgactaataaaaaaaaaaacatcgatttctaaattctcaaaacttacaaataaacttctactaaaaataaacgcccgcgactcgccgcccacgacctatatcttaaaataacacctaatcctccgacacgctaaaacatcaacgaataaacgtcacgaacacaaaacgaccaatcacgcgccgccttcgcccaaatccctccgcacgaaacaaccccgcaaccgcaaataaccccgacgaatacttccaccttcccttcccgtaataccctaaaactaacctccgacctcgctaacccgcccctcccctcgaccgcttcccttactaaacttactaaactccgaaacccgcgaaactcgcgccaaactcctaaaaaaaaacgaaaaatattaccgaaaaacaactactccattatacctcgaaaccccgatcgaactaaaccgacgacctccctcccttcacctttcctctcctaacgaaattcgacgacgaacgaataactacgaccacgcctaaaaaacgactctcctataaataaaccaaaaaacgaacataacgaaacgaaaaaactaacgaaaaacgaaaaacgaaaaacgaaaaacaataacgctaacctacgacgcgttcgaaccgactataaaacgaaacaaaacgaaacgaaaccgtacgacgaaacgaaaccgaacgacgaaacctaatttcctccctcaacgccattttataacaacgaaacccacaaataaaaaaaaacgcaaaaattacgacgaaactaaaaacgcgacgaaaccgacgacaaaactatccgactacgcgataacccgaaaaacccgaacgacaaaacaaacaacgcgacctcgacctatacgaccgataacgccgacgcgacttctacctaaaaaaataaacgcgaaccgactaacgaaaacgaacgcg

SEQ ID NO: 21369 - DNA, 634 bp, Artificial Sequence
  chemically treated genomic DNA (Homo sapiens) CpG-island No: 21369
tcgggaagtcgtgcgttttgtagcggtagtaggcgacggtagcggagaagttttgggatgttaaggttttcgagggtcggttgcggaagtgtgagagtatcgattcggggtatttgtcgcgtttcgatagcgcggagtagtcgtatgcgttttgtagttttttgtatagtttttcggagtatagcgtcgagttcgagggggagggcggttcgggttcggggttaggggtcgtaggggtcgagttcggggcgcgagaagtcggtttggagttggagaagaagcggttggaggagcgtatcgtttagtttattttttataattaggcggtggtggacgatgtttagttggataacgtgcggtttcggaagatcgggttgtttaaatagggtagtatcgatttgtttacgttttatatttataaggattttttttattttgatattcgcgcgttggagttaggtcgtaggagggtttcgggtttcgtgcgttttatttggacgtttttagataagtttcggtttttttttttttatttcgtttttatttagttttttattatcgtggaatgtgttttcgttattaggagtaattcgttgtttttcgtcgagggttttaggacgtggttggagtttag

SEQ ID NO: 21370 - DNA, 634 bp, Artificial Sequence
  chemically treated genomic DNA (Homo sapiens) CpG-island No: 21370
ctaaactccaaccacgtcctaaaaccctcgacgaaaaacaacgaattactcctaataacgaaaacacattccacgataataaaaaactaaataaaaacgaaataaaaaaaaaaaaaccgaaacttatctaaaaacgtccaaataaaacgcacgaaacccgaaaccctcctacgacctaactccaacgcgcgaatatcaaaataaaaaaaatccttataaatataaaacgtaaacaaatcgatactaccctatttaaacaacccgatcttccgaaaccgcacgttatccaactaaacatcgtccaccaccgcctaattataaaaaataaactaaacgatacgctcctccaaccgcttcttctccaactccaaaccgacttctcgcgccccgaactcgacccctacgacccctaaccccgaacccgaaccgccctccccctcgaactcgacgctatactccgaaaaactatacaaaaaactacaaaacgcatacgactactccgcgctatcgaaacgcgacaaataccccgaatcgatactctcacacttccgcaaccgaccctcgaaaaccttaacatcccaaaacttctccgctaccgtcgcctactaccgctacaaaacgcacgacttcccga

SEQ ID NO: 21371 - DNA, 634 bp, Artificial Sequence
  chemically treated genomic DNA (Homo sapiens) CpG-island No: 21371
ttgggttttagttacgttttggagttttcgacgaagggtagcgagttgtttttggtgacggggatatattttacggtggtggagagttgagtggggacggagtggaagaagaggggtcgagatttgtttgggggcgtttaggtggagcgtacggggttcggggtttttttacggtttggttttagcgcgcggatgttaaagtggaaggagtttttgtaggtgtagggcgtgggtaggtcgatgttgttttgtttggatagttcggtttttcggggtcgtacgttgtttagttgggtatcgtttattatcgtttggttgtgggagatgagttgggcgatgcgtttttttagtcgttttttttttagttttaggtcggtttttcgcgtttcgggttcggtttttgcgatttttggtttcgggttcgggtcgttttttttttcggattcggcgttgtgtttcgaaaggttgtgtagggggttgtagggcgtatgcggttgtttcgcgttgtcggagcgcgataggtatttcgagtcggtgtttttatattttcgtagtcggttttcgggggttttggtattttagggttttttcgttgtcgtcgtttgttgtcgttgtagggcgtacggtttttcgg

SEQ ID NO: 21372 - DNA, 634 bp, Artificial Sequence
  chemically treated genomic DNA (Homo sapiens) CpG-island No: 21372
ccgaaaaaccgtacgccctacaacgacaacaaacgacgacaacgaaaaaaccctaaaataccaaaacccccgaaaaccgactacgaaaatataaaaacaccgactcgaaatacctatcgcgctccgacaacgcgaaacaaccgcatacgccctacaaccccctacacaacctttcgaaacacaacgccgaatccgaaaaaaaaaacgacccgaacccgaaaccaaaaatcgcaaaaaccgaacccgaaacgcgaaaaaccgacctaaaactaaaaaaaaaacgactaaaaaaacgcatcgcccaactcatctcccacaaccaaacgataataaacgatacccaactaaacaacgtacgaccccgaaaaaccgaactatccaaacaaaacaacatcgacctacccacgccctacacctacaaaaactccttccactttaacatccgcgcgctaaaaccaaaccgtaaaaaaaccccgaaccccgtacgctccacctaaacgcccccaaacaaatctcgacccctcttcttccactccgtccccactcaactctccaccaccgtaaaatatatccccgtcaccaaaaacaactcgctacccttcgtcgaaaactccaaaacgtaactaaaacccaa

SEQ ID NO: 21373 - DNA, 750 bp, Artificial Sequence
  chemically treated genomic DNA (Homo sapiens) CpG-island No: 21373
  misc_feature (252)..(252): n is either a, c, g or t
  misc_feature (270)..(270): n is either a, c, g or t
aggggggcgtcgtttttcgtgattttttaatcggtttttggagttagaggttttttttcgtttttcggcgggagaaagttcgcggtcggttgttgttgttcgtttttttgtttcgaggaaaaacgattttataattttgtgcgcgagagaggttcgttttttcggcggtttttttttttttttttcgttgcgggtttgtttttttgttggagtcgagcgttggaggcggaggagggagggtggggcgtaggntcgttgggtcgcgcgttntcgtttttatttttcgggaaggggttcgttttcgggtagttaggggttcgttttttagatgagaagggtgtagattagcgttagtttttcggttcgcgtttttgtagcgtttcggttttttttcggcgttttcgtttcgtcgtcgtcggtttagtaattttgtttcggaagattagttttattacgttttcgggttagcgtttgtcgggtttcggcggttatcgcggttatcgcgtcgggaatttggcgttttaagttatttgattgcgcgtttcgttaattagcgtcggttttgcgcgtttttttagttcgtagtagttcggttcggcgtttggttggtttggggcgcgcgttttagagtgaatcgtgcgtgtcgggagtcgggagttcggagatcgaattagaatggatgtttcgagtagatataattttttttatttagattattcgaaaatgtgagttacgtttttttaggtaaaa

SEQ ID NO: 21374 - DNA, 750 bp, Artificial Sequence
  chemically treated genomic DNA (Homo sapiens) CpG-island No: 21374
  misc_feature (481)..(481): n is either a, c, g or t
  misc_feature (499)..(499): n is either a, c, g or t
ttttacctaaaaaaacgtaactcacattttcgaataatctaaataaaaaaaattatatctactcgaaacatccattctaattcgatctccgaactcccgactcccgacacgcacgattcactctaaaacgcgcgccccaaaccaaccaaacgccgaaccgaactactacgaactaaaaaaacgcgcaaaaccgacgctaattaacgaaacgcgcaatcaaataacttaaaacgccaaattcccgacgcgataaccgcgataaccgccgaaacccgacaaacgctaacccgaaaacgtaataaaactaatcttccgaaacaaaattactaaaccgacgacgacgaaacgaaaacgccgaaaaaaaaccgaaacgctacaaaaacgcgaaccgaaaaactaacgctaatctacacccttctcatctaaaaaacgaacccctaactacccgaaaacgaaccccttcccgaaaaataaaaacganaacgcgcgacccaacgancctacgccccaccctccctcctccgcctccaacgctcgactccaacaaaaaaacaaacccgcaacgaaaaaaaaaaaaaaaaaccgccgaaaaaacgaacctctctcgcgcacaaaattataaaatcgtttttcctcgaaacaaaaaaacgaacaacaacaaccgaccgcgaactttctcccgccgaaaaacgaaaaaaaacctctaactccaaaaaccgattaaaaaatcacgaaaaacgacgcccccct

SEQ ID NO: 21375 - DNA, 750 bp, Artificial Sequence
  chemically treated genomic DNA (Homo sapiens) CpG-island No: 21375
  misc_feature (481)..(481): n is either a, c, g or t
  misc_feature (499)..(499): n is either a, c, g or t
ttttgtttaaggggacgtgatttatattttcggataatttgaataaggggaattgtgtttgttcgaggtatttattttggttcggttttcggattttcggttttcggtacgtacggtttattttggagcgcgcgttttaggttagttaagcgtcgagtcgggttgttgcgggttgggagggcgcgtagggtcggcgttgattgacggggcgcgtagttaggtgatttggggcgttaagttttcgacgcggtggtcgcggtgatcgtcgaggttcggtagacgttgattcgggaacgtagtggggttgatttttcggaataaagttgttgggtcggcggcggcggggcgagagcgtcgagggggagtcggagcgttgtagaggcgcgggtcggagggttggcgttgatttgtattttttttatttggagagcggatttttggttgttcggaggcgagttttttttcggggggtgggggcggnaacgcgcgatttagcggntttgcgttttattttttttttttcgtttttagcgttcggttttaataaaggggtaggttcgtagcggggaggaggaggaggagtcgtcgaaggagcgagtttttttcgcgtataaagttgtggagtcgttttttttcggagtagggaagcgggtagtagtagtcggtcgcgggttttttttcgtcgaggggcgaggaggagtttttggttttagaagtcgattggggaattacggggagcggcgttttttt

SEQ ID NO: 21376 - DNA, 750 bp, Artificial Sequence
  chemically treated genomic DNA (Homo sapiens) CpG-island No: 21376
  misc_feature (252)..(252): n is either a, c, g or t
  misc_feature (270)..(270): n is either a, c, g or t
aaaaaaacgccgctccccgtaattccccaatcgacttctaaaaccaaaaactcctcctcgcccctcgacgaaaaaaaacccgcgaccgactactactacccgcttccctactccgaaaaaaaacgactccacaactttatacgcgaaaaaaactcgctccttcgacgactcctcctcctcctccccgctacgaacctacccctttattaaaaccgaacgctaaaaacgaaaaaaaaaaaataaaacgcaaanccgctaaatcgcgcgttnccgcccccaccccccgaaaaaaaactcgcctccgaacaaccaaaaatccgctctccaaataaaaaaaatacaaatcaacgccaaccctccgacccgcgcctctacaacgctccgactccccctcgacgctctcgccccgccgccgccgacccaacaactttattccgaaaaatcaaccccactacgttcccgaatcaacgtctaccgaacctcgacgatcaccgcgaccaccgcgtcgaaaacttaacgccccaaatcacctaactacgcgccccgtcaatcaacgccgaccctacgcgccctcccaacccgcaacaacccgactcgacgcttaactaacctaaaacgcgcgctccaaaataaaccgtacgtaccgaaaaccgaaaatccgaaaaccgaaccaaaataaatacctcgaacaaacacaattccccttattcaaattatccgaaaatataaatcacgtccccttaaacaaaa

SEQ ID NO: 21377 - DNA, 775 bp, Artificial Sequence
  chemically treated genomic DNA (Homo sapiens) CpG-island No: 21377
tagtcgatcgttttttgtacgttgagttcgatgacgtttagggtgtcggtttgtttttttattagtatcgttatttgtaagaagagttcgtgtacgtcgcggatgtcgttttttaggcgtaatagttcgcggtggcggttttcgatttcgttgagggcggttcgcgcgtttttttacgtcgttagtaagttttcggtaaatacgtgttatttattttgttcgaatatgttttcgatttggtcgttcgagattttttggtttatgatttttagttggcgttggatgcggattttgtagttgtcgcgttgtttttatttcggtttgggttgtagtcgtgtatggcgcgttggaaggtgagggtgagcgcgttgtattgcgttcgcgaaatgcgcgttattgtcgagtgcgggtcgtgttgggttttagtcgtttcgtttagtttttttatggcgcgtagtttgtagtggatgatttcgtttcgggttttgatggttttggcgatggagttggtgtcgcgtttgatgttgttgaggcgtcgtatggacgtgaggaagcgggcgttttgtttttttagtcgttttacgtcggttattagtagttggtttttattttgaatgtttcggatgtttcggtatagggattttaggatgtggttcgtttcgaatacgatgttttcgtggggcgagttaaatttatcgttttcgtttgggaattgttggttatattgtttggataagtttagaagttttgttagtcggttttttattttgtttgt

SEQ ID NO: 21378 - DNA, 775 bp, Artificial Sequence
  chemically treated genomic DNA (Homo sapiens) CpG-island No: 21378
acaaacaaaataaaaaaccgactaacaaaacttctaaacttatccaaacaatataaccaacaattcccaaacgaaaacgataaatttaactcgccccacgaaaacatcgtattcgaaacgaaccacatcctaaaatccctataccgaaacatccgaaacattcaaaataaaaaccaactactaataaccgacgtaaaacgactaaaaaaacaaaacgcccgcttcctcacgtccatacgacgcctcaacaacatcaaacgcgacaccaactccatcgccaaaaccatcaaaacccgaaacgaaatcatccactacaaactacgcgccataaaaaaactaaacgaaacgactaaaacccaacacgacccgcactcgacaataacgcgcatttcgcgaacgcaatacaacgcgctcaccctcaccttccaacgcgccatacacgactacaacccaaaccgaaataaaaacaacgcgacaactacaaaatccgcatccaacgccaactaaaaatcataaaccaaaaaatctcgaacgaccaaatcgaaaacatattcgaacaaaataaataacacgtatttaccgaaaacttactaacgacgtaaaaaaacgcgcgaaccgccctcaacgaaatcgaaaaccgccaccgcgaactattacgcctaaaaaacgacatccgcgacgtacacgaactcttcttacaaataacgatactaataaaaaaacaaaccgacaccctaaacgtcatcgaactcaacgtacaaaaaacgatcgacta

SEQ ID NO: 21379 - DNA, 775 bp, Artificial Sequence
  chemically treated genomic DNA (Homo sapiens) CpG-island No: 21379
gtaggtaaaatgaaagatcggttagtagaatttttggatttgtttaagtaatatgattagtagtttttagacggggacgatgagtttgattcgttttacgaggatatcgtgttcgagacggattatattttggagtttttgtatcgagatattcgggatatttaggatgaaaattagttgttggtggtcgacgtgaagcggttgggaaagtagaacgttcgtttttttacgtttatgcggcgttttagtagtattaagcgcgatattaattttatcgttaaggttattaaggttcggggcgaggttatttattgtaagttgcgcgttatgaaggagttgagcgaggcggttgaggtttagtacggttcgtattcggtagtggcgcgtatttcgcgggcgtagtataacgcgtttatttttattttttagcgcgttatgtacgattataatttaggtcgagatgaaagtagcgcgataattgtaagattcgtatttagcgttagttggagattatgggttaggaagtttcgggcgattaaatcgaagatatgttcgagtagggtaagtggtacgtgtttatcgagaatttgttggcgacgtgaaagggcgcgcgggtcgtttttaacgagatcgagagtcgttatcgcgaattgttgcgtttggagagcggtattcgcgacgtatacgagttttttttgtagatggcggtgttggtggagaagtaggtcgatattttgaacgttatcgagtttaacgtataaaagacggtcgatta

SEQ ID NO: 21380 - DNA, 775 bp, Artificial Sequence
  chemically treated genomic DNA (Homo sapiens) CpG-island No: 21380
taatcgaccgtcttttatacgttaaactcgataacgttcaaaatatcgacctacttctccaccaacaccgccatctacaaaaaaaactcgtatacgtcgcgaataccgctctccaaacgcaacaattcgcgataacgactctcgatctcgttaaaaacgacccgcgcgccctttcacgtcgccaacaaattctcgataaacacgtaccacttaccctactcgaacatatcttcgatttaatcgcccgaaacttcctaacccataatctccaactaacgctaaatacgaatcttacaattatcgcgctactttcatctcgacctaaattataatcgtacataacgcgctaaaaaataaaaataaacgcgttatactacgcccgcgaaatacgcgccactaccgaatacgaaccgtactaaacctcaaccgcctcgctcaactccttcataacgcgcaacttacaataaataacctcgccccgaaccttaataaccttaacgataaaattaatatcgcgcttaatactactaaaacgccgcataaacgtaaaaaaacgaacgttctactttcccaaccgcttcacgtcgaccaccaacaactaattttcatcctaaatatcccgaatatctcgatacaaaaactccaaaatataatccgtctcgaacacgatatcctcgtaaaacgaatcaaactcatcgtccccgtctaaaaactactaatcatattacttaaacaaatccaaaaattctactaaccgatctttcattttacctac

SEQ ID NO: 21381 - DNA, 922 bp, Artificial Sequence
  chemically treated genomic DNA (Homo sapiens) CpG-island No: 21381
ggagaagacgtttcggttagatcgaacgtagggtaggggaggcgagtaggcgaggaggagggaaggggacgggaggggcggagttttcgcggtcgcggggttttgtgtagagttaaggtcgggatagaaattttgtttcgcgggggacgggtcgagggggtaggaggtcgacgcggggtattttaaatttgcgttgttacgaatggtgggcgggagaagggagagaatgggtcgtttttttcgtcgtcgttattattaaggcggggtaggtcggcgtcgtttttagcggcggttattttcgaggttgcggattgtacggtcgaagggggagaggtaggagataagacgggcgggttttttgattttcgttcgtaggaatcgcgggggttgcgttaggaagagggtttcgttttaattgtgtcgggtcgggaacgggttaagatgcggttaaatgtcggtttttttttttttttattttttagtttcggcgtttattcgcgacggtagtcgcggaatttagcgttcggtttcgcgcgtttatttcgatatcggttcggtcgtttatcgtcgtagtagtagtagattttttttttgtcgtttttttgattgtacgttatgggtttttcggttatcgtcgttatcgggtttttttttttgttgttgttgttgttgttgttgtcgtcgcggttcggtcgggagagaaaagggttgagggaaacgtgggggcgatagtttcgcggggaagggtaggtcggtgggaggagaggagggggcgtcgggaaggttcggtattattcggtagaggtgtcgaaagttcggaatcggagttgtagcggtattaattcgcgaggagggggttattaaattattttaggaggtcgtagggaggtgagcgtatttattgcggtttttacggggagga

SEQ ID NO: 21382 - DNA, 922 bp, Artificial Sequence
  chemically treated genomic DNA (Homo sapiens) CpG-island No: 21382
tcctccccgtaaaaaccgcaataaatacgctcacctccctacgacctcctaaaataatttaataaccccctcctcgcgaattaataccgctacaactccgattccgaactttcgacacctctaccgaataataccgaaccttcccgacgccccctcctctcctcccaccgacctacccttccccgcgaaactatcgcccccacgtttccctcaacccttttctctcccgaccgaaccgcgacgacaacaacaacaacaacaacaacaaaaaaaaaaacccgataacgacgataaccgaaaaacccataacgtacaatcaaaaaaacgacaaaaaaaaaatctactactactacgacgataaacgaccgaaccgatatcgaaataaacgcgcgaaaccgaacgctaaattccgcgactaccgtcgcgaataaacgccgaaactaaaaaataaaaaaaaaaaaaaaccgacatttaaccgcatcttaacccgttcccgacccgacacaattaaaacgaaaccctcttcctaacgcaacccccgcgattcctacgaacgaaaatcaaaaaacccgcccgtcttatctcctacctctcccccttcgaccgtacaatccgcaacctcgaaaataaccgccgctaaaaacgacgccgacctaccccgccttaataataacgacgacgaaaaaaacgacccattctctcccttctcccgcccaccattcgtaacaacgcaaatttaaaataccccgcgtcgacctcctaccccctcgacccgtcccccgcgaaacaaaatttctatcccgaccttaactctacacaaaaccccgcgaccgcgaaaactccgcccctcccgtccccttccctcctcctcgcctactcgcctcccctaccctacgttcgatctaaccgaaacgtcttctcc

SEQ ID NO: 21383 - DNA, 922 bp, Artificial Sequence
  chemically treated genomic DNA (Homo sapiens) CpG-island No: 21383
tttttttcgtggaggtcgtagtggatgcgtttatttttttgcggttttttgaggtggtttggtggtttttttttcgcgagttggtgtcgttgtaatttcgatttcgagttttcggtatttttgtcgggtggtatcgagttttttcggcgtttttttttttttttttatcggtttgttttttttcgcgggattatcgtttttacgttttttttagtttttttttttttcggtcgagtcgcggcggtagtagtagtagtagtagtagtaggaggaggagttcggtggcggcggtggtcggggagtttatggcgtatagttaaggaggcggtaaaaaaaaagtttgttattattacgacggtgagcggtcgggtcggtgtcggggtgggcgcgcggggtcgggcgttgggtttcgcggttgtcgtcgcgagtgggcgtcggggttgaggggtgggaaggaggagggatcgatatttggtcgtattttaattcgttttcggttcggtatagttagaacgagattttttttttggcgtagttttcgcggtttttgcgggcgggaattagggggttcgttcgttttgttttttgttttttttttttcggtcgtgtagttcgtagtttcgaaggtggtcgtcgttggggacggcgtcggtttatttcgttttggtggtggcggcggcgaagggggcggtttatttttttttttttttcgtttattattcgtggtaacgtaggtttggggtgtttcgcgtcggttttttattttttcgattcgtttttcgcgaggtaaaatttttatttcggttttgattttatataaagtttcgcggtcgcgagagtttcgtttttttcgtttttttttttttttttcgtttgttcgttttttttattttgcgttcggtttggtcggagcgtttttttt

SEQ ID NO: 21384 - DNA, 922 bp, Artificial Sequence
  chemically treated genomic DNA (Homo sapiens) CpG-island No: 21384
aaaaaaaacgctccgaccaaaccgaacgcaaaataaaaaaaacgaacaaacgaaaaaaaaaaaaaaaaacgaaaaaaacgaaactctcgcgaccgcgaaactttatataaaatcaaaaccgaaataaaaattttacctcgcgaaaaacgaatcgaaaaaataaaaaaccgacgcgaaacaccccaaacctacgttaccacgaataataaacgaaaaaaaaaaaaaaataaaccgcccccttcgccgccgccaccaccaaaacgaaataaaccgacgccgtccccaacgacgaccaccttcgaaactacgaactacacgaccgaaaaaaaaaaaacaaaaaacaaaacgaacgaaccccctaattcccgcccgcaaaaaccgcgaaaactacgccaaaaaaaaaatctcgttctaactataccgaaccgaaaacgaattaaaatacgaccaaatatcgatccctcctccttcccacccctcaaccccgacgcccactcgcgacgacaaccgcgaaacccaacgcccgaccccgcgcgcccaccccgacaccgacccgaccgctcaccgtcgtaataataacaaactttttttttaccgcctccttaactatacgccataaactccccgaccaccgccgccaccgaactcctcctcctactactactactactactactaccgccgcgactcgaccgaaaaaaaaaaaaactaaaaaaaacgtaaaaacgataatcccgcgaaaaaaaacaaaccgataaaaaaaaaaaaaaaaacgccgaaaaaactcgataccacccgacaaaaataccgaaaactcgaaatcgaaattacaacgacaccaactcgcgaaaaaaaaaccaccaaaccacctcaaaaaaccgcaaaaaaataaacgcatccactacgacctccacgaaaaaaa

SEQ ID NO: 21385 - DNA, 734 bp, Artificial Sequence
  chemically treated genomic DNA (Homo sapiens) CpG-island No: 21385
ttcgagagcgaaagatatagatggggttttgtcgtttttcgaagagtcggatgggcgcgttcgttttcggtgtattaagaggttggttcggttaggggcgaggggttcgtatcgaatttcgcgtatttcgtcgcgggcggggttgggtcgtagtcggttcgatttaaggttggtatttaaggttgcggtcggttaggcgaggcgaggcgacgtgagcgagggtgtttagggagaatagtcgttggtagtttaatgttgggtggttaacgttcgacggtgttcggtagtaattcggtcgatatttcgattcggatttcgagttgcgtcgcggacgatgtcgcgggttcgttcgggattacgattttcgacgggttttgcgatcgtttcggggcggtttagcgtgtattgcgtcggttagtttgatagtcgggcgttttattcggttagttttgtttttagcgagggacgttggttttttcgcggttttttttcgatatttttttttattttagttgtttgaaattcggttttacgaatggtaggtagcgtttaaaatttaatttcgtaaagttagtattagttaataaagcgtacggatggaggttacgtgatagtagtgggtcggtttttcggttgagttttgatttttatggttttcgcggttcgttagaaggagtgtggtttatcggaggattttttatattttttttttattattttattgttttcggtgg

SEQ ID NO: 21386 - DNA, 734 bp, Artificial Sequence
  chemically treated genomic DNA (Homo sapiens) CpG-island No: 21386
ccaccgaaaacaataaaataataaaaaaaaaatataaaaaatcctccgataaaccacactccttctaacgaaccgcgaaaaccataaaaatcaaaactcaaccgaaaaaccgacccactactatcacgtaacctccatccgtacgctttattaactaatactaactttacgaaattaaattttaaacgctacctaccattcgtaaaaccgaatttcaaacaactaaaataaaaaaaaatatcgaaaaaaaaccgcgaaaaaaccaacgtccctcgctaaaaacaaaactaaccgaataaaacgcccgactatcaaactaaccgacgcaatacacgctaaaccgccccgaaacgatcgcaaaacccgtcgaaaatcgtaatcccgaacgaacccgcgacatcgtccgcgacgcaactcgaaatccgaatcgaaatatcgaccgaattactaccgaacaccgtcgaacgttaaccacccaacattaaactaccaacgactattctccctaaacaccctcgctcacgtcgcctcgcctcgcctaaccgaccgcaaccttaaataccaaccttaaatcgaaccgactacgacccaaccccgcccgcgacgaaatacgcgaaattcgatacgaacccctcgcccctaaccgaaccaacctcttaatacaccgaaaacgaacgcgcccatccgactcttcgaaaaacgacaaaaccccatctatatctttcgctctcgaa

SEQ ID NO: 21387 - DNA, 734 bp, Artificial Sequence
  chemically treated genomic DNA (Homo sapiens) CpG-island No: 21387
ttatcggaggtagtgaggtaatggaggaagaatgtagggagtttttcggtggattatattttttttagcgagtcgcggaaattatagagattagggtttagtcggagggtcggtttattgttgttacgtggtttttattcgtgcgttttattggttggtgttggttttacggggttgaattttggacgttgtttgttattcgtgggatcgagttttaggtagttggaataaagagagatatcgggggaaagtcgcgagaaggttagcgtttttcgttgggagtagagttagtcgagtagggcgttcggttgttaaattggtcggcgtagtgtacgttgggtcgtttcggagcgatcgtagagttcgtcgggagtcgtagtttcggacgggttcgcggtatcgttcgcgacgtagttcgggattcgggtcggggtgtcggtcgggttgttgtcgggtatcgtcgagcgttagttatttagtattgagttgttagcggttgttttttttaagtattttcgtttacgtcgtttcgtttcgtttgatcggtcgtagttttggatattagttttaaatcgagtcgattacggtttagtttcgttcgcggcgaggtgcgcggggttcggtgcgagtttttcgtttttggtcgggttagttttttgatgtatcggggacgggcgcgtttattcgatttttcgaggggcggtagggttttatttgtgtttttcgttttcgag

SEQ ID NO: 21388 - DNA, 734 bp, Artificial Sequence
  chemically treated genomic DNA (Homo sapiens) CpG-island No: 21388
ctcgaaaacgaaaaacacaaataaaaccctaccgcccctcgaaaaatcgaataaacgcgcccgtccccgatacatcaaaaaactaacccgaccaaaaacgaaaaactcgcaccgaaccccgcgcacctcgccgcgaacgaaactaaaccgtaatcgactcgatttaaaactaatatccaaaactacgaccgatcaaacgaaacgaaacgacgtaaacgaaaatacttaaaaaaaacaaccgctaacaactcaatactaaataactaacgctcgacgatacccgacaacaacccgaccgacaccccgacccgaatcccgaactacgtcgcgaacgataccgcgaacccgtccgaaactacgactcccgacgaactctacgatcgctccgaaacgacccaacgtacactacgccgaccaatttaacaaccgaacgccctactcgactaactctactcccaacgaaaaacgctaaccttctcgcgactttcccccgatatctctctttattccaactacctaaaactcgatcccacgaataacaaacaacgtccaaaattcaaccccgtaaaaccaacaccaaccaataaaacgcacgaataaaaaccacgtaacaacaataaaccgaccctccgactaaaccctaatctctataatttccgcgactcgctaaaaaaaatataatccaccgaaaaactccctacattcttcctccattacctcactacctccgataa

SEQ ID NO: 21389 - DNA, 945 bp, Artificial Sequence
  chemically treated genomic DNA (Homo sapiens) CpG-island No: 21389
cgatttagttttttagtcgttcggggaatatttttagtttttttcggtcgtcgtcgtcgtcgtcgtttcgtcgttttttttttcgtttgtcggtttttttcgtttcgtttcgttcgcgtagcgcgttcggttcgttcgtaggttagtttttttcgggagtttttatttaggcgtatggttttatgaagtaagaggaggaggtagagcgcgagaggtttcgttcgttttagtcgcgtttgggttaggataaaaggtgggaaattcgggttgcgtcgtattttttttttcgttgtcgggttaggtttttttcggttcgtcgtcgttttgttcgtcgggtttgttttcgtcggggcgggcggcggggtcgggaagagatttcgcggttttggggcgagggttcgggggtagcgtgggggaggggtttcgggcggcgggcggggttttaggttatgttttagcggagggtagggggtcgggaggtattgtcggggaggggtaggcggcgtcgtgtttcgggtcgcgaggttcggttttcgtttttggtttttgtttgtattttttttaggaagtaggttcgttcgttgtaatgtttggtggttttcggcgtcgtttggtggtttttatttatcgtttcgtcgtttcgtcgttttttttttcgttcggcgtttggattttattttcgcggttcggtttaagttgttttatttgtcgttttatcgtttttttaattttttagcgtttcgggttttttttttttttattttcgttttttattttttattttgtttttcggttcgtttttttttttttcgttttgttttgtcgtttttttaatattttttatacgcgtatttttttttttttttttttttttttttttatttttatttttgggttttttttttttaattttcgttggttttttattttatgattcgtttattt

SEQ ID NO: 21390 - DNA, 945 bp, Artificial Sequence
  chemically treated genomic DNA (Homo sapiens) CpG-island No: 21390
aaataaacgaatcataaaataaaaaaccaacgaaaattaaaaaaaaaaaacccaaaaataaaaataaaaaaaaaaaaaaaaaaaaaaaaaaaaatacgcgtataaaaaatattaaaaaaacgacaaaacaaaacgaaaaaaaaaaaaacgaaccgaaaaacaaaataaaaaataaaaaacgaaaataaaaaaaaaaaaaacccgaaacgctaaaaaattaaaaaaacgataaaacgacaaataaaacaacttaaaccgaaccgcgaaaataaaatccaaacgccgaacgaaaaaaaaaacgacgaaacgacgaaacgataaataaaaaccaccaaacgacgccgaaaaccaccaaacattacaacgaacgaacctacttcctaaaaaaaatacaaacaaaaaccaaaaacgaaaaccgaacctcgcgacccgaaacacgacgccgcctacccctccccgacaatacctcccgaccccctaccctccgctaaaacataacctaaaaccccgcccgccgcccgaaacccctcccccacgctacccccgaaccctcgccccaaaaccgcgaaatctcttcccgaccccgccgcccgccccgacgaaaacaaacccgacgaacaaaacgacgacgaaccgaaaaaaacctaacccgacaacgaaaaaaaaaatacgacgcaacccgaatttcccaccttttatcctaacccaaacgcgactaaaacgaacgaaacctctcgcgctctacctcctcctcttacttcataaaaccatacgcctaaataaaaactcccgaaaaaaactaacctacgaacgaaccgaacgcgctacgcgaacgaaacgaaacgaaaaaaaccgacaaacgaaaaaaaaaacgacgaaacgacgacgacgacgacgaccgaaaaaaactaaaaatattccccgaacgactaaaaaactaaatcg

SEQ ID NO: 21391 - DNA, 945 bp, Artificial Sequence
  chemically treated genomic DNA (Homo sapiens) CpG-island No: 21391
aggtggacggattatggaatggggggttagcggaggttaaggaaggagggtttaaaggtaggggtgggaaaaagagaagaggaggaggaggaagtgcgcgtgtgaagagtgttaagaaaacgataggatagagcggggaggggaaaagcgggtcgagggatagggtgaaaggtgagaaacgagggtaagaggaaagagggttcggggcgttggggagttggggagacgatggagcgataggtagagtagtttgggtcgagtcgcgggggtggaatttagacgtcgggcgggggagggggcggcggggcggcgggacggtgggtgggggttattaggcggcgtcggagattattaaatattatagcgagcgagtttgttttttggagggagtgtagataaggattaggagcgggagtcgagtttcgcggttcggggtacggcgtcgtttgttttttttcggtagtgtttttcgattttttgtttttcgttgggatatggtttgaggtttcgttcgtcgttcgggattttttttttacgttgttttcggattttcgttttaggatcgcggggttttttttcggtttcgtcgttcgtttcggcgagaataggttcggcgggtaaggcggcggcggatcgagggaggtttggttcggtagcggggagaagggtgcggcgtagttcgagttttttattttttattttggtttagacgcggttggggcggacgggatttttcgcgttttgttttttttttttgttttatggagttatgcgtttgggtgggggttttcgagagaagttggtttgcgggcgggtcggacgcgttgcgcggacgggacggggcgaaggaggtcggtaggcggaggaggaagcggcggggcggcggcggcggcggcggtcgggaagaattagaggtatttttcgggcggttggaggattgagtcg

SEQ ID NO: 21392 - DNA, 945 bp, Artificial Sequence
  chemically treated genomic DNA (Homo sapiens) CpG-island No: 21392
cgactcaatcctccaaccgcccgaaaaatacctctaattcttcccgaccgccgccgccgccgccgccccgccgcttcctcctccgcctaccgacctccttcgccccgtcccgtccgcgcaacgcgtccgacccgcccgcaaaccaacttctctcgaaaacccccacccaaacgcataactccataaaacaaaaaaaaaaaacaaaacgcgaaaaatcccgtccgccccaaccgcgtctaaaccaaaataaaaaataaaaaactcgaactacgccgcacccttctccccgctaccgaaccaaacctccctcgatccgccgccgccttacccgccgaacctattctcgccgaaacgaacgacgaaaccgaaaaaaaaccccgcgatcctaaaacgaaaatccgaaaacaacgtaaaaaaaaaatcccgaacgacgaacgaaacctcaaaccatatcccaacgaaaaacaaaaaatcgaaaaacactaccgaaaaaaaacaaacgacgccgtaccccgaaccgcgaaactcgactcccgctcctaatccttatctacactccctccaaaaaacaaactcgctcgctataatatttaataatctccgacgccgcctaataacccccacccaccgtcccgccgccccgccgccccctcccccgcccgacgtctaaattccacccccgcgactcgacccaaactactctacctatcgctccatcgtctccccaactccccaacgccccgaaccctctttcctcttaccctcgtttctcacctttcaccctatccctcgacccgcttttcccctccccgctctatcctatcgttttcttaacactcttcacacgcgcacttcctcctcctcctcttctctttttcccacccctacctttaaaccctccttccttaacctccgctaaccccccattccataatccgtccacct

SEQ ID NO: 21393 - DNA, 553 bp, Artificial Sequence
  chemically treated genomic DNA (Homo sapiens) CpG-island No: 21393
gagtacgagtgagaaagcggaggaggaggttggttagaggcgtttagtttttttagcggtttgaatttttgattcgatgcgtagagggcggggcgggtcgtttggggtcgcggcgggcggaggtttagtttttttttcggtttagtagggggtacggggagtggtttttcgtcgttttttttttttttgcgggcgtcgggtagattgttgtagtcgtaagcggcgagcgtagtgggcggggcgggtttggtcgggtcgggcggcggcgttgcgttgacgggttgagtttggcggcggcggaagttgtagaggttatcggggcgttaattgggtggtcggtgggtcgttgtggtttcgagtagttttttcgcgcggtttcgtatttcggtaagtagtagcgggtcgcgacgtttagtttgttagtgagttgcgacgggtatatttcggagcgtcggcgattgcggataggttagagtgggggtaggggcgggcgcgggagtagtttagggttagagagggagttcgagttaggttatttttaattatgttcgat

SEQ ID NO: 21394 - DNA, 553 bp, Artificial Sequence
  chemically treated genomic DNA (Homo sapiens) CpG-island No: 21394
atcgaacataattaaaaataacctaactcgaactccctctctaaccctaaactactcccgcgcccgcccctacccccactctaacctatccgcaatcgccgacgctccgaaatatacccgtcgcaactcactaacaaactaaacgtcgcgacccgctactacttaccgaaatacgaaaccgcgcgaaaaaactactcgaaaccacaacgacccaccgaccacccaattaacgccccgataacctctacaacttccgccgccgccaaactcaacccgtcaacgcaacgccgccgcccgacccgaccaaacccgccccgcccactacgctcgccgcttacgactacaacaatctacccgacgcccgcaaaaaaaaaaaaaacgacgaaaaaccactccccgtaccccctactaaaccgaaaaaaaaactaaacctccgcccgccgcgaccccaaacgacccgccccgccctctacgcatcgaatcaaaaattcaaaccgctaaaaaaactaaacgcctctaaccaacctcctcctccgctttctcactcgtactc

SEQ ID NO: 21395 - DNA, 553 bp, Artificial Sequence
  chemically treated genomic DNA (Homo sapiens) CpG-island No: 21395
gtcggatatggttggagatggtttggttcgggttttttttttggttttgggttgttttcgcgttcgtttttgtttttattttaatttgttcgtagtcgtcgacgtttcggggtgtgttcgtcgtagtttattggtaggttgggcgtcgcggttcgttgttgtttgtcggggtgcggggtcgcgcgaagaggttgttcgaggttatagcggtttatcggttatttagttagcgtttcggtggtttttgtagttttcgtcgtcgttagatttagttcgttagcgtagcgtcgtcgttcggttcggttaggttcgtttcgtttattgcgttcgtcgtttgcgattgtagtagtttgttcggcgttcgtaaggaggggaagggcggcgggaagttatttttcgtgttttttgttggatcggaggaggaattgaattttcgttcgtcgcggttttaagcggttcgtttcgttttttacgtatcgaattagggatttaggtcgttagaaaggttaggcgtttttggttaattttttttttcgtttttttattcgtattt

SEQ ID NO: 21396 - DNA, 553 bp, Artificial Sequence
  chemically treated genomic DNA (Homo sapiens) CpG-island No: 21396
aaatacgaataaaaaaacgaaaaaaaaaattaaccaaaaacgcctaacctttctaacgacctaaatccctaattcgatacgtaaaaaacgaaacgaaccgcttaaaaccgcgacgaacgaaaattcaattcctcctccgatccaacaaaaaacacgaaaaataacttcccgccgcccttcccctccttacgaacgccgaacaaactactacaatcgcaaacgacgaacgcaataaacgaaacgaacctaaccgaaccgaacgacgacgctacgctaacgaactaaatctaacgacgacgaaaactacaaaaaccaccgaaacgctaactaaataaccgataaaccgctataacctcgaacaacctcttcgcgcgaccccgcaccccgacaaacaacaacgaaccgcgacgcccaacctaccaataaactacgacgaacacaccccgaaacgtcgacgactacgaacaaattaaaataaaaacaaaaacgaacgcgaaaacaacccaaaaccaaaaaaaaaacccgaaccaaaccatctccaaccatatccgac

SEQ ID NO: 21397 - DNA, 630 bp, Artificial Sequence
  chemically treated genomic DNA (Homo sapiens) CpG-island No: 21397
cgcgtttcggagtcggttttagcgtcgtttaattagtttttatttttttcggtgaaattgttaaattaaaatgaattatttggtttataatggtcgaggcgtttatcgggggcgggcggattcgcggtagtgttttatttttgcggcgtatacggtttcggcgcgtttcggtttatgttaacgaggtttggaacgtgagtgggattatagcgcgtcggtggaggggtcgggcgggcgcggggcgggcgggggagcgggggtcgcgggaggggtcgggtcgtcgtcgtttaggatcgggttttaaaatggttatacgcgtattttcgtagcggaaaaacgtgagtattttggtttttttttaggggaaaagtaattcgcggttttttatcgaattttttattaatttttttttttttttttttacgttcgtaaaagaggttttcgttttttttttttcggtttttttcgatggtcggggggggcggtgggggggtattttttacggacgttttcgtttcggttgtcgtcgtttttttcgtttcggagattttttttttttttttttttttttttttacgtaatatatagaaatgcgcgaggttgtggttggtttttatttttttttcgtgg

SEQ ID NO: 21398 - DNA, 630 bp, Artificial Sequence
  chemically treated genomic DNA (Homo sapiens) CpG-island No: 21398
ccacgaaaaaaaaataaaaaccaaccacaacctcgcgcatttctatatattacgtaaaaaaaaaaaaaaaaaaaaaaaaaaaatctccgaaacgaaaaaaacgacgacaaccgaaacgaaaacgtccgtaaaaaatacccccccaccgccccccccgaccatcgaaaaaaaccgaaaaaaaaaaaacgaaaacctcttttacgaacgtaaaaaaaaaaaaaaaaaaattaataaaaaattcgataaaaaaccgcgaattacttttcccctaaaaaaaaaccaaaatactcacgtttttccgctacgaaaatacgcgtataaccattttaaaacccgatcctaaacgacgacgacccgacccctcccgcgacccccgctcccccgcccgccccgcgcccgcccgacccctccaccgacgcgctataatcccactcacgttccaaacctcgttaacataaaccgaaacgcgccgaaaccgtatacgccgcaaaaataaaacactaccgcgaatccgcccgcccccgataaacgcctcgaccattataaaccaaataattcattttaatttaacaatttcaccgaaaaaaataaaaactaattaaacgacgctaaaaccgactccgaaacgcg

SEQ ID NO: 21399 - DNA, 630 bp, Artificial Sequence
  chemically treated genomic DNA (Homo sapiens) CpG-island No: 21399
ttacgaagaagaaatgaaaattaattatagtttcgcgtatttttgtatattgcgtaaggaaaagggggaaggaaggaagagagttttcgaggcgggaggggcggcggtagtcggggcgggggcgttcgtggaaaatgtttttttatcgtttttttcggttatcgaaaggaatcgagggaaagggagcgaagattttttttgcggacgtggggaaaaagaggaggaaattgatgaagaattcggtgggaggtcgcgggttgttttttttttagaaaaaggttagaatgtttacgttttttcgttacgggggtacgcgtgtggttattttgaggttcggttttgagcggcggcggttcggtttttttcgcggttttcgttttttcgttcgtttcgcgttcgttcggtttttttatcgacgcgttgtaattttatttacgttttaggtttcgttagtatgggtcgaggcgcgtcggggtcgtgtgcgtcgtagagataaggtattgtcgcgggttcgttcgttttcgataagcgtttcggttattatgggttaaatgatttattttaatttggtaattttatcggagggagtggggattggttgagcggcgttaggatcggtttcggaacgcg

SEQ ID NO: 21400 - DNA, 630 bp, Artificial Sequence
  chemically treated genomic DNA (Homo sapiens) CpG-island No: 21400
cgcgttccgaaaccgatcctaacgccgctcaaccaatccccactccctccgataaaattaccaaattaaaataaatcatttaacccataataaccgaaacgcttatcgaaaacgaacgaacccgcgacaataccttatctctacgacgcacacgaccccgacgcgcctcgacccatactaacgaaacctaaaacgtaaataaaattacaacgcgtcgataaaaaaaccgaacgaacgcgaaacgaacgaaaaaacgaaaaccgcgaaaaaaaccgaaccgccgccgctcaaaaccgaacctcaaaataaccacacgcgtacccccgtaacgaaaaaacgtaaacattctaacctttttctaaaaaaaaaacaacccgcgacctcccaccgaattcttcatcaatttcctcctctttttccccacgtccgcaaaaaaaatcttcgctccctttccctcgattcctttcgataaccgaaaaaaacgataaaaaaacattttccacgaacgcccccgccccgactaccgccgcccctcccgcctcgaaaactctcttccttccttcccccttttccttacgcaatatacaaaaatacgcgaaactataattaattttcatttcttcttcgtaa

SEQ ID NO: 21401 - DNA, 504 bp, Artificial Sequence
  chemically treated genomic DNA (Homo sapiens) CpG-island No: 21401
  misc_feature (196)..(196): n is either a, c, g or t
atcggtttgtgttttcggtttcgacgtttcgtcgtgtttttcgaggtcgtttttttgcggagttcgttttttttattggtttttagtttcgtagttacgcggttttcgtacggttaagtagtacgggtcgggcgtttgtattttcggagaaaagtcgtcgtttaggtttcgcgttgcggcgttatttgttaaaaantaggggagtcgcgttgagatagagtagtaggaagtagaatagcgggtattggcggtagatttcgcgttttacgtttagtcgtagtcgttgttttagtttttgttttatcgttcgtatttagggtattattttcgtaacggcgaggtcgagattgcgttattggttgaggtagaggttaaggcgattttttatttatatttcgggttttcgttttatcgatttggcggggtatatagacgtttatcggtagttagtcgtcgaaggttgaggtcgcgttcggttgggttaagtttaacgtttttcgtcgt

SEQ ID NO: 21402 - DNA, 504 bp, Artificial Sequence
  chemically treated genomic DNA (Homo sapiens) CpG-island No: 21402
  misc_feature (309)..(309): n is either a, c, g or t
acgacgaaaaacgttaaacttaacccaaccgaacgcgacctcaaccttcgacgactaactaccgataaacgtctatataccccgccaaatcgataaaacgaaaacccgaaatataaataaaaaatcgccttaacctctacctcaaccaataacgcaatctcgacctcgccgttacgaaaataataccctaaatacgaacgataaaacaaaaactaaaacaacgactacgactaaacgtaaaacgcgaaatctaccgccaatacccgctattctacttcctactactctatctcaacgcgactcccctantttttaacaaataacgccgcaacgcgaaacctaaacgacgacttttctccgaaaatacaaacgcccgacccgtactacttaaccgtacgaaaaccgcgtaactacgaaactaaaaaccaataaaaaaaacgaactccgcaaaaaaacgacctcgaaaaacacgacgaaacgtcgaaaccgaaaacacaaaccgat

SEQ ID NO: 21403 - DNA, 504 bp, Artificial Sequence
  chemically treated genomic DNA (Homo sapiens) CpG-island No: 21403
  misc_feature (309)..(309): n is either a, c, g or t
gcggcggggggcgttgggtttggtttaatcggacgcgattttagttttcggcggttaattgtcggtaggcgtttgtgtgtttcgttaagtcggtggggcggggattcgaagtgtggatggggggtcgttttgatttttgttttagttagtagcgtagtttcggtttcgtcgttacggagatggtgttttgggtgcggacgatggggtagaagttgaagtagcggttgcgattgaacgtgggacgcgagatttgtcgttagtattcgttgttttgttttttgttgttttgttttagcgcggtttttttgntttttaataggtaacgtcgtagcgcggagtttgggcggcggttttttttcgaaggtgtaaacgttcggttcgtgttgtttaatcgtgcggaggtcgcgtaattgcgggattggggattagtggggaaagcgagtttcgtaaaggaacggtttcggggagtacggcggagcgtcgaggtcggaagtataggtcggt

SEQ ID NO: 21404 - DNA, 504 bp, Artificial Sequence
  chemically treated genomic DNA (Homo sapiens) CpG-island No: 21404
  misc_feature (196)..(196): n is either a, c, g or t
accgacctatacttccgacctcgacgctccgccgtactccccgaaaccgttcctttacgaaactcgctttccccactaatccccaatcccgcaattacgcgacctccgcacgattaaacaacacgaaccgaacgtttacaccttcgaaaaaaaaccgccgcccaaactccgcgctacgacgttacctattaaaaancaaaaaaaccgcgctaaaacaaaacaacaaaaaacaaaacaacgaatactaacgacaaatctcgcgtcccacgttcaatcgcaaccgctacttcaacttctaccccatcgtccgcacccaaaacaccatctccgtaacgacgaaaccgaaactacgctactaactaaaacaaaaatcaaaacgaccccccatccacacttcgaatccccgccccaccgacttaacgaaacacacaaacgcctaccgacaattaaccgccgaaaactaaaatcgcgtccgattaaaccaaacccaacgccccccgccgc

SEQ ID NO: 21405 - DNA, 743 bp, Artificial Sequence
  chemically treated genomic DNA (Homo sapiens) CpG-island No: 21405
tcgagcgtcgaattgttcgggaggcgttcgttcgtgcggatgttaggggtatcggggtagttcgggttcgtagttttcgagtttttcgtacgcgtttttgataaggtattttttattcgggtttcgttttgtgtgtgtatttttttttttttttttagtgttcggtatcgggttttcggtcgttttttttttttttttcgtttttcgttttttttttcggggcggattatttttttcgggttgcgtttcggatttcggggatgtttttagcgttcggcgagtaggcgatttatagtcgagcggttcgagtcggttggaggagcgttgggggcgcgcgggggcggcgaggggcgcgagcgggttagaattttcgatttcggaggtttcgtcgtaggttggggttgggggttagggggcgcggcgttagagggaggcggggggagaaaggattcgagtagtttcgatttggggagagagcgagcgagggggcgaggagagggagcgagggcgcggcgagtcggagggagagcgagcggtgtagtgatagggattgttattggggttaaaggagtatagttttaggaagtagggcggtcgaggcgtcgtttcgtgcgcgtttttcggcgggatttcgcgtttttgtacgtttttttcgtagtttttgtttattcggatttttatcggtgtttcgaagttttagggtttcgagaggaggagggagtcgagggcgaggttcggtagtt

SEQ ID NO: 21406 - DNA, 743 bp, Artificial Sequence
  chemically treated genomic DNA (Homo sapiens) CpG-island No: 21406
aactaccgaacctcgccctcgactccctcctcctctcgaaaccctaaaacttcgaaacaccgataaaaatccgaataaacaaaaactacgaaaaaaacgtacaaaaacgcgaaatcccgccgaaaaacgcgcacgaaacgacgcctcgaccgccctacttcctaaaactatactcctttaaccccaataacaatccctatcactacaccgctcgctctccctccgactcgccgcgccctcgctccctctcctcgccccctcgctcgctctctccccaaatcgaaactactcgaatcctttctccccccgcctccctctaacgccgcgccccctaacccccaaccccaacctacgacgaaacctccgaaatcgaaaattctaacccgctcgcgcccctcgccgcccccgcgcgcccccaacgctcctccaaccgactcgaaccgctcgactataaatcgcctactcgccgaacgctaaaaacatccccgaaatccgaaacgcaacccgaaaaaaataatccgccccgaaaaaaaaaacgaaaaacgaaaaaaaaaaaaaaaacgaccgaaaacccgataccgaacactaaaaaaaaaaaaaaaaatacacacacaaaacgaaacccgaataaaaaataccttatcaaaaacgcgtacgaaaaactcgaaaactacgaacccgaactaccccgatacccctaacatccgcacgaacgaacgcctcccgaacaattcgacgctcga

SEQ ID NO: 21407 - DNA, 743 bp, Artificial Sequence
  chemically treated genomic DNA (Homo sapiens) CpG-island No: 21407
ggttatcgggtttcgttttcggttttttttttttttcgaaattttggggtttcggggtatcggtgggggttcgagtgggtagggattgcgggaggggcgtgtaggggcgcggggtttcgtcggggagcgcgtacggagcggcgtttcggtcgttttgttttttggagttgtgtttttttgattttagtggtagtttttgttattgtatcgttcgtttttttttcggttcgtcgcgttttcgtttttttttttcgttttttcgttcgttttttttttagatcgaggttgttcgggtttttttttttttcgtttttttttagcgtcgcgttttttggtttttagttttagtttgcggcgggattttcggggtcgaaggttttggttcgttcgcgtttttcgtcgttttcgcgcgtttttagcgtttttttagtcggttcgggtcgttcggttatggatcgtttgttcgtcgggcgttgaaggtattttcgggattcggagcgtagttcgggaaaggtaattcgtttcgggaagggaggcggagggcgggggagggggaggaggcggtcgggagttcggtgtcgagtattagaggaagggaaaaaaatgtatatataaagcggagttcgggtgagaggtgttttgttagaggcgcgtgcgaggggttcggaggttgcggattcgggttgtttcggtgtttttgatattcgtacgagcgggcgtttttcgggtaattcggcgttcgg

SEQ ID NO: 21408 - DNA, 743 bp, Artificial Sequence
  chemically treated genomic DNA (Homo sapiens) CpG-island No: 21408
ccgaacgccgaattacccgaaaaacgcccgctcgtacgaatatcaaaaacaccgaaacaacccgaatccgcaacctccgaacccctcgcacgcgcctctaacaaaacacctctcacccgaactccgctttatatatacatttttttcccttcctctaatactcgacaccgaactcccgaccgcctcctccccctcccccgccctccgcctcccttcccgaaacgaattacctttcccgaactacgctccgaatcccgaaaataccttcaacgcccgacgaacaaacgatccataaccgaacgacccgaaccgactaaaaaaacgctaaaaacgcgcgaaaacgacgaaaaacgcgaacgaaccaaaaccttcgaccccgaaaatcccgccgcaaactaaaactaaaaaccaaaaaacgcgacgctaaaaaaaaacgaaaaaaaaaaaaacccgaacaacctcgatctaaaaaaaaaacgaacgaaaaaacgaaaaaaaaaaacgaaaacgcgacgaaccgaaaaaaaaacgaacgatacaataacaaaaactaccactaaaatcaaaaaaacacaactccaaaaaacaaaacgaccgaaacgccgctccgtacgcgctccccgacgaaaccccgcgcccctacacgcccctcccgcaatccctacccactcgaacccccaccgataccccgaaaccccaaaatttcgaaaaaaaaaaaaaaccgaaaacgaaacccgataacc

SEQ ID NO: 21409 - DNA, 504 bp, Artificial Sequence
  chemically treated genomic DNA (Homo sapiens) CpG-island No: 21409
cgcgcgcggggatcgtttggacgtaatcgtttttcgtttcggtgttcgtttatttagtcggggttggttttgttattgtcgttatatttcgtttttaattttcgtttcgttttcgttcggttttgatatcgcgttttatagttatttcggtttattcgattcgtttcgtattttatatacggttcgtcggcggtcgtcgttattttcgcgcgttcgttcgttttaatttcgtttttagacgttatgtttacgtgatcgttcgttttcggattcggagcgtgggcggggatttcgttacgtgacgttgtcgcggggcggtgttaagatggcgaggtttaaagaggtgaggagtcggtagcgggggcggttgtaattgtgaggaaggttgtagagtggcgacgtttacgtcgtaggttggaggttgtggggggtggtcgggcgttagtttttaggtcgtagaagtgatttgcggtggagtttttttttcgttgttggagaacggag

SEQ ID NO: 21410 - DNA, 504 bp, Artificial Sequence
  chemically treated genomic DNA (Homo sapiens) CpG-island No: 21410
ctccgttctccaacaacgaaaaaaaaactccaccgcaaatcacttctacgacctaaaaactaacgcccgaccaccccccacaacctccaacctacgacgtaaacgtcgccactctacaaccttcctcacaattacaaccgcccccgctaccgactcctcacctctttaaacctcgccatcttaacaccgccccgcgacaacgtcacgtaacgaaatccccgcccacgctccgaatccgaaaacgaacgatcacgtaaacataacgtctaaaaacgaaattaaaacgaacgaacgcgcgaaaataacgacgaccgccgacgaaccgtatataaaatacgaaacgaatcgaataaaccgaaataactataaaacgcgatatcaaaaccgaacgaaaacgaaacgaaaattaaaaacgaaatataacgacaataacaaaaccaaccccgactaaataaacgaacaccgaaacgaaaaacgattacgtccaaacgatccccgcgcgcg

SEQ ID NO: 21411 - DNA, 504 bp, Artificial Sequence
  chemically treated genomic DNA (Homo sapiens) CpG-island No: 21411
tttcgttttttagtagcgaggagggaattttatcgtaggttatttttgcggtttgggagttggcgttcggttattttttatagtttttaatttacggcgtagacgtcgttattttgtagttttttttatagttatagtcgttttcgttgtcggttttttatttttttgggtttcgttattttggtatcgtttcgcggtaacgttacgtgacgaaattttcgtttacgtttcgggttcgggggcgagcggttacgtgggtatggcgtttgggggcggggttagggcgagcgggcgcgcgaagatggcggcggtcgtcggcgggtcgtgtgtgaggtgcggagcgggtcgaatggatcggggtggttgtgaagcgcggtgttaaagtcgagcggaagcggggcgggaattggaggcgggatgtggcgatagtggtagggttaatttcggttggatggacgggtatcgagacgggaggcggttacgtttaaacggttttcgcgcgcg

SEQ ID NO: 21412 - DNA, 504 bp, Artificial Sequence
  chemically treated genomic DNA (Homo sapiens) CpG-island No: 21412
cgcgcgcgaaaaccgtttaaacgtaaccgcctcccgtctcgatacccgtccatccaaccgaaattaaccctaccactatcgccacatcccgcctccaattcccgccccgcttccgctcgactttaacaccgcgcttcacaaccaccccgatccattcgacccgctccgcacctcacacacgacccgccgacgaccgccgccatcttcgcgcgcccgctcgccctaaccccgcccccaaacgccatacccacgtaaccgctcgcccccgaacccgaaacgtaaacgaaaatttcgtcacgtaacgttaccgcgaaacgataccaaaataacgaaacccaaaaaaataaaaaaccgacaacgaaaacgactataactataaaaaaaactacaaaataacgacgtctacgccgtaaattaaaaactataaaaaataaccgaacgccaactcccaaaccgcaaaaataacctacgataaaattccctcctcgctactaaaaaacgaaa

SEQ ID NO: 21413 - DNA, 689 bp, Artificial Sequence
  chemically treated genomic DNA (Homo sapiens) CpG-island No: 21413
tcgacgtcgtagcggaaagttttttttttattttttcgtcgagtttcgtttcgcggcggcggtcgtcgtttattttaggtttcgtggtttttagcgatcgtcgcggtcgtcgttttttcgaattcggggttcgggttttttgtgtagtattaatttcgttttttcggtcgtcgtcgttattttagtttgtgcggtaaaatgcgtttttttggatggttgggatttagtttagggcgtagtttttcgggttcgagagtcggaggtcgggttttttaagttttttcgttatttttagtttcgtcgttgttatagtttagaggttcgaaatttattcgggttttagcgaatttgattaaataatttttgaaatttatagtttggtgtcgtgtgcgttaaatcggggcgacgttgggagtacgcggcgttttcgcgttatacgtcgttttgtacgttattcggttttagcggttttttttcgtttttcgtttttcgtttttagtttcggtttttacggcgtaggcgcgttgttttttcgtttttgtcgggttgcgggtcgcgggggtggttagcgaggagttttcgggaagtttcgcgttggtggagcgtttgggttaattagataaacgagggtagcggaaatagtgtattattgttttcgggtgttagaaattaaataaggttattttttt

SEQ ID NO: 21414 - DNA, 689 bp, Artificial Sequence
  chemically treated genomic DNA (Homo sapiens) CpG-island No: 21414
aaaaaaataaccttatttaatttctaacacccgaaaacaataatacactatttccgctaccctcgtttatctaattaacccaaacgctccaccaacgcgaaacttcccgaaaactcctcgctaaccacccccgcgacccgcaacccgacaaaaacgaaaaaacaacgcgcctacgccgtaaaaaccgaaactaaaaacgaaaaacgaaaaacgaaaaaaaaccgctaaaaccgaataacgtacaaaacgacgtataacgcgaaaacgccgcgtactcccaacgtcgccccgatttaacgcacacgacaccaaactataaatttcaaaaattatttaatcaaattcgctaaaacccgaataaatttcgaacctctaaactataacaacgacgaaactaaaaataacgaaaaaacttaaaaaacccgacctccgactctcgaacccgaaaaactacgccctaaactaaatcccaaccatccaaaaaaacgcattttaccgcacaaactaaaataacgacgacgaccgaaaaaacgaaattaatactacacaaaaaacccgaaccccgaattcgaaaaaacgacgaccgcgacgatcgctaaaaaccacgaaacctaaaataaacgacgaccgccgccgcgaaacgaaactcgacgaaaaaataaaaaaaaaactttccgctacgacgtcga

SEQ ID NO: 21415 - DNA, 689 bp, Artificial Sequence
  chemically treated genomic DNA (Homo sapiens) CpG-island No: 21415
ggggaggtgattttgtttggtttttggtattcgagaatagtggtgtattgttttcgttgttttcgtttgtttaattggtttagacgttttattagcgcgaagtttttcgggagtttttcgttggttattttcgcggttcgtagttcggtagaggcgggaaagtagcgcgtttgcgtcgtgggaatcggggttggaggcgaaaagcggggagcggaggggggtcgttggagtcgagtagcgtatagagcggcgtgtgacgcggggacgtcgcgtgtttttaacgtcgtttcggtttgacgtatacggtattaaattgtgagttttaggggttatttggttagattcgttgggattcgagtgggtttcgggtttttgggttgtggtagcggcgggattgagggtggcggaagaatttgggggattcggttttcggttttcgggttcggggagttacgttttaggttgggttttagttatttaaaaggacgtattttgtcgtataggttaagatggcggcggcggtcgaggaggcggagttggtgttatataaggagttcgggtttcgggttcggggaggcggcggtcgcggcggtcgttgggggttacggagtttgaggtgagcggcggtcgtcgtcgcggggcgggattcggcggggggatggggggggggtttttcgttgcggcgtcgg

SEQ ID NO: 21416 - DNA, 689 bp, Artificial Sequence
  chemically treated genomic DNA (Homo sapiens) CpG-island No: 21416
ccgacgccgcaacgaaaaaccccccccccatccccccgccgaatcccgccccgcgacgacgaccgccgctcacctcaaactccgtaacccccaacgaccgccgcgaccgccgcctccccgaacccgaaacccgaactccttatataacaccaactccgcctcctcgaccgccgccgccatcttaacctatacgacaaaatacgtccttttaaataactaaaacccaacctaaaacgtaactccccgaacccgaaaaccgaaaaccgaatcccccaaattcttccgccaccctcaatcccgccgctaccacaacccaaaaacccgaaacccactcgaatcccaacgaatctaaccaaataacccctaaaactcacaatttaataccgtatacgtcaaaccgaaacgacgttaaaaacacgcgacgtccccgcgtcacacgccgctctatacgctactcgactccaacgacccccctccgctccccgcttttcgcctccaaccccgattcccacgacgcaaacgcgctactttcccgcctctaccgaactacgaaccgcgaaaataaccaacgaaaaactcccgaaaaacttcgcgctaataaaacgtctaaaccaattaaacaaacgaaaacaacgaaaacaatacaccactattctcgaataccaaaaaccaaacaaaatcacctcccc

SEQ ID NO: 21417 - DNA, 558 bp, Artificial Sequence
  chemically treated genomic DNA (Homo sapiens) CpG-island No: 21417
gttttcgttcgtcgcggggttagcgtcggtttttaagagtaggagtttcgttagtcggttcgggttgttgacgcgtaggatgttgatgtcgttttcgtagtaaaacgtttggattagggtgaagtggatttgtagagttatatttttgtcgtcgttttcgttcgtcgttagtaggtataatattacgttatcggggtcgttgggggtagcgggcggggttagtgagcgtagaagcgcgggcgtttttaattattgttcgggtttttgggggtcgtcgttcggttcgttcgttttttttttttcgagataggtagaaaagcgataggaagtggcgcggtcgggcgaggggcgtttagttaaggcgatttttcgggttggggcgggaaggggtgttatgggggacgcgtaagggttttatttatacgttgagtagtttggtcgtttcgtatatttcgatagtgatcgtgcgttgatttagggttttgttgagtattttttttagggtattttttattttatttattttatacgcgggtaagggcgaggggtttcgttagt

SEQ ID NO: 21418 - DNA, 558 bp, Artificial Sequence
  chemically treated genomic DNA (Homo sapiens) CpG-island No: 21418
actaacgaaacccctcgcccttacccgcgtataaaataaataaaataaaaaataccctaaaaaaaatactcaacaaaaccctaaatcaacgcacgatcactatcgaaatatacgaaacgaccaaactactcaacgtataaataaaacccttacgcgtcccccataacaccccttcccgccccaacccgaaaaatcgccttaactaaacgcccctcgcccgaccgcgccacttcctatcgcttttctacctatctcgaaaaaaaaaaaacgaacgaaccgaacgacgacccccaaaaacccgaacaataattaaaaacgcccgcgcttctacgctcactaaccccgcccgctacccccaacgaccccgataacgtaatattatacctactaacgacgaacgaaaacgacgacaaaaatataactctacaaatccacttcaccctaatccaaacgttttactacgaaaacgacatcaacatcctacgcgtcaacaacccgaaccgactaacgaaactcctactcttaaaaaccgacgctaaccccgcgacgaacgaaaac

SEQ ID NO: 21419 - DNA, 558 bp, Artificial Sequence
  chemically treated genomic DNA (Homo sapiens) CpG-island No: 21419
gttgacgggatttttcgtttttgttcgcgtgtaggatggataaggtgggggatgttttggaggaagtgtttagtaaagttttgagttagcgtacgattattgtcggggtgtacgaagcggttaagttgtttaacgtgtaagtggggtttttgcgcgttttttatggtattttttttcgttttagttcgggaggtcgttttggttgggcgtttttcgttcggtcgcgttattttttgtcgtttttttgtttgtttcggaagggagggggcgagcgggtcgggcggcgatttttagggattcgggtagtggttgagggcgttcgcgtttttgcgtttattggtttcgttcgttgtttttagcgatttcgataacgtggtgttgtgtttgttggcggcggacgaggacgacgatagagatgtggttttgtagatttattttattttgatttaggcgttttgttgcgagaacgatattaatattttgcgcgttagtaattcgggtcggttggcggagtttttgtttttggagatcgacgttggtttcgcggcgagcgagggt

SEQ ID NO: 21420 - DNA, 558 bp, Artificial Sequence
  chemically treated genomic DNA (Homo sapiens) CpG-island No: 21420
accctcgctcgccgcgaaaccaacgtcgatctccaaaaacaaaaactccgccaaccgacccgaattactaacgcgcaaaatattaatatcgttctcgcaacaaaacgcctaaatcaaaataaaataaatctacaaaaccacatctctatcgtcgtcctcgtccgccgccaacaaacacaacaccacgttatcgaaatcgctaaaaacaacgaacgaaaccaataaacgcaaaaacgcgaacgccctcaaccactacccgaatccctaaaaatcgccgcccgacccgctcgccccctcccttccgaaacaaacaaaaaaacgacaaaaaataacgcgaccgaacgaaaaacgcccaaccaaaacgacctcccgaactaaaacgaaaaaaaataccataaaaaacgcgcaaaaaccccacttacacgttaaacaacttaaccgcttcgtacaccccgacaataatcgtacgctaactcaaaactttactaaacacttcctccaaaacatcccccaccttatccatcctacacgcgaacaaaaacgaaaaatcccgtcaac

SEQ ID NO: 21421 - DNA, 538 bp, Artificial Sequence
  chemically treated genomic DNA (Homo sapiens) CpG-island No: 21421
ttttcgcgggaggtttggtttgcgggatttcgggttggggtcgtacgggttggtaggcgggtttcgggtaataagggcgcggttgcggattggcgggcggatttcggggaggggttttacggaggcgtcgcggtcggagcggagcggagtcgttcgggttgggcgcgtagcgttgtcgggcgggcggtggcgttgcggaggcggtggtcgaggtcgacgagcgcggaggaggggttcgaggttggggcggttggtggtagttgttttagtgacgattgtcggtatcgcggcgatttgaggagattaagtcgtaggtttcgtcgtcgttattattttcgttagtttttttttttcgttttcggtcggggcgttaggaatgggttttaatcgtcgtgggtttcgtattttgcgtcgttcgtaggttttagtagtcggaggtcgatcggttttttattatttttcgttttagttaagtcgtttttattttaaattttcgggaaggaagatgagggagacgggttcggcgtttagtagttag

SEQ ID NO: 21422 - DNA, 538 bp, Artificial Sequence
  chemically treated genomic DNA (Homo sapiens) CpG-island No: 21422
ctaactactaaacgccgaacccgtctccctcatcttccttcccgaaaatttaaaataaaaacgacttaactaaaacgaaaaataataaaaaaccgatcgacctccgactactaaaacctacgaacgacgcaaaatacgaaacccacgacgattaaaacccattcctaacgccccgaccgaaaacgaaaaaaaaaaactaacgaaaataataacgacgacgaaacctacgacttaatctcctcaaatcgccgcgataccgacaatcgtcactaaaacaactaccaccaaccgccccaacctcgaacccctcctccgcgctcgtcgacctcgaccaccgcctccgcaacgccaccgcccgcccgacaacgctacgcgcccaacccgaacgactccgctccgctccgaccgcgacgcctccgtaaaacccctccccgaaatccgcccgccaatccgcaaccgcgcccttattacccgaaacccgcctaccaacccgtacgaccccaacccgaaatcccgcaaaccaaacctcccgcgaaaa

SEQ ID NO: 21423 - DNA, 538 bp, Artificial Sequence
  chemically treated genomic DNA (Homo sapiens) CpG-island No: 21423
ttggttgttaagcgtcgggttcgttttttttattttttttttcggggatttggggtggggacggtttggttagggcgaggggtagtgggaggtcggtcggttttcggttattggggtttacgggcgacgtagggtgcggggtttacggcgattggggtttatttttgacgtttcggtcgggagcggagaaggaagattggcgggagtggtggcgacggcggggtttgcggtttgatttttttaggtcgtcgcgatgtcggtagtcgttattgaggtagttgttattagtcgttttagtttcgggtttttttttcgcgttcgtcggtttcggttatcgttttcgtagcgttatcgttcgttcggtagcgttgcgcgtttagttcgggcggtttcgtttcgtttcggtcgcggcgttttcgtgaagttttttttcggggttcgttcgttagttcgtagtcgcgtttttgttgttcggagttcgtttgttagttcgtgcggttttaattcggagtttcgtaagttaagtttttcgcgaaag

SEQ ID NO: 21424 - DNA, 538 bp, Artificial Sequence
  chemically treated genomic DNA (Homo sapiens) CpG-island No: 21424
ctttcgcgaaaaacttaacttacgaaactccgaattaaaaccgcacgaactaacaaacgaactccgaacaacaaaaacgcgactacgaactaacgaacgaaccccgaaaaaaaacttcacgaaaacgccgcgaccgaaacgaaacgaaaccgcccgaactaaacgcgcaacgctaccgaacgaacgataacgctacgaaaacgataaccgaaaccgacgaacgcgaaaaaaaaacccgaaactaaaacgactaataacaactacctcaataacgactaccgacatcgcgacgacctaaaaaaatcaaaccgcaaaccccgccgtcgccaccactcccgccaatcttccttctccgctcccgaccgaaacgtcaaaaataaaccccaatcgccgtaaaccccgcaccctacgtcgcccgtaaaccccaataaccgaaaaccgaccgacctcccactacccctcgccctaaccaaaccgtccccaccccaaatccccgaaaaaaaaaataaaaaaaacgaacccgacgcttaacaaccaa

SEQ ID NO: 21425 - DNA, 550 bp, Artificial Sequence
  chemically treated genomic DNA (Homo sapiens) CpG-island No: 21425
gcgcggaaataggagtttattaagtcgttgtttataggtttttcgcgtttagtttagtttcgcggtttttcgattcgggggttcgaatcgtcgtcgcgttcggaggagacgttttttcggttataaagggaagattcgggttacgttcgtcgttatattttttttgttcggttttcgcgttcgaaatcgtatcgcgtcgttatttattcgtcgtttttcgtcgcgttgtttcgttcggggttggaattcgttcgggaggcgcgcgtaggtcgcgtagttagaagtcgtagtcgggatcggttgtgtcgtagcggcgcgcgtttttcgtttcggatcgcgcggttacgcggttgagttatttagcgttttacgttaagagtttttttcgcgcgtggtacgtcgggaaggtcgtgtttggggatttcgttcggggtcgtatcgtaaatgggtgtcgttttttttttagtttattttgtatttaattttagcgggcgtatttttttgagttgcgtatatttttttaattattaaaggttgtagacggaaaagt

SEQ ID NO: 21426 - DNA, 550 bp, Artificial Sequence
  chemically treated genomic DNA (Homo sapiens) CpG-island No: 21426
acttttccgtctacaacctttaataattaaaaaaatatacgcaactcaaaaaaatacgcccgctaaaattaaatacaaaataaactaaaaaaaaaacgacacccatttacgatacgaccccgaacgaaatccccaaacacgaccttcccgacgtaccacgcgcgaaaaaaactcttaacgtaaaacgctaaataactcaaccgcgtaaccgcgcgatccgaaacgaaaaacgcgcgccgctacgacacaaccgatcccgactacgacttctaactacgcgacctacgcgcgcctcccgaacgaattccaaccccgaacgaaacaacgcgacgaaaaacgacgaataaataacgacgcgatacgatttcgaacgcgaaaaccgaacaaaaaaaatataacgacgaacgtaacccgaatcttccctttataaccgaaaaaacgtctcctccgaacgcgacgacgattcgaacccccgaatcgaaaaaccgcgaaactaaactaaacgcgaaaaacctataaacaacgacttaataaactcctatttccgcgc

SEQ ID NO: 21427 - DNA, 550 bp, Artificial Sequence
  chemically treated genomic DNA (Homo sapiens) CpG-island No: 21427
attttttcgtttgtaatttttaataattgagagggtatgcgtaatttagaaaagtgcgttcgttgaggttgggtgtagagtggattggaggaaaggcgatatttatttacggtgcggtttcggacggggtttttagatacggttttttcggcgtgttacgcgcggaggggatttttaacgtgaagcgttgggtgatttagtcgcgtggtcgcgcggttcggggcggggggcgcgcgtcgttgcggtatagtcggtttcggttgcggtttttggttgcgcggtttgcgcgcgtttttcgggcggattttagtttcgagcgggatagcgcggcggggagcgacgagtaagtggcggcgcggtacggtttcgggcgcgaagatcgggtagggagagtgtggcggcgggcgtggttcgagttttttttttgtggtcgagggggcgtttttttcggacgcggcggcggttcggattttcgagtcgaaaggtcgcggggttgagttgggcgcgaggaatttgtgggtagcggtttgatgggtttttgttttcgcgt

SEQ ID NO: 21428 - DNA, 550 bp, Artificial Sequence
  chemically treated genomic DNA (Homo sapiens) CpG-island No: 21428
acgcgaaaacaaaaacccatcaaaccgctacccacaaattcctcgcgcccaactcaaccccgcgacctttcgactcgaaaatccgaaccgccgccgcgtccgaaaaaaacgccccctcgaccacaaaaaaaaaactcgaaccacgcccgccgccacactctccctacccgatcttcgcgcccgaaaccgtaccgcgccgccacttactcgtcgctccccgccgcgctatcccgctcgaaactaaaatccgcccgaaaaacgcgcgcaaaccgcgcaaccaaaaaccgcaaccgaaaccgactataccgcaacgacgcgcgccccccgccccgaaccgcgcgaccacgcgactaaatcacccaacgcttcacgttaaaaatcccctccgcgcgtaacacgccgaaaaaaccgtatctaaaaaccccgtccgaaaccgcaccgtaaataaatatcgcctttcctccaatccactctacacccaacctcaacgaacgcacttttctaaattacgcataccctctcaattattaaaaattacaaacgaaaaaat

SEQ ID NO: 21429 - DNA, 971 bp, Artificial Sequence
  chemically treated genomic DNA (Homo sapiens) CpG-island No: 21429
cgtttgcgagagtattacggcgatggttatgtaggttgtcgtttttttttttttaagtatttgtttcgtatttagtagtcgttcgtcgttagtttttaatttcgggttttttttttcgttatatagatttcgttcggttaggcgttgtagggttatcggagaaagcgttcgtaattatatggaggttcgggttcgttttattggttgcggtcgggttagtcgcggtattcgtcggttgcggttggttttagagttgtagcgtttgtacgggttcggagtttatgttacgttttgtttaatttttttcgttatagagttatgtgttgttgttttcgtcgtcgttgttgtcgttgtcgttgtcgtcgttcgtggtgtttcggttttttcgtcgcgtttcgaggtggtagtcgcgggcggggtcgcgggagtagggtttagggtgtagcgcgttttcgtcgtttcggcgcgtttcggtgtagtcgtcgttcgtcgcgggtgatgtcgttattttcggttttagtataagtcgtggtttggcggtcgagttgtattttaaggttggtgcgtatttttttcggtaggggtcgggggttgcgagggaaggcgacgcgtaggtggagtcgcgtcgagtcggagcgcgtaattttggcgtaggcgtcgcggttcgagttgcggttgcggtcgggaatttattcggggacgttcgggggtcgggaggaggtggcggcgagcggagtgggttttcgtttgttgtcgttagggtttgggagattgtttcgttttttgtagtttgagcgtcggtcgtttcggtttcgggcggtcggttttgcgggaggggagtgcggttttttggtttttgaatttttcgcgcgcgttttttttttttattttttttcgttttatcggaaaggcggggagagtcggtttcggttttgttggtttttttcggaggtgggtgtttggtgtttggt

SEQ ID NO: 21430 - DNA, 971 bp, Artificial Sequence
  chemically treated genomic DNA (Homo sapiens) CpG-island No: 21430
accaaacaccaaacacccacctccgaaaaaaaccaacaaaaccgaaaccgactctccccgcctttccgataaaacgaaaaaaaataaaaaaaaaaaacgcgcgcgaaaaattcaaaaaccaaaaaaccgcactcccctcccgcaaaaccgaccgcccgaaaccgaaacgaccgacgctcaaactacaaaaaacgaaacaatctcccaaaccctaacgacaacaaacgaaaacccactccgctcgccgccacctcctcccgacccccgaacgtccccgaataaattcccgaccgcaaccgcaactcgaaccgcgacgcctacgccaaaattacgcgctccgactcgacgcgactccacctacgcgtcgccttccctcgcaacccccgacccctaccgaaaaaaatacgcaccaaccttaaaatacaactcgaccgccaaaccacgacttatactaaaaccgaaaataacgacatcacccgcgacgaacgacgactacaccgaaacgcgccgaaacgacgaaaacgcgctacaccctaaaccctactcccgcgaccccgcccgcgactaccacctcgaaacgcgacgaaaaaaccgaaacaccacgaacgacgacaacgacaacgacaacaacgacgacgaaaacaacaacacataactctataacgaaaaaaattaaacaaaacgtaacataaactccgaacccgtacaaacgctacaactctaaaaccaaccgcaaccgacgaataccgcgactaacccgaccgcaaccaataaaacgaacccgaacctccatataattacgaacgctttctccgataaccctacaacgcctaaccgaacgaaatctatataacgaaaaaaaaaacccgaaattaaaaactaacgacgaacgactactaaatacgaaacaaatacttaaaaaaaaaaaaacgacaacctacataaccatcgccgtaatactctcgcaaacg

SEQ ID NO: 21431 - DNA, 971 bp, Artificial Sequence
  chemically treated genomic DNA (Homo sapiens) CpG-island No: 21431
gttagatattaaatatttattttcgggaggaattagtagagtcgaaatcggtttttttcgttttttcgatagggcggagggaggtgagagaagggagcgcgcgcgaggggtttaggagttaggaagtcgtatttttttttcgtagggtcggtcgttcggggtcgaagcggtcgacgtttagattgtagaaagcggaataattttttaggttttggcggtagtaaacgggagtttatttcgttcgtcgttattttttttcgattttcggacgttttcgaatgagttttcggtcgtaatcgtagttcgggtcgcggcgtttgcgttagggttgcgcgtttcggttcggcgcggttttatttgcgcgtcgttttttttcgtagttttcggtttttgtcgggagaggtgcgtattaattttggggtgtagttcggtcgttaagttacggtttatgttgaggtcggaggtggcggtattattcgcggcgggcggcggttgtatcgggacgcgtcggggcggcgaaggcgcgttgtattttggattttgttttcgcggtttcgttcgcggttgttatttcgaagcgcggcggaggagtcggggtattacgggcggcggtagcggtagcggtagtagcggcgacgggagtagtagtatatgattttgtaacgaggggaattagataaagcgtaatatggatttcgggttcgtgtaggcgttgtagttttgggattaatcgtagtcggcgagtgtcgcgattggttcggtcgtagttaatggggcgggttcgggtttttatgtgattgcgagcgtttttttcggtggttttgtagcgtttgatcggacggggtttgtgtggcgagggaggggattcggggttggagattggcggcgagcgattgttagatgcggagtaggtgtttgggaggggaagaacggtagtttatataattatcgtcgtaatgttttcgtaagcg

SEQ ID NO: 21432 - DNA, 971 bp, Artificial Sequence
  chemically treated genomic DNA (Homo sapiens) CpG-island No: 21432
cgcttacgaaaacattacgacgataattatataaactaccgttcttcccctcccaaacacctactccgcatctaacaatcgctcgccgccaatctccaaccccgaatcccctccctcgccacacaaaccccgtccgatcaaacgctacaaaaccaccgaaaaaaacgctcgcaatcacataaaaacccgaacccgccccattaactacgaccgaaccaatcgcgacactcgccgactacgattaatcccaaaactacaacgcctacacgaacccgaaatccatattacgctttatctaattcccctcgttacaaaatcatatactactactcccgtcgccgctactaccgctaccgctaccgccgcccgtaataccccgactcctccgccgcgcttcgaaataacaaccgcgaacgaaaccgcgaaaacaaaatccaaaatacaacgcgccttcgccgccccgacgcgtcccgatacaaccgccgcccgccgcgaataataccgccacctccgacctcaacataaaccgtaacttaacgaccgaactacaccccaaaattaatacgcacctctcccgacaaaaaccgaaaactacgaaaaaaaacgacgcgcaaataaaaccgcgccgaaccgaaacgcgcaaccctaacgcaaacgccgcgacccgaactacgattacgaccgaaaactcattcgaaaacgtccgaaaatcgaaaaaaaataacgacgaacgaaataaactcccgtttactaccgccaaaacctaaaaaattattccgctttctacaatctaaacgtcgaccgcttcgaccccgaacgaccgaccctacgaaaaaaaaatacgacttcctaactcctaaacccctcgcgcgcgctcccttctctcacctccctccgccctatcgaaaaaacgaaaaaaaccgatttcgactctactaattcctcccgaaaataaatatttaatatctaac

SEQ ID NO: 21433 - DNA, 550 bp, Artificial Sequence
  chemically treated genomic DNA (Homo sapiens) CpG-island No: 21433
gcggttatgttcgggttttagagcgtttgtcgtagtttgcgtttcgtagtttcgtagtttcgcgttcgtcgtcgtttttttaatgggtaatttgttcggcggggttagttttcgcgagtttattatcgtggaggattgcgattttatttggtagatcgattcggagttcgagttcgaagaattagggtcgggcggcggtagcgagggttcggggtaggagttcgagtagttcgcgtagttttcggagtaagtcggcgggcggttcggcgttagtttcgcgtcggacgaggacgtcgaggcggcgggcgtcgagtaggtacgcggtttagcggtggtttcgggtcgggttggggcgtttcgatattttagaggggtaagtgttaagtcgttttcgcgttcggaggttaggggcgttaggtggttgttcgtcgttgcgattcgattttttcgcgtcgcggttgatttgtttttcggtggagttcgggggtttgtaggagtttaaagcgtcggatttttttattgtcggtttggggtttggtcgagggtacgg

SEQ ID NO: 21434 - DNA, 550 bp, Artificial Sequence
  chemically treated genomic DNA (Homo sapiens) CpG-island No: 21434
ccgtaccctcgaccaaaccccaaaccgacaataaaaaaatccgacgctttaaactcctacaaacccccgaactccaccgaaaaacaaatcaaccgcgacgcgaaaaaatcgaatcgcaacgacgaacaaccacctaacgcccctaacctccgaacgcgaaaacgacttaacacttacccctctaaaatatcgaaacgccccaacccgacccgaaaccaccgctaaaccgcgtacctactcgacgcccgccgcctcgacgtcctcgtccgacgcgaaactaacgccgaaccgcccgccgacttactccgaaaactacgcgaactactcgaactcctaccccgaaccctcgctaccgccgcccgaccctaattcttcgaactcgaactccgaatcgatctaccaaataaaatcgcaatcctccacgataataaactcgcgaaaactaaccccgccgaacaaattacccattaaaaaaacgacgacgaacgcgaaactacgaaactacgaaacgcaaactacgacaaacgctctaaaacccgaacataaccgc

SEQ ID NO: 21435 - DNA, 550 bp, Artificial Sequence
  chemically treated genomic DNA (Homo sapiens) CpG-island No: 21435
tcgtgttttcggttaggttttaggtcggtagtgggagggttcggcgttttgggtttttgtaggttttcgggttttatcgggagataggttagtcgcggcgcggaggggtcgggtcgtagcggcgagtagttatttggcgtttttggttttcgagcgcgagggcggtttggtatttgtttttttggggtgtcggggcgttttagttcgattcgaggttatcgttgggtcgcgtatttgttcggcgttcgtcgtttcggcgttttcgttcggcgcggggttggcgtcgggtcgttcgtcggtttgtttcgggggttgcgcgggttgttcggatttttgtttcgggttttcgttgtcgtcgttcggttttggtttttcgggttcgggtttcgagtcggtttgttaggtggagtcgtagttttttacggtggtgggttcgcggaagttgatttcgtcgagtaggttgtttattgaagaggcggcggcgggcgcggggttgcggggttgcggggcgtaagttgcggtaggcgttttagggttcgggtatggtcgt

SEQ ID NO: 21436 - DNA, 550 bp, Artificial Sequence
  chemically treated genomic DNA (Homo sapiens) CpG-island No: 21436
acgaccatacccgaaccctaaaacgcctaccgcaacttacgccccgcaaccccgcaaccccgcgcccgccgccgcctcttcaataaacaacctactcgacgaaatcaacttccgcgaacccaccaccgtaaaaaactacgactccacctaacaaaccgactcgaaacccgaacccgaaaaaccaaaaccgaacgacgacaacgaaaacccgaaacaaaaatccgaacaacccgcgcaacccccgaaacaaaccgacgaacgacccgacgccaaccccgcgccgaacgaaaacgccgaaacgacgaacgccgaacaaatacgcgacccaacgataacctcgaatcgaactaaaacgccccgacaccccaaaaaaacaaataccaaaccgccctcgcgctcgaaaaccaaaaacgccaaataactactcgccgctacgacccgacccctccgcgccgcgactaacctatctcccgataaaacccgaaaacctacaaaaacccaaaacgccgaaccctcccactaccgacctaaaacctaaccgaaaacacga

SEQ ID NO: 21437 - DNA, 591 bp, Artificial Sequence
  chemically treated genomic DNA (Homo sapiens) CpG-island No: 21437
tttcgcgtcgcgatcgttaggaggcgtcgttcgggagaggaagtttagttgggttcggtcgggtttcggaggcgtcgttcgggagaggaagtttagttgggttcggtcgggttttagaggcgtagggcgggagtcgtttcgcgtagggttttttttaagtcggcgttaggttttgttttcgttcggttttgttttcgtttggtttcgttcgggtcgcgagtattggcgggttttgggttttgtgatcggttaggcggcgttagcgggcgcggcggagggttggtcggtttcgggggagttttcgcggtcgtcgggggcgcggcggtagagcgcgaggtcgggtagggggttagattcggagtcgaggcgcgttcgatagtcgtagcgtttatggcgggcggaggagtcggggatttcggtttgggggcggtcgtcgttttagcgttcgagattcgcgagtatttttttaaggtgttggtgatcggcgagtttggcgtgggtaagattagtattattaagcgttacgtttattagttttttttttagtattatcgggttattatcggggtggatttcgtttttaaggttttt

SEQ ID NO: 21438 - DNA, 591 bp, Artificial Sequence
  chemically treated genomic DNA (Homo sapiens) CpG-island No: 21438
aaaaaccttaaaaacgaaatccaccccgataataacccgataatactaaaaaaaaaactaataaacgtaacgcttaataatactaatcttacccacgccaaactcgccgatcaccaacaccttaaaaaaatactcgcgaatctcgaacgctaaaacgacgaccgcccccaaaccgaaatccccgactcctccgcccgccataaacgctacgactatcgaacgcgcctcgactccgaatctaaccccctacccgacctcgcgctctaccgccgcgcccccgacgaccgcgaaaactcccccgaaaccgaccaaccctccgccgcgcccgctaacgccgcctaaccgatcacaaaacccaaaacccgccaatactcgcgacccgaacgaaaccaaacgaaaacaaaaccgaacgaaaacaaaacctaacgccgacttaaaaaaaaccctacgcgaaacgactcccgccctacgcctctaaaacccgaccgaacccaactaaacttcctctcccgaacgacgcctccgaaacccgaccgaacccaactaaacttcctctcccgaacgacgcctcctaacgatcgcgacgcgaaa

SEQ ID NO: 21439 - DNA, 591 bp, Artificial Sequence
  chemically treated genomic DNA (Homo sapiens) CpG-island No: 21439
gaggattttgagggcgaagtttatttcgatggtggttcggtagtgttgggagaagagttggtggacgtagcgtttgatgatgttggttttgtttacgttaagttcgtcgattattagtattttgaagaggtgttcgcgggtttcgggcgttggggcggcggtcgtttttaggtcggggttttcggttttttcgttcgttatgagcgttgcggttgtcgggcgcgtttcgatttcgagtttggttttttgttcggtttcgcgttttgtcgtcgcgttttcggcggtcgcggaaattttttcgaggtcggttagtttttcgtcgcgttcgttgacgtcgtttgatcggttataggatttagaattcgttagtgttcgcggttcgggcggggttagacgagggtagggtcggacgagggtagggtttggcgtcggtttggggaggattttgcgcgaggcggttttcgttttgcgtttttgaagttcggtcgggtttaattggattttttttttcgggcggcgttttcgaagttcggtcgggtttagttggattttttttttcgggcggcgttttttggcggtcgcggcgcggag

SEQ ID NO: 21440 - DNA, 591 bp, Artificial Sequence
  chemically treated genomic DNA (Homo sapiens) CpG-island No: 21440
ctccgcgccgcgaccgccaaaaaacgccgcccgaaaaaaaaaatccaactaaacccgaccgaacttcgaaaacgccgcccgaaaaaaaaaatccaattaaacccgaccgaacttcaaaaacgcaaaacgaaaaccgcctcgcgcaaaatcctccccaaaccgacgccaaaccctaccctcgtccgaccctaccctcgtctaaccccgcccgaaccgcgaacactaacgaattctaaatcctataaccgatcaaacgacgtcaacgaacgcgacgaaaaactaaccgacctcgaaaaaatttccgcgaccgccgaaaacgcgacgacaaaacgcgaaaccgaacaaaaaaccaaactcgaaatcgaaacgcgcccgacaaccgcaacgctcataacgaacgaaaaaaccgaaaaccccgacctaaaaacgaccgccgccccaacgcccgaaacccgcgaacacctcttcaaaatactaataatcgacgaacttaacgtaaacaaaaccaacatcatcaaacgctacgtccaccaactcttctcccaacactaccgaaccaccatcgaaataaacttcgccctcaaaatcctc

SEQ ID NO: 21441 - DNA, 534 bp, Artificial Sequence
  chemically treated genomic DNA (Homo sapiens) CpG-island No: 21441
aagcggtttcgtttcgggtttatttcgaggtttggtttaatcgcgtttcggtagttttcggaataggagcgttgcgagacggtcggttttaagtgggtttgggcgcgggggagaggcgggtttgttttcgggaattgtaaggttttgtgagcgggaggattgggatttcggtcgcggttgttggaagcgtcgaagtttagcggggtcgcggatattgatttgtgtttagaatttattttggttcgtagagtttgtcgcgagtttttggcgttttttgtggcgggtttttggagttattttttcgagcggaagttagttcgcggttcggatttcggcgggatttgttcggaggaatggcgtcgtcgggtgaggagttgcgcgtggttttggggagagggttgtcgttcgcgggaggttattagtcgtcgttcgagagtcggttaggcgggattttttttttttgcgggataggggtatgggtataagttttggttggggcgttttcggatcgagggttcgaaggagggttgcgag

SEQ ID NO: 21442 - DNA, 534 bp, Artificial Sequence
  chemically treated genomic DNA (Homo sapiens) CpG-island No: 21442
ctcgcaaccctccttcgaaccctcgatccgaaaacgccccaaccaaaacttatacccatacccctatcccgcaaaaaaaaaaaatcccgcctaaccgactctcgaacgacgactaataacctcccgcgaacgacaaccctctccccaaaaccacgcgcaactcctcacccgacgacgccattcctccgaacaaatcccgccgaaatccgaaccgcgaactaacttccgctcgaaaaaataactccaaaaacccgccacaaaaaacgccaaaaactcgcgacaaactctacgaaccaaaataaattctaaacacaaatcaatatccgcgaccccgctaaacttcgacgcttccaacaaccgcgaccgaaatcccaatcctcccgctcacaaaaccttacaattcccgaaaacaaacccgcctctcccccgcgcccaaacccacttaaaaccgaccgtctcgcaacgctcctattccgaaaactaccgaaacgcgattaaaccaaacctcgaaataaacccgaaacgaaaccgctt

SEQ ID NO: 21443 - DNA, 534 bp, Artificial Sequence
  chemically treated genomic DNA (Homo sapiens) CpG-island No: 21443
ttcgtagttttttttcggattttcgattcgagagcgttttagttagagtttgtgtttatgtttttgtttcgtaggggaaggggatttcgtttggtcggttttcgagcggcgattagtaatttttcgcgggcgatagttttttttttaaagttacgcgtaattttttattcggcggcgttattttttcgagtaggtttcgtcggagttcgagtcgcgggttgattttcgttcgggaaagtggttttaagagttcgttataggggacgttagggattcgcggtaggttttgcgggttaggatgagttttaagtataggttagtgttcgcggtttcgttgagtttcgacgtttttagtagtcgcggtcgggattttagttttttcgtttatagggttttgtagttttcgaggatagattcgtttttttttcgcgtttaggtttatttggaatcgatcgtttcgtaacgtttttatttcgggagttatcgggacgcggttgggttaggtttcggggtgggttcgagacggggtcgttt

SEQ ID NO: 21444 - DNA, 534 bp, Artificial Sequence
  chemically treated genomic DNA (Homo sapiens) CpG-island No: 21444
aaacgaccccgtctcgaacccaccccgaaacctaacccaaccgcgtcccgataactcccgaaataaaaacgttacgaaacgatcgattccaaataaacctaaacgcgaaaaaaaaacgaatctatcctcgaaaactacaaaaccctataaacgaaaaaactaaaatcccgaccgcgactactaaaaacgtcgaaactcaacgaaaccgcgaacactaacctatacttaaaactcatcctaacccgcaaaacctaccgcgaatccctaacgtcccctataacgaactcttaaaaccactttcccgaacgaaaatcaacccgcgactcgaactccgacgaaacctactcgaaaaaataacgccgccgaataaaaaattacgcgtaactttaaaaaaaaaactatcgcccgcgaaaaattactaatcgccgctcgaaaaccgaccaaacgaaatccccttcccctacgaaacaaaaacataaacacaaactctaactaaaacgctctcgaatcgaaaatccgaaaaaaaactacgaa

SEQ ID NO: 21445 - DNA, 736 bp, Artificial Sequence
  chemically treated genomic DNA (Homo sapiens) CpG-island No: 21445
ttgacgttatttgcggtagtcggggtcggtcggtatttttgttttagagttcgtagttcgtttgtcgggttttatcgaagtttcgtcgttgtttgaaaggtcggtttgagggtatcgcgcgggttcggttgggcgcgtaggtcggggttttggggcgcggggatgtgtttgcggtttgggggtttcgggggtttcgcgtttcgcgtttaagggtttcggggttcgcgttgagtacggcggttgcggttgcgggaggtaattcgttcggtgacgttaggttataatattttttaaaggggaggttagtgcgtcgtttttattgggtcgacgtataattcgttcgttcggattcgtgacgttacggcgtagagagtttgggttcgcggatcgggacgcgaggggcggggtttttgggcgcgttatagtttcgtgacgttatgggtagcgcgggagtttttttcgtagttcgaatttaaggtaaggttcggagggcggtggggtcgttttaggtcgatggagcgggcgggttaggttgtagttttacggtattatttttcgtttttatcgagtttgtgttaggattgacgcggttttgggcgtcgtgggaaatagtcggagttaaaggttcggcgtttttacggggtttagggcgagagaagggagaaggtgcgggaggtatagttagatataggatagaataggatgttagaaatgaacgtttaggtttgaaaaagaa

SEQ ID NO: 21446 - DNA, 736 bp, Artificial Sequence
  chemically treated genomic DNA (Homo sapiens) CpG-island No: 21446
ttctttttcaaacctaaacgttcatttctaacatcctattctatcctatatctaactatacctcccgcaccttctcccttctctcgccctaaaccccgtaaaaacgccgaacctttaactccgactatttcccacgacgcccaaaaccgcgtcaatcctaacacaaactcgataaaaacgaaaaataataccgtaaaactacaacctaacccgcccgctccatcgacctaaaacgaccccaccgccctccgaaccttaccttaaattcgaactacgaaaaaaactcccgcgctacccataacgtcacgaaactataacgcgcccaaaaaccccgcccctcgcgtcccgatccgcgaacccaaactctctacgccgtaacgtcacgaatccgaacgaacgaattatacgtcgacccaataaaaacgacgcactaacctcccctttaaaaaatattataacctaacgtcaccgaacgaattacctcccgcaaccgcaaccgccgtactcaacgcgaaccccgaaacccttaaacgcgaaacgcgaaacccccgaaacccccaaaccgcaaacacatccccgcgccccaaaaccccgacctacgcgcccaaccgaacccgcgcgataccctcaaaccgacctttcaaacaacgacgaaacttcgataaaacccgacaaacgaactacgaactctaaaacaaaaataccgaccgaccccgactaccgcaaataacgtcaa

SEQ ID NO: 21447 - DNA, 736 bp, Artificial Sequence
  chemically treated genomic DNA (Homo sapiens) CpG-island No: 21447
tttttttttaaatttgggcgtttatttttagtattttgttttattttgtgtttgattgtgtttttcgtatttttttttttttttcgttttaagtttcgtgaaggcgtcgggtttttggtttcggttgttttttacggcgtttagaatcgcgttagttttgatatagattcggtgagggcgggaagtggtgtcgtggggttgtagtttggttcgttcgttttatcggtttagggcggttttatcgtttttcgggttttattttgagttcgggttgcgggagaagttttcgcgttgtttatgacgttacgggattgtgacgcgtttagaagtttcgtttttcgcgtttcggttcgcggatttaggttttttgcgtcgtgacgttacgggttcgggcgggcgggttgtgcgtcggtttaatgggagcggcgtattggttttttttttaaggaatgttgtgatttgacgttatcgggcgagttatttttcgtagtcgtagtcgtcgtgtttagcgcgagtttcggagtttttgagcgcgaggcgcggagttttcggagtttttaaatcgtagatatattttcgcgttttagagtttcggtttgcgcgtttagtcgggttcgcgcgatgtttttagatcggttttttaagtagcggcggagtttcggtgaggttcggtaggcgagttgcgagttttggggtaggggtgtcggtcgatttcgattgtcgtaggtgacgttag

SEQ ID NO: 21448 - DNA, 736 bp, Artificial Sequence
  chemically treated genomic DNA (Homo sapiens) CpG-island No: 21448
ctaacgtcacctacgacaatcgaaatcgaccgacacccctaccccaaaactcgcaactcgcctaccgaacctcaccgaaactccgccgctacttaaaaaaccgatctaaaaacatcgcgcgaacccgactaaacgcgcaaaccgaaactctaaaacgcgaaaatatatctacgatttaaaaactccgaaaactccgcgcctcgcgctcaaaaactccgaaactcgcgctaaacacgacgactacgactacgaaaaataactcgcccgataacgtcaaatcacaacattccttaaaaaaaaaaccaatacgccgctcccattaaaccgacgcacaacccgcccgcccgaacccgtaacgtcacgacgcaaaaaacctaaatccgcgaaccgaaacgcgaaaaacgaaacttctaaacgcgtcacaatcccgtaacgtcataaacaacgcgaaaacttctcccgcaacccgaactcaaaataaaacccgaaaaacgataaaaccgccctaaaccgataaaacgaacgaaccaaactacaaccccacgacaccacttcccgccctcaccgaatctatatcaaaactaacgcgattctaaacgccgtaaaaaacaaccgaaaccaaaaacccgacgccttcacgaaacttaaaacgaaaaaaaaaaaaaaatacgaaaaacacaatcaaacacaaaataaaacaaaatactaaaaataaacgcccaaatttaaaaaaaaa

SEQ ID NO: 21449 - DNA, 562 bp, Artificial Sequence
  chemically treated genomic DNA (Homo sapiens) CpG-island No: 21449
tattcgtttttgtagtcgcgttatcggttcgtagtttggttcgtaggtgaggcgtgaataggtaatcgtatttgttcggttagttttatttgttgcgttttcgtattcggttttttttttttattatttcggtcggcgcggttcgtttttttggaatcggggtgttacgtttcgatttatttgcgcgattttagtttcggacgttcgcgtttttcgcggcgtgtttttgggtcgtttcgggcgggtaggttgcggtttcgcgttcgtattttttcggttgtcggaggttgcgggtttagcgggaagtttcggcgttgttcggttcgtcgttttcgatcggttttattgtgacgcgacgcgtttcgttggttaatgggcgttcggcggcgcgaatcgttgattaagttcgcgggtggaggaggaggggacggggcggaggtagggcgcggaggcggttattacggtggtggcggtagtagtggcggaggaggatgtagagggaggaagaggaggaagaggttgtagtcgtttcggtagttgtttttgttgtgaattttttagt

SEQ ID NO: 21450 - DNA, 562 bp, Artificial Sequence
  chemically treated genomic DNA (Homo sapiens) CpG-island No: 21450
actaaaaaattcacaacaaaaacaactaccgaaacgactacaacctcttcctcctcttcctccctctacatcctcctccgccactactaccgccaccaccgtaataaccgcctccgcgccctacctccgccccgtcccctcctcctccacccgcgaacttaatcaacgattcgcgccgccgaacgcccattaaccaacgaaacgcgtcgcgtcacaataaaaccgatcgaaaacgacgaaccgaacaacgccgaaacttcccgctaaacccgcaacctccgacaaccgaaaaaatacgaacgcgaaaccgcaacctacccgcccgaaacgacccaaaaacacgccgcgaaaaacgcgaacgtccgaaactaaaatcgcgcaaataaatcgaaacgtaacaccccgattccaaaaaaacgaaccgcgccgaccgaaataataaaaaaaaaaaaccgaatacgaaaacgcaacaaataaaactaaccgaacaaatacgattacctattcacgcctcacctacgaaccaaactacgaaccgataacgcgactacaaaaacgaata

SEQ ID NO: 21451 - DNA, 562 bp, Artificial Sequence
  chemically treated genomic DNA (Homo sapiens) CpG-island No: 21451
gttgaaaaatttatagtaggagtagttatcgaagcgattgtagttttttttttttttttttttttttatattttttttcgttattgttatcgttattatcgtggtagtcgttttcgcgttttgttttcgtttcgttttttttttttttattcgcgaatttagttagcggttcgcgtcgtcgagcgtttattggttagcggaacgcgtcgcgttataatggagtcggtcggaggcggcgagtcggatagcgtcggggtttttcgttgagttcgtagttttcggtagtcgggaaagtgcgggcgcggggtcgtagtttgttcgttcggagcggtttaggagtacgtcgcggggagcgcgggcgttcggggttggagtcgcgtaggtaggtcggagcgtgatatttcggttttaggagggcgagtcgcgtcgatcgaggtggtggaggaggaggatcggatacggggacgtagtaggtggggttggtcgaataggtgcggttatttgtttacgttttatttgcgagttaggttgcgggtcggtagcgcggttgtagagacgagtg

SEQ ID NO: 21452 - DNA, 562 bp, Artificial Sequence
  chemically treated genomic DNA (Homo sapiens) CpG-island No: 21452
cactcgtctctacaaccgcgctaccgacccgcaacctaactcgcaaataaaacgtaaacaaataaccgcacctattcgaccaaccccacctactacgtccccgtatccgatcctcctcctccaccacctcgatcgacgcgactcgccctcctaaaaccgaaatatcacgctccgacctacctacgcgactccaaccccgaacgcccgcgctccccgcgacgtactcctaaaccgctccgaacgaacaaactacgaccccgcgcccgcactttcccgactaccgaaaactacgaactcaacgaaaaaccccgacgctatccgactcgccgcctccgaccgactccattataacgcgacgcgttccgctaaccaataaacgctcgacgacgcgaaccgctaactaaattcgcgaataaaaaaaaaaaaaacgaaacgaaaacaaaacgcgaaaacgactaccacgataataacgataacaataacgaaaaaaaatataaaaaaaaaaaaaaaaaaaaaaaactacaatcgcttcgataactactcctactataaatttttcaac

SEQ ID NO: 21453 - DNA, 580 bp, Artificial Sequence
  chemically treated genomic DNA (Homo sapiens) CpG-island No: 21453
ggggggggggatatggaaaatcgagaaaggggaatgggggcgagggggaggggtagggaaaaaagaaaaacgacgggggataaacgttagaaaagtcgcggcggggggaggaaaggagaggagggggcgggaaggaaaaaggaggggaaaaagggggggaatcgagggggggaaaaaaagggaggggaaagaagaagaggagcgagcgaacgatggggggggagggggggaacggacgggaaaaaaaaaggggcgaaagaggaaggaaaggcgattaaagagggggaaattaagagaaggggggggggggaaaaaaagaggggaaagggggcgcgggaaaagaatgggggattaggagaaggggaaaaataggggggggttcgggggcgggggagtgaggggaataaaggggggggacgggatgagtgagcgtaggttgaaatagttaatacgggggtaaaaaaggcgggtacgggtaaagggacgcggttttaaaatagggggggggagattatatagttaagggggttaggggtgtggcgggttgcgaaaaagagaatgattaaggtgattaagtcga

SEQ ID NO: 21454 - DNA, 580 bp, Artificial Sequence
  chemically treated genomic DNA (Homo sapiens) CpG-island No: 21454
tcgacttaatcaccttaatcattctctttttcgcaacccgccacacccctaacccccttaactatataatctccccccccctattttaaaaccgcgtccctttacccgtacccgccttttttacccccgtattaactatttcaacctacgctcactcatcccgtcccccccctttattcccctcactcccccgcccccgaacccccccctatttttccccttctcctaatcccccattcttttcccgcgccccctttcccctctttttttccccccccccccttctcttaatttccccctctttaatcgcctttccttcctctttcgcccctttttttttcccgtccgttccccccctccccccccatcgttcgctcgctcctcttcttctttcccctccctttttttccccccctcgattccccccctttttcccctcctttttccttcccgccccctcctctcctttcctccccccgccgcgacttttctaacgtttatcccccgtcgtttttcttttttccctacccctccccctcgcccccattcccctttctcgattttccatatcccccccccc

SEQ ID NO: 21455 - DNA, 580 bp, Artificial Sequence
  chemically treated genomic DNA (Homo sapiens) CpG-island No: 21455
tcgatttaattattttggttattttttttttcgtaattcgttatatttttgatttttttggttgtatgatttttttttttttattttggggtcgcgtttttttattcgtattcgttttttttgttttcgtgttggttattttagtttgcgtttatttatttcgttttttttttttattttttttattttttcgttttcgggtttttttttattttttttttttttttaattttttatttttttttcgcgttttttttttttttttttttttttttttttttttttttttggtttttttttttttggtcgttttttttttttttttcgtttttttttttttttcgttcgttttttttttttttttttatcgttcgttcgttttttttttttttttttttttttttttttttttttttcggttttttttttttttttttttttttttttttttcgttttttttttttttttttttttttcgtcgcggtttttttggcgtttgtttttcgtcgttttttttttttttttgtttttttttttcgtttttatttttttttttcggttttttatgttttttttttt

SEQ ID NO: 21456 - DNA, 580 bp, Artificial Sequence
  chemically treated genomic DNA (Homo sapiens) CpG-island No: 21456
aaaaaaaaaaacataaaaaaccgaaaaaaaaaaataaaaacgaaaaaaaaaaacaaaaaaaaaaaaaaaacgacgaaaaacaaacgccaaaaaaaccgcgacgaaaaaaaaaaaaaaaaaaaaaaaacgaaaaaaaaaaaaaaaaaaaaaaaaaaaaaaaaccgaaaaaaaaaaaaaaaaaaaaaaaaaaaaaaaaaaaaaacgaacgaacgataaaaaaaaaaaaaaaaaacgaacgaaaaaaaaaaaaaaacgaaaaaaaaaaaaaaaacgaccaaaaaaaaaaaaaccaaaaaaaaaaaaaaaaaaaaaaaaaaaaaaaaaaaaaaaacgcgaaaaaaaaataaaaaattaaaaaaaaaaaaaaaataaaaaaaaacccgaaaacgaaaaaataaaaaaaataaaaaaaaaaaacgaaataaataaacgcaaactaaaataaccaacacgaaaacaaaaaaaacgaatacgaataaaaaaacgcgaccccaaaataaaaaaaaaaaaatcatacaaccaaaaaaatcaaaaatataacgaattacgaaaaaaaaaataaccaaaataattaaatcga

SEQ ID NO: 21457 - DNA, 661 bp, Artificial Sequence
  chemically treated genomic DNA (Homo sapiens) CpG-island No: 21457
gcgggaaggtcgggttgtggttattggcgtttaggatatatacgttgaagatagtcgtggcggagcgtagcgggcggttatcgtttagggttattagttttaggttgtcggcggtttggttttcgcggtttagtttttgtagtagtattaggttcgtatattgagcgtcgttcgcgcgtttttgtagttttacgcgaaaaggggttgtgcggttgggttaggcgtacgttttgtagtttattggtgtttacgttttagtttatcggtatttttagggtgcgtgtatacggtcgtatttttaaatatttttatcgggatttgggttcgggggaagcgcggcgcgtggtcgttgatattttttatttttatttttacgtgtattagtaggaattgtttttgcgagaagttgattacgtcgaagattagtacgtattgcggggtttggtcgtatagcgtttcgtagtttaggtcggtgttttcgacggttagttgttcgtagttttcgcgtattcggagtagagagttgttgaattgttttattagttgaaattgatttggtatttcgcgttgcgaattaaattggacgtgattagataaaatatcgacgttggtgttaggggtgttttttttataggtgaggaaattgatagtatcggtataa

SEQ ID NO: 21458 - DNA, 661 bp, Artificial Sequence
  chemically treated genomic DNA (Homo sapiens) CpG-island No: 21458
ttataccgatactatcaatttcctcacctataaaaaaaacacccctaacaccaacgtcgatattttatctaatcacgtccaatttaattcgcaacgcgaaataccaaatcaatttcaactaataaaacaattcaacaactctctactccgaatacgcgaaaactacgaacaactaaccgtcgaaaacaccgacctaaactacgaaacgctatacgaccaaaccccgcaatacgtactaatcttcgacgtaatcaacttctcgcaaaaacaattcctactaatacacgtaaaaataaaaataaaaaatatcaacgaccacgcgccgcgcttcccccgaacccaaatcccgataaaaatatttaaaaatacgaccgtatacacgcaccctaaaaataccgataaactaaaacgtaaacaccaataaactacaaaacgtacgcctaacccaaccgcacaaccccttttcgcgtaaaactacaaaaacgcgcgaacgacgctcaatatacgaacctaatactactacaaaaactaaaccgcgaaaaccaaaccgccgacaacctaaaactaataaccctaaacgataaccgcccgctacgctccgccacgactatcttcaacgtatatatcctaaacgccaataaccacaacccgaccttcccgc

SEQ ID NO: 21459 - DNA, 661 bp, Artificial Sequence
  chemically treated genomic DNA (Homo sapiens) CpG-island No: 21459
ttgtatcgatattgttaatttttttatttgtgaggaagatatttttggtattagcgtcggtgttttgtttgattacgtttagtttaattcgtagcgcgaggtgttaagttagttttagttgatgaaataatttaatagttttttgtttcgggtgcgcgagggttacgggtagttgatcgtcggggatatcggtttggattgcgaggcgttgtgcggttaggtttcgtagtgcgtgttggttttcgacgtggttagtttttcgtaggaatagtttttgttggtgtacgtggaggtggaggtgaggaatgttaacgattacgcgtcgcgtttttttcgggtttagatttcggtggagatgtttgagggtgcggtcgtgtgtacgtattttggaggtgtcggtggattaggacgtgggtattaatgggttgtagagcgtgcgtttggtttaatcgtatagttttttttcgcgtggagttgtagaagcgcgcggacggcgtttagtgtgcggatttggtgttgttgtaggagttggatcgcgagagttaggtcgtcgatagtttggagttggtggttttggacggtggtcgttcgttgcgtttcgttacggttgtttttaacgtgtgtgttttggacgttaatgattatagttcggttttttcgt

SEQ ID NO: 21460 - DNA, 661 bp, Artificial Sequence
  chemically treated genomic DNA (Homo sapiens) CpG-island No: 21460
acgaaaaaaccgaactataatcattaacgtccaaaacacacacgttaaaaacaaccgtaacgaaacgcaacgaacgaccaccgtccaaaaccaccaactccaaactatcgacgacctaactctcgcgatccaactcctacaacaacaccaaatccgcacactaaacgccgtccgcgcgcttctacaactccacgcgaaaaaaaactatacgattaaaccaaacgcacgctctacaacccattaatacccacgtcctaatccaccgacacctccaaaatacgtacacacgaccgcaccctcaaacatctccaccgaaatctaaacccgaaaaaaacgcgacgcgtaatcgttaacattcctcacctccacctccacgtacaccaacaaaaactattcctacgaaaaactaaccacgtcgaaaaccaacacgcactacgaaacctaaccgcacaacgcctcgcaatccaaaccgatatccccgacgatcaactacccgtaaccctcgcgcacccgaaacaaaaaactattaaattatttcatcaactaaaactaacttaacacctcgcgctacgaattaaactaaacgtaatcaaacaaaacaccgacgctaataccaaaaatatcttcctcacaaataaaaaaattaacaatatcgatacaa

SEQ ID NO: 21461 - DNA, 666 bp, Artificial Sequence
  chemically treated genomic DNA (Homo sapiens) CpG-island No: 21461
atagcgcgcggattgagtcgagggcggacgttacggtttggtttgggtcgggcgtttaatagattaatatcgtcgtttatttgagggacgttagacgagttttagagtcgatcgcggcgtttcggtcgttcggcgtttgcgtagtgaagatcgcggcgagtcgcgcgtatgcgtgtaggttcggagttttaggcgttggcggggtagaaacgcggcgttttgcgttttttggtttcgaggttggtttttatcgttttcgtttcggcggaagtgaggaggagggtttttcgattcgtgttgagttggatggatcgcgagacgcgcgttttcgtcgatagttattttcgaggtttgggggtcgatgttttcggcgtcggttaggtttcgggtcgggtagttttcgtttcggagtcgggcgtttttttttacgtcgattttgtgcggggttttttgttgtttaatttgttttgcgtgttttttagcgtttttacgtagggttggggtagtcggcggcgttgggtgacgttcgcggggaggttcgatttcgattatttgttacggatttacggtggggcggcggtcgtagatttcgggcggggaggaaaggtcggcgggatttaggttcgggaggttttcgtttagagaggggtattagggagggtgagg

SEQ ID NO: 21462 - DNA, 666 bp, Artificial Sequence
  chemically treated genomic DNA (Homo sapiens) CpG-island No: 21462
cctcaccctccctaatacccctctctaaacgaaaacctcccgaacctaaatcccgccgacctttcctccccgcccgaaatctacgaccgccgccccaccgtaaatccgtaacaaataatcgaaatcgaacctccccgcgaacgtcacccaacgccgccgactaccccaaccctacgtaaaaacgctaaaaaacacgcaaaacaaattaaacaacaaaaaaccccgcacaaaatcgacgtaaaaaaaaacgcccgactccgaaacgaaaactacccgacccgaaacctaaccgacgccgaaaacatcgacccccaaacctcgaaaataactatcgacgaaaacgcgcgtctcgcgatccatccaactcaacacgaatcgaaaaaccctcctcctcacttccgccgaaacgaaaacgataaaaaccaacctcgaaaccaaaaaacgcaaaacgccgcgtttctaccccgccaacgcctaaaactccgaacctacacgcatacgcgcgactcgccgcgatcttcactacgcaaacgccgaacgaccgaaacgccgcgatcgactctaaaactcgtctaacgtccctcaaataaacgacgatattaatctattaaacgcccgacccaaaccaaaccgtaacgtccgccctcgactcaatccgcgcgctat

SEQ ID NO: 21463 - DNA, 666 bp, Artificial Sequence
  chemically treated genomic DNA (Homo sapiens) CpG-island No: 21463
ttttattttttttggtgtttttttttaggcgggggtttttcgggtttgggtttcgtcggtttttttttttcgttcggggtttgcggtcgtcgttttatcgtaggttcgtagtaggtggtcgaagtcgggttttttcgcgggcgttatttagcgtcgtcggttgttttagttttgcgtgaaggcgttggaaaatacgtagggtaggttgggtagtaagaagtttcgtataaagtcggcgtaggagaaggcgttcggtttcgagacgaaggttattcggttcggagtttggtcgacgtcggggatatcgatttttaggtttcggaagtggttgtcggcgagggcgcgcgtttcgcggtttatttagtttagtacgggtcgaaggatttttttttttattttcgtcggagcggaaacggtgaggattagtttcggaattagaagacgtagggcgtcgcgtttttgtttcgttagcgtttggggtttcgggtttgtacgtatgcgcgcggttcgtcgcggtttttattgcgtaggcgtcgagcggtcgaggcgtcgcggtcggttttgggattcgtttggcgttttttaggtgagcgacggtgttggtttgttgggcgttcggtttaagttaagtcgtagcgttcgttttcggtttagttcgcgcgttgt

SEQ ID NO: 21464 - DNA, 666 bp, Artificial Sequence
  chemically treated genomic DNA (Homo sapiens) CpG-island No: 21464
acaacgcgcgaactaaaccgaaaacgaacgctacgacttaacttaaaccgaacgcccaacaaaccaacaccgtcgctcacctaaaaaacgccaaacgaatcccaaaaccgaccgcgacgcctcgaccgctcgacgcctacgcaataaaaaccgcgacgaaccgcgcgcatacgtacaaacccgaaaccccaaacgctaacgaaacaaaaacgcgacgccctacgtcttctaattccgaaactaatcctcaccgtttccgctccgacgaaaataaaaaaaaaaatccttcgacccgtactaaactaaataaaccgcgaaacgcgcgccctcgccgacaaccacttccgaaacctaaaaatcgatatccccgacgtcgaccaaactccgaaccgaataaccttcgtctcgaaaccgaacgccttctcctacgccgactttatacgaaacttcttactacccaacctaccctacgtattttccaacgccttcacgcaaaactaaaacaaccgacgacgctaaataacgcccgcgaaaaaacccgacttcgaccacctactacgaacctacgataaaacgacgaccgcaaaccccgaacgaaaaaaaaaaaccgacgaaacccaaacccgaaaaacccccgcctaaaaaaaaacaccaaaaaaaataaaa

SEQ ID NO: 21465 - DNA, 984 bp, Artificial Sequence
  chemically treated genomic DNA (Homo sapiens) CpG-island No: 21465
cgcggaagatttataggcgtaggcgtagacgggtgcgcgtttttagggtgcgcgcgagttaagatcgcggttcggggtagggtgttttcggtttcgttttttgtagttttatcggagttagcgcgtttgcgtcgcgggcgtacggtgggcggagttttcggcgttttcgttttttattcggcgtgtttcgcgttcggaggcgttgacgtggtcgtcgttagagtcgttattttgtgggagtaaaattaacgtttggttcggagtagtagtttttgaggtgagggcgaggggcgcgggtcggtgtgggtcgtagagacgttggagtcggcgggggttggggattggtttcggggcgatttgaggttcgcgaagggtacgtcgattttcgcggcggcggcggcgatagggtcgggtcgggggcggacgtagacgggtcgggttgaggttggggttcggtcggagtcggggttgggcggacgggcgggtcggtgagtttttcgtattttttataggttttcgaagtcgttcgcggtcgtttgtttttttttgtttgtttttgttttcgttcgtcgttcggaagttcgtttggacgtcgggtttttttttaggaaatttgggttttttgtttttttcgtttttgtttttttcgtttttcgaggtcgttcgcgcgtggacggttgggattagcggtcgcgggggtcggtgggggtcgtggggttttttttattcgagtataggcgagcgagcggtattcgggcggattttcgtttcggggatcgggaaattgaggttcgggcggtttgagacgtcgttaaggttatgtaggtggtgggggtttgtattttcgtttttcgattttatttagttcgtgtttgttgtgaagacggtatcgggttaggggtggtgagagcgggcgggtaggtggataggaatttcgtgtttttttttgtttgttgaacggaatgcgtggattttcgggggagt

SEQ ID NO: 21466 - DNA, 984 bp, Artificial Sequence
  chemically treated genomic DNA (Homo sapiens) CpG-island No: 21466
actcccccgaaaatccacgcattccgttcaacaaacaaaaaaaaacacgaaattcctatccacctacccgcccgctctcaccacccctaacccgataccgtcttcacaacaaacacgaactaaataaaatcgaaaaacgaaaatacaaacccccaccacctacataaccttaacgacgtctcaaaccgcccgaacctcaatttcccgatccccgaaacgaaaatccgcccgaataccgctcgctcgcctatactcgaataaaaaaaaccccacgacccccaccgacccccgcgaccgctaatcccaaccgtccacgcgcgaacgacctcgaaaaacgaaaaaaacaaaaacgaaaaaaacaaaaaacccaaatttcctaaaaaaaaacccgacgtccaaacgaacttccgaacgacgaacgaaaacaaaaacaaacaaaaaaaaacaaacgaccgcgaacgacttcgaaaacctataaaaaatacgaaaaactcaccgacccgcccgtccgcccaaccccgactccgaccgaaccccaacctcaacccgacccgtctacgtccgcccccgacccgaccctatcgccgccgccgccgcgaaaatcgacgtacccttcgcgaacctcaaatcgccccgaaaccaatccccaacccccgccgactccaacgtctctacgacccacaccgacccgcgcccctcgccctcacctcaaaaactactactccgaaccaaacgttaattttactcccacaaaataacgactctaacgacgaccacgtcaacgcctccgaacgcgaaacacgccgaataaaaaacgaaaacgccgaaaactccgcccaccgtacgcccgcgacgcaaacgcgctaactccgataaaactacaaaaaacgaaaccgaaaacaccctaccccgaaccgcgatcttaactcgcgcgcaccctaaaaacgcgcacccgtctacgcctacgcctataaatcttccgcg

SEQ ID NO: 21467 - DNA, 984 bp, Artificial Sequence
  chemically treated genomic DNA (Homo sapiens) CpG-island No: 21467
gttttttcggaggtttacgtatttcgtttagtagatagggaagggtacggggtttttgtttatttgttcgttcgtttttattatttttgattcggtatcgtttttatagtaaatacgaattggatggagtcgggaggcgaagatgtaagtttttattatttatatgattttgacggcgttttaggtcgttcgagttttagtttttcggttttcgaggcgggggttcgttcggatgtcgttcgttcgtttgtattcgggtgggggaggttttacgatttttatcggttttcgcggtcgttaattttaatcgtttacgcgcgggcggtttcgggaaacgagaaaggtagaggcgagggaagtaggaagtttaggttttttggagaagagttcggcgtttaagcggattttcgggcgacgggcgggggtagggataggtagaggaggataagcggtcgcgagcgatttcgggaatttgtgaggggtgcgaggagtttatcgattcgttcgttcgtttagtttcgatttcggtcgggttttagttttagttcggttcgtttgcgttcgttttcggttcggttttgtcgtcgtcgtcgtcgcgggggtcgacgtgtttttcgcgaattttaagtcgtttcgaggttagtttttagttttcgtcggttttaacgtttttgcggtttatatcggttcgcgtttttcgtttttattttagaggttgttgtttcgagttaggcgttggttttgtttttataagatggcggttttgacggcggttacgttagcgttttcgggcgcggggtacgtcgggtaaggggcggagacgtcgggaatttcgtttatcgtgcgttcgcgacgtaggcgcgttggtttcggtagggttgtagggggcggggtcggggatattttgtttcgggtcgcggttttagttcgcgcgtattttaggggcgcgtattcgtttgcgtttgcgtttgtgagtttttcgcg

SEQ ID NO: 21468 - DNA, 984 bp, Artificial Sequence
  chemically treated genomic DNA (Homo sapiens) CpG-island No: 21468
cgcgaaaaactcacaaacgcaaacgcaaacgaatacgcgcccctaaaatacgcgcgaactaaaaccgcgacccgaaacaaaatatccccgaccccgccccctacaaccctaccgaaaccaacgcgcctacgtcgcgaacgcacgataaacgaaattcccgacgtctccgccccttacccgacgtaccccgcgcccgaaaacgctaacgtaaccgccgtcaaaaccgccatcttataaaaacaaaaccaacgcctaactcgaaacaacaacctctaaaataaaaacgaaaaacgcgaaccgatataaaccgcaaaaacgttaaaaccgacgaaaactaaaaactaacctcgaaacgacttaaaattcgcgaaaaacacgtcgacccccgcgacgacgacgacgacaaaaccgaaccgaaaacgaacgcaaacgaaccgaactaaaactaaaacccgaccgaaatcgaaactaaacgaacgaacgaatcgataaactcctcgcacccctcacaaattcccgaaatcgctcgcgaccgcttatcctcctctacctatccctacccccgcccgtcgcccgaaaatccgcttaaacgccgaactcttctccaaaaaacctaaacttcctacttccctcgcctctacctttctcgtttcccgaaaccgcccgcgcgtaaacgattaaaattaacgaccgcgaaaaccgataaaaatcgtaaaacctcccccacccgaatacaaacgaacgaacgacatccgaacgaacccccgcctcgaaaaccgaaaaactaaaactcgaacgacctaaaacgccgtcaaaatcatataaataataaaaacttacatcttcgcctcccgactccatccaattcgtatttactataaaaacgataccgaatcaaaaataataaaaacgaacgaacaaataaacaaaaaccccgtacccttccctatctactaaacgaaatacgtaaacctccgaaaaaac

SEQ ID NO: 21469 - DNA, 1157 bp, Artificial Sequence
  chemically treated genomic DNA (Homo sapiens) CpG-island No: 21469
cgggatatcgttacgcggtttacggagttattgtagggatatggcgatgaagatagtacggtaggggttcgttttattcgagtaatcgagtttagtgttgtttttttttggaaattcgttcgtattttgcgttttttagttttagtagtcggtttacgttttttttttcggggtcgtttttttttcgtttgtagattttcgcgaagttttgtaggtgcgagagtatagggagcgttcgagtcggttttatatttacggttttttacgcgttttttatttcggggagttatttttttgtttaggttcgtgggttgtttttttacgtttttgtagttattgcgagagggtcggggtaggcgttaggacggacggatttttttttattataggtttttattattttagttttcgtttttagggtttcgttcgcgcgagttttcgtagtttcgttttcgtttagttcgatttttagttttcggtttcggttttattttgtttcggtagcgtcgttttaggtatcgatcgttgtcgttcgcggatatttatagggcggttagtagcgtttcgcgtttcgtttttcgtacggttgttagttttttttcgcggttcgggttcgcgtatggcgttcggtttttggcgtattaggtgaggtcgcggtttttttgttagcggtttatcggcgttattagcgagttgtttgcggacgtagacgttgtgagtttagcgttcgttcgggatttcggagttcggagttcggagttcgtttatcgcgcgtatttatttaggtagttttttcgttgtttgttagtttttacgtttttttagttgaattggttttgttcgtcgcgtacgtttttacgattggagtcgaatatggcgtcgggaaggtagttgtttggggtttgcggtttgtaatttgtaattcgtaattcgagattcgttatttattatcgtcggatttaggttcgatttcgttttcgcgtcgcgcgtcgtgacgttattttcgcgtttattcggtttcgtcgcgcgtttttgcgtagcgtattgtttcggatttgtgttttcgcgtattatttttacgtcggttttgggcgtttgcgtattgcgtttattttgtcgggcgcgggaacgtttttgaattggaagtttaaaaatgg

SEQ ID NO: 21470 - DNA, 1157 bp, Artificial Sequence
  chemically treated genomic DNA (Homo sapiens) CpG-island No: 21470
ccatttttaaacttccaattcaaaaacgttcccgcgcccgacaaaataaacgcaatacgcaaacgcccaaaaccgacgtaaaaataatacgcgaaaacacaaatccgaaacaatacgctacgcaaaaacgcgcgacgaaaccgaataaacgcgaaaataacgtcacgacgcgcgacgcgaaaacgaaatcgaacctaaatccgacgataataaataacgaatctcgaattacgaattacaaattacaaaccgcaaaccccaaacaactaccttcccgacgccatattcgactccaatcgtaaaaacgtacgcgacgaacaaaaccaattcaactaaaaaaacgtaaaaactaacaaacaacgaaaaaactacctaaataaatacgcgcgataaacgaactccgaactccgaactccgaaatcccgaacgaacgctaaactcacaacgtctacgtccgcaaacaactcgctaataacgccgataaaccgctaacaaaaaaaccgcgacctcacctaatacgccaaaaaccgaacgccatacgcgaacccgaaccgcgaaaaaaaactaacaaccgtacgaaaaacgaaacgcgaaacgctactaaccgccctataaatatccgcgaacgacaacgatcgatacctaaaacgacgctaccgaaacaaaataaaaccgaaaccgaaaactaaaaatcgaactaaacgaaaacgaaactacgaaaactcgcgcgaacgaaaccctaaaaacgaaaactaaaataataaaaacctataataaaaaaaaatccgtccgtcctaacgcctaccccgaccctctcgcaataactacaaaaacgtaaaaaaacaacccacgaacctaaacaaaaaaataactccccgaaataaaaaacgcgtaaaaaaccgtaaatataaaaccgactcgaacgctccctatactctcgcacctacaaaacttcgcgaaaatctacaaacgaaaaaaaaacgaccccgaaaaaaaaaacgtaaaccgactactaaaactaaaaaacgcaaaatacgaacgaatttccaaaaaaaaacaacactaaactcgattactcgaataaaacgaacccctaccgtactatcttcatcgccatatccctacaataactccgtaaaccgcgtaacgatatcccg

SEQ ID NO: 21471 - DNA, 1157 bp, Artificial Sequence
  chemically treated genomic DNA (Homo sapiens) CpG-island No: 21471
ttatttttaaatttttagtttagaggcgttttcgcgttcggtagggtaggcgtagtgcgtaggcgtttaaagtcgacgtggaggtgatgcgcgggagtatagattcggggtagtgcgttgcgtagaggcgcgcggcgaagtcgagtgggcgcgggagtgacgttacggcgcgcgacgcggaggcggggtcgggtttgggttcgacggtagtgggtagcgggtttcgggttgcgggttgtaggttgtaagtcgtaggttttaggtaattgttttttcggcgttatgttcggttttagtcgtggaggcgtgcgcggcgggtaggattagtttaattgggaggacgtgaagattgataagtagcgggagaattatttgggtgggtgcgcgcggtgggcgggtttcgggtttcgggtttcgggatttcgggcgggcgttggatttatagcgtttacgttcgtaggtaattcgttgatggcgtcggtaggtcgttggtagaagggtcgcgattttatttggtacgttaagggtcgggcgttatgcgcgggttcgagtcgcgaggaggaattggtagtcgtgcgggaggcggagcgcgaggcgttgttggtcgttttgtgagtgttcgcggacggtagcggtcggtgtttgggacggcgttgtcggggtagggtggggtcggggtcggggattgggggtcgggttgggcgggagcggggttgcggggattcgcgcgggcgggattttgaggacgaaggttggagtggtgaggatttgtggtgggaggaggttcgttcgttttgacgtttgtttcggttttttcgtagtggttataagaacgtgaagaagtagtttacgggtttgagtaaggaggtaatttttcggggtggggggcgcgtggagggtcgtgggtgtggggtcgattcgagcgttttttgtgttttcgtatttgtaggatttcgcggaggtttgtaagcgggaaggaggcgatttcgaggagaagggcgtggatcggttgttggggttggggagcgtaaggtgcgggcgggtttttaggggagggtagtattgggttcgattgttcgggtgaggcggatttttgtcgtattgtttttatcgttatgtttttgtagtggtttcgtgggtcgcgtggcgatgtttcg

SEQ ID NO: 21472 - DNA, 1157 bp, Artificial Sequence
  chemically treated genomic DNA (Homo sapiens) CpG-island No: 21472
cgaaacatcgccacgcgacccacgaaaccactacaaaaacataacgataaaaacaatacgacaaaaatccgcctcacccgaacaatcgaacccaatactaccctcccctaaaaacccgcccgcaccttacgctccccaaccccaacaaccgatccacgcccttctcctcgaaatcgcctccttcccgcttacaaacctccgcgaaatcctacaaatacgaaaacacaaaaaacgctcgaatcgaccccacacccacgaccctccacgcgccccccaccccgaaaaattacctccttactcaaacccgtaaactacttcttcacgttcttataaccactacgaaaaaaccgaaacaaacgtcaaaacgaacgaacctcctcccaccacaaatcctcaccactccaaccttcgtcctcaaaatcccgcccgcgcgaatccccgcaaccccgctcccgcccaacccgacccccaatccccgaccccgaccccaccctaccccgacaacgccgtcccaaacaccgaccgctaccgtccgcgaacactcacaaaacgaccaacaacgcctcgcgctccgcctcccgcacgactaccaattcctcctcgcgactcgaacccgcgcataacgcccgacccttaacgtaccaaataaaatcgcgacccttctaccaacgacctaccgacgccatcaacgaattacctacgaacgtaaacgctataaatccaacgcccgcccgaaatcccgaaacccgaaacccgaaacccgcccaccgcgcgcacccacccaaataattctcccgctacttatcaatcttcacgtcctcccaattaaactaatcctacccgccgcgcacgcctccacgactaaaaccgaacataacgccgaaaaaacaattacctaaaacctacgacttacaacctacaacccgcaacccgaaacccgctacccactaccgtcgaacccaaacccgaccccgcctccgcgtcgcgcgccgtaacgtcactcccgcgcccactcgacttcgccgcgcgcctctacgcaacgcactaccccgaatctatactcccgcgcatcacctccacgtcgactttaaacgcctacgcactacgcctaccctaccgaacgcgaaaacgcctctaaactaaaaatttaaaaataa

SEQ ID NO: 21473 - DNA, 504 bp, Artificial Sequence
  chemically treated genomic DNA (Homo sapiens) CpG-island No: 21473
gaggcgttaatttgcggtcgttatagtcgttgcggaggggtttgaggataggcggttttgattttcgttgttcggtggaattaagattagggacgaggttacgtaggagattaaggtatttattgcgttgggtgttgttgcgttgtagtttacgacgttattggtaggcgttgcgtcgcgcggtatgacgtgttttatggtagggagaggtaagagtgggcggtgagatacgaagatatacgtttttgttgggcggggtcggcgcggcgtgatgtaatttcgggggcgggacgaagtttaggtgggcggggtttgcgggggcgttgtggcggtataagaatttaggcggggtcggcgagtaggtgattttcgtttttatcgggaggattagggcgggtcggcgaggtcgagggggattcgcgggtttgagggaggacggagtgggggagtgttgagggaggattcggggtggggagttgagggaggattcgtagggttgaggga

SEQ ID NO: 21474 - DNA, 504 bp, Artificial Sequence
  chemically treated genomic DNA (Homo sapiens) CpG-island No: 21474
tccctcaaccctacgaatcctccctcaactccccaccccgaatcctccctcaacactcccccactccgtcctccctcaaacccgcgaatccccctcgacctcgccgacccgccctaatcctcccgataaaaacgaaaatcacctactcgccgaccccgcctaaattcttataccgccacaacgcccccgcaaaccccgcccacctaaacttcgtcccgcccccgaaattacatcacgccgcgccgaccccgcccaacaaaaacgtatatcttcgtatctcaccgcccactcttacctctccctaccataaaacacgtcataccgcgcgacgcaacgcctaccaataacgtcgtaaactacaacgcaacaacacccaacgcaataaataccttaatctcctacgtaacctcgtccctaatcttaattccaccgaacaacgaaaatcaaaaccgcctatcctcaaacccctccgcaacgactataacgaccgcaaattaacgcctc

SEQ ID NO: 21475 - DNA, 504 bp, Artificial Sequence
  chemically treated genomic DNA (Homo sapiens) CpG-island No: 21475
ttttttagttttgcggatttttttttagttttttatttcgggtttttttttagtatttttttatttcgtttttttttagattcgcgggtttttttcgatttcgtcggttcgttttggttttttcggtagggacggaggttatttgttcgtcggtttcgtttgggtttttgtatcgttatagcgttttcgtaggtttcgtttatttaggtttcgtttcgttttcgagattatattacgtcgcgtcggtttcgtttaataggggcgtatattttcgtgttttatcgtttatttttgtttttttttgttatggaatacgttatatcgcgcgacgtagcgtttgttagtgacgtcgtgggttgtagcgtagtagtatttaacgtagtgagtattttgattttttgcgtggtttcgtttttggttttagttttatcgggtagcgggagttaggatcgtttgtttttagattttttcgtagcgattgtggcggtcgtaggttggcgtttt

SEQ ID NO: 21476 - DNA, 504 bp, Artificial Sequence
  chemically treated genomic DNA (Homo sapiens) CpG-island No: 21476
aaaacgccaacctacgaccgccacaatcgctacgaaaaaatctaaaaacaaacgatcctaactcccgctacccgataaaactaaaaccaaaaacgaaaccacgcaaaaaatcaaaatactcactacgttaaatactactacgctacaacccacgacgtcactaacaaacgctacgtcgcgcgatataacgtattccataacaaaaaaaaacaaaaataaacgataaaacacgaaaatatacgcccctattaaacgaaaccgacgcgacgtaatataatctcgaaaacgaaacgaaacctaaataaacgaaacctacgaaaacgctataacgatacaaaaacccaaacgaaaccgacgaacaaataacctccgtccctaccgaaaaaaccaaaacgaaccgacgaaatcgaaaaaaacccgcgaatctaaaaaaaaacgaaataaaaaaatactaaaaaaaaacccgaaataaaaaactaaaaaaaaatccgcaaaactaaaaaa

SEQ ID NO: 21477 - DNA, 567 bp, Artificial Sequence
  chemically treated genomic DNA (Homo sapiens) CpG-island No: 21477
tttgcgcgtgtttcgtaggttatcgttagttatatgtattttaagtgtaagtgttacgggttgtcgggtagttgcgaggtgaagatatgttggtggtcgtaattcgattttcgcgttatcggtgatttttttaaggataagtacgatagcgtttcggagatggtggtggagaagtatcgggagtttcgcggttgggtggagattttgcggtcgcgttatatttattttaaggtgtttacggagcgcgatttggtttattacgaggtttcgtttaatttttgcgagtttaattttgagacgggttttttcggtacgcgcgatcgtatttgtaacgttagttcgtacggtatcgacggttgcgatttgttgtgttgcggtcgcggttataacgcgcgagcggagcggcgtcgggagaagtgtcgttgcgtgttttattggtgttgttacgttagttgttaggagtgtacgcgcgtttacgacgtgtatatttgtaagtaggtatcggtcgcggttttttttggacggggcgggttttgtttgagggtgggtttttttttgggtggagta

SEQ ID NO: 21478 - DNA, 567 bp, Artificial Sequence
  chemically treated genomic DNA (Homo sapiens) CpG-island No: 21478
tactccacccaaaaaaaaacccaccctcaaacaaaacccgccccgtccaaaaaaaaccgcgaccgatacctacttacaaatatacacgtcgtaaacgcgcgtacactcctaacaactaacgtaacaacaccaataaaacacgcaacgacacttctcccgacgccgctccgctcgcgcgttataaccgcgaccgcaacacaacaaatcgcaaccgtcgataccgtacgaactaacgttacaaatacgatcgcgcgtaccgaaaaaacccgtctcaaaattaaactcgcaaaaattaaacgaaacctcgtaataaaccaaatcgcgctccgtaaacaccttaaaataaatataacgcgaccgcaaaatctccacccaaccgcgaaactcccgatacttctccaccaccatctccgaaacgctatcgtacttatccttaaaaaaatcaccgataacgcgaaaatcgaattacgaccaccaacatatcttcacctcgcaactacccgacaacccgtaacacttacacttaaaatacatataactaacgataacctacgaaacacgcgcaaa

SEQ ID NO: 21479 - DNA, 567 bp, Artificial Sequence
  chemically treated genomic DNA (Homo sapiens) CpG-island No: 21479
tgttttatttagggaaaagtttatttttaggtagggttcgtttcgtttagggggagtcgcggtcggtgtttatttgtaggtgtgtacgtcgtagacgcgcgtgtatttttggtagttgacgtagtagtattagtggaatacgtagcggtatttttttcggcgtcgtttcgttcgcgcgttgtggtcgcggtcgtagtatagtaggtcgtagtcgtcgatgtcgtgcgagttgacgttgtaggtgcggtcgcgcgtgtcgaaggagttcgttttagggttgggttcgtagaagttgggcgaggtttcgtagtagattaggtcgcgtttcgtgggtattttgaagtaggtgtagcgcggtcgtagggtttttatttagtcgcgggattttcggtgtttttttattattattttcgaggcgttgtcgtatttgtttttgaggaagttatcgatggcgcggaagtcgggttgcgattattagtatgtttttatttcgtagttgttcgatagttcgtggtatttgtatttgaggtgtatgtggttggcgatggtttgcggggtacgcgtagg

SEQ ID NO: 21480 - DNA, 567 bp, Artificial Sequence
  chemically treated genomic DNA (Homo sapiens) CpG-island No: 21480
cctacgcgtaccccgcaaaccatcgccaaccacatacacctcaaatacaaataccacgaactatcgaacaactacgaaataaaaacatactaataatcgcaacccgacttccgcgccatcgataacttcctcaaaaacaaatacgacaacgcctcgaaaataataataaaaaaacaccgaaaatcccgcgactaaataaaaaccctacgaccgcgctacacctacttcaaaatacccacgaaacgcgacctaatctactacgaaacctcgcccaacttctacgaacccaaccctaaaacgaactccttcgacacgcgcgaccgcacctacaacgtcaactcgcacgacatcgacgactacgacctactatactacgaccgcgaccacaacgcgcgaacgaaacgacgccgaaaaaaataccgctacgtattccactaatactactacgtcaactaccaaaaatacacgcgcgtctacgacgtacacacctacaaataaacaccgaccgcgactccccctaaacgaaacgaaccctacctaaaaataaacttttccctaaataaaaca

SEQ ID NO: 21481 - DNA, 591 bp, Artificial Sequence
  chemically treated genomic DNA (Homo sapiens) CpG-island No: 21481
gtagggcgcgcggggttggaaatttaggacgcggttcgggagttttaggagggcgtttgcggatcgcgcggtttcgggtcggtcgtttgtttatttggcgtattttagcgcgtcgcgtatatttgggggttcgtatattagtacgtttttagatatatcgatatttacggtagtaggcgggggttaacgtcgtcgtcgcggttcgggttttcgtggtttcgtttgtttttgtttgtttcgttcgggtttcggtttcggcgggcgtttttcgcggcgttgtttcgttttcgtcgtttcgcgtcgtttcgggtttcggttcgtagttcggtcgtcggtttatttggcgtagcgtcgttttcggagttcgcgtatattcgcgtattcgcggtcgtaggagggtttagcgacgtcgtcgcgttagtttttagggttcggtttttttcggcgtttacgttttcggggcggattttcggtttttcgcgttttttcgcgcggcgatggttttattcggatattttttatttttttgtagtttgaagtaggttttgggtagttattcgatttggtggtgagtgagttttttcgcgttcg

SEQ ID NO: 21482 - DNA, 591 bp, Artificial Sequence
  chemically treated genomic DNA (Homo sapiens) CpG-island No: 21482
cgaacgcgaaaaaactcactcaccaccaaatcgaataactacccaaaacctacttcaaactacaaaaaaataaaaaatatccgaataaaaccatcgccgcgcgaaaaaacgcgaaaaaccgaaaatccgccccgaaaacgtaaacgccgaaaaaaaccgaaccctaaaaactaacgcgacgacgtcgctaaaccctcctacgaccgcgaatacgcgaatatacgcgaactccgaaaacgacgctacgccaaataaaccgacgaccgaactacgaaccgaaacccgaaacgacgcgaaacgacgaaaacgaaacaacgccgcgaaaaacgcccgccgaaaccgaaacccgaacgaaacaaacaaaaacaaacgaaaccacgaaaacccgaaccgcgacgacgacgttaacccccgcctactaccgtaaatatcgatatatctaaaaacgtactaatatacgaacccccaaatatacgcgacgcgctaaaatacgccaaataaacaaacgaccgacccgaaaccgcgcgatccgcaaacgccctcctaaaactcccgaaccgcgtcctaaatttccaaccccgcgcgccctac

SEQ ID NO: 21483 - DNA, 591 bp, Artificial Sequence
  chemically treated genomic DNA (Homo sapiens) CpG-island No: 21483
cgaacgcgaggaggtttatttattattagatcgggtagttgtttagagtttgttttaggttgtagaggagtaagaagtattcgagtggggttatcgtcgcgcgagagggcgcggagggtcgggagttcgtttcgagagcgtgagcgtcggggggggtcgggttttgggagttggcgcggcggcgtcgttgggtttttttgcggtcgcgggtgcgcgggtgtgcgcgggtttcgagggcggcgttgcgttaggtgggtcggcggtcgggttgcgggtcgaggttcggggcggcgcggggcggcgggggcggggtagcgtcgcggggggcgttcgtcggggtcggggttcgggcggggtaggtaggggtaggcggggttacgggagttcgaatcgcggcggcggcgttggttttcgtttgttgtcgtgggtgtcggtgtgtttgaggacgtgttggtgtgcgggtttttaggtgtgcgcggcgcgttggggtgcgttagatgggtaggcggtcggttcggggtcgcgcgattcgtaggcgtttttttggagttttcgggtcgcgttttgggtttttagtttcgcgcgttttgt

SEQ ID NO: 21484 - DNA, 591 bp, Artificial Sequence
  chemically treated genomic DNA (Homo sapiens) CpG-island No: 21484
acaaaacgcgcgaaactaaaaacccaaaacgcgacccgaaaactccaaaaaaacgcctacgaatcgcgcgaccccgaaccgaccgcctacccatctaacgcaccccaacgcgccgcgcacacctaaaaacccgcacaccaacacgtcctcaaacacaccgacacccacgacaacaaacgaaaaccaacgccgccgccgcgattcgaactcccgtaaccccgcctacccctacctaccccgcccgaaccccgaccccgacgaacgccccccgcgacgctaccccgcccccgccgccccgcgccgccccgaacctcgacccgcaacccgaccgccgacccacctaacgcaacgccgccctcgaaacccgcgcacacccgcgcacccgcgaccgcaaaaaaacccaacgacgccgccgcgccaactcccaaaacccgaccccccccgacgctcacgctctcgaaacgaactcccgaccctccgcgccctctcgcgcgacgataaccccactcgaatacttcttactcctctacaacctaaaacaaactctaaacaactacccgatctaataataaataaacctcctcgcgttcg

SEQ ID NO: 21485 - DNA, 974 bp, Artificial Sequence
  chemically treated genomic DNA (Homo sapiens) CpG-island No: 21485
tgggcggtcggcggttcgaggtagcggcgtaggtaggtagcgcgacgtagaaggttttcgaagaagtttaggtcgcgtagggcggcggcgttcgaggtttgggtcgggttgggggattagtcggggtttagtttttacgggaagtcggcggtatattgggtgcggtagcgtaggcgaagggcgcggagggttgttcgggagcgtagcgttcgttttatgtttaggattatttcgggttagttttcgcgcgcgtaggttgcggttttttcggcgaagagtagattaggcgttattatgttttattttgtttcggattcgatttcggtttgggaggtagcggttacgatagttagtagtgtggttagtagttttaacgcgcgtatcgttatcgtttttttagatttaacggaatcgttagttattcgttattaaggtcggagttttattttcggcgaaggttcgttttcgggcgaagttttattttttaagtcgggcggcgtatgtttacgaggtttgtatcgttttttttttttttagttagttcggatttttttatcggtttttagcgaatttcggcgcgttagtcggagtttcgttttcgagtttaggttttgtttagtcgaattgacgtttagtagataagaaagacggaagtttcgtttacgcgtttttatgcgtaggttttttttattcgtatagtttagggagtggggaggataaggcgttgttatggaggacgtcgtcgcgtcggggcggatcgagggggtttttgaaaggtaaggagcgtcgttagttgtaggttagggaggtatgcggggcgggagttagtagggggaagttagttttcgcgaggtagtcggtttcggggtttcgcgggaggtcgacggcgggagtttacggtttgtgtttttgggtgtgtgtcgtaggagttttggtggagtttatttcgattttcggcggtttggttttggtga

SEQ ID NO: 21486 - DNA, 974 bp, Artificial Sequence
  chemically treated genomic DNA (Homo sapiens) CpG-island No: 21486
tcaccaaaaccaaaccgccgaaaatcgaaataaactccaccaaaactcctacgacacacacccaaaaacacaaaccgtaaactcccgccgtcgacctcccgcgaaaccccgaaaccgactacctcgcgaaaactaacttccccctactaactcccgccccgcatacctccctaacctacaactaacgacgctccttacctttcaaaaaccccctcgatccgccccgacgcgacgacgtcctccataacaacgccttatcctccccactccctaaactatacgaataaaaaaaacctacgcataaaaacgcgtaaacgaaacttccgtctttcttatctactaaacgtcaattcgactaaacaaaacctaaactcgaaaacgaaactccgactaacgcgccgaaattcgctaaaaaccgataaaaaaatccgaactaactaaaaaaaaaaaaaacgatacaaacctcgtaaacatacgccgcccgacttaaaaaataaaacttcgcccgaaaacgaaccttcgccgaaaataaaactccgaccttaataacgaataactaacgattccgttaaatctaaaaaaacgataacgatacgcgcgttaaaactactaaccacactactaactatcgtaaccgctacctcccaaaccgaaatcgaatccgaaacaaaataaaacataataacgcctaatctactcttcgccgaaaaaaccgcaacctacgcgcgcgaaaactaacccgaaataatcctaaacataaaacgaacgctacgctcccgaacaaccctccgcgcccttcgcctacgctaccgcacccaatataccgccgacttcccgtaaaaactaaaccccgactaatcccccaacccgacccaaacctcgaacgccgccgccctacgcgacctaaacttcttcgaaaaccttctacgtcgcgctacctacctacgccgctacctcgaaccgccgaccgccca

SEQ ID NO: 21487 - DNA, 974 bp, Artificial Sequence
  chemically treated genomic DNA (Homo sapiens) CpG-island No: 21487
ttattagggttaggtcgtcgggggtcggggtgagttttattagggtttttgcgatatatatttaggaatataagtcgtgagttttcgtcgtcggtttttcgcggagtttcgagatcggttgtttcgcgggagttgatttttttttgttgattttcgtttcgtatatttttttggtttgtagttggcggcgttttttgttttttaaggattttttcggttcgtttcggcgcggcggcgttttttatgatagcgttttattttttttattttttgggttgtgcgagtaggaagagtttgcgtataaaggcgcgtgggcggagttttcgttttttttgtttattgggcgttagttcgattgagtaaggtttgagttcggaggcggggtttcggttgacgcgtcgggattcgttgagggtcggtggggggattcgggttgattgaaaggaaaagaggcggtgtaagtttcgtgggtatgcgtcgttcggtttggaaggtggggtttcgttcgggggcgggttttcgtcgggggtaggatttcggttttggtggcgggtggttggcggtttcgttaggtttgagggagcgatggcggtacgcgcgttgaagttgttgattatattgttggttgtcgtggtcgttgttttttaagtcgaggtcgagttcgaggtaggatggggtatggtgacgtttgatttgtttttcgtcgaggggatcgtagtttacgcgcgcggggattggttcggggtggttttgagtatggaacgggcgttgcgttttcgggtagtttttcgcgtttttcgtttgcgttgtcgtatttagtgtgtcgtcgatttttcgtgggagttggatttcgattggttttttagttcggtttaggtttcgggcgtcgtcgttttgcgcgatttgagttttttcgggggttttttgcgtcgcgttgtttgtttgcgtcgttgtttcgggtcgtcggtcgttta

SEQ ID NO: 21488 - DNA, 974 bp, Artificial Sequence
  chemically treated genomic DNA (Homo sapiens) CpG-island No: 21488
taaacgaccgacgacccgaaacaacgacgcaaacaaacaacgcgacgcaaaaaacccccgaaaaaactcaaatcgcgcaaaacgacgacgcccgaaacctaaaccgaactaaaaaaccaatcgaaatccaactcccacgaaaaatcgacgacacactaaatacgacaacgcaaacgaaaaacgcgaaaaactacccgaaaacgcaacgcccgttccatactcaaaaccaccccgaaccaatccccgcgcgcgtaaactacgatcccctcgacgaaaaacaaatcaaacgtcaccataccccatcctacctcgaactcgacctcgacttaaaaaacaacgaccacgacaaccaacaatataatcaacaacttcaacgcgcgtaccgccatcgctccctcaaacctaacgaaaccgccaaccacccgccaccaaaaccgaaatcctacccccgacgaaaacccgcccccgaacgaaaccccaccttccaaaccgaacgacgcatacccacgaaacttacaccgcctcttttcctttcaatcaacccgaatccccccaccgaccctcaacgaatcccgacgcgtcaaccgaaaccccgcctccgaactcaaaccttactcaatcgaactaacgcccaataaacaaaaaaaacgaaaactccgcccacgcgcctttatacgcaaactcttcctactcgcacaacccaaaaaataaaaaaaataaaacgctatcataaaaaacgccgccgcgccgaaacgaaccgaaaaaatccttaaaaaacaaaaaacgccgccaactacaaaccaaaaaaatatacgaaacgaaaatcaacaaaaaaaaatcaactcccgcgaaacaaccgatctcgaaactccgcgaaaaaccgacgacgaaaactcacgacttatattcctaaatatatatcgcaaaaaccctaataaaactcaccccgacccccgacgacctaaccctaataa

SEQ ID NO: 21489 - DNA, 2561 bp, Artificial Sequence
  chemically treated genomic DNA (Homo sapiens) CpG-island No: 21489
ttgtatatgaaagtatcgggtgatataagttttcgtttgatgaagtaatttaatagttttttgtttcgggtgcgcgaaggcgacgggtagttgatcgtcggggacgtcggtttggatcgcgagcggttgtgtggttaggtttcgtagtgcgtgttggttttcgatgtggttagtttttcgtaggagtagtttcggttggtgtacgtggaggtagaggtgagggacgttaacgattacgcgtcgcgtttttttagggtttagatttcggtagaggtgttcgagggtgcggtagtgggtacgcgtatttttttggaggtgtcggtggacgaggacgtgggcgttaacgggttgtagatcgtgcgtttggtcgagtcgtatagtttttttcgcgtggagttgtagacgcgagcggacggcgtttagtgcgtagatttggtgttgttgtaggagttggatcgcgagagttaggtcgtttatagtttggagttggtggtttaggacggcggtcgttcgtcgcgtttcgttacggttgtttttagcgtgcgcgttttggatgcgaatgattatagttcggttttttcgtagggcgtcgtggtcgaagtggagttggcggaagacgcgttcgtgggttttttgtttttcgatttggacgtagtcgatttcgacgagggatttacggcgacgtggtgttcgtatttggcgttcgtatttcgtcggaggcgcgtcgtttttttcggtttgattcgcgattaggtcgttttattttggtcgggttcgtggattacgagcgttaggatatttacgagttggacgtgcgggcgtaggatcgcggattcgggtttcgcgttgttatttgtaaggttatcgtgcgtattcgagacgttaatgataacgtattcgatatcgttattatttcgttggtcgttttaggcgcgtcggtaattttatttttcgtcgttgtcgtcgtcgtcgttgtattcgggggagcggacgttagttcgtcggcgggagtcgggacgtcggaggttggtgttatttcgttggtgtcggagggggcggcgcgcgagagtttggtggttttggttagtatttcggatagggattcgggcgttaacgggtaagtgcgttgcgttttttatgggtacgagtattttcggttgtagtcggtttacgcgggtagttatttggtggtgatcgcggcgtcgttggatcgcgaacgtatcgtcgagtataatttgacgttggtggtcgaggatcgcggcgcgttttcgttgcgtatagtgcggttttatacggtgcgtgtgggcgacgagaacgataacgcgtcgttttttacgcggtcggtttatgaggtgtcggtgcgcgagaataattcgttaggcgtttatttggttacggtggtcgttcgcgatcgggatttgggtcgtaacggttaggttatttatcggttgttggaggtcgaggtgggtcgcgtcgggggcgtcgtgtttatttatgtttcggtggatttagttatcggagttatttacgcgttgcgtagtttcgattatgagacgttgcgttaattcgacgttcgtatttaagttagcgacggcggttttttttagttttttagtagcgttttagtgtaagtgcgcgtgttggattagaacgattatgcgttagttttggtgtattcggcgttagttaatggttttttagaagtggcggtgtttgggcgtatcgtaaaggatacggttgtggttcgtgtgtaggttcgggatgtagacgagggagttaacggggagttggcgttcgagttgtagtagtaggagtcgcgcgaagttttcgttatcggtcgtcgtacgggggagatattgtttatcggcgatttttcgtaggagttattcggtcgcgtgtttagggcgtttttggttatattcgacggcggtcgtttttcgtttattattatcgtaattgttagtttcgtggtaatagtagggggcgggcgtgggtcggttgcgtttgttagtgtaggaagttcggagcgttttcgttcgtttggttttcggttcggggtgttcgggtcggtgttgtaatgggatacgtcgttgatcgttattatcgtgttggtcgggagttgtacgttgttgttggtcgttattatcgttatcgttattatttgtaatcgtcgtaagaaggaggtgcgtaaagggggggtttttcgggaagagcggttcggggcggcgggcggcggagtttcggttttcggtttttcggaggaggtcgttcggggagtcgggtttaggtttaatatgttcgacgtgtttattttttttggtatcggtaaagcgttttttggtagtttcgcggcggacgcgttttcgtttgcggtcgtcgcggtcgaagtgtcgggtttagagggcggtagcgttattggggaaagcgtttgttatttcgaggggtagtagcggtttcgcggcgcgtacgtcgaggtgaggttttttttcggttgggcgttttttttcgagtttcgcggataggttgggggaagggagattggagggggtagggtgggtgta

SEQ ID NO: 21490 - DNA, 2561 bp, Artificial Sequence
  chemically treated genomic DNA (Homo sapiens) CpG-island No: 21490
tacacccaccctaccccctccaatctcccttcccccaacctatccgcgaaactcgaaaaaaaacgcccaaccgaaaaaaaacctcacctcgacgtacgcgccgcgaaaccgctactacccctcgaaataacaaacgctttccccaataacgctaccgccctctaaacccgacacttcgaccgcgacgaccgcaaacgaaaacgcgtccgccgcgaaactaccaaaaaacgctttaccgataccaaaaaaaataaacacgtcgaacatattaaacctaaacccgactccccgaacgacctcctccgaaaaaccgaaaaccgaaactccgccgcccgccgccccgaaccgctcttcccgaaaaaccccccctttacgcacctccttcttacgacgattacaaataataacgataacgataataacgaccaacaacaacgtacaactcccgaccaacacgataataacgatcaacgacgtatcccattacaacaccgacccgaacaccccgaaccgaaaaccaaacgaacgaaaacgctccgaacttcctacactaacaaacgcaaccgacccacgcccgccccctactattaccacgaaactaacaattacgataataataaacgaaaaacgaccgccgtcgaatataaccaaaaacgccctaaacacgcgaccgaataactcctacgaaaaatcgccgataaacaatatctcccccgtacgacgaccgataacgaaaacttcgcgcgactcctactactacaactcgaacgccaactccccgttaactccctcgtctacatcccgaacctacacacgaaccacaaccgtatcctttacgatacgcccaaacaccgccacttctaaaaaaccattaactaacgccgaatacaccaaaactaacgcataatcgttctaatccaacacgcgcacttacactaaaacgctactaaaaaactaaaaaaaaccgccgtcgctaacttaaatacgaacgtcgaattaacgcaacgtctcataatcgaaactacgcaacgcgtaaataactccgataactaaatccaccgaaacataaataaacacgacgcccccgacgcgacccacctcgacctccaacaaccgataaataacctaaccgttacgacccaaatcccgatcgcgaacgaccaccgtaaccaaataaacgcctaacgaattattctcgcgcaccgacacctcataaaccgaccgcgtaaaaaacgacgcgttatcgttctcgtcgcccacacgcaccgtataaaaccgcactatacgcaacgaaaacgcgccgcgatcctcgaccaccaacgtcaaattatactcgacgatacgttcgcgatccaacgacgccgcgatcaccaccaaataactacccgcgtaaaccgactacaaccgaaaatactcgtacccataaaaaacgcaacgcacttacccgttaacgcccgaatccctatccgaaatactaaccaaaaccaccaaactctcgcgcgccgccccctccgacaccaacgaaataacaccaacctccgacgtcccgactcccgccgacgaactaacgtccgctcccccgaatacaacgacgacgacgacaacgacgaaaaataaaattaccgacgcgcctaaaacgaccaacgaaataataacgatatcgaatacgttatcattaacgtctcgaatacgcacgataaccttacaaataacaacgcgaaacccgaatccgcgatcctacgcccgcacgtccaactcgtaaatatcctaacgctcgtaatccacgaacccgaccaaaataaaacgacctaatcgcgaatcaaaccgaaaaaaacgacgcgcctccgacgaaatacgaacgccaaatacgaacaccacgtcgccgtaaatccctcgtcgaaatcgactacgtccaaatcgaaaaacaaaaaacccacgaacgcgtcttccgccaactccacttcgaccacgacgccctacgaaaaaaccgaactataatcattcgcatccaaaacgcgcacgctaaaaacaaccgtaacgaaacgcgacgaacgaccgccgtcctaaaccaccaactccaaactataaacgacctaactctcgcgatccaactcctacaacaacaccaaatctacgcactaaacgccgtccgctcgcgtctacaactccacgcgaaaaaaactatacgactcgaccaaacgcacgatctacaacccgttaacgcccacgtcctcgtccaccgacacctccaaaaaaatacgcgtacccactaccgcaccctcgaacacctctaccgaaatctaaaccctaaaaaaacgcgacgcgtaatcgttaacgtccctcacctctacctccacgtacaccaaccgaaactactcctacgaaaaactaaccacatcgaaaaccaacacgcactacgaaacctaaccacacaaccgctcgcgatccaaaccgacgtccccgacgatcaactacccgtcgccttcgcgcacccgaaacaaaaaactattaaattacttcatcaaacgaaaacttatatcacccgatactttcatatacaa

SEQ ID NO: 21491 - DNA, 2561 bp, Artificial Sequence
  chemically treated genomic DNA (Homo sapiens) CpG-island No: 21491
tgtatttattttattttttttagtttttttttttttagtttgttcgcggagttcggaggggggcgtttagtcgaaggaaggttttatttcggcgtgcgcgtcgcggagtcgttgttgtttttcgaagtgataggcgttttttttagtggcgttgtcgttttttgagttcggtatttcggtcgcggcgatcgtaggcggaggcgcgttcgtcgcggggttgttaaagggcgttttgtcggtgttagggaaggtgagtacgtcgaatatgttgggtttgggttcggtttttcgggcggtttttttcggggagtcgggagtcgaggtttcgtcgttcgtcgtttcgggtcgtttttttcggagggttttttttttgcgtattttttttttgcggcggttgtaggtggtggcgatggcgatgatggcggttagtagtagcgtgtagttttcggttagtacgatgatgacgattagcggcgtgttttattgtagtatcgattcggatatttcgagtcgagagttaggcgggcgggaacgtttcgggttttttgtattggtaggcgtagtcggtttacgttcgttttttgttgttattacgaagttgatagttgcggtggtggtgagcgggggacggtcgtcgtcggatatgattaggagcgttttgaatacgcgatcgggtggtttttgcgagaggtcgtcggtgagtagtatttttttcgtgcggcggtcgatggcgaaggtttcgcgcggtttttgttgttgtagttcgaacgttagtttttcgttggttttttcgtttgtatttcgggtttgtatacgggttataatcgtgttttttgcggtgcgtttaggtatcgttatttttagggagttattggttggcgtcgggtgtattaggattggcgtatggtcgttttggtttagtacgcgtatttgtattagggcgttgttggaaagttgaggggagtcgtcgtcgttagtttggatgcgaacgtcgagttggcgtagcgttttatagtcgaagttgcgtagcgcgtagatggtttcggtagttgggtttatcgagatataagtggatacggcgttttcggcgcggtttatttcggtttttagtagtcggtaggtgatttggtcgttgcggtttaggtttcggtcgcgggcggttatcgtggttaggtaggcgtttggcgggttgttttcgcgtatcgatattttatagatcggtcgcgtgaagagcggcgcgttgtcgttttcgtcgtttatacgtatcgtgtagggtcgtattgtgcgtagcgggggcgcgtcgcgattttcggttattagcgttaagttgtattcggcgatgcgttcgcggtttagcgacgtcgcggttattattaggtagttgttcgcgtaggtcggttgtagtcggaagtgttcgtgtttatagagggcgtagcgtatttgttcgttggcgttcgagtttttgttcgaggtgttgattagggttattaggttttcgcgcgtcgtttttttcggtattagcgaagtggtattagttttcggcgtttcggttttcgtcggcgagttagcgttcgttttttcgagtgtagcggcggcggcggtagcggcgaagggtgaggttgtcggcgcgtttggggcggttagcggggtgatggcgatgtcgggtgcgttgttattgacgtttcggatgcgtacgatgattttgtaggtggtagcgcggggttcgggttcgcggttttgcgttcgtacgtttagttcgtaggtgttttgacgttcgtagtttacgggttcggttagggtgaggcggtttgatcgcgggttaagtcgaaagaggcggcgcgttttcggcggggtgcgggcgttaaatgcgaatattacgtcgtcgtaggtttttcgtcggggtcggttgcgtttaggtcgagaagtagggagtttacgggcgcgtttttcgttagttttatttcggttacggcgttttgcgggaaggtcgggttgtggttattcgtatttaggacgcgtacgttgagggtagtcgtggcggagcgcggcgggcggtcgtcgttttgggttattagttttaggttgtaggcggtttggttttcgcggtttagtttttgtagtagtattaggtttgcgtattgagcgtcgttcgttcgcgtttgtagttttacgcgaaaggggttgtgcggttcggttaggcgtacggtttgtagttcgttggcgtttacgttttcgtttatcggtatttttaaggggatgcgcgtgtttattgtcgtattttcggatatttttatcgggatttgggttttggggaagcgcggcgcgtggtcgttgacgttttttatttttatttttacgtgtattagtcggaattgtttttgcgagaagttgattatatcgaaggttagtacgtattgcggggtttggttatatagtcgttcgcggtttaggtcggcgttttcgacggttagttgttcgtcgttttcgcgtattcggagtagagagttgttgaattgttttattaggcggaagtttgtgttattcgatatttttatatgtag

SEQ ID NO: 21492 - DNA, 2561 bp, Artificial Sequence
  chemically treated genomic DNA (Homo sapiens) CpG-island No: 21492
ctacatataaaaatatcgaataacacaaacttccgcctaataaaacaattcaacaactctctactccgaatacgcgaaaacgacgaacaactaaccgtcgaaaacgccgacctaaaccgcgaacgactatataaccaaaccccgcaatacgtactaaccttcgatataatcaacttctcgcaaaaacaattccgactaatacacgtaaaaataaaaataaaaaacgtcaacgaccacgcgccgcgcttccccaaaacccaaatcccgataaaaatatccgaaaatacgacaataaacacgcgcatccccttaaaaataccgataaacgaaaacgtaaacgccaacgaactacaaaccgtacgcctaaccgaaccgcacaacccctttcgcgtaaaactacaaacgcgaacgaacgacgctcaatacgcaaacctaatactactacaaaaactaaaccgcgaaaaccaaaccgcctacaacctaaaactaataacccaaaacgacgaccgcccgccgcgctccgccacgactaccctcaacgtacgcgtcctaaatacgaataaccacaacccgaccttcccgcaaaacgccgtaaccgaaataaaactaacgaaaaacgcgcccgtaaactccctacttctcgacctaaacgcaaccgaccccgacgaaaaacctacgacgacgtaatattcgcatttaacgcccgcaccccgccgaaaacgcgccgcctctttcgacttaacccgcgatcaaaccgcctcaccctaaccgaacccgtaaactacgaacgtcaaaacacctacgaactaaacgtacgaacgcaaaaccgcgaacccgaaccccgcgctaccacctacaaaatcatcgtacgcatccgaaacgtcaataacaacgcacccgacatcgccatcaccccgctaaccgccccaaacgcgccgacaacctcacccttcgccgctaccgccgccgccgctacactcgaaaaaacgaacgctaactcgccgacgaaaaccgaaacgccgaaaactaataccacttcgctaataccgaaaaaaacgacgcgcgaaaacctaataaccctaatcaacacctcgaacaaaaactcgaacgccaacgaacaaatacgctacgccctctataaacacgaacacttccgactacaaccgacctacgcgaacaactacctaataataaccgcgacgtcgctaaaccgcgaacgcatcgccgaatacaacttaacgctaataaccgaaaatcgcgacgcgcccccgctacgcacaatacgaccctacacgatacgtataaacgacgaaaacgacaacgcgccgctcttcacgcgaccgatctataaaatatcgatacgcgaaaacaacccgccaaacgcctacctaaccacgataaccgcccgcgaccgaaacctaaaccgcaacgaccaaatcacctaccgactactaaaaaccgaaataaaccgcgccgaaaacgccgtatccacttatatctcgataaacccaactaccgaaaccatctacgcgctacgcaacttcgactataaaacgctacgccaactcgacgttcgcatccaaactaacgacgacgactcccctcaactttccaacaacgccctaatacaaatacgcgtactaaaccaaaacgaccatacgccaatcctaatacacccgacgccaaccaataactccctaaaaataacgatacctaaacgcaccgcaaaaaacacgattataacccgtatacaaacccgaaatacaaacgaaaaaaccaacgaaaaactaacgttcgaactacaacaacaaaaaccgcgcgaaaccttcgccatcgaccgccgcacgaaaaaaatactactcaccgacgacctctcgcaaaaaccacccgatcgcgtattcaaaacgctcctaatcatatccgacgacgaccgtcccccgctcaccaccaccgcaactatcaacttcgtaataacaacaaaaaacgaacgtaaaccgactacgcctaccaatacaaaaaacccgaaacgttcccgcccgcctaactctcgactcgaaatatccgaatcgatactacaataaaacacgccgctaatcgtcatcatcgtactaaccgaaaactacacgctactactaaccgccatcatcgccatcgccaccacctacaaccgccgcaaaaaaaaaatacgcaaaaaaaaaaccctccgaaaaaaacgacccgaaacgacgaacgacgaaacctcgactcccgactccccgaaaaaaaccgcccgaaaaaccgaacccaaacccaacatattcgacgtactcaccttccctaacaccgacaaaacgccctttaacaaccccgcgacgaacgcgcctccgcctacgatcgccgcgaccgaaataccgaactcaaaaaacgacaacgccactaaaaaaaacgcctatcacttcgaaaaacaacaacgactccgcgacgcgcacgccgaaataaaaccttccttcgactaaacgcccccctccgaactccgcgaacaaactaaaaaaaaaaaaactaaaaaaaataaaataaataca

SEQ ID NO: 21493 - DNA, 792 bp, Artificial Sequence
  chemically treated genomic DNA (Homo sapiens) CpG-island No: 21493
agtaggacggtgttttttaaacggcgttgatgttcgatttcgatttcgaggagattgcggatttcgattgcggtttttattagggtcggttcgtttttattttattttttgaggttggggcggagtcgatcggtcggtttcgagattttttgttttatcggtggagtaaggaatcggaagtcgcggtttttatataatcgggatgatgttagggcgggcgattttcggggggcgggattagggcggaggtcgcgtcgggagcgcggtggggttaggcgtggggcgttttcggtatgtttttgtatcgtagcgtcgtgtggttcgttaaggggttgcgcgagtatattaagtaaggcggcgcggcggggcgcggggtttcgggttgttacgtggttcgtttcggcgcgggcgagtagggttggcggggacgcgttcgcggttttttcgttttttcgttgggtcgattaagcgtgtttagaacgacgggtgcgttcgtcgtttagcgatttacggttgggcgtggggtagtcgttagattttagtcgtttaatgttcgcgatcgagattggcgttcgaggggcggggttgtggcgcgtttaagtttagggtcgttttattgacgttaggcggtttcggcgttaaggagttttttgggcggtatttcggcgtttcgttgggtgtgttcgtggaagtgttttcgtggtgttgttggcggcgttagatagggttggatttaaatcgttagttaaggttttgttttagtgtttttgggtgtgttttttttaaaaagat

SEQ ID NO: 21494 - DNA, 792 bp, Artificial Sequence
  chemically treated genomic DNA (Homo sapiens) CpG-island No: 21494
atctttttaaaaaaaacacacccaaaaacactaaaacaaaaccttaactaacgatttaaatccaaccctatctaacgccgccaacaacaccacgaaaacacttccacgaacacacccaacgaaacgccgaaataccgcccaaaaaactccttaacgccgaaaccgcctaacgtcaataaaacgaccctaaacttaaacgcgccacaaccccgcccctcgaacgccaatctcgatcgcgaacattaaacgactaaaatctaacgactaccccacgcccaaccgtaaatcgctaaacgacgaacgcacccgtcgttctaaacacgcttaatcgacccaacgaaaaaacgaaaaaaccgcgaacgcgtccccgccaaccctactcgcccgcgccgaaacgaaccacgtaacaacccgaaaccccgcgccccgccgcgccgccttacttaatatactcgcgcaaccccttaacgaaccacacgacgctacgatacaaaaacataccgaaaacgccccacgcctaaccccaccgcgctcccgacgcgacctccgccctaatcccgccccccgaaaatcgcccgccctaacatcatcccgattatataaaaaccgcgacttccgattccttactccaccgataaaacaaaaaatctcgaaaccgaccgatcgactccgccccaacctcaaaaaataaaataaaaacgaaccgaccctaataaaaaccgcaatcgaaatccgcaatctcctcgaaatcgaaatcgaacatcaacgccgtttaaaaaacaccgtcctact

SEQ ID NO: 21495 - DNA, 792 bp, Artificial Sequence
  chemically treated genomic DNA (Homo sapiens) CpG-island No: 21495
atttttttaaaggaaatatatttaaaggtattaggatagagttttagttagcgatttagatttagttttatttgacgtcgttagtagtattacgaagatatttttacgagtatatttagcggggcgtcgaggtgtcgtttaagaggttttttggcgtcggggtcgtttgacgttagtgggacggttttgggtttgggcgcgttatagtttcgtttttcgggcgttagtttcggtcgcgggtattgagcggttggagtttggcgattgttttacgtttagtcgtgggtcgttagacggcgggcgtattcgtcgttttggatacgtttagtcggtttagcgagagggcgaaggagtcgcgggcgcgttttcgttaattttgttcgttcgcgtcgaggcgggttacgtgatagttcggggtttcgcgtttcgtcgcgtcgttttatttggtgtattcgcgtagttttttggcgaattatacgacgttgcggtatagggatatgtcgggagcgttttacgtttagttttatcgcgttttcggcgcggttttcgttttggtttcgtttttcgggagtcgttcgttttgatattatttcggttatgtaagagtcgcggttttcggttttttgttttatcggtaaggtaaggggtttcggggtcggtcggtcgatttcgttttagttttagagggtggagtgagggcggatcggttttggtgggggtcgtagtcgaggttcgtagttttttcggggtcgaaatcgggtattagcgtcgtttagagaatatcgttttgtt

SEQ ID NO: 21496 - DNA, 792 bp, Artificial Sequence
  chemically treated genomic DNA (Homo sapiens) CpG-island No: 21496
aacaaaacgatattctctaaacgacgctaatacccgatttcgaccccgaaaaaactacgaacctcgactacgacccccaccaaaaccgatccgccctcactccaccctctaaaactaaaacgaaatcgaccgaccgaccccgaaaccccttaccttaccgataaaacaaaaaaccgaaaaccgcgactcttacataaccgaaataatatcaaaacgaacgactcccgaaaaacgaaaccaaaacgaaaaccgcgccgaaaacgcgataaaactaaacgtaaaacgctcccgacatatccctataccgcaacgtcgtataattcgccaaaaaactacgcgaatacaccaaataaaacgacgcgacgaaacgcgaaaccccgaactatcacgtaacccgcctcgacgcgaacgaacaaaattaacgaaaacgcgcccgcgactccttcgccctctcgctaaaccgactaaacgtatccaaaacgacgaatacgcccgccgtctaacgacccacgactaaacgtaaaacaatcgccaaactccaaccgctcaatacccgcgaccgaaactaacgcccgaaaaacgaaactataacgcgcccaaacccaaaaccgtcccactaacgtcaaacgaccccgacgccaaaaaacctcttaaacgacacctcgacgccccgctaaatatactcgtaaaaatatcttcgtaatactactaacgacgtcaaataaaactaaatctaaatcgctaactaaaactctatcctaatacctttaaatatatttcctttaaaaaaat

SEQ ID NO: 21497 - DNA, 628 bp, Artificial Sequence
  chemically treated genomic DNA (Homo sapiens) CpG-island No: 21497
ttcggtgcggtgagttttttttttcggtcgcgtttttttcgttttttttttttcgttatgcgaaggcgtagttttcgggcggtttcgaagttagaagggggattagcggtaggcggaggggttggagcgtcggagtcgggtcgttttatttatgtcggtcgtatattcgtcgttattttatttaaacgtagttttcgcggcgagtacgtcggcgttcggtttatttgggggtcgtagttttcgtagtttatagatatgttatcggttttaacgattcgtgagcgagtcgggtaagtaagttggttttttttcgcgttgatttttagtttttttttttttagtttcgcggttcgttttcgttttgtttatttttcggttttcgtcgtcgtcgtcgtcgtcgtagtttcggttcgtaatatcgtttattttttacgttttttattttttttcgcgagagggtagcgcgtttttcgcgagaaaaatttcgcggtcgagttcgcgtaaaagtgggtgggcgtttaaaaagggaaagaaggaataggaaaaaaagtttttttacgtgttttagtgtagttcgcggagtagttcgcggggtagtttcgttggttatatgatttaaagggggttt

SEQ ID NO: 21498 - DNA, 628 bp, Artificial Sequence
  chemically treated genomic DNA (Homo sapiens) CpG-island No: 21498
aaaccccctttaaatcatataaccaacgaaactaccccgcgaactactccgcgaactacactaaaacacgtaaaaaaactttttttcctattccttctttccctttttaaacgcccacccacttttacgcgaactcgaccgcgaaatttttctcgcgaaaaacgcgctaccctctcgcgaaaaaaaataaaaaacgtaaaaaataaacgatattacgaaccgaaactacgacgacgacgacgacgacgaaaaccgaaaaataaacaaaacgaaaacgaaccgcgaaactaaaaaaaaaaaaactaaaaatcaacgcgaaaaaaaaccaacttacttacccgactcgctcacgaatcgttaaaaccgataacatatctataaactacgaaaactacgacccccaaataaaccgaacgccgacgtactcgccgcgaaaactacgtttaaataaaataacgacgaatatacgaccgacataaataaaacgacccgactccgacgctccaacccctccgcctaccgctaatcccccttctaacttcgaaaccgcccgaaaactacgccttcgcataacgaaaaaaaaaaaacgaaaaaaacgcgaccgaaaaaaaaaactcaccgcaccgaa

SEQ ID NO: 21499 - DNA, 628 bp, Artificial Sequence
  chemically treated genomic DNA (Homo sapiens) CpG-island No: 21499
aggttttttttaagttatgtgattagcggggttgtttcgcgggttgtttcgcgggttgtattggagtacgtgggaaggtttttttttttgttttttttttttttttttaaacgtttatttatttttgcgcgggttcggtcgcggaatttttttcgcgagaggcgcgttgttttttcgcgagagagagtgggaggcgtggagagtaggcggtgttgcgggtcggagttgcggcggcggcggcggcggcggaagtcgaggggtgggtagggcgggggcgggtcgcggggttgggagggggagggttgggggttagcgcgggagggggttagtttgtttgttcggttcgtttacgggtcgttgaggtcggtgatatgtttgtgagttgcggaggttgcggtttttaggtgagtcgggcgtcgacgtgttcgtcgcggaggttgcgtttagatggggtggcggcgggtgtgcggtcggtatggatggagcggttcggtttcggcgttttagttttttcgtttgtcgttggttttttttttggtttcggggtcgttcgagagttgcgttttcgtatggcggagggaggagggcgggaggagcgcggtcgaaggaggaaatttatcgtatcggg

SEQ ID NO: 21500 - DNA, 628 bp, Artificial Sequence
  chemically treated genomic DNA (Homo sapiens) CpG-island No: 21500
cccgatacgataaatttcctccttcgaccgcgctcctcccgccctcctccctccgccatacgaaaacgcaactctcgaacgaccccgaaaccaaaaaaaaaaccaacgacaaacgaaaaaactaaaacgccgaaaccgaaccgctccatccataccgaccgcacacccgccgccaccccatctaaacgcaacctccgcgacgaacacgtcgacgcccgactcacctaaaaaccgcaacctccgcaactcacaaacatatcaccgacctcaacgacccgtaaacgaaccgaacaaacaaactaaccccctcccgcgctaacccccaaccctccccctcccaaccccgcgacccgcccccgccctacccacccctcgacttccgccgccgccgccgccgccgcaactccgacccgcaacaccgcctactctccacgcctcccactctctctcgcgaaaaaacaacgcgcctctcgcgaaaaaaattccgcgaccgaacccgcgcaaaaataaataaacgtttaaaaaaaaaaaaaaaaaacaaaaaaaaaaaccttcccacgtactccaatacaacccgcgaaacaacccgcgaaacaaccccgctaatcacataacttaaaaaaaacct

SEQ ID NO: 21501 - DNA, 1062 bp, Artificial Sequence
  chemically treated genomic DNA (Homo sapiens) CpG-island No: 21501
ttgaatttcgtttaatgggcgtaagtttgtttttttacgttaaaatgtaagaggtagggacgttttttatgttttatagtatttttacgtggggtggcgttttcgtaagtggatttagcggttttattaattttcgaaatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagcggtttcgttgagtttcggatatggggtcgcgttttcggaaggggatttagtggtttcgttgagtttcggatatggggtcgcgtttttagaaggggatttagtggtttcgttaattttcgaacgggtttggtttttgtttttgtgaatgagattgatggacggtgttcgtagtttatttt

SEQ ID NO: 21502 - DNA, 1062 bp, Artificial Sequence
  chemically treated genomic DNA (Homo sapiens) CpG-island No: 21502
aaaataaactacgaacaccgtccatcaatctcattcacaaaaacaaaaaccaaacccgttcgaaaattaacgaaaccactaaatccccttctaaaaacgcgaccccatatccgaaactcaacgaaaccactaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatatccgaaactcaacgaaaccgctaaatccccttccgaaaacgcgaccccatttcgaaaattaataaaaccgctaaatccacttacgaaaacgccaccccacgtaaaaatactataaaacataaaaaacgtccctacctcttacattttaacgtaaaaaaacaaacttacgcccattaaacgaaattcaa

SEQ ID NO: 21503 - DNA, 1062 bp, Artificial Sequence
  chemically treated genomic DNA (Homo sapiens) CpG-island No: 21503
gaagtgagttgcgggtatcgtttattagttttatttataagagtaaggattagattcgttcgaggattagcggggttattaggtttttttttgaaggcgcgattttatgttcggggtttagcggggttattggattttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatgttcggggtttagcggggtcgttgggttttttttcgaaggcgcgattttatttcgggggttagtggggtcgttgagtttatttgcgaaggcgttattttacgtgagggtgttgtggagtatgggagacgtttttgttttttgtattttaacgtgaaaaggtaagtttgcgtttattagacgaggtttag

SEQ ID NO: 21504 - DNA, 1062 bp, Artificial Sequence
  chemically treated genomic DNA (Homo sapiens) CpG-island No: 21504
ctaaacctcgtctaataaacgcaaacttaccttttcacgttaaaatacaaaaaacaaaaacgtctcccatactccacaacaccctcacgtaaaataacgccttcgcaaataaactcaacgaccccactaacccccgaaataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaacccaacgaccccgctaaaccccgaacataaaatcgcgccttcgaaaaaaaatccaataaccccgctaaaccccgaacataaaatcgcgccttcaaaaaaaaacctaataaccccgctaatcctcgaacgaatctaatccttactcttataaataaaactaataaacgatacccgcaactcacttc

SEQ ID NO: 21505 - DNA, 536 bp, Artificial Sequence
  chemically treated genomic DNA (Homo sapiens) CpG-island No: 21505
tcgttaggcgcggattcgttgcggttagagaatttagtttgcgttagttcggttcgttcgcgaagttacgggttttattgacgcgattttttaagacgtgggggttattatgggtagaggatatcggttcggagttagattacgggttttataagtattagattataagtagcgtcgttattgagagtcgttcggaattcgtttagtatgtcgggttttttagttagggtttggtgtacgtggtcgagggttttggaagtttcgatggtttaggaggagtaggcgggcggggcggcgggtgtcgttggtcggtagagagtttcggtttgatttagcgtaggtttggtgcgcgtagagaataattttaagcgtatcgacgttcgcgagttttttttaaatatcgaacgggatttagagttcgagtttataggcggcggtcgggggagggagtagggtgttggtcgtcgttcgggagtgttcgcgttttgggtgatttttggaaggacgtggggtttaaatttcggttggggttggga

SEQ ID NO: 21506 - DNA, 536 bp, Artificial Sequence
  chemically treated genomic DNA (Homo sapiens) CpG-island No: 21506
tcccaaccccaaccgaaatttaaaccccacgtccttccaaaaatcacccaaaacgcgaacactcccgaacgacgaccaacaccctactccctcccccgaccgccgcctataaactcgaactctaaatcccgttcgatatttaaaaaaaactcgcgaacgtcgatacgcttaaaattattctctacgcgcaccaaacctacgctaaatcaaaccgaaactctctaccgaccaacgacacccgccgccccgcccgcctactcctcctaaaccatcgaaacttccaaaaccctcgaccacgtacaccaaaccctaactaaaaaacccgacatactaaacgaattccgaacgactctcaataacgacgctacttataatctaatacttataaaacccgtaatctaactccgaaccgatatcctctacccataataacccccacgtcttaaaaaatcgcgtcaataaaacccgtaacttcgcgaacgaaccgaactaacgcaaactaaattctctaaccgcaacgaatccgcgcctaacga

SEQ ID NO: 21507 - DNA, 536 bp, Artificial Sequence
  chemically treated genomic DNA (Homo sapiens) CpG-island No: 21507
ttttaattttagtcggagtttgggttttacgtttttttaggggttatttaggacgcgaatattttcgggcggcggttagtattttgttttttttttcggtcgtcgtttgtgggttcgggttttggatttcgttcggtgtttggaaggagttcgcgggcgtcggtgcgtttggagttgttttttgcgcgtattagatttgcgttaggttaggtcgaagttttttatcggttagcgatattcgtcgtttcgttcgtttgttttttttaggttatcggggtttttagggttttcgattacgtatattaggttttggttaggggattcgatatgttgggcgagtttcgagcggtttttagtggcggcgttgtttatggtttgatgtttatggggttcgtgatttggtttcgaatcgatgttttttgtttatggtgatttttacgttttggaaagtcgcgttagtgaagttcgtggtttcgcgagcgagtcgggttggcgtagattgggttttttggtcgtagcgggttcgcgtttgacgg

SEQ ID NO: 21508 - DNA, 536 bp, Artificial Sequence
  chemically treated genomic DNA (Homo sapiens) CpG-island No: 21508
ccgtcaaacgcgaacccgctacgaccaaaaaacccaatctacgccaacccgactcgctcgcgaaaccacgaacttcactaacgcgactttccaaaacgtaaaaatcaccataaacaaaaaacatcgattcgaaaccaaatcacgaaccccataaacatcaaaccataaacaacgccgccactaaaaaccgctcgaaactcgcccaacatatcgaatcccctaaccaaaacctaatatacgtaatcgaaaaccctaaaaaccccgataacctaaaaaaaacaaacgaacgaaacgacgaatatcgctaaccgataaaaaacttcgacctaacctaacgcaaatctaatacgcgcaaaaaacaactccaaacgcaccgacgcccgcgaactccttccaaacaccgaacgaaatccaaaacccgaacccacaaacgacgaccgaaaaaaaaaacaaaatactaaccgccgcccgaaaatattcgcgtcctaaataacccctaaaaaaacgtaaaacccaaactccgactaaaattaaaa

SEQ ID NO: 21509 - DNA, 932 bp, Artificial Sequence
  chemically treated genomic DNA (Homo sapiens) CpG-island No: 21509
tttcgcgcgtcgaggagtttagcgttagtggcggcggttaggagagattcgggtgttaggaaagatgggtcgtttgggggatagtagggagttcgggggaaacgtaggcgtcgggtatagagtcggtatcggcgtttttagttttgtcgaagatcgcggtcgggtttggttcgcgggaggggttttggcgtcggatttgtttcggttttgcgtgggcggtttcgtcgggttttgtaggagcgacgcgcgttaaaaggcggcgggaaggaggcggggtagagcgcgttcgggatttcgatttggacgcggttagttggagaggcggagcgtcgggaggagattttggtttcgtcgcgattcggtggttcgcgttgttttttcgcgcgtcgggttaaaaaggcgttaacgttcgcggtcgtttatttttcgcggcgtttttttttttcgcgtttatataattcgtttaggggtcgggtagttcgttttgttttttcgttcgcgtattcgttcggaggttcgcgcgttcgcgaaggggacgtagcgaaatcggggttcgcgttaggttagtcgggacggacgtcgatgttcggggttgcgacggttgtaggtaggaggtttagggtcggggggcggttcggtttcgcgggcgggggttggagcgtagcgttgggtaggtatttgggttcgtagtttcgaagttgggaggtgaggggagagcgatcggggacgagttgggataaggcgatataggggttttttcggagttggatcggtttttgggatttggcgttcgcgagaggttggagcggttagagtttagtttgcgaggagacgcgggttttgtttttagcgtcggtcgtttttggcgttaaagatagtttcgtaggggtttcgggagggttttttttttgttgttttttttttatttcggg

SEQ ID NO: 21510 - DNA, 932 bp, Artificial Sequence
  chemically treated genomic DNA (Homo sapiens) CpG-island No: 21510
cccgaaataaaaaaaaaacaacaaaaaaaaaaccctcccgaaacccctacgaaactatctttaacgccaaaaacgaccgacgctaaaaacaaaacccgcgtctcctcgcaaactaaactctaaccgctccaacctctcgcgaacgccaaatcccaaaaaccgatccaactccgaaaaaacccctatatcgccttatcccaactcgtccccgatcgctctcccctcacctcccaacttcgaaactacgaacccaaatacctacccaacgctacgctccaacccccgcccgcgaaaccgaaccgccccccgaccctaaacctcctacctacaaccgtcgcaaccccgaacatcgacgtccgtcccgactaacctaacgcgaaccccgatttcgctacgtccccttcgcgaacgcgcgaacctccgaacgaatacgcgaacgaaaaaacaaaacgaactacccgacccctaaacgaattatataaacgcgaaaaaaaaaaacgccgcgaaaaataaacgaccgcgaacgttaacgcctttttaacccgacgcgcgaaaaaacaacgcgaaccaccgaatcgcgacgaaaccaaaatctcctcccgacgctccgcctctccaactaaccgcgtccaaatcgaaatcccgaacgcgctctaccccgcctccttcccgccgccttttaacgcgcgtcgctcctacaaaacccgacgaaaccgcccacgcaaaaccgaaacaaatccgacgccaaaacccctcccgcgaaccaaacccgaccgcgatcttcgacaaaactaaaaacgccgataccgactctatacccgacgcctacgtttcccccgaactccctactatcccccaaacgacccatctttcctaacacccgaatctctcctaaccgccgccactaacgctaaactcctcgacgcgcgaaa

SEQ ID NO: 21511 - DNA, 932 bp, Artificial Sequence
  chemically treated genomic DNA (Homo sapiens) CpG-island No: 21511
ttcggggtggagaggggatagtaggaggagggttttttcggaatttttgcggggttgtttttggcgttaaaggcggtcggcgttgagggtaggattcgcgttttttcgtaggttagattttggtcgttttagtttttcgcgagcgttaagttttaggggtcgatttaatttcgagggagtttttgtgtcgttttgttttagttcgttttcgatcgttttttttttattttttagtttcggagttgcgagtttaggtgtttgtttagcgttgcgttttagttttcgttcgcggagtcgaatcgtttttcggttttgggttttttatttgtagtcgtcgtagtttcgggtatcggcgttcgtttcggttggtttggcgcgggtttcggtttcgttgcgtttttttcgcgggcgcgcgagttttcgggcgggtgcgcgggcggggaggtagggcgggttgttcggtttttaggcgggttatatgggcgcggggaggggaggcgtcgcggggagtaggcggtcgcgggcgttagcgtttttttagttcggcgcgcgggaaggtagcgcgggttatcgagtcgcggcggggttaaggttttttttcggcgtttcgtttttttagttggtcgcgtttaagtcggggtttcgggcgcgttttgtttcgtttttttttcgtcgttttttggcgcgcgtcgtttttgtagagttcggcgaggtcgtttacgtagggtcgaagtaggttcggcgttagggtttttttcgcgggttagattcgatcgcgattttcggtagagttggggacgtcggtgtcgattttgtgttcgacgtttgcgtttttttcggattttttgttgttttttagacggtttattttttttgatattcgggttttttttggtcgtcgttattagcgttgggtttttcggcgcgcgggg

SEQ ID NO: 21512 - DNA, 932 bp, Artificial Sequence
  chemically treated genomic DNA (Homo sapiens) CpG-island No: 21512
ccccgcgcgccgaaaaacccaacgctaataacgacgaccaaaaaaaacccgaatatcaaaaaaaataaaccgtctaaaaaacaacaaaaaatccgaaaaaaacgcaaacgtcgaacacaaaatcgacaccgacgtccccaactctaccgaaaatcgcgatcgaatctaacccgcgaaaaaaaccctaacgccgaacctacttcgaccctacgtaaacgacctcgccgaactctacaaaaacgacgcgcgccaaaaaacgacgaaaaaaaaacgaaacaaaacgcgcccgaaaccccgacttaaacgcgaccaactaaaaaaacgaaacgccgaaaaaaaaccttaaccccgccgcgactcgataacccgcgctaccttcccgcgcgccgaactaaaaaaacgctaacgcccgcgaccgcctactccccgcgacgcctcccctccccgcgcccatataacccgcctaaaaaccgaacaacccgccctacctccccgcccgcgcacccgcccgaaaactcgcgcgcccgcgaaaaaaacgcaacgaaaccgaaacccgcgccaaaccaaccgaaacgaacgccgatacccgaaactacgacgactacaaataaaaaacccaaaaccgaaaaacgattcgactccgcgaacgaaaactaaaacgcaacgctaaacaaacacctaaactcgcaactccgaaactaaaaaataaaaaaaaaacgatcgaaaacgaactaaaacaaaacgacacaaaaactccctcgaaattaaatcgacccctaaaacttaacgctcgcgaaaaactaaaacgaccaaaatctaacctacgaaaaaacgcgaatcctaccctcaacgccgaccgcctttaacgccaaaaacaaccccgcaaaaattccgaaaaaaccctcctcctactatcccctctccaccccgaa

SEQ ID NO: 21513 - DNA, 565 bp, Artificial Sequence
  chemically treated genomic DNA (Homo sapiens) CpG-island No: 21513
ggcgtcgtttttttgaagcgggcgtaaagttaggttttcggggcggtcgtgttcgcgtcgtttcgcgttttcgtttttcgaaagtacgcggtttagtggtttttagcgagcggggatatttcggtttttttgttttcgtcgttttcgtcggggtaatacggaaggtcgggggatatacgtttcgggagtttttggagttaataggtgggcgcggtcggtcggttcgtttcgggattggtattcgtagtttagatcgcgcgcgtttattggttttcggcgtcggggggttttcgcggtagggtagtaggggtcgtgtttaggggcggggtcgggtaggaggcggtgattggtaggttcgtacgtttcgtttttttcgtttttgtggtttgatttttttgcggttgaatcgttcggttgagtcgatattgtcggcgttttggcgattcggttcgacgagtttcgttttcgttatagtatggtggtttattggagataggttggatttaggtaggtttaggtttttagagggaagggtttcgcgagtcggttcgcgcgtatttcggtg

SEQ ID NO: 21514 - DNA, 565 bp, Artificial Sequence
  chemically treated genomic DNA (Homo sapiens) CpG-island No: 21514
caccgaaatacgcgcgaaccgactcgcgaaacccttccctctaaaaacctaaacctacctaaatccaacctatctccaataaaccaccatactataacgaaaacgaaactcgtcgaaccgaatcgccaaaacgccgacaatatcgactcaaccgaacgattcaaccgcaaaaaaatcaaaccacaaaaacgaaaaaaacgaaacgtacgaacctaccaatcaccgcctcctacccgaccccgcccctaaacacgacccctactaccctaccgcgaaaaccccccgacgccgaaaaccaataaacgcgcgcgatctaaactacgaataccaatcccgaaacgaaccgaccgaccgcgcccacctattaactccaaaaactcccgaaacgtatatcccccgaccttccgtattaccccgacgaaaacgacgaaaacaaaaaaaccgaaatatccccgctcgctaaaaaccactaaaccgcgtactttcgaaaaacgaaaacgcgaaacgacgcgaacacgaccgccccgaaaacctaactttacgcccgcttcaaaaaaacgacgcc

SEQ ID NO: 21515 - DNA, 565 bp, Artificial Sequence
  chemically treated genomic DNA (Homo sapiens) CpG-island No: 21515
tatcgggatgcgcgcgggtcggttcgcgaagtttttttttttggaggtttgggtttatttgagtttagtttgtttttagtaggttattatgttgtagcgaaagcggagttcgtcgggtcgaatcgttaagacgtcggtaatgtcggtttagtcgggcggtttagtcgtaggaagattagattatagaagcggaagaggcggggcgtgcggatttgttaattatcgttttttattcggtttcgtttttgagtacggtttttgttgttttgtcgcggaagtttttcggcgtcgggagttaatgggcgcgcgcggtttggattgcgggtgttaatttcggggcgggtcggtcggtcgcgtttatttattggttttaagagttttcggggcgtgtgtttttcgatttttcgtattatttcggcggggacgacgggggtaagaaggtcggggtgttttcgttcgttaaggattattgagtcgcgtgttttcgggaagcgaggacgcgaggcggcgcgggtacggtcgtttcgagggtttggttttgcgttcgttttagggaaacggcgtt

SEQ ID NO: 21516 - DNA, 565 bp, Artificial Sequence
  chemically treated genomic DNA (Homo sapiens) CpG-island No: 21516
aacgccgtttccctaaaacgaacgcaaaaccaaaccctcgaaacgaccgtacccgcgccgcctcgcgtcctcgcttcccgaaaacacgcgactcaataatccttaacgaacgaaaacaccccgaccttcttacccccgtcgtccccgccgaaataatacgaaaaatcgaaaaacacacgccccgaaaactcttaaaaccaataaataaacgcgaccgaccgacccgccccgaaattaacacccgcaatccaaaccgcgcgcgcccattaactcccgacgccgaaaaacttccgcgacaaaacaacaaaaaccgtactcaaaaacgaaaccgaataaaaaacgataattaacaaatccgcacgccccgcctcttccgcttctataatctaatcttcctacgactaaaccgcccgactaaaccgacattaccgacgtcttaacgattcgacccgacgaactccgctttcgctacaacataataacctactaaaaacaaactaaactcaaataaacccaaacctccaaaaaaaaaaacttcgcgaaccgacccgcgcgcatcccgata

SEQ ID NO: 21517 - DNA, 776 bp, Artificial Sequence
  chemically treated genomic DNA (Homo sapiens) CpG-island No: 21517
gagtcgggcgggggttttcgggtttcgcggtttcgtcgtcgttcgttttcgcgcgtttttttttttttttcgggtcgagtcggcgttattgcgttaggatggagcgagttcggcgcgggaggagatgacgtaaaagttagcgttttttttaaaaaagtgtttttttaggacgaagatggcggtaatttagttcgcggattgaagatgattgtggttttcgggaggtttagtttaggcgattcggttcggagtttcgcgggaggcggcgttagtagtcggagtttcggcggcggcgttcgcgggcggttttgcggtagcggcggcggcggcggcggcggcggtagtatttagagcgcggggtggggggtgggggggagggagcgtttcgtcggaggtagtttaggtttcggattttgggagagttagcgcggagtaggagcgggaggcggaggagaagaagaaggagaaggaaaggaaggaggaggaagaggaggagaagaagaggaggaggaggaggaggaggggaggcgtttcgggcgtcgttagtgggtagcggaggcgcggtatgtttttggtaggggagagcgggttgggtttcgcggggttatggggattcgcgcgttgataatgtttgggtgatcggagtcgcgttagttattttgttatttttattatcgttttttgtatttagtttcgtcgtcggttattagtattagtttttttcgtttttttttttttttttttttttattattgttttttattttatagaggatg

SEQ ID NO: 21518 - DNA, 776 bp, Artificial Sequence
  chemically treated genomic DNA (Homo sapiens) CpG-island No: 21518
catcctctataaaataaaaaacaataataaaaaaaaaaaaaaaaaaaaaaacgaaaaaaactaatactaataaccgacgacgaaactaaatacaaaaaacgataataaaaataacaaaataactaacgcgactccgatcacccaaacattatcaacgcgcgaatccccataaccccgcgaaacccaacccgctctcccctaccaaaaacataccgcgcctccgctacccactaacgacgcccgaaacgcctcccctcctcctcctcctcctcctcttcttctcctcctcttcctcctccttcctttccttctccttcttcttctcctccgcctcccgctcctactccgcgctaactctcccaaaatccgaaacctaaactacctccgacgaaacgctccctcccccccaccccccaccccgcgctctaaatactaccgccgccgccgccgccgccgccgctaccgcaaaaccgcccgcgaacgccgccgccgaaactccgactactaacgccgcctcccgcgaaactccgaaccgaatcgcctaaactaaacctcccgaaaaccacaatcatcttcaatccgcgaactaaattaccgccatcttcgtcctaaaaaaacacttttttaaaaaaaacgctaacttttacgtcatctcctcccgcgccgaactcgctccatcctaacgcaataacgccgactcgacccgaaaaaaaaaaaaaaacgcgcgaaaacgaacgacgacgaaaccgcgaaacccgaaaacccccgcccgactc

SEQ ID NO: 21519 - DNA, 776 bp, Artificial Sequence
  chemically treated genomic DNA (Homo sapiens) CpG-island No: 21519
tattttttgtagagtgggaaataataatggagagagagagagagagagagacggaggaggttggtgttggtggtcggcggcgaggttgggtgtagggggcgatggtggaggtgatagggtggttggcgcggtttcggttatttaggtattgttagcgcgcgggtttttatggtttcgcggagtttagttcgtttttttttgttaggggtatgtcgcgttttcgttgtttattgacggcgttcggagcgttttttttttttttttttttttttttttttttttttttttttttttttttttttttttttttttttttttttttttttttcgtttttcgtttttgtttcgcgttggtttttttagagttcggagtttgggttgttttcggcggggcgtttttttttttttattttttatttcgcgttttaagtgttgtcgtcgtcgtcgtcgtcgtcgtcgttgtcgtagggtcgttcgcgggcgtcgtcgtcggggtttcgattgttgacgtcgtttttcgcggagtttcgggtcgaatcgtttgggttgggtttttcgagagttatagttatttttagttcgcgggttaagttgtcgttattttcgttttggagaaatatttttttggggggagcgttggtttttgcgttattttttttcgcgtcgagttcgttttattttggcgtagtggcgtcggttcggttcgggaggagggagaaggcgcgcgggggcgggcggcggcggggtcgcggggttcgggggttttcgttcggttt

SEQ ID NO: 21520 - DNA, 776 bp, Artificial Sequence
  chemically treated genomic DNA (Homo sapiens) CpG-island No: 21520
aaaccgaacgaaaacccccgaaccccgcgaccccgccgccgcccgcccccgcgcgccttctccctcctcccgaaccgaaccgacgccactacgccaaaataaaacgaactcgacgcgaaaaaaaataacgcaaaaaccaacgctccccccaaaaaaatatttctccaaaacgaaaataacgacaacttaacccgcgaactaaaaataactataactctcgaaaaacccaacccaaacgattcgacccgaaactccgcgaaaaacgacgtcaacaatcgaaaccccgacgacgacgcccgcgaacgaccctacgacaacgacgacgacgacgacgacgacgacaacacttaaaacgcgaaataaaaaataaaaaaaaaaaaacgccccgccgaaaacaacccaaactccgaactctaaaaaaaccaacgcgaaacaaaaacgaaaaacgaaaaaaaaaaaaaaaaaaaaaaaaaaaaaaaaaaaaaaaaaaaaaaaaaaaaaaaaaaaaaaaaaaaaaaaaaaaaaaaacgctccgaacgccgtcaataaacaacgaaaacgcgacatacccctaacaaaaaaaaacgaactaaactccgcgaaaccataaaaacccgcgcgctaacaatacctaaataaccgaaaccgcgccaaccaccctatcacctccaccatcgccccctacacccaacctcgccgccgaccaccaacaccaacctcctccgtctctctctctctctctctctccattattatttcccactctacaaaaaata

SEQ ID NO: 21521 - DNA, 673 bp, Artificial Sequence
  chemically treated genomic DNA (Homo sapiens) CpG-island No: 21521
gtgttgagtgattttagcgcgcggtcgtcgtagggaagcgttgttcgtaggagttcggtggtttcgagggcgtaggagggttggggattttagggtggcggttcgggatggggtcgagatcgttggggggagggggtaggaagggcgtcgaggatcgttggcggaggtttcggttcggtggggggcgttggggatggcgggcgtaggtttagcgcgtcgattgcggggttaggggcgaaggggtaggcggagggtagcgcgcggggagtcggcgcggcggttcgggttatcgcggttcgattttgttattcgtagtttcggcgcgggggttggggcggatttcggtcgtatttcgttgtttgtatttttttggtaggcggcggagtttgggttgaaaggaatcgtttttatttggaacgttgtttattttttttaattagttagcgtcgacggacgatttcgcgagtacggaggtcggattcggtcgatttagcgttagaaaggggttaggattgggggcggttaggcgaggtggtgttgcgagcgttcgtattgggaatgtgtttcggtgttttagcggtcgggatgggggaagggtcgtggcgggtttaaggattttttattacgtaggaaaatagatttttttttgttagagttattatattttagtttt

SEQ ID NO: 21522 - DNA, 673 bp, Artificial Sequence
  chemically treated genomic DNA (Homo sapiens) CpG-island No: 21522
aaaactaaaatataataactctaacaaaaaaaaatctattttcctacgtaataaaaaatccttaaacccgccacgacccttcccccatcccgaccgctaaaacaccgaaacacattcccaatacgaacgctcgcaacaccacctcgcctaaccgcccccaatcctaacccctttctaacgctaaatcgaccgaatccgacctccgtactcgcgaaatcgtccgtcgacgctaactaattaaaaaaaataaacaacgttccaaataaaaacgattcctttcaacccaaactccgccgcctaccaaaaaaatacaaacaacgaaatacgaccgaaatccgccccaacccccgcgccgaaactacgaataacaaaatcgaaccgcgataacccgaaccgccgcgccgactccccgcgcgctaccctccgcctaccccttcgcccctaaccccgcaatcgacgcgctaaacctacgcccgccatccccaacgccccccaccgaaccgaaacctccgccaacgatcctcgacgcccttcctaccccctccccccaacgatctcgaccccatcccgaaccgccaccctaaaatccccaaccctcctacgccctcgaaaccaccgaactcctacgaacaacgcttccctacgacgaccgcgcgctaaaatcactcaacac

SEQ ID NO: 21523 - DNA, 673 bp, Artificial Sequence
  chemically treated genomic DNA (Homo sapiens) CpG-island No: 21523
aaagttaaggtatgataattttggtaggagaaagtttgtttttttacgtggtagaaagtttttgggttcgttacgattttttttttatttcggtcgttggggtatcggggtatatttttagtgcgggcgttcgtagtattatttcgtttggtcgtttttagttttgatttttttttagcgttggatcggtcgggttcggttttcgtgttcgcggggtcgttcgtcggcgttggttagttaagaaaaataaataacgttttaaatgaaggcgattttttttaatttaagtttcgtcgtttgttagagaaatgtaaatagcggggtacggtcggagttcgttttagttttcgcgtcggagttgcgggtggtagggtcgggtcgcggtaattcgagtcgtcgcgtcggtttttcgcgcgttgtttttcgtttgttttttcgtttttgatttcgtagtcggcgcgttgggtttgcgttcgttatttttagcgttttttatcgggtcgggattttcgttagcggttttcggcgttttttttgttttttttttttagcggtttcggttttatttcgaatcgttattttgggatttttagtttttttgcgttttcgaggttatcgggtttttgcgagtaacgtttttttgcggcgatcgcgcgttgggattatttaatat

SEQ ID NO: 21524 - DNA, 673 bp, Artificial Sequence
  chemically treated genomic DNA (Homo sapiens) CpG-island No: 21524
atattaaataatcccaacgcgcgatcgccgcaaaaaaacgttactcgcaaaaacccgataacctcgaaaacgcaaaaaaactaaaaatcccaaaataacgattcgaaataaaaccgaaaccgctaaaaaaaaaaaacaaaaaaaacgccgaaaaccgctaacgaaaatcccgacccgataaaaaacgctaaaaataacgaacgcaaacccaacgcgccgactacgaaatcaaaaacgaaaaaacaaacgaaaaacaacgcgcgaaaaaccgacgcgacgactcgaattaccgcgacccgaccctaccacccgcaactccgacgcgaaaactaaaacgaactccgaccgtaccccgctatttacatttctctaacaaacgacgaaacttaaattaaaaaaaatcgccttcatttaaaacgttatttatttttcttaactaaccaacgccgacgaacgaccccgcgaacacgaaaaccgaacccgaccgatccaacgctaaaaaaaaatcaaaactaaaaacgaccaaacgaaataatactacgaacgcccgcactaaaaatataccccgataccccaacgaccgaaataaaaaaaaaatcgtaacgaacccaaaaactttctaccacgtaaaaaaacaaactttctcctaccaaaattatcataccttaacttt

SEQ ID NO: 21525 - DNA, 1264 bp, Artificial Sequence
  chemically treated genomic DNA (Homo sapiens) CpG-island No: 21525
acggtcgcggatggtcggtaggatttgatatttaaaatcgttttgtttatttgggtttcggagtttttgataggcgggcgtgttagcgatagtgtggggaaggggttgggtttcgttaggtagcgcgcgacgacgtttttgttttggtttttatagagtagaattcgagaagtttattcgttcgttttggttaacgtttttaacgtttagggtttttttcgtagtcggcgggtaggtgtgcgtggtgcgcgagtttagtgcgtgtcgggtgcggcgttagtagcggaggggcggttcggcgtttagcggagagtcgttggttgggtgggtgtcggttttttcgtttttttttttttttcgttcgtttgtcggggatgtttgcgcgaggcgttttttcgtttttaagttttcggtttcggggggcggtgtgtgtgagtagttgggagggggtcgcgaggcgtttcgtcgagggttcgttcgggtttgttcgtcgtcgttatttgattcgtcggaggagttatagttgaggtgggggcggggatggggacgtagttcggagcgttagagagacgcggcggcgttggtagaagaggcggcggcgggcgggtattggtttttggggttaggggttaggggcggtgggcgtcgggatcgcggagttgaggagcggggttcggttagggttggagattttgcgttcgggggtatcggggttgcgcgcggtcgtatatatttatcggcgcggtttttttcggcggttcgggtttcgtttattttgcggcgggcggcgtcgtttaggggcggggtgagtattcgcggcggtattcggtttttttttcgcgttagggtttcgcggggattcgtagaggataattttagggtgcggagaagggtagcggtcgagtgatagtttcgcggagcgttttagggcgggcgggggattgggtttcgttgttagttcggtttttttttaaagttaggaagggtgaggcgttttaagatttcggcgttttcgtagagttttcgggcggtttttgcggtagggatttggaatcggggggaaggggttcgggcgatgggtttcggcgaggttttggagtcggcggcgaggaaggaaggggaggcgagggtataatatggcgtaacgttaggataatttttttcgcgattgagggaggacgagttttttgttgtagtagcgcgaggaggaggagggaggtagttagggtttgggtattcgatgtatttttcgaagtttgcgggt

SEQ ID NO: 21526 - DNA, 1264 bp, Artificial Sequence
  chemically treated genomic DNA (Homo sapiens) CpG-island No: 21526
acccgcaaacttcgaaaaatacatcgaatacccaaaccctaactacctccctcctcctcctcgcgctactacaacaaaaaactcgtcctccctcaatcgcgaaaaaaattatcctaacgttacgccatattataccctcgcctccccttccttcctcgccgccgactccaaaacctcgccgaaacccatcgcccgaaccccttccccccgattccaaatccctaccgcaaaaaccgcccgaaaactctacgaaaacgccgaaatcttaaaacgcctcacccttcctaactttaaaaaaaaaccgaactaacaacgaaacccaatcccccgcccgccctaaaacgctccgcgaaactatcactcgaccgctacccttctccgcaccctaaaattatcctctacgaatccccgcgaaaccctaacgcgaaaaaaaaaccgaataccgccgcgaatactcaccccgcccctaaacgacgccgcccgccgcaaaataaacgaaacccgaaccgccgaaaaaaaccgcgccgataaatatatacgaccgcgcgcaaccccgatacccccgaacgcaaaatctccaaccctaaccgaaccccgctcctcaactccgcgatcccgacgcccaccgcccctaacccctaaccccaaaaaccaatacccgcccgccgccgcctcttctaccaacgccgccgcgtctctctaacgctccgaactacgtccccatccccgcccccacctcaactataactcctccgacgaatcaaataacgacgacgaacaaacccgaacgaaccctcgacgaaacgcctcgcgaccccctcccaactactcacacacaccgccccccgaaaccgaaaacttaaaaacgaaaaaacgcctcgcgcaaacatccccgacaaacgaacgaaaaaaaaaaaaaaacgaaaaaaccgacacccacccaaccaacgactctccgctaaacgccgaaccgcccctccgctactaacgccgcacccgacacgcactaaactcgcgcaccacgcacacctacccgccgactacgaaaaaaaccctaaacgttaaaaacgttaaccaaaacgaacgaataaacttctcgaattctactctataaaaaccaaaacaaaaacgtcgtcgcgcgctacctaacgaaacccaaccccttccccacactatcgctaacacgcccgcctatcaaaaactccgaaacccaaataaacaaaacgattttaaatatcaaatcctaccgaccatccgcgaccgt

SEQ ID NO: 21527 - DNA, 1264 bp, Artificial Sequence
  chemically treated genomic DNA (Homo sapiens) CpG-island No: 21527
gttcgtaggtttcggggaatgtatcggatatttaagttttggttgttttttttttttttttcgcgttgttgtagtaaagggttcgtttttttttagtcgcgaaggagattattttagcgttgcgttatgttatgttttcgttttttttttttttttcgtcgtcggttttaaagtttcgtcgaggtttatcgttcgggtttttttttttcggttttaaatttttgtcgtaggggtcgttcgggagttttgcggaggcgtcggagttttggggcgttttattttttttggttttggagaggagtcgggttgatagcgaagtttagtttttcgttcgttttggagcgtttcgcggagttgttattcggtcgttgttttttttcgtattttgggattattttttgcggattttcgcgagattttggcgcggggagggggtcgagtatcgtcgcgggtatttatttcgtttttgagcggcgtcgttcgtcgtaggatgagcggagttcgggtcgtcgagggaagtcgcgtcggtggatgtgtgcgatcgcgcgtagtttcggtgttttcgggcgtaaagtttttagttttggtcgggtttcgttttttagtttcgcggtttcggcgtttatcgtttttggtttttggttttagaagttagtattcgttcgtcgtcgttttttttgttagcgtcgtcgcgtttttttagcgtttcgagttgcgtttttattttcgtttttattttagttgtggttttttcgacgagttaggtgacggcggcggataaattcggacgagttttcggcggagcgtttcgcggtttttttttagttatttatatatatcgtttttcggggtcgggagtttaaaggcgagggggcgtttcgcgtaagtattttcggtaagcgggcggggagaagaaggaggcggggaggtcgatatttatttagttagcggtttttcgttgggcgtcgggtcgttttttcgttgttggcgtcgtattcggtacgtattgggttcgcgtattacgtatatttgttcgtcgattgcggggggagttttgggcgttgggggcgttggttaagacgggcgagtgggtttttcgggttttattttgtgaaggttaaggtaagggcgtcgtcgcgcgttgtttggcggagtttagttttttttttatattgtcgttgatacgttcgtttgttaaaggtttcgaggtttagatgagtagggcgattttaaatgttagattttgtcggttattcgcgatcgt

SEQ ID NO: 21528 - DNA, 1264 bp, Artificial Sequence
  chemically treated genomic DNA (Homo sapiens) CpG-island No: 21528
acgatcgcgaataaccgacaaaatctaacatttaaaatcgccctactcatctaaacctcgaaacctttaacaaacgaacgtatcaacgacaatataaaaaaaaaactaaactccgccaaacaacgcgcgacgacgcccttaccttaaccttcacaaaataaaacccgaaaaacccactcgcccgtcttaaccaacgcccccaacgcccaaaactccccccgcaatcgacgaacaaatatacgtaatacgcgaacccaatacgtaccgaatacgacgccaacaacgaaaaaacgacccgacgcccaacgaaaaaccgctaactaaataaatatcgacctccccgcctccttcttctccccgcccgcttaccgaaaatacttacgcgaaacgccccctcgcctttaaactcccgaccccgaaaaacgatatatataaataactaaaaaaaaaccgcgaaacgctccgccgaaaactcgtccgaatttatccgccgccgtcacctaactcgtcgaaaaaaccacaactaaaataaaaacgaaaataaaaacgcaactcgaaacgctaaaaaaacgcgacgacgctaacaaaaaaaacgacgacgaacgaatactaacttctaaaaccaaaaaccaaaaacgataaacgccgaaaccgcgaaactaaaaaacgaaacccgaccaaaactaaaaactttacgcccgaaaacaccgaaactacgcgcgatcgcacacatccaccgacgcgacttccctcgacgacccgaactccgctcatcctacgacgaacgacgccgctcaaaaacgaaataaatacccgcgacgatactcgaccccctccccgcgccaaaatctcgcgaaaatccgcaaaaaataatcccaaaatacgaaaaaaaacaacgaccgaataacaactccgcgaaacgctccaaaacgaacgaaaaactaaacttcgctatcaacccgactcctctccaaaaccaaaaaaaataaaacgccccaaaactccgacgcctccgcaaaactcccgaacgacccctacgacaaaaatttaaaaccgaaaaaaaaaaacccgaacgataaacctcgacgaaactttaaaaccgacgacgaaaaaaaaaaaaaaaacgaaaacataacataacgcaacgctaaaataatctccttcgcgactaaaaaaaaacgaaccctttactacaacaacgcgaaaaaaaaaaaaaaaacaaccaaaacttaaatatccgatacattccccgaaacctacgaac

SEQ ID NO: 21529 - DNA, 848 bp, Artificial Sequence
  chemically treated genomic DNA (Homo sapiens) CpG-island No: 21529
  misc_feature (541)..(541): n is either a, c, g or t
gcgcgtcgagatcgttcgcgtatgcgcgttattgacgtttcgtcggcgcgcgttgtcgttagcgaggttcgggaagatcgcggcggaggcggaggttcggcgttttgggcggcgttttgttttcgaagttcgtttttttcgttaggtggcgagcgttcgaggggaggggatagtcgggtaagtaggaagttgcggtttaaaagggtaattcgcgcgggattttttttttttagtcgcggggagtttgagaaagcgcgtttgtttcgcgattattacgtatttttttttcgtttgtggttatgtatcgttatttgggcgaagcgttgttgttgtttcgggtcgggttcgttgttttgggttcggcgttcgtcgattcggtcgcgttgttgggttgggttcggggatagttcgtcgtcgtttcgtagtcggggttggtattggtcgttcggcgttattatagcgaggcggtggtcgatcgcgaggacgattttaatttttttaagatggtggagggttttttcgatcgcggcgttagtatcgnggaggataagttggtggaggatttgaggattcgggagagcgaggagtagaagcggaatcgggtgcgcggtattttgcggattattaagttttgtaattatgtgttgagtttttttttttttattcggcgcgacgacggtttttgggaggttatcgaaggttatcgggtttagtatagttagtatcgtacgttttgtaagggaggtgagcgtcggtcgggtttcgtttcgttttttttgttttttttgcggttttttttttcggtttattgtcggtgcggggtcgttgtttagtttagtttagtttag

SEQ ID NO: 21530 - DNA, 848 bp, Artificial Sequence
  chemically treated genomic DNA (Homo sapiens) CpG-island No: 21530
  misc_feature (308)..(308): n is either a, c, g or t
ctaaactaaactaaactaaacaacgaccccgcaccgacaataaaccgaaaaaaaaaaccgcaaaaaaaacaaaaaaaacgaaacgaaacccgaccgacgctcacctcccttacaaaacgtacgatactaactatactaaacccgataaccttcgataacctcccaaaaaccgtcgtcgcgccgaataaaaaaaaaaaaactcaacacataattacaaaacttaataatccgcaaaataccgcgcacccgattccgcttctactcctcgctctcccgaatcctcaaatcctccaccaacttatcctccncgatactaacgccgcgatcgaaaaaaccctccaccatcttaaaaaaattaaaatcgtcctcgcgatcgaccaccgcctcgctataataacgccgaacgaccaataccaaccccgactacgaaacgacgacgaactatccccgaacccaacccaacaacgcgaccgaatcgacgaacgccgaacccaaaacaacgaacccgacccgaaacaacaacaacgcttcgcccaaataacgatacataaccacaaacgaaaaaaaaatacgtaataatcgcgaaacaaacgcgctttctcaaactccccgcgactaaaaaaaaaaaatcccgcgcgaattacccttttaaaccgcaacttcctacttacccgactatcccctcccctcgaacgctcgccacctaacgaaaaaaacgaacttcgaaaacaaaacgccgcccaaaacgccgaacctccgcctccgccgcgatcttcccgaacctcgctaacgacaacgcgcgccgacgaaacgtcaataacgcgcatacgcgaacgatctcgacgcgc

SEQ ID NO: 21531 - DNA, 848 bp, Artificial Sequence
  chemically treated genomic DNA (Homo sapiens) CpG-island No: 21531
  misc_feature (308)..(308): n is either a, c, g or t
ttgggttgggttgggttgagtagcggtttcgtatcggtagtaggtcggaggggagggtcgtaggggaggtagggagggcgggacggggttcggtcgacgtttattttttttgtagggcgtgcggtgttggttgtgttgggttcggtagttttcgatgattttttaggagtcgtcgtcgcgtcggatggggaaggagagatttagtatatggttgtagggtttgatgattcgtaggatgtcgcgtattcggtttcgtttttgtttttcgttttttcgggtttttaggttttttattagtttgttttttncgatgttggcgtcgcgatcgaagaagttttttattattttgaagaagttggggtcgttttcgcggtcggttatcgtttcgttgtagtggcgtcgggcggttaatgttagtttcggttgcggggcggcggcgggttgttttcgggtttagtttagtaacgcggtcgagtcggcggacgtcgagtttagggtagcgggttcggttcgggatagtaatagcgtttcgtttaggtagcggtatatggttataagcggaggggaggtgcgtgatggtcgcgaaataggcgcgtttttttagatttttcgcgattagggaggaagggtttcgcgcgggttgtttttttaagtcgtagttttttgtttgttcggttgtttttttttttcgggcgttcgttatttaacggggaggacggatttcggggatagggcgtcgtttagggcgtcgggttttcgttttcgtcgcggttttttcgggtttcgttggcggtagcgcgcgtcggcggggcgttagtggcgcgtatgcgcgggcggtttcggcgcgt

SEQ ID NO: 21532 - DNA, 848 bp, Artificial Sequence
  chemically treated genomic DNA (Homo sapiens) CpG-island No: 21532
  misc_feature (541)..(541): n is either a, c, g or t
acgcgccgaaaccgcccgcgcatacgcgccactaacgccccgccgacgcgcgctaccgccaacgaaacccgaaaaaaccgcgacgaaaacgaaaacccgacgccctaaacgacgccctatccccgaaatccgtcctccccgttaaataacgaacgcccgaaaaaaaaaaacaaccgaacaaacaaaaaactacgacttaaaaaaacaacccgcgcgaaacccttcctccctaatcgcgaaaaatctaaaaaaacgcgcctatttcgcgaccatcacgcacctcccctccgcttataaccatataccgctacctaaacgaaacgctattactatcccgaaccgaacccgctaccctaaactcgacgtccgccgactcgaccgcgttactaaactaaacccgaaaacaacccgccgccgccccgcaaccgaaactaacattaaccgcccgacgccactacaacgaaacgataaccgaccgcgaaaacgaccccaacttcttcaaaataataaaaaacttcttcgatcgcgacgccaacatcgnaaaaaacaaactaataaaaaacctaaaaacccgaaaaaacgaaaaacaaaaacgaaaccgaatacgcgacatcctacgaatcatcaaaccctacaaccatatactaaatctctccttccccatccgacgcgacgacgactcctaaaaaatcatcgaaaactaccgaacccaacacaaccaacaccgcacgccctacaaaaaaaataaacgtcgaccgaaccccgtcccgccctccctacctcccctacgaccctcccctccgacctactaccgatacgaaaccgctactcaacccaacccaacccaa

SEQ ID NO: 21533 - DNA, 709 bp, Artificial Sequence
  chemically treated genomic DNA (Homo sapiens) CpG-island No: 21533
cgaggcgttgagggtatcgttatagaaggtcgtttttatttttgtagttatagaatagttcgttattttacgtgaggttagtttgggttgcgcgtataagtttcggggtcgtaatagggttgtggtaagcgggggatattcgcgtttttcggagtttttgatagggaaagtttttttaagagcgtacgtattcgttggttgtcgttttcgttgcgttttttttattagttcgttttagggagcgtagggttaattaagatgtttttcgtatttttatttgtcgattcgcgcgcgttattcggttttgaaaagtcgcggttatttattgagcgtttttcgtgcgtagcggtttttcggagttcgtaggcgaatttattttttagagtagcggtttttttcgcggagcggattagtgcggattttgtagtggtcggtcggcggcgggttttggtcgttcggatttcgacgatttgttttttttttcgttgttagggggagggggcgttcggtagtcgcggttcgcgttcgtttaagtttaataatcggtgcgagcgaagttgagcgtacgtttttttttttttgcgtggtttttcgtcgttttttggtttttatcgtcgtggagaagtttaagacgtaggaaaggtttgtaaaagttggtttcgggattttgttatttgttttcggtttttttagtcgggaaagttttttg

SEQ ID NO: 21534 - DNA, 709 bp, Artificial Sequence
  chemically treated genomic DNA (Homo sapiens) CpG-island No: 21534
caaaaaactttcccgactaaaaaaaccgaaaacaaataacaaaatcccgaaaccaacttttacaaacctttcctacgtcttaaacttctccacgacgataaaaaccaaaaaacgacgaaaaaccacgcaaaaaaaaaaaaacgtacgctcaacttcgctcgcaccgattattaaacttaaacgaacgcgaaccgcgactaccgaacgccccctccccctaacaacgaaaaaaaaaacaaatcgtcgaaatccgaacgaccaaaacccgccgccgaccgaccactacaaaatccgcactaatccgctccgcgaaaaaaaccgctactctaaaaaataaattcgcctacgaactccgaaaaaccgctacgcacgaaaaacgctcaataaataaccgcgacttttcaaaaccgaataacgcgcgcgaatcgacaaataaaaatacgaaaaacatcttaattaaccctacgctccctaaaacgaactaataaaaaaaacgcaacgaaaacgacaaccaacgaatacgtacgctcttaaaaaaactttccctatcaaaaactccgaaaaacgcgaatatcccccgcttaccacaaccctattacgaccccgaaacttatacgcgcaacccaaactaacctcacgtaaaataacgaactattctataactacaaaaataaaaacgaccttctataacgataccctcaacgcctcg

SEQ ID NO: 21535 - DNA, 709 bp, Artificial Sequence
  chemically treated genomic DNA (Homo sapiens) CpG-island No: 21535
taaagaattttttcggttgggaggatcggagataagtggtagagtttcggagttaatttttgtaagttttttttgcgttttaggtttttttacggcggtaaagattagaaggcggcggagagttacgtaagagaagaaggacgtgcgtttagtttcgttcgtatcggttgttgaatttgggcgagcgcgagtcgcggttgtcgggcgttttttttttttagtagcggaggaggggataagtcgtcggagttcgggcggttaagattcgtcgtcggtcggttattgtagggttcgtattgattcgtttcgcggggagagtcgttgttttgggaagtgagttcgtttgcggatttcgaggaatcgttgcgtacgaagagcgtttagtgagtgatcgcgattttttaaagtcgggtagcgcgcgcgagtcgataagtaagagtgcgggaggtattttaattaattttgcgttttttggagcgagttggtgaggagggcgtagcggggacgatagttagcgggtgcgtgcgtttttagagaaattttttttgttaaaggtttcggggggcgcgggtgtttttcgtttgttatagttttgttgcggtttcgaaatttgtgcgcgtagtttaaattaattttacgtgaagtgacggattgttttatgattgtaaagatggaaacgattttttatgacgatgtttttaacgtttcg

SEQ ID NO: 21536 - DNA, 709 bp, Artificial Sequence
  chemically treated genomic DNA (Homo sapiens) CpG-island No: 21536
cgaaacgttaaaaacatcgtcataaaaaatcgtttccatctttacaatcataaaacaatccgtcacttcacgtaaaattaatttaaactacgcgcacaaatttcgaaaccgcaacaaaactataacaaacgaaaaacacccgcgccccccgaaacctttaacaaaaaaaatttctctaaaaacgcacgcacccgctaactatcgtccccgctacgccctcctcaccaactcgctccaaaaaacgcaaaattaattaaaatacctcccgcactcttacttatcgactcgcgcgcgctacccgactttaaaaaatcgcgatcactcactaaacgctcttcgtacgcaacgattcctcgaaatccgcaaacgaactcacttcccaaaacaacgactctccccgcgaaacgaatcaatacgaaccctacaataaccgaccgacgacgaatcttaaccgcccgaactccgacgacttatcccctcctccgctactaaaaaaaaaaaacgcccgacaaccgcgactcgcgctcgcccaaattcaacaaccgatacgaacgaaactaaacgcacgtccttcttctcttacgtaactctccgccgccttctaatctttaccgccgtaaaaaaacctaaaacgcaaaaaaaacttacaaaaattaactccgaaactctaccacttatctccgatcctcccaaccgaaaaaattcttta

SEQ ID NO: 21537 - DNA, 542 bp, Artificial Sequence
  chemically treated genomic DNA (Homo sapiens) CpG-island No: 21537
tttcgaagtttgtatttcggttaagtttaggagcgacggttcgcggggtcgtttggttgttcgtagaagtcgagagatttgtattgttcgaaattggacgtttagttgagttttcgttgtattttattttatttttcgggatcgtgggggaaagggcgcgggggtttatagttttgtttcggaggggtagtttttatagtgggcgtaattggtgggtaatagggtttagatgggaataagcgtgtaggcgattcgaaattcggggaatttcggtgttagtttattttttttttcgttttcggataatacgtatacgtttaatataatacgtataatataacgcgcgcgcgcgcgtatatatatattttattcgcgtcgagttgttttcgggaaaataagtttagaaggcggcggatattcgtataaagttacgtagtagtattcggagttcggggtagaatttggattttaaatttttgtattttcggtcgggtggtgggcgtatattttgggtagtttttaggaagcgttagatatatgta

SEQ ID NO: 21538 - DNA, 542 bp, Artificial Sequence
  chemically treated genomic DNA (Homo sapiens) CpG-island No: 21538
tacatatatctaacgcttcctaaaaactacccaaaatatacgcccaccacccgaccgaaaatacaaaaatttaaaatccaaattctaccccgaactccgaatactactacgtaactttatacgaatatccgccgccttctaaacttattttcccgaaaacaactcgacgcgaataaaatatatatatacgcgcgcgcgcgcgttatattatacgtattatattaaacgtatacgtattatccgaaaacgaaaaaaaaaataaactaacaccgaaattccccgaatttcgaatcgcctacacgcttattcccatctaaaccctattacccaccaattacgcccactataaaaactacccctccgaaacaaaactataaacccccgcgccctttcccccacgatcccgaaaaataaaataaaatacaacgaaaactcaactaaacgtccaatttcgaacaatacaaatctctcgacttctacgaacaaccaaacgaccccgcgaaccgtcgctcctaaacttaaccgaaatacaaacttcgaaa

SEQ ID NO: 21539 - DNA, 542 bp, Artificial Sequence
  chemically treated genomic DNA (Homo sapiens) CpG-island No: 21539
tatatgtgtttagcgttttttagaggttatttaggatatgcgtttattattcggtcgggagtgtagagatttgaagtttaggttttatttcgggtttcgagtattattgcgtgattttatgcgagtgttcgtcgttttttgggtttgttttttcggaagtaattcggcgcggatggagtgtgtgtgtgcgcgcgcgcgcgcgttatgttgtgcgtgttgtgttaagcgtgtgcgtgttgttcgggggcgggagggggagtagattaatatcggggtttttcgagtttcggatcgtttatacgtttgtttttatttggattttgttatttattaattgcgtttattataaaaattgttttttcgaggtaaagttgtgaattttcgcgtttttttttttacggtttcggaggatgaagtggggtgtaacggagatttagttgagcgtttagtttcgggtaatataaatttttcggtttttacgagtagttagacgatttcgcggatcgtcgtttttgaatttgatcgagatgtaaatttcggag

SEQ ID NO: 21540 - DNA, 542 bp, Artificial Sequence
  chemically treated genomic DNA (Homo sapiens) CpG-island No: 21540
ctccgaaatttacatctcgatcaaattcaaaaacgacgatccgcgaaatcgtctaactactcgtaaaaaccgaaaaatttatattacccgaaactaaacgctcaactaaatctccgttacaccccacttcatcctccgaaaccgtaaaaaaaaaaacgcgaaaattcacaactttacctcgaaaaaacaatttttataataaacgcaattaataaataacaaaatccaaataaaaacaaacgtataaacgatccgaaactcgaaaaaccccgatattaatctactccccctcccgcccccgaacaacacgcacacgcttaacacaacacgcacaacataacgcgcgcgcgcgcgcacacacacactccatccgcgccgaattacttccgaaaaaacaaacccaaaaaacgacgaacactcgcataaaatcacgcaataatactcgaaacccgaaataaaacctaaacttcaaatctctacactcccgaccgaataataaacgcatatcctaaataacctctaaaaaacgctaaacacatata

SEQ ID NO: 21541 - DNA, 821 bp, Artificial Sequence
  chemically treated genomic DNA (Homo sapiens) CpG-island No: 21541
tcggcgcgtttgtatttttcggtttgttagtgtatttgtcggcgtttcggtcgatcgttttcgttttttttttcgttgcgttcgtatttttgtttttggttttgacgtttttttttcgttcggaaagttgtttagttattagtaattttttaggtaattcgggtttttcgtagtgttcggtcggttgatattttttcgcgtcgggttttttagaggggcgtgtgtggggacggtggagattgggtcgtaggcgggcggcgtttcggggttaggtttcgttaggtcgtggttagttcgtgggtcggcggtgagcgtcgcggcgtcggtttgataggatttttgggcgggggcggaggtgttttttgcgcggtttcggtttgagttttttgttttttttaatcggcggggcgtttcgaggcgtgtagggaagggtgtgtttcggtttcgtttttttcgttttttcggcgcggttgggtaggatcgtatttttcgcgggtttttttttcgtcgttgtttttcgcggtcgtagttcgttttcgtagggtgtatttacgcgtgtcgcgtcgttttgtagttcgtaagttttagacgtggcggtttcgtttcgtaggtcgcgtttggttttgagtataaaggtagtttttcgtagtttttttggcgtttcggggtagtttcggtgtttttgtcgatgtggggagttcggttttgtagtcgggtcgggtcggggtcggggtttgggtttgtgcgtttgtgtttgcgatgttttggttttggtgcgtttttgtgaggttcgtggatagtttttacggttttgaatttat

SEQ ID NO: 21542 - DNA, 821 bp, Artificial Sequence
  chemically treated genomic DNA (Homo sapiens) CpG-island No: 21542
ataaattcaaaaccgtaaaaactatccacgaacctcacaaaaacgcaccaaaaccaaaacatcgcaaacacaaacgcacaaacccaaaccccgaccccgacccgacccgactacaaaaccgaactccccacatcgacaaaaacaccgaaactaccccgaaacgccaaaaaaactacgaaaaactacctttatactcaaaaccaaacgcgacctacgaaacgaaaccgccacgtctaaaacttacgaactacaaaacgacgcgacacgcgtaaatacaccctacgaaaacgaactacgaccgcgaaaaacaacgacgaaaaaaaaacccgcgaaaaatacgatcctacccaaccgcgccgaaaaaacgaaaaaaacgaaaccgaaacacacccttccctacacgcctcgaaacgccccgccgattaaaaaaaacaaaaaactcaaaccgaaaccgcgcaaaaaacacctccgcccccgcccaaaaatcctatcaaaccgacgccgcgacgctcaccgccgacccacgaactaaccacgacctaacgaaacctaaccccgaaacgccgcccgcctacgacccaatctccaccgtccccacacacgcccctctaaaaaacccgacgcgaaaaaatatcaaccgaccgaacactacgaaaaacccgaattacctaaaaaattactaataactaaacaactttccgaacgaaaaaaaaacgtcaaaaccaaaaacaaaaatacgaacgcaacgaaaaaaaaaacgaaaacgatcgaccgaaacgccgacaaatacactaacaaaccgaaaaatacaaacgcgccga

SEQ ID NO: 21543 - DNA, 821 bp, Artificial Sequence
  chemically treated genomic DNA (Homo sapiens) CpG-island No: 21543
gtaggtttagggtcgtagaggttgtttacgggttttataggaacgtattaaaattaggatatcgtaagtataggcgtatagatttagatttcggtttcggttcggttcggttgtagggtcgggttttttatatcgataaggatatcggagttgtttcgagacgttaagagggttgcgaagagttgtttttgtatttagagttagacgcggtttacgggacgggatcgttacgtttggggtttgcgggttgtagggcggcgcggtacgcgtgggtatattttgcgggggcgggttgcggtcgcggggaatagcggcgagaggggggttcgcgggagatgcggttttgtttagtcgcgtcgagaaggcggggaaggcgaggtcggaatatatttttttttgtacgtttcggagcgtttcgtcggttggggagggtaggaggtttaggtcggagtcgcgtaggggatattttcgttttcgtttaggagttttgttaggtcggcgtcgcggcgtttatcgtcgatttacgggttagttacggtttgacggggtttggtttcggggcgtcgttcgtttgcggtttagtttttatcgtttttatatacgtttttttgaagaattcggcgcgaggaggtattagtcggtcggatattacggaaggttcgggttatttggggggttgttggtggttgggtagtttttcgggcgggaggggggcgttaggattaggaataggagtgcggacgtagcgggagagggggcgggggcggtcgatcgaggcgtcggtaggtatattggtaggtcgagaggtgtagacgcgtcgg

SEQ ID NO: 21544 - DNA, 821 bp, Artificial Sequence
  chemically treated genomic DNA (Homo sapiens) CpG-island No: 21544
ccgacgcgtctacacctctcgacctaccaatatacctaccgacgcctcgatcgaccgcccccgccccctctcccgctacgtccgcactcctattcctaatcctaacgcccccctcccgcccgaaaaactacccaaccaccaacaaccccccaaataacccgaaccttccgtaatatccgaccgactaatacctcctcgcgccgaattcttcaaaaaaacgtatataaaaacgataaaaactaaaccgcaaacgaacgacgccccgaaaccaaaccccgtcaaaccgtaactaacccgtaaatcgacgataaacgccgcgacgccgacctaacaaaactcctaaacgaaaacgaaaatatcccctacgcgactccgacctaaacctcctaccctccccaaccgacgaaacgctccgaaacgtacaaaaaaaaatatattccgacctcgccttccccgccttctcgacgcgactaaacaaaaccgcatctcccgcgaacccccctctcgccgctattccccgcgaccgcaacccgcccccgcaaaatatacccacgcgtaccgcgccgccctacaacccgcaaaccccaaacgtaacgatcccgtcccgtaaaccgcgtctaactctaaatacaaaaacaactcttcgcaaccctcttaacgtctcgaaacaactccgatatccttatcgatataaaaaacccgaccctacaaccgaaccgaaccgaaaccgaaatctaaatctatacgcctatacttacgatatcctaattttaatacgttcctataaaacccgtaaacaacctctacgaccctaaacctac

SEQ ID NO: 21545 - DNA, 910 bp, Artificial Sequence
  chemically treated genomic DNA (Homo sapiens) CpG-island No: 21545
tcgtttttatttttttttatttaaattttttttttttatttatcgttttacgttcgtttcgggtttttttttttttttcgtttaattttaatttttagatacgcgttttcgtttcgaatttattttaagtcggtttatattacgttcggttcgggttttttcgtttttgtcgtcggtttttattgttcgggtcggatgtcggggaacgggttcggttaggtttgacgtttatcgtttagaagtcgagtcgagtagtttcgtaggttgaggtagagcgggagaagttcgggttttttttttaggggtttagcggcgcggtagttattttgttgtgttgtgtcggttgtcgaggggtcgcgcgcgcgtggtcggggttagttttagttacgttttttttttttttcggtattgttggaagggacgcggaggcgtttttcgttttttttgtagttagcgcgttaggatgtcggggagttttgggcgcgaggttttcggtcgcgcggggtcgacgggatgcggtgttttcgttttcggattgcgttgtaggtgaagtgtcgggtgtagagttagggggagtcgaggttttatgcggtagttgttcgtagtgttgtggttttcgttgagataaagttgtcgtcgttattttttgaaatacggatacgttttttagggtttgtgttcgaggacggtttgaggtatcggcgtagcgttttttcggttttttttatttttgatgtttgcgcgttatgagcgagtgtttttattagtatatttttttttgatagtcgtatttaaagcgaattttttttagggatcgaattgtttaggttcggatgaattttaaagcggacgtagtttgggttttagttgtcgcgtgaggtttagggagtttgggaattttaggtagagg

SEQ ID NO: 21546 - DNA, 910 bp, Artificial Sequence
  chemically treated genomic DNA (Homo sapiens) CpG-island No: 21546
cctctacctaaaattcccaaactccctaaacctcacgcgacaactaaaacccaaactacgtccgctttaaaattcatccgaacctaaacaattcgatccctaaaaaaaattcgctttaaatacgactatcaaaaaaaaatatactaataaaaacactcgctcataacgcgcaaacatcaaaaataaaaaaaaccgaaaaaacgctacgccgatacctcaaaccgtcctcgaacacaaaccctaaaaaacgtatccgtatttcaaaaaataacgacgacaactttatctcaacgaaaaccacaacactacgaacaactaccgcataaaacctcgactccccctaactctacacccgacacttcacctacaacgcaatccgaaaacgaaaacaccgcatcccgtcgaccccgcgcgaccgaaaacctcgcgcccaaaactccccgacatcctaacgcgctaactacaaaaaaaacgaaaaacgcctccgcgtcccttccaacaataccgaaaaaaaaaaaaaacgtaactaaaactaaccccgaccacgcgcgcgcgacccctcgacaaccgacacaacacaacaaaataactaccgcgccgctaaacccctaaaaaaaaaacccgaacttctcccgctctacctcaacctacgaaactactcgactcgacttctaaacgataaacgtcaaacctaaccgaacccgttccccgacatccgacccgaacaataaaaaccgacgacaaaaacgaaaaaacccgaaccgaacgtaatataaaccgacttaaaataaattcgaaacgaaaacgcgtatctaaaaattaaaattaaacgaaaaaaaaaaaaaaacccgaaacgaacgtaaaacgataaataaaaaaaaaaaatttaaataaaaaaaaataaaaacga

SEQ ID NO: 21547 - DNA, 910 bp, Artificial Sequence
  chemically treated genomic DNA (Homo sapiens) CpG-island No: 21547
tttttgtttaggatttttaagttttttgaattttacgcgatagttggagtttaggttgcgttcgttttgaggtttattcgagtttgggtagttcggtttttggagggaattcgttttagatacgattgttagagagaagtgtgttgataagaatattcgtttatagcgcgtaagtattagaagtgggggaggtcggggaggcgttgcgtcggtgttttaggtcgttttcggatataggttttgagaagcgtgttcgtgttttagagggtggcggcggtagttttgttttagcgaaggttatagtattgcgggtagttgtcgtatgaaatttcggttttttttgattttgtattcgatattttatttgtaacgtaattcgaaggcgaaggtatcgtatttcgtcggtttcgcgcggtcggaagtttcgcgtttaagatttttcggtattttagcgcgttggttgtaaaagaggcgggaaacgttttcgcgttttttttaatagtatcggagagggagaggggcgtggttgagattagtttcgattacgcgcgcgcggtttttcggtaatcggtataatataataaaatggttgtcgcgtcgttgggtttttgaggaaagagttcgaatttttttcgttttattttagtttgcgggattgttcggttcggtttttaggcggtgagcgttagatttggtcgagttcgtttttcggtattcggttcgagtagtgggggtcggcggtaaaggcgggaaggttcggatcgggcgtggtgtgggtcggtttgggatggattcggggcgggggcgcgtgtttgggaattgggattggacgggaaagaggggagggttcggaacgggcgtggggcggtggatgaaggagggaggtttggatgggaagaggtggggacgg

SEQ ID NO: 21548 - DNA, 910 bp, Artificial Sequence
  chemically treated genomic DNA (Homo sapiens) CpG-island No: 21548
ccgtccccacctcttcccatccaaacctccctccttcatccaccgccccacgcccgttccgaaccctcccctctttcccgtccaatcccaattcccaaacacgcgcccccgccccgaatccatcccaaaccgacccacaccacgcccgatccgaaccttcccgcctttaccgccgacccccactactcgaaccgaataccgaaaaacgaactcgaccaaatctaacgctcaccgcctaaaaaccgaaccgaacaatcccgcaaactaaaataaaacgaaaaaaattcgaactctttcctcaaaaacccaacgacgcgacaaccattttattatattataccgattaccgaaaaaccgcgcgcgcgtaatcgaaactaatctcaaccacgcccctctccctctccgatactattaaaaaaaacgcgaaaacgtttcccgcctcttttacaaccaacgcgctaaaataccgaaaaatcttaaacgcgaaacttccgaccgcgcgaaaccgacgaaatacgataccttcgccttcgaattacgttacaaataaaatatcgaatacaaaatcaaaaaaaaccgaaatttcatacgacaactacccgcaatactataaccttcgctaaaacaaaactaccgccgccaccctctaaaacacgaacacgcttctcaaaacctatatccgaaaacgacctaaaacaccgacgcaacgcctccccgacctcccccacttctaatacttacgcgctataaacgaatattcttatcaacacacttctctctaacaatcgtatctaaaacgaattccctccaaaaaccgaactacccaaactcgaataaacctcaaaacgaacgcaacctaaactccaactatcgcgtaaaattcaaaaaacttaaaaatcctaaacaaaaa

SEQ ID NO: 21549 - DNA, 642 bp, Artificial Sequence
  chemically treated genomic DNA (Homo sapiens) CpG-island No: 21549
cgtcggtttttttcgttagttatatattcggcgtcgaggtcggaagtttttttttcggtttttaagatcgcgtttcggaaatgagtcgttttattagtatttaagatggtcgtcggtttatttatcgtcgcgatcggtgtgaggaaagtgttacgaattcggaattgttcgatttcgttatggtaggcgtcgggggcgtggttttcggcggttatagtttgttagtcgtcgcggcggggtcgagcgggggcggtagttgataggcgtttttttttcgatcgtagcggttggtttttagcgaggcgggcggtttttagttcgcgttttcgagttttagttcgcgaggcgttagggttgcgtttgggtatggaagaggggaagatggacgagaatgaatgggggtattacggagagggtaataagagtttggtggtggtttacgcgtaggtgagcggtggacgtgcggcgtaggttcggtattttatttcgacggtcggtattatttcgtttttattattcgtttttttaatagggtcggttttacgtttttttagtatttttttttttttcggtcggttttcggaatttttttattttttagtatttttttttatcgtttgggttttttattattttagtatt

SEQ ID NO: 21550 - DNA, 642 bp, Artificial Sequence
  chemically treated genomic DNA (Homo sapiens) CpG-island No: 21550
aatactaaaataataaaaaacccaaacgataaaaaaaaatactaaaaaataaaaaaattccgaaaaccgaccgaaaaaaaaaaaaatactaaaaaaacgtaaaaccgaccctattaaaaaaacgaataataaaaacgaaataataccgaccgtcgaaataaaataccgaacctacgccgcacgtccaccgctcacctacgcgtaaaccaccaccaaactcttattaccctctccgtaatacccccattcattctcgtccatcttcccctcttccatacccaaacgcaaccctaacgcctcgcgaactaaaactcgaaaacgcgaactaaaaaccgcccgcctcgctaaaaaccaaccgctacgatcgaaaaaaaaacgcctatcaactaccgcccccgctcgaccccgccgcgacgactaacaaactataaccgccgaaaaccacgcccccgacgcctaccataacgaaatcgaacaattccgaattcgtaacactttcctcacaccgatcgcgacgataaataaaccgacgaccatcttaaatactaataaaacgactcatttccgaaacgcgatcttaaaaaccgaaaaaaaaacttccgacctcgacgccgaatatataactaacgaaaaaaaccgacg

SEQ ID NO: 21551 - DNA, 642 bp, Artificial Sequence
  chemically treated genomic DNA (Homo sapiens) CpG-island No: 21551
gatattggggtgatgaggaatttaagcggtagggggggatgttggagggtgggggaatttcggagatcggtcggggaggaggaaggtattggggggacgtggaatcgattttgttgaggaaacggataatgggggcggggtgatatcggtcgtcggagtgaggtatcggatttgcgtcgtacgtttatcgtttatttgcgcgtgggttattattaggtttttattgtttttttcgtggtatttttatttattttcgtttattttttttttttttatgtttaggcgtagttttggcgtttcgcgggttaggattcggggacgcgagttgggggtcgttcgtttcgttgggaattagtcgttgcggtcgggggaggagcgtttgttagttgtcgttttcgttcgatttcgtcgcggcgattagtaagttgtggtcgtcggaagttacgttttcggcgtttgttatgacggagtcgggtaatttcgggttcgtgatattttttttatatcgatcgcgacggtggatgggtcggcggttattttaggtattggtagagcgatttattttcggaacgcggttttgggagtcggaagagaagttttcggtttcggcgtcggatgtgtagttggcggaaggagtcggcg

SEQ ID NO: 21552 - DNA, 642 bp, Artificial Sequence
  chemically treated genomic DNA (Homo sapiens) CpG-island No: 21552
cgccgactccttccgccaactacacatccgacgccgaaaccgaaaacttctcttccgactcccaaaaccgcgttccgaaaataaatcgctctaccaatacctaaaataaccgccgacccatccaccgtcgcgatcgatataaaaaaaatatcacgaacccgaaattacccgactccgtcataacaaacgccgaaaacgtaacttccgacgaccacaacttactaatcgccgcgacgaaatcgaacgaaaacgacaactaacaaacgctcctcccccgaccgcaacgactaattcccaacgaaacgaacgacccccaactcgcgtccccgaatcctaacccgcgaaacgccaaaactacgcctaaacataaaaaaaaaaaaaataaacgaaaataaataaaaataccacgaaaaaaacaataaaaacctaataataacccacgcgcaaataaacgataaacgtacgacgcaaatccgatacctcactccgacgaccgatatcaccccgcccccattatccgtttcctcaacaaaatcgattccacgtccccccaataccttcctcctccccgaccgatctccgaaattcccccaccctccaacatccccccctaccgcttaaattcctcatcaccccaatatc

SEQ ID NO: 21553 - DNA, 817 bp, Artificial Sequence
  chemically treated genomic DNA (Homo sapiens) CpG-island No: 21553
cggacgttttgttttttgtaaagtatttaacgcgatgtttttgttttaagggtagtcgcgagaaaggtaggtataggaggcgggagtcggggtcgggcgatggggcggaaggagtttcgtatcgggaggggtcgtggagtggggtggaaggatttggtagtcgttaaagattgggtgggtaggttttacgggcggtgggagggatttcggggaggtttttgtcggttgttattcgagtataaacggtagttttttggtttttgttcggtcgttttcgtcgtattgtgaatttttatttttagcgcgcgacggcggtagattacgtgattagggttaatatggtcgtcgtcgtcgtttggagttgaagtgtcgtcgtcggcgggtagttacggggaattcgttcgtatcgtcgttttcgtcggtcgggcggtcgtggggtttagagcgtcggaggttagggttggggcggtatcgcgtagcggttacggggtttcgttagagtagcgttcggcgggttatgtcgagagttcggagcggtcggaggagtagaggggtcggcgggagggaggaagtaggtttgtttacgggttgtttggggcggagtagttttggtcgggggttcggtgttggggcggagattagaattataggtcgcgtttgacgttttttttttttatttggtatcggttcgcgatttttttttagatttttttgcgagtacgagttaatcggtagattcgattgaatggtgagttttgttcggttttttttttcgttttattttcggtttttttttttttttttttattgtttgtcg

SEQ ID NO: 21554 - DNA, 817 bp, Artificial Sequence
  chemically treated genomic DNA (Homo sapiens) CpG-island No: 21554
cgacaaacaataaaaaaaaaaaaaaaaaaaccgaaaataaaacgaaaaaaaaaaccgaacaaaactcaccattcaatcgaatctaccgattaactcgtactcgcaaaaaaatctaaaaaaaaatcgcgaaccgataccaaataaaaaaaaaaaacgtcaaacgcgacctataattctaatctccgccccaacaccgaacccccgaccaaaactactccgccccaaacaacccgtaaacaaacctacttcctccctcccgccgacccctctactcctccgaccgctccgaactctcgacataacccgccgaacgctactctaacgaaaccccgtaaccgctacgcgataccgccccaaccctaacctccgacgctctaaaccccacgaccgcccgaccgacgaaaacgacgatacgaacgaattccccgtaactacccgccgacgacgacacttcaactccaaacgacgacgacgaccatattaaccctaatcacgtaatctaccgccgtcgcgcgctaaaaataaaaattcacaatacgacgaaaacgaccgaacaaaaaccaaaaaactaccgtttatactcgaataacaaccgacaaaaacctccccgaaatccctcccaccgcccgtaaaacctacccacccaatctttaacgactaccaaatccttccaccccactccacgacccctcccgatacgaaactccttccgccccatcgcccgaccccgactcccgcctcctatacctacctttctcgcgactacccttaaaacaaaaacatcgcgttaaatactttacaaaaaacaaaacgtccg

SEQ ID NO: 21555 - DNA, 817 bp, Artificial Sequence
  chemically treated genomic DNA (Homo sapiens) CpG-island No: 21555
cggtaggtagtgagggagggagggaggaggtcgggggtggggcggagggaggggtcgggtaggatttattatttagtcgggtttgtcggttggttcgtattcgtagaaaggtttgggagaagatcgcgggtcgatgttagataagaaaagagagcgttaggcgcggtttgtagttttggttttcgttttagtatcggattttcgattaaagttgtttcgttttaaatagttcgtaaataaatttattttttttttttcgtcggtttttttgttttttcggtcgtttcgggttttcggtatagttcgtcgggcgttgttttaacgggatttcgtggtcgttgcgcggtgtcgttttagttttggttttcggcgttttgggttttacggtcgttcggtcggcgagggcggcgatgcgggcggatttttcgtggttgttcgtcggcggcggtattttagttttaagcggcggcggcggttatgttggttttaattacgtgatttgtcgtcgtcgcgcgttgggggtgaaagtttataatgcggcgggggcggtcggatagagattaggaagttgtcgtttgtattcgggtagtaatcggtagaagttttttcggggttttttttatcgttcgtgaagtttatttatttaatttttagcggttgttaagtttttttattttattttacgatttttttcggtgcggggtttttttcgttttatcgttcggtttcggttttcgttttttgtgtttgtttttttcgcggttgtttttagggtagaggtatcgcgttgggtgttttataggggataaggcgttcg

SEQ ID NO: 21556 - DNA, 817 bp, Artificial Sequence
  chemically treated genomic DNA (Homo sapiens) CpG-island No: 21556
cgaacgccttatcccctataaaacacccaacgcgatacctctaccctaaaaacaaccgcgaaaaaaacaaacacaaaaaacgaaaaccgaaaccgaacgataaaacgaaaaaaaccccgcaccgaaaaaaatcgtaaaataaaataaaaaaacttaacaaccgctaaaaattaaataaataaacttcacgaacgataaaaaaaaccccgaaaaaacttctaccgattactacccgaatacaaacgacaacttcctaatctctatccgaccgcccccgccgcattataaactttcacccccaacgcgcgacgacgacaaatcacgtaattaaaaccaacataaccgccgccgccgcttaaaactaaaataccgccgccgacgaacaaccacgaaaaatccgcccgcatcgccgccctcgccgaccgaacgaccgtaaaacccaaaacgccgaaaaccaaaactaaaacgacaccgcgcaacgaccacgaaatcccgttaaaacaacgcccgacgaactataccgaaaacccgaaacgaccgaaaaaacaaaaaaaccgacgaaaaaaaaaaaataaatttatttacgaactatttaaaacgaaacaactttaatcgaaaatccgatactaaaacgaaaaccaaaactacaaaccgcgcctaacgctctcttttcttatctaacatcgacccgcgatcttctcccaaacctttctacgaatacgaaccaaccgacaaacccgactaaataataaatcctacccgacccctccctccgccccacccccgacctcctccctccctccctcactacctaccg

SEQ ID NO: 21557 - DNA, 798 bp, Artificial Sequence
  chemically treated genomic DNA (Homo sapiens) CpG-island No: 21557
gcgcgtgtttggagtttttcggtatagtgaggcgcgcgtttgtttggttagggtttttgtgaaggaatgggatttcgaggtgtttgttaggatcgtagtaggcggaagttgttggtagcgcgaacgggcggttttcgtcggcgtgggtgggggaagggcggtagttatattcggaagtcggttcgggagggagggggaaatttgagggaacgaggttttcggtggcgtaaagggtgtcgggagcggttttttgtaaattttttttggtatttggagggattatcgttgtcgcgttttcggtttttacgatttgcgttcgggttacgcggttacggcggtagttattgcgatttttattgtgtttggttttgtttatattagtttttaggcggtcgtcgtcgttttagtagcggtagcggtagcggtagcggcggatatgttgtgaggcggcggcgcgggtgtttgaaggatggtttggtcgaggcggcggtaacggttgttggcggcggcggtagcggtagcggggtttcgggttttatagagtcgagttcgttgggtattcgttcggtatcgcggcgaggttagtgtttttggattttgtttttgtttcgacgtcgttggggattagttaggcgatagcgttcgtttttttgaggagatacgaaggtggttttttagtcgtttaaattttcggattatcgcgtttttttttttttagtttgggttgtgttttttttagaattttcgggtttttattttttttttaaatttattttaaattttttatatacgcgagtg

SEQ ID NO: 21558 - DNA, 798 bp, Artificial Sequence
  chemically treated genomic DNA (Homo sapiens) CpG-island No: 21558
cactcgcgtatataaaaaatttaaaataaatttaaaaaaaaaataaaaacccgaaaattctaaaaaaaacacaacccaaactaaaaaaaaaaaaacgcgataatccgaaaatttaaacgactaaaaaaccaccttcgtatctcctcaaaaaaacgaacgctatcgcctaactaatccccaacgacgtcgaaacaaaaacaaaatccaaaaacactaacctcgccgcgataccgaacgaatacccaacgaactcgactctataaaacccgaaaccccgctaccgctaccgccgccgccaacaaccgttaccgccgcctcgaccaaaccatccttcaaacacccgcgccgccgcctcacaacatatccgccgctaccgctaccgctaccgctactaaaacgacgacgaccgcctaaaaactaatataaacaaaaccaaacacaataaaaatcgcaataactaccgccgtaaccgcgtaacccgaacgcaaatcgtaaaaaccgaaaacgcgacaacgataatccctccaaataccaaaaaaaatttacaaaaaaccgctcccgacaccctttacgccaccgaaaacctcgttccctcaaatttccccctccctcccgaaccgacttccgaatataactaccgcccttcccccacccacgccgacgaaaaccgcccgttcgcgctaccaacaacttccgcctactacgatcctaacaaacacctcgaaatcccattccttcacaaaaaccctaaccaaacaaacgcgcgcctcactataccgaaaaactccaaacacgcgc

SEQ ID NO: 21559 - DNA, 798 bp, Artificial Sequence
  chemically treated genomic DNA (Homo sapiens) CpG-island No: 21559
tattcgcgtgtgtgagagatttaggatgagtttgggaagaaagtgggggttcgaggattttagagagagtatagtttaggttgaggaggggaaagcgcggtggttcggaaatttgagcggttggggaattattttcgtgtttttttagaggggcgggcgttgtcgtttaattggtttttaacggcgtcggagtagaggtaagatttaggggtattggtttcgtcgcggtatcgggcgggtatttagcgggttcggttttatagagttcgaggtttcgttgtcgttgtcgtcgtcgttagtagtcgttgtcgtcgtttcggttaaattattttttagatattcgcgtcgtcgttttataatatgttcgtcgttgtcgttgtcgttgtcgttgttggaacggcgacggtcgtttgggaattaatatggatagagttaggtatagtgggagtcgtagtggttgtcgtcgtggtcgcgtagttcgaacgtagatcgtggaagtcgaagacgcggtaacggtggtttttttagatgttagggaaggtttgtaggaagtcgttttcgatattttttgcgttatcggaagtttcgtttttttagatttttttttttttttcggatcgattttcgggtgtggttgtcgttttttttttatttacgtcggcgggagtcgttcgttcgcgttgttagtagttttcgtttgttacggttttggtaagtatttcgggattttatttttttatagggattttagttaggtaagcgcgcgttttattgtatcggagagttttaagtacgcgt

SEQ ID NO: 21560 - DNA, 798 bp, Artificial Sequence
  chemically treated genomic DNA (Homo sapiens) CpG-island No: 21560
acgcgtacttaaaactctccgatacaataaaacgcgcgcttacctaactaaaatccctataaaaaaataaaatcccgaaatacttaccaaaaccgtaacaaacgaaaactactaacaacgcgaacgaacgactcccgccgacgtaaataaaaaaaaaacgacaaccacacccgaaaatcgatccgaaaaaaaaaaaaaaatctaaaaaaacgaaacttccgataacgcaaaaaatatcgaaaacgacttcctacaaaccttccctaacatctaaaaaaaccaccgttaccgcgtcttcgacttccacgatctacgttcgaactacgcgaccacgacgacaaccactacgactcccactatacctaactctatccatattaattcccaaacgaccgtcgccgttccaacaacgacaacgacaacgacaacgacgaacatattataaaacgacgacgcgaatatctaaaaaataatttaaccgaaacgacgacaacgactactaacgacgacgacaacgacaacgaaacctcgaactctataaaaccgaacccgctaaatacccgcccgataccgcgacgaaaccaatacccctaaatcttacctctactccgacgccgttaaaaaccaattaaacgacaacgcccgcccctctaaaaaaacacgaaaataattccccaaccgctcaaatttccgaaccaccgcgctttcccctcctcaacctaaactatactctctctaaaatcctcgaacccccactttcttcccaaactcatcctaaatctctcacacacgcgaata

SEQ ID NO: 21561 - DNA, 687 bp, Artificial Sequence
  chemically treated genomic DNA (Homo sapiens) CpG-island No: 21561
  misc_feature (56)..(56): n is either a, c, g or t
gttttcggcgtttcggtttttatcgggtatcgtcggttacggttcgggcgtttganggagggggcgtcgagcggcgcgattggttcgttcgttttgtcgcgttcggggcgggttttagggagtcgcggttttattcgcgtaggggtcgggttcgtatggaatcgcggcgggtgcgggtcggggtttttacggtgtttgtcgtcgcgcgtcggcgcgattggggcggcgagggtgggacgggcgtcgttcggggttttttttttcgggtcggtttttgtagaattagggggcgaggttgtcgggaacgggggtggcggtcgcggggcgcgttcgggtttttttttttcgtcgtcgttgtagtttcggcgtttcgttgttttggtttttcgtttttcgtttttcgttgggtttcgggttttagtttcggtttcggttcgggttttcgggtcgcgagtgttatcgtagtttagagcggcgttttattgataaagaaagtacgtagttttcggaacgggcgaggaggcgaggaggcgaggtcggcgcgcgcgcgtagtttcgcgcggagttatcgcgcgtttttcgttttcgcgcgttcggtcgggttcgagatttaggagggggatttttttcggcggttttcgcgtagcggaggtttttaaggggagggtttttttttttttttgtttt

SEQ ID NO: 21562 - DNA, 687 bp, Artificial Sequence
  chemically treated genomic DNA (Homo sapiens) CpG-island No: 21562
  misc_feature (632)..(632): n is either a, c, g or t
aaaacaaaaaaaaaaaaaaaccctccccttaaaaacctccgctacgcgaaaaccgccgaaaaaaatccccctcctaaatctcgaacccgaccgaacgcgcgaaaacgaaaaacgcgcgataactccgcgcgaaactacgcgcgcgcgccgacctcgcctcctcgcctcctcgcccgttccgaaaactacgtactttctttatcaataaaacgccgctctaaactacgataacactcgcgacccgaaaacccgaaccgaaaccgaaactaaaacccgaaacccaacgaaaaacgaaaaacgaaaaaccaaaacaacgaaacgccgaaactacaacgacgacgaaaaaaaaaaacccgaacgcgccccgcgaccgccacccccgttcccgacaacctcgccccctaattctacaaaaaccgacccgaaaaaaaaaaccccgaacgacgcccgtcccaccctcgccgccccaatcgcgccgacgcgcgacgacaaacaccgtaaaaaccccgacccgcacccgccgcgattccatacgaacccgacccctacgcgaataaaaccgcgactccctaaaacccgccccgaacgcgacaaaacgaacgaaccaatcgcgccgctcgacgccccctccntcaaacgcccgaaccgtaaccgacgatacccgataaaaaccgaaacgccgaaaac

SEQ ID NO: 21563 - DNA, 687 bp, Artificial Sequence
  chemically treated genomic DNA (Homo sapiens) CpG-island No: 21563
  misc_feature (632)..(632): n is either a, c, g or t
gggataggaggggagggaagttttttttttaaggattttcgttgcgcgggagtcgtcgggaggggttttttttttgggtttcgagttcggtcgggcgcgcgggagcggggagcgcgcggtggtttcgcgcggggttgcgcgcgcgcgtcggtttcgttttttcgttttttcgttcgtttcggaggttacgtgttttttttgttaatgaggcgtcgttttgagttgcggtagtattcgcggttcgggaattcgagtcggagtcggggttggaattcgaagtttagcgaggagcgaggagcgaggagttaggatagcggggcgtcgaggttgtagcggcggcgggagggagggattcgagcgcgtttcgcggtcgttattttcgttttcggtagtttcgttttttagttttgtaggagtcggttcgggggagggggtttcgggcggcgttcgttttattttcgtcgttttaatcgcgtcggcgcgcggcgataggtatcgtgggaatttcggttcgtattcgtcgcggttttatgcgggttcggtttttgcgcgggtgaagtcgcggttttttggagttcgtttcgggcgcggtaggacgagcgagttagtcgcgtcgttcggcgttttttttnttaggcgttcgggtcgtggtcggcgatgttcggtgaggatcggggcgtcgagggt

SEQ ID NO: 21564 - DNA, 687 bp, Artificial Sequence
  chemically treated genomic DNA (Homo sapiens) CpG-island No: 21564
  misc_feature (56)..(56): n is either a, c, g or t
accctcgacgccccgatcctcaccgaacatcgccgaccacgacccgaacgcctaanaaaaaaaacgccgaacgacgcgactaactcgctcgtcctaccgcgcccgaaacgaactccaaaaaaccgcgacttcacccgcgcaaaaaccgaacccgcataaaaccgcgacgaatacgaaccgaaattcccacgatacctatcgccgcgcgccgacgcgattaaaacgacgaaaataaaacgaacgccgcccgaaaccccctcccccgaaccgactcctacaaaactaaaaaacgaaactaccgaaaacgaaaataacgaccgcgaaacgcgctcgaatccctccctcccgccgccgctacaacctcgacgccccgctatcctaactcctcgctcctcgctcctcgctaaacttcgaattccaaccccgactccgactcgaattcccgaaccgcgaatactaccgcaactcaaaacgacgcctcattaacaaaaaaaacacgtaacctccgaaacgaacgaaaaaacgaaaaaacgaaaccgacgcgcgcgcgcaaccccgcgcgaaaccaccgcgcgctccccgctcccgcgcgcccgaccgaactcgaaacccaaaaaaaaaacccctcccgacgactcccgcgcaacgaaaatccttaaaaaaaaaacttccctcccctcctatccc

SEQ ID NO: 21565 - DNA, 1480 bp, Artificial Sequence
  chemically treated genomic DNA (Homo sapiens) CpG-island No: 21565
  misc_feature (778)..(778): n is either a, c, g or t
aagcgtgttttcgtagtagcgcgttttcgtttcggtcgtcgcgttttcgcggtcgtcgtcgtcgtcgtcgttcgggattgagtttttcgtttgttttttttttattttttaaattttaagaggttgcggtagttacggcggcggcggcggcggcggcggcggtagcggcggcgttttttcgtttttttttcggtcggttcgtttcgtttttttttttttatttttcggtcggtcgtttcgtttcgttcgtttttcgtttaattttcgcgttcggtttcgtttcgttgtatttaatagcgttttgttattggtcgacgcgtttttacgtattttaacgtttttcgttttttttatttttttcgcgcgattcgtttacgttttcgtttttcgtttcgagtcgttgcgagtcggttttaggtaggtcgcggttttttggcgcggggttgatcgttgagtagagttgagtcgatttaggggagggagtatgtggttgcgattgcggtgatagggtcgtggttcgttgtggaggcgtaagatagagcgtgagacgtaggaaatgtatatttgaaatgtatggtaataatttttgtagtcggcgaaacgcgaatcgtggttttttggttttgtttttttatcgtcgcggttttcgttgtagtaagagtgtttggtacgttttgtattgaggcgtacggggaggttcgggaatcgagcgagcggtagtttcgcgggatatcgttggtttcgtttttttttttttttttttttttttttttttttntttttttttatttttttttttttcgtttttttttttcgattatttcgttttttgttttttttttttttcgattagttcgttttttgtttttttttttttttttttcgattagttcgtttttttttttttttttttttcggttagttttttttttcggttagttttttttttcgattaattttttttttcgatcggttttttttttcgatcggtttttttttttggtcgggttttttttttgatcggttttttttttcgatcggttttttttttcggtcggttttttttttcggttagttttttttttcgattagttttttttttcgattagtttttttttttattagtttagtttttcgtagtttttttcgcgaggtttcgtttattcgatagttcgtttttttttggttggtttcgtttttcgtagtttttttcgtaaggtttcgtttattcgatagtttcgtttttttttggttggtttcgtttttcgtagtttttgtcgcgaggttttatttattcgatagtttcgtttttttttagtcggtttcgtttttcgtagtttttttcgcgaggttacgtttatatgcgtagtttttttttttcggcgtcggtttcgtttatcgaggcgaggttttaaagatttggtggtcgttgcgttaataggattttatttttattttttaatttggtttgattataaat

SEQ ID NO: 21566 - DNA, 1480 bp, Artificial Sequence
  chemically treated genomic DNA (Homo sapiens) CpG-island No: 21566
  misc_feature (703)..(703): n is either a, c, g or t
atttataatcaaaccaaattaaaaaataaaaataaaatcctattaacgcaacgaccaccaaatctttaaaacctcgcctcgataaacgaaaccgacgccgaaaaaaaaaaactacgcatataaacgtaacctcgcgaaaaaaactacgaaaaacgaaaccgactaaaaaaaaacgaaactatcgaataaataaaacctcgcgacaaaaactacgaaaaacgaaaccaaccaaaaaaaaacgaaactatcgaataaacgaaaccttacgaaaaaaactacgaaaaacgaaaccaaccaaaaaaaaacgaactatcgaataaacgaaacctcgcgaaaaaaactacgaaaaactaaactaataaaaaaaaaaactaatcgaaaaaaaaaactaatcgaaaaaaaaaactaaccgaaaaaaaaaaccgaccgaaaaaaaaaaccgatcgaaaaaaaaaaccgatcaaaaaaaaaacccgaccaaaaaaaaaaaccgatcgaaaaaaaaaaccgatcgaaaaaaaaaattaatcgaaaaaaaaaactaaccgaaaaaaaaaactaaccgaaaaaaaaaaaaaaaaaaaaacgaactaatcgaaaaaaaaaaaaaaaaaaacaaaaaacgaactaatcgaaaaaaaaaaaaaacaaaaaacgaaataatcgaaaaaaaaaaacgaaaaaaaaaaaaataaaaaaaaanaaaaaaaaaaaaaaaaaaaaaaaaaaaaaaaaacgaaaccaacgatatcccgcgaaactaccgctcgctcgattcccgaacctccccgtacgcctcaatacaaaacgtaccaaacactcttactacaacgaaaaccgcgacgataaaaaaacaaaaccaaaaaaccacgattcgcgtttcgccgactacaaaaattattaccatacatttcaaatatacatttcctacgtctcacgctctatcttacgcctccacaacgaaccacgaccctatcaccgcaatcgcaaccacatactccctcccctaaatcgactcaactctactcaacgatcaaccccgcgccaaaaaaccgcgacctacctaaaaccgactcgcaacgactcgaaacgaaaaacgaaaacgtaaacgaatcgcgcgaaaaaaataaaaaaaacgaaaaacgttaaaatacgtaaaaacgcgtcgaccaataacaaaacgctattaaatacaacgaaacgaaaccgaacgcgaaaattaaacgaaaaacgaacgaaacgaaacgaccgaccgaaaaataaaaaaaaaaaaacgaaacgaaccgaccgaaaaaaaaacgaaaaaacgccgccgctaccgccgccgccgccgccgccgccgccgtaactaccgcaacctcttaaaatttaaaaaataaaaaaaaaacaaacgaaaaactcaatcccgaacgacgacgacgacgacgaccgcgaaaacgcgacgaccgaaacgaaaacgcgctactacgaaaacacgctt

SEQ ID NO: 21567 - DNA, 1480 bp, Artificial Sequence
  chemically treated genomic DNA (Homo sapiens) CpG-island No: 21567
  misc_feature (703)..(703): n is either a, c, g or t
atttatgattaagttaaattaaagaataaaaataaaattttattggcgtagcggttattaagtttttgaggtttcgtttcggtgggcggggtcgacgtcggaggagaggggttgcgtatgtgggcgtgatttcgcggaaggagttgcggagggcggggtcgattggagaggggcggggttgtcgggtgggtgggatttcgcggtaaaagttgcggagggcgggattaattaggaaaggacgggattgtcgggtaggcgggattttgcgggagaaattgcggagggcgggattaattagggaggggcgggttgtcggatgggcgggatttcgcgggaggagttgcggaaagttgagttggtgaggggaggggttggtcgaggggaggggttggtcgaggggaggggttggtcgagggaaggggtcggtcgaggggaggggtcggtcgaggggaggggtcggttaaggggagggttcggttaaggggaggggtcggtcgaggggaggggtcggtcgaggagaggggttggtcgaggggaagggttggtcgaggggaggggttggtcgagggaagaagaggggaggggacgggttggtcgaggggaggggaggggagggtaggggacgggttggtcgagagaaggggagggtaggggacggggtggtcgaggggaggggacggaggggaggggagtagagggagangagggaaggggaggggagggaagggaggggaggcggggttagcggtgtttcgcgaaattgtcgttcgttcggttttcgggttttttcgtgcgttttagtgtaaagcgtgttaggtatttttattgtaacgagagtcgcggcggtgagggggtaaggttaagaggttacggttcgcgtttcgtcggttgtagaagttgttgttatatattttaaatgtgtattttttacgttttacgttttgttttgcgtttttatagcgggttacggttttgttatcgtagtcgtagttatatgtttttttttttgagtcggtttagttttgtttagcggttagtttcgcgttaggaggtcgcggtttgtttgaggtcggttcgtagcgattcgggacggagggcgggggcgtgaacgggtcgcgcggagagggtggggggagcggggagcgttagggtacgtgggggcgcgtcgattaatggtagggcgttgttgagtgtagcggggcggggtcgggcgcgggggttgggcgagaagcgggcggggcggggcggtcggtcggggggtgggaggagaggggcggggcgggtcggtcgggggaggggcggagagacgtcgtcgttgtcgtcgtcgtcgtcgtcgtcgtcgtcgtggttgtcgtagttttttggagtttggaaaatgggaaggagataagcgaaagatttagtttcgggcggcggcggcggcggcggtcgcgggggcgcgacggtcggggcgggggcgcgttgttgcgggggtacgttt

SEQ ID NO: 21568 - DNA, 1480 bp, Artificial Sequence
  chemically treated genomic DNA (Homo sapiens) CpG-island No: 21568
  misc_feature (778)..(778): n is either a, c, g or t
aaacgtacccccgcaacaacgcgcccccgccccgaccgtcgcgcccccgcgaccgccgccgccgccgccgcccgaaactaaatctttcgcttatctccttcccattttccaaactccaaaaaactacgacaaccacgacgacgacgacgacgacgacgacgacaacgacgacgtctctccgcccctcccccgaccgacccgccccgcccctctcctcccaccccccgaccgaccgccccgccccgcccgcttctcgcccaacccccgcgcccgaccccgccccgctacactcaacaacgccctaccattaatcgacgcgcccccacgtaccctaacgctccccgctccccccaccctctccgcgcgacccgttcacgcccccgccctccgtcccgaatcgctacgaaccgacctcaaacaaaccgcgacctcctaacgcgaaactaaccgctaaacaaaactaaaccgactcaaaaaaaaaaacatataactacgactacgataacaaaaccgtaacccgctataaaaacgcaaaacaaaacgtaaaacgtaaaaaatacacatttaaaatatataacaacaacttctacaaccgacgaaacgcgaaccgtaacctcttaaccttaccccctcaccgccgcgactctcgttacaataaaaatacctaacacgctttacactaaaacgcacgaaaaaacccgaaaaccgaacgaacgacaatttcgcgaaacaccgctaaccccgcctcccctcccttccctcccctccccttccctcntctccctctactcccctcccctccgtcccctcccctcgaccaccccgtcccctaccctccccttctctcgaccaacccgtcccctaccctcccctcccctcccctcgaccaacccgtcccctcccctcttcttccctcgaccaacccctcccctcgaccaacccttcccctcgaccaacccctctcctcgaccgacccctcccctcgaccgacccctccccttaaccgaaccctccccttaaccgacccctcccctcgaccgacccctcccctcgaccgaccccttccctcgaccaacccctcccctcgaccaacccctcccctcgaccaacccctcccctcaccaactcaactttccgcaactcctcccgcgaaatcccgcccatccgacaacccgcccctccctaattaatcccgccctccgcaatttctcccgcaaaatcccgcctacccgacaatcccgtcctttcctaattaatcccgccctccgcaacttttaccgcgaaatcccacccacccgacaaccccgcccctctccaatcgaccccgccctccgcaactccttccgcgaaatcacgcccacatacgcaacccctctcctccgacgtcgaccccgcccaccgaaacgaaacctcaaaaacttaataaccgctacgccaataaaattttatttttattctttaatttaacttaatcataaat

SEQ ID NO: 21569 - DNA, 567 bp, Artificial Sequence
  chemically treated genomic DNA (Homo sapiens) CpG-island No: 21569
  misc_feature (517)..(517): n is either a, c, g or t
  misc_feature (562)..(562): n is either a, c, g or t
  misc_feature (564)..(564): n is either a, c, g or t
  misc_feature (566)..(566): n is either a, c, g or t
attttttcggcggtcgtatttgttcgtttaagtttacggcgcgttgtcggaaacgggcgttttttcgatttttttttcgggtcgcgttttttttttacgtttagtttcggtttattacgaaggttttagcggttcgggtttgcgtttcgcggtttcggcgcgattttcgggtttttcgtttttatcgggtatgaggtcgagagaagttcggggatgtttggttcggtcgttttcggggacgcgaagttcgcggcgttaggcggggaattgagtcggggttcgggcgtaggatttcggtgtcgtcgcgttttttttcggtagtttttttttgtttttttcgtttcgcggtcgggttcggatttatttttttttttttgtttttattcggtatggttggagcgggtcgtcgtcgtcgtcgtcgtttttgtcgtcgtttgtatttcgtagtagtagcgttttcgtttcgaacgtggtttttcgcggcgtcgtttcgtcgtattttaagattgattttttntttaatttttttttttttacgatttataagtgtagattatagtananana

SEQ ID NO: 21570 - DNA, 567 bp, Artificial Sequence
  chemically treated genomic DNA (Homo sapiens) CpG-island No: 21570
  misc_feature (2)..(2): n is either a, c, g or t
  misc_feature (4)..(4): n is either a, c, g or t
  misc_feature (6)..(6): n is either a, c, g or t
  misc_feature (51)..(51): n is either a, c, g or t
tntntntactataatctacacttataaatcgtaaaaaaaaaaaaattaaanaaaaaatcaatcttaaaatacgacgaaacgacgccgcgaaaaaccacgttcgaaacgaaaacgctactactacgaaatacaaacgacgacaaaaacgacgacgacgacgacgacccgctccaaccataccgaataaaaacaaaaaaaaaaaaataaatccgaacccgaccgcgaaacgaaaaaaacaaaaaaaaactaccgaaaaaaaacgcgacgacaccgaaatcctacgcccgaaccccgactcaattccccgcctaacgccgcgaacttcgcgtccccgaaaacgaccgaaccaaacatccccgaacttctctcgacctcatacccgataaaaacgaaaaacccgaaaatcgcgccgaaaccgcgaaacgcaaacccgaaccgctaaaaccttcgtaataaaccgaaactaaacgtaaaaaaaaaacgcgacccgaaaaaaaaatcgaaaaaacgcccgtttccgacaacgcgccgtaaacttaaacgaacaaatacgaccgccgaaaaaat

SEQ ID NO: 21571 - DNA, 567 bp, Artificial Sequence
  chemically treated genomic DNA (Homo sapiens) CpG-island No: 21571
  misc_feature (2)..(2): n is either a, c, g or t
  misc_feature (4)..(4): n is either a, c, g or t
  misc_feature (6)..(6): n is either a, c, g or t
  misc_feature (51)..(51): n is either a, c, g or t
tntntntgttgtagtttgtatttgtggatcgtaaaagagaaggagttaagnaaaaaattagttttggggtgcggcggggcggcgtcgcggggggttacgttcggggcgggggcgttgttgttgcggggtgtaggcggcggtaggggcggcggcggcggcggcggttcgttttagttatgtcgaataaaaataagaaggagaaagtgagttcgggttcggtcgcgggacggagggagtagggagggattgtcgggggagggcgcgacggtatcggggttttgcgttcgggtttcggtttagtttttcgtttgacgtcgcgggtttcgcgttttcgagggcggtcgagttaggtattttcgggtttttttcggttttatgttcggtgggggcggggagttcggggatcgcgtcggagtcgcggggcgtaggttcgggtcgttgggattttcgtgatgggtcggggttgggcgtggagggagggcgcggttcggggagggggtcggaggggcgttcgttttcgatagcgcgtcgtgggtttgggcgggtaggtgcggtcgtcgagggggt

SEQ ID NO: 21572 - DNA, 567 bp, Artificial Sequence
  chemically treated genomic DNA (Homo sapiens) CpG-island No: 21572
  misc_feature (517)..(517): n is either a, c, g or t
  misc_feature (562)..(562): n is either a, c, g or t
  misc_feature (564)..(564): n is either a, c, g or t
  misc_feature (566)..(566): n is either a, c, g or t
accccctcgacgaccgcacctacccgcccaaacccacgacgcgctatcgaaaacgaacgcccctccgaccccctccccgaaccgcgccctccctccacgcccaaccccgacccatcacgaaaatcccaacgacccgaacctacgccccgcgactccgacgcgatccccgaactccccgcccccaccgaacataaaaccgaaaaaaacccgaaaatacctaactcgaccgccctcgaaaacgcgaaacccgcgacgtcaaacgaaaaactaaaccgaaacccgaacgcaaaaccccgataccgtcgcgccctcccccgacaatccctccctactccctccgtcccgcgaccgaacccgaactcactttctccttcttatttttattcgacataactaaaacgaaccgccgccgccgccgccgcccctaccgccgcctacaccccgcaacaacaacgcccccgccccgaacgtaaccccccgcgacgccgccccgccgcaccccaaaactaattttttncttaactccttctcttttacgatccacaaatacaaactacaacananana

SEQ ID NO: 21573 - DNA, 731 bp, Artificial Sequence
  chemically treated genomic DNA (Homo sapiens) CpG-island No: 21573
  misc_feature (10)..(12): n is either a, c, g or t
  misc_feature (108)..(111): n is either a, c, g or t
  misc_feature (146)..(148): n is either a, c, g or t
  misc_feature (185)..(185): n is either a, c, g or t
  misc_feature (302)..(303): n is either a, c, g or t
  misc_feature (718)..(718): n is either a, c, g or t
  misc_feature (720)..(720): n is either a, c, g or t
cgagttattnnntgggttatggcggcggatagagtagaatcgaagagcggcgacgcgcggaggacgagtgagggaaagattcgtagcggttttttttagaaattgcgnnnntttacgttcggtttttcggcgtcggttaatcgaannnaagggggtggagttatgaagttatattattggttttnttcgacgtttgttagattattcgaggtaaacgtgttcgtttattttcgggggtcggattagtggagcgtcgagtatttagatgatattgtttcggcgaggtttcgggtttttcgttnnacgcgtagagtttttcgttcgttttagttgtatttcggttttgtaggtcgttcgtttggcgtagttgtagttatagtaatttacgtaggatcgcgttttatagtttattaggtattcggacgttttgggcgcgagcgttcgtcgttttttttttaggttattgcggtgtatcgtgcgggttcgcgtcgtgtttttcgtttcggagtagggatcgggcgtgttcgtttagttttgtgcgtattcggaatggggtcggggaaggttgagttttagggcgattttgatgtggagtcgtgcgatcgtttattgcggttgaagagatttaggcgtagatagcgtaggcggggtatgtattggttggagtatgatggggttaggatttgagttttttatttaggttcggagttaacggtantnaattttttttt

SEQ ID NO: 21574 - DNA, 731 bp, Artificial Sequence
  chemically treated genomic DNA (Homo sapiens) CpG-island No: 21574
  misc_feature (12)..(12): n is either a, c, g or t
  misc_feature (14)..(14): n is either a, c, g or t
  misc_feature (429)..(430): n is either a, c, g or t
  misc_feature (547)..(547): n is either a, c, g or t
  misc_feature (584)..(586): n is either a, c, g or t
  misc_feature (621)..(624): n is either a, c, g or t
  misc_feature (720)..(722): n is either a, c, g or t
aaaaaaaaattnantaccgttaactccgaacctaaataaaaaactcaaatcctaaccccatcatactccaaccaatacataccccgcctacgctatctacgcctaaatctcttcaaccgcaataaacgatcgcacgactccacatcaaaatcgccctaaaactcaaccttccccgaccccattccgaatacgcacaaaactaaacgaacacgcccgatccctactccgaaacgaaaaacacgacgcgaacccgcacgatacaccgcaataacctaaaaaaaaaacgacgaacgctcgcgcccaaaacgtccgaatacctaataaactataaaacgcgatcctacgtaaattactataactacaactacgccaaacgaacgacctacaaaaccgaaatacaactaaaacgaacgaaaaactctacgcgtnnaacgaaaaacccgaaacctcgccgaaacaatatcatctaaatactcgacgctccactaatccgacccccgaaaataaacgaacacgtttacctcgaataatctaacaaacgtcgaanaaaaccaataatataacttcataactccacccccttnnnttcgattaaccgacgccgaaaaaccgaacgtaaannnncgcaatttctaaaaaaaaccgctacgaatctttccctcactcgtcctccgcgcgtcgccgctcttcgattctactctatccgccgccataacccannnaataactcg

SEQ ID NO: 21575 - DNA, 731 bp, Artificial Sequence
  chemically treated genomic DNA (Homo sapiens) CpG-island No: 21575
  misc_feature (12)..(12): n is either a, c, g or t
  misc_feature (14)..(14): n is either a, c, g or t
  misc_feature (429)..(430): n is either a, c, g or t
  misc_feature (547)..(547): n is either a, c, g or t
  misc_feature (584)..(586): n is either a, c, g or t
  misc_feature (621)..(624): n is either a, c, g or t
  misc_feature (720)..(722): n is either a, c, g or t
gagaaggggttnantatcgttaatttcgggtttgggtaaaagatttaagttttgattttattatattttaattaatatatatttcgtttgcgttgtttgcgtttgggtttttttaatcgtagtgagcggtcgtacggttttatattagggtcgttttgaggtttagtttttttcggttttatttcgagtgcgtataggattgaacgagtacgttcggtttttgtttcggagcggaggatacgacgcggattcgtacggtgtatcgtagtgatttgaggaaggagcgacgggcgttcgcgtttaaggcgttcgagtgtttggtaaattgtaaagcgcggttttgcgtgagttgttatggttatagttgcgttaggcggacggtttgtaggatcgaggtgtagttgggacgagcggaaagttttgcgcgtnnggcggggagttcggagtttcgtcggggtaatgttatttaggtgttcggcgttttattgattcggttttcgggggtgggcgggtacgtttgtttcggatggtttaataggcgtcgggnagagttaatggtgtggttttatggttttatttttttnnnttcgattggtcggcgtcgaaaagtcgggcgtgagnnnncgtagtttttggagggagtcgttgcgggttttttttttattcgtttttcgcgcgtcgtcgtttttcggttttgttttgttcgtcgttatggtttannnagtgattcg

SEQ ID NO: 21576 - DNA, 731 bp, Artificial Sequence
  chemically treated genomic DNA (Homo sapiens) CpG-island No: 21576
  misc_feature (10)..(12): n is either a, c, g or t
  misc_feature (108)..(111): n is either a, c, g or t
  misc_feature (146)..(148): n is either a, c, g or t
  misc_feature (185)..(185): n is either a, c, g or t
  misc_feature (302)..(303): n is either a, c, g or t
  misc_feature (718)..(718): n is either a, c, g or t
  misc_feature (720)..(720): n is either a, c, g or t
cgaatcactnnntaaaccataacgacgaacaaaacaaaaccgaaaaacgacgacgcgcgaaaaacgaataaaaaaaaaacccgcaacgactccctccaaaaactacgnnnnctcacgcccgacttttcgacgccgaccaatcgaannnaaaaaaataaaaccataaaaccacaccattaactctncccgacgcctattaaaccatccgaaacaaacgtacccgcccacccccgaaaaccgaatcaataaaacgccgaacacctaaataacattaccccgacgaaactccgaactccccgccnnacgcgcaaaactttccgctcgtcccaactacacctcgatcctacaaaccgtccgcctaacgcaactataaccataacaactcacgcaaaaccgcgctttacaatttaccaaacactcgaacgccttaaacgcgaacgcccgtcgctccttcctcaaatcactacgatacaccgtacgaatccgcgtcgtatcctccgctccgaaacaaaaaccgaacgtactcgttcaatcctatacgcactcgaaataaaaccgaaaaaaactaaacctcaaaacgaccctaatataaaaccgtacgaccgctcactacgattaaaaaaacccaaacgcaaacaacgcaaacgaaatatatattaattaaaatataataaaatcaaaacttaaatcttttacccaaacccgaaattaacgatantnaaccccttctc

SEQ ID NO: 21577 - DNA, 575 bp, Artificial Sequence
  chemically treated genomic DNA (Homo sapiens) CpG-island No: 21577
gcggacgtatttgtttttcgcgtggttagagtcgtttttgtttcggtcggacgcgggtgttttgattttaagagtgggtgggagggtgggttggggaagcgtgttcgtgattgtcgttgtttttttcgggttgggtcgacgtcgggtttcggggattcggtcgtatttcgggggtgtgttgtatttttagcgcgttgaaacgtacgcggggttcgaggggtcgggtgggggttgcgggtcgttgttttaggcgtttggggaggtagcggttttttcgagtgtcgggttagtgcgtattttcgcgtttttttttattcggagttaagagttcgggagtaggtcgtcgcggttttttagtggggcgggagtcgtagaggggtagtttcgcgttgttgtcggggtcgcggagttttgggggggacgtgttttcggggacgcgtcgggtcgtaggcgtttttttttttttcggttttacgttgcgttcgttcgcgatttgtttttattatttttgtttttagcgtttacggatagtcgcgtttacggataatttaattttagtattttgggaggttaag

SEQ ID NO: 21578 - DNA, 575 bp, Artificial Sequence
  chemically treated genomic DNA (Homo sapiens) CpG-island No: 21578
cttaacctcccaaaatactaaaattaaattatccgtaaacgcgactatccgtaaacgctaaaaacaaaaataataaaaacaaatcgcgaacgaacgcaacgtaaaaccgaaaaaaaaaaaaacgcctacgacccgacgcgtccccgaaaacacgtcccccccaaaactccgcgaccccgacaacaacgcgaaactacccctctacgactcccgccccactaaaaaaccgcgacgacctactcccgaactcttaactccgaataaaaaaaaacgcgaaaatacgcactaacccgacactcgaaaaaaccgctacctccccaaacgcctaaaacaacgacccgcaacccccacccgacccctcgaaccccgcgtacgtttcaacgcgctaaaaatacaacacacccccgaaatacgaccgaatccccgaaacccgacgtcgacccaacccgaaaaaaacaacgacaatcacgaacacgcttccccaacccaccctcccacccactcttaaaatcaaaacacccgcgtccgaccgaaacaaaaacgactctaaccacgcgaaaaacaaatacgtccgc

SEQ ID NO: 21579 - DNA, 575 bp, Artificial Sequence
  chemically treated genomic DNA (Homo sapiens) CpG-island No: 21579
tttggttttttaaagtgttgggattagattgttcgtgggcgcgattgttcgtgggcgttaggggtaggggtgataggagtaggtcgcgagcgggcgtagcgtgggatcgaaggggagaaggacgtttgcggttcggcgcgttttcggaggtacgttttttttagggtttcgcggtttcggtaatagcgcggggttatttttttacggttttcgttttattgggggatcgcgacggtttgttttcgggtttttggtttcgagtggagaagagcgcggaagtgcgtattagttcgatattcgggagggtcgttgtttttttaagcgtttgggatagcggttcgtagtttttattcggtttttcgggtttcgcgtgcgttttagcgcgttgaggatgtagtatattttcgaggtgcgatcgggttttcgaagttcggcgtcggtttaattcggaggaggtagcggtagttacgggtacgtttttttaatttatttttttatttatttttagggttaggatattcgcgttcggtcggggtaggggcggttttgattacgcgagaagtaggtgcgttcgt

SEQ ID NO: 21580 - DNA, 575 bp, Artificial Sequence
  chemically treated genomic DNA (Homo sapiens) CpG-island No: 21580
acgaacgcacctacttctcgcgtaatcaaaaccgcccctaccccgaccgaacgcgaatatcctaaccctaaaaataaataaaaaaataaattaaaaaaacgtacccgtaactaccgctacctcctccgaattaaaccgacgccgaacttcgaaaacccgatcgcacctcgaaaatatactacatcctcaacgcgctaaaacgcacgcgaaacccgaaaaaccgaataaaaactacgaaccgctatcccaaacgcttaaaaaaacaacgaccctcccgaatatcgaactaatacgcacttccgcgctcttctccactcgaaaccaaaaacccgaaaacaaaccgtcgcgatcccccaataaaacgaaaaccgtaaaaaaataaccccgcgctattaccgaaaccgcgaaaccctaaaaaaaacgtacctccgaaaacgcgccgaaccgcaaacgtccttctccccttcgatcccacgctacgcccgctcgcgacctactcctatcacccctacccctaacgcccacgaacaatcgcgcccacgaacaatctaatcccaacactttaaaaaaccaaa

SEQ ID NO: 21581 - DNA, 1141 bp, Artificial Sequence
  chemically treated genomic DNA (Homo sapiens) CpG-island No: 21581
gcgtttttcgattcgtatgtttagcgtagtttcgtcggcggcgcgttacgggtagagcgggtttagcgggggacggaagtttagcgttgcgatcgggatttcgtaggttcgtttcgtagggtcgcggttttttttcgtgtaggtgttgggttcgcgggggcggggcgtttatacggttcgcgtttagatttaagcggggaaaaagcgaagagcggatagcggggtaggtgttatagggagttttcgttttatcgcgcgagtagtaagtttgcggcgtttgatatttgtattgcgaatgttaggtcgtagttcgggtttttaagacgcgaatacgcgcgtttgttcgtgacgttattttttgcggttttttcgagagttagtagcgggcgtcgttatgatgttttacggaagtcgatagtttttgtttagcggtatttcgttttttcggttttcggttttgttataaagtttttcgaagacgcggtcgttattcggagacgcggtcgttatttagaagcgtttttcggggaagtttcgttcgtgggatcgcgttatttgcgtcgtttttgcggttcgtagttcgacgggcgtcgttatgttggggttttagcgagggacgcgtaggtgtttttataagatgtcggggtagcggcgcgcgtttttttttaagatggcgtttatgcgggagagcgatacgggtttgtggttgtataataagttgggggttacggacgagttgtgggcgtcgtttagtatcgcgtttttgtttacggtcgcggttatcgataatattcgtttttgtttttatggtttttcgtcggtagtgaagtttaagttgttattcgggacgttgtatttttcgcgtcgtacggtggacgaggtaaggtaggcgtggcgtttcgcggtttttagatttttaatttttttattttcgattcgtatatttaatttcggatttttttcgtttttttttttaatttttttatttttttttagattgttaattttttcggttcgtttttacgtttttttttcgttttttcgaatttttttttttagtttttatttttttttgggtttttatttttcgtttcgatttttattttttatttcggtttttatttttatcgtgggtttttag

SEQ ID NO: 21582 - DNA, 1141 bp, Artificial Sequence
  chemically treated genomic DNA (Homo sapiens) CpG-island No: 21582
ctaaaaacccacgataaaaataaaaaccgaaataaaaaataaaaatcgaaacgaaaaataaaaacccaaaaaaaaataaaaactaaaaaaaaaaattcgaaaaaacgaaaaaaaaacgtaaaaacgaaccgaaaaaattaacaatctaaaaaaaaataaaaaaattaaaaaaaaaaacgaaaaaaatccgaaattaaatatacgaatcgaaaataaaaaaattaaaaatctaaaaaccgcgaaacgccacgcctaccttacctcgtccaccgtacgacgcgaaaaatacaacgtcccgaataacaacttaaacttcactaccgacgaaaaaccataaaaacaaaaacgaatattatcgataaccgcgaccgtaaacaaaaacgcgatactaaacgacgcccacaactcgtccgtaacccccaacttattatacaaccacaaacccgtatcgctctcccgcataaacgccatcttaaaaaaaaacgcgcgccgctaccccgacatcttataaaaacacctacgcgtccctcgctaaaaccccaacataacgacgcccgtcgaactacgaaccgcaaaaacgacgcaaataacgcgatcccacgaacgaaacttccccgaaaaacgcttctaaataacgaccgcgtctccgaataacgaccgcgtcttcgaaaaactttataacaaaaccgaaaaccgaaaaaacgaaataccgctaaacaaaaactatcgacttccgtaaaacatcataacgacgcccgctactaactctcgaaaaaaccgcaaaaaataacgtcacgaacaaacgcgcgtattcgcgtcttaaaaacccgaactacgacctaacattcgcaatacaaatatcaaacgccgcaaacttactactcgcgcgataaaacgaaaactccctataacacctaccccgctatccgctcttcgctttttccccgcttaaatctaaacgcgaaccgtataaacgccccgcccccgcgaacccaacacctacacgaaaaaaaaccgcgaccctacgaaacgaacctacgaaatcccgatcgcaacgctaaacttccgtcccccgctaaacccgctctacccgtaacgcgccgccgacgaaactacgctaaacatacgaatcgaaaaacgc

SEQ ID NO: 21583 - DNA, 1141 bp, Artificial Sequence
  chemically treated genomic DNA (Homo sapiens) CpG-island No: 21583
ttgaagatttacggtggggatgagaatcgaggtgggagatgaggatcgaggcgggggatgaggatttagggggaggtgaggattggagggagggattcggaggagcgaggagggggcgtgagggcgggtcgggggggttaatagtttgaagggggatgggaaggttgggggagggagcgaggagggttcggagttgggtgtgcgggtcggaggtgggaaggttgggaatttgggggtcgcggggcgttacgtttgttttatttcgtttatcgtgcggcgcgggaggtgtagcgtttcgagtagtaatttgagttttattgtcgacgagaggttatggaagtagagacggatgttgtcgatgatcgcggtcgtgagtagggacgcgatgttgggcggcgtttatagttcgttcgtggtttttagtttgttgtgtagttataggttcgtgtcgttttttcgtatggacgttattttgggggaaagcgcgcgtcgttgtttcggtattttatgaagatatttacgcgtttttcgttaggattttaatatggcggcgttcgtcgggttgcgggtcgtagaggcggcgtaggtggcgcggttttacgagcggggttttttcggagagcgtttttgggtggcgatcgcgttttcgggtagcggtcgcgttttcgggaagttttgtggtaaagtcgagagtcggaaggacggggtgtcgttgagtaaggattatcggttttcgtaaaatattatggcggcgttcgttgttggttttcgggaagatcgtaaaaaatgacgttacgagtaggcgcgcgtattcgcgttttgggagttcgggttgcggtttggtattcgtagtgtaggtgttaagcgtcgtagatttgttgttcgcgcggtggggcggaggttttttgtggtatttgtttcgttgttcgtttttcgtttttttttcgtttgggtttgggcgcggatcgtgtggacgtttcgttttcgcgggtttagtatttgtacggagaggagtcgcggttttgcggagcgagtttgcgggatttcggtcgtagcgttgagttttcgtttttcgttgagttcgttttgttcgtggcgcgtcgtcgacggggttgcgttgagtatgcgggtcggagggcgt

SEQ ID NO: 21584 - DNA, 1141 bp, Artificial Sequence
  chemically treated genomic DNA (Homo sapiens) CpG-island No: 21584
acgccctccgacccgcatactcaacgcaaccccgtcgacgacgcgccacgaacaaaacgaactcaacgaaaaacgaaaactcaacgctacgaccgaaatcccgcaaactcgctccgcaaaaccgcgactcctctccgtacaaatactaaacccgcgaaaacgaaacgtccacacgatccgcgcccaaacccaaacgaaaaaaaaacgaaaaacgaacaacgaaacaaataccacaaaaaacctccgccccaccgcgcgaacaacaaatctacgacgcttaacacctacactacgaataccaaaccgcaacccgaactcccaaaacgcgaatacgcgcgcctactcgtaacgtcattttttacgatcttcccgaaaaccaacaacgaacgccgccataatattttacgaaaaccgataatccttactcaacgacaccccgtccttccgactctcgactttaccacaaaacttcccgaaaacgcgaccgctacccgaaaacgcgatcgccacccaaaaacgctctccgaaaaaaccccgctcgtaaaaccgcgccacctacgccgcctctacgacccgcaacccgacgaacgccgccatattaaaatcctaacgaaaaacgcgtaaatatcttcataaaataccgaaacaacgacgcgcgctttcccccaaaataacgtccatacgaaaaaacgacacgaacctataactacacaacaaactaaaaaccacgaacgaactataaacgccgcccaacatcgcgtccctactcacgaccgcgatcatcgacaacatccgtctctacttccataacctctcgtcgacaataaaactcaaattactactcgaaacgctacacctcccgcgccgcacgataaacgaaataaaacaaacgtaacgccccgcgacccccaaattcccaaccttcccacctccgacccgcacacccaactccgaaccctcctcgctccctcccccaaccttcccatcccccttcaaactattaacccccccgacccgccctcacgccccctcctcgctcctccgaatccctccctccaatcctcacctccccctaaatcctcatcccccgcctcgatcctcatctcccacctcgattctcatccccaccgtaaatcttcaa

SEQ ID NO: 21585 - DNA, 1125 bp, Artificial Sequence
  chemically treated genomic DNA (Homo sapiens) CpG-island No: 21585
tgcgttagcgttcgtttgaggtttcgtatataaattttaggtttatgggttcgtttcgcggggtaggcgtcgtgggtttaaggaggttaggttaggagtttcggtttcggggttacgcggcggcgggtagttttttcgtttcgtttagggtgttgttaatttatagtcgagtagcgattcgtaggatcggcgagaatttcgttattgttttcggtcggaagagaacgtgtagagatgtacgttattttcggggcgtggcgtggtcgggcgtggtcgtttcgtttttggcggcgtgtttggtgttttgtttcgcgtttgtgcgatcgttcgtttcgagcgcgtagtcgcggtaggtgcggggcgggacgggggcgttcggggtggggggcgtagggggcgttcgggttgggggtgggataggggacgcgcggggtgggggaggagacgggattcggggtacgcgggggtggggcgggtgagaggtgcgtagggtaggggagtagggggcgcgcggggtgtggggttggattaggggcgcgcggggtgggggcggtgggaggcgcgcggcgtgggggttagagggcgcgtagggtgggggacgggatcggggacgcgtagggtggggggcgggatcgggggcgcgcggggtgggggcggggatcgggacgtacgcgggatggcggagtgggaggcgcgcggggttgggggtgtttttgcgttcggtgtgtattttatggttttcgttagggagatcgagttcgggttaggggtcggaatcgcggggcgcgggtcggggttggggttggggttgggatcgggatcgggatcgggatcgggattcgggtttttcgcggttttaagttttttttcgttgttacgagggcgtgggaggcgcggtcgtggggtggggtggggttaggttcgcgatgtgtttattttggttttttaggatcgttgtttttgcggttattttttgtgtaattttcgaagtttgcgttttttgttgtttgggttcggggcgggggtatcgcgtaggttagaacggtttttgcgttcgtagttagagtttttgttattagtttttttagggtgttcgtcggttgtcgggtgtgggggtatgttagg

SEQ ID NO: 21586 - DNA, 1125 bp, Artificial Sequence
  chemically treated genomic DNA (Homo sapiens) CpG-island No: 21586
cctaacatacccccacacccgacaaccgacgaacaccctaaaaaaactaataacaaaaactctaactacgaacgcaaaaaccgttctaacctacgcgatacccccgccccgaacccaaacaacaaaaaacgcaaacttcgaaaattacacaaaaaataaccgcaaaaacaacgatcctaaaaaaccaaaataaacacatcgcgaacctaaccccaccccaccccacgaccgcgcctcccacgccctcgtaacaacgaaaaaaaacttaaaaccgcgaaaaacccgaatcccgatcccgatcccgatcccgatcccaaccccaaccccaaccccgacccgcgccccgcgattccgacccctaacccgaactcgatctccctaacgaaaaccataaaatacacaccgaacgcaaaaacacccccaaccccgcgcgcctcccactccgccatcccgcgtacgtcccgatccccgcccccaccccgcgcgcccccgatcccgccccccaccctacgcgtccccgatcccgtcccccaccctacgcgccctctaacccccacgccgcgcgcctcccaccgcccccaccccgcgcgcccctaatccaaccccacaccccgcgcgccccctactcccctaccctacgcacctctcacccgccccacccccgcgtaccccgaatcccgtctcctcccccaccccgcgcgtcccctatcccacccccaacccgaacgccccctacgccccccaccccgaacgcccccgtcccgccccgcacctaccgcgactacgcgctcgaaacgaacgatcgcacaaacgcgaaacaaaacaccaaacacgccgccaaaaacgaaacgaccacgcccgaccacgccacgccccgaaaataacgtacatctctacacgttctcttccgaccgaaaacaataacgaaattctcgccgatcctacgaatcgctactcgactataaattaacaacaccctaaacgaaacgaaaaaactacccgccgccgcgtaaccccgaaaccgaaactcctaacctaacctccttaaacccacgacgcctaccccgcgaaacgaacccataaacctaaaatttatatacgaaacctcaaacgaacgctaacgca

SEQ ID NO: 21587 - DNA, 1125 bp, Artificial Sequence
  chemically treated genomic DNA (Homo sapiens) CpG-island No: 21587
tttggtatatttttatattcgatagtcggcgagtattttaaaggggttgatggtaggggttttggttacggacgtaggggtcgttttggtttgcgcgatgttttcgtttcgaatttaggtagtaggaaacgtaggtttcggggattgtataaaaaatagtcgtaaaggtaacggttttgagagattagggtgagtatatcgcggatttggttttattttattttacggtcgcgttttttacgttttcgtaatagcgagagaaaatttgaagtcgcggggaattcggatttcgatttcgatttcgatttcgattttaattttaattttagtttcggttcgcgtttcgcgatttcggtttttggttcggattcggtttttttggcgggggttatggggtgtatatcggacgtaggagtatttttaatttcgcgcgttttttatttcgttatttcgcgtgcgtttcggttttcgtttttatttcgcgcgttttcggtttcgttttttattttgcgcgttttcggtttcgttttttattttgcgcgttttttaatttttacgtcgcgcgttttttatcgtttttatttcgcgcgtttttggtttagttttatatttcgcgcgttttttatttttttattttgcgtattttttattcgttttattttcgcgtatttcgggtttcgtttttttttttatttcgcgcgttttttgttttatttttaattcgagcgttttttacgttttttatttcgggcgttttcgtttcgtttcgtatttgtcgcggttgcgcgttcgggacggacggtcgtatagacgcggaatagggtattaggtacgtcgttaggggcgggacggttacgttcggttacgttacgtttcggaagtgacgtatatttttgtacgttttttttcggtcggaggtagtggcggggttttcgtcggttttgcgggtcgttgttcggttgtgggttagtagtattttgagcggagcggaagagttgttcgtcgtcgcgtaatttcgaggtcgagatttttggtttggtttttttgggtttacgacgtttgtttcgcggagcggatttatgggtttgaggtttgtgtgcggggttttaggcgagcgttggcgta

SEQ ID NO: 21588 - DNA, 1125 bp, Artificial Sequence
  chemically treated genomic DNA (Homo sapiens) CpG-island No: 21588
tacgccaacgctcgcctaaaaccccgcacacaaacctcaaacccataaatccgctccgcgaaacaaacgtcgtaaacccaaaaaaaccaaaccaaaaatctcgacctcgaaattacgcgacgacgaacaactcttccgctccgctcaaaatactactaacccacaaccgaacaacgacccgcaaaaccgacgaaaaccccgccactacctccgaccgaaaaaaaacgtacaaaaatatacgtcacttccgaaacgtaacgtaaccgaacgtaaccgtcccgcccctaacgacgtacctaataccctattccgcgtctatacgaccgtccgtcccgaacgcgcaaccgcgacaaatacgaaacgaaacgaaaacgcccgaaataaaaaacgtaaaaaacgctcgaattaaaaataaaacaaaaaacgcgcgaaataaaaaaaaaaacgaaacccgaaatacgcgaaaataaaacgaataaaaaatacgcaaaataaaaaaataaaaaacgcgcgaaatataaaactaaaccaaaaacgcgcgaaataaaaacgataaaaaacgcgcgacgtaaaaattaaaaaacgcgcaaaataaaaaacgaaaccgaaaacgcgcaaaataaaaaacgaaaccgaaaacgcgcgaaataaaaacgaaaaccgaaacgcacgcgaaataacgaaataaaaaacgcgcgaaattaaaaatactcctacgtccgatatacaccccataacccccgccaaaaaaaccgaatccgaaccaaaaaccgaaatcgcgaaacgcgaaccgaaactaaaattaaaattaaaatcgaaatcgaaatcgaaatcgaaatccgaattccccgcgacttcaaattttctctcgctattacgaaaacgtaaaaaacgcgaccgtaaaataaaataaaaccaaatccgcgatatactcaccctaatctctcaaaaccgttacctttacgactattttttatacaatccccgaaacctacgtttcctactacctaaattcgaaacgaaaacatcgcgcaaaccaaaacgacccctacgtccgtaaccaaaacccctaccatcaacccctttaaaatactcgccgactatcgaatataaaaatataccaaa

SEQ ID NO: 21589 - DNA, 693 bp, Artificial Sequence
  chemically treated genomic DNA (Homo sapiens) CpG-island No: 21589
gtgttcgtttatttcgacggcgttgggttgttaaggtgagtcgtcgaggagtttcgtgtttcgaggcgggtatagtcgttttgtatgggtgttttcggcgcgggattgacgtagagttttgttcggagttttagcgatttcgtttttgttttaggcggtcgtttcgaagtttgagtcgggtaacgcgtagttcgtttggttcggttttttttcgcgcgttttcgtcgcgagttgtcgtttgggagttttagacgttttcgtttagggcgattcggacgttttcgtttagggcgatttcggtttttgtagtttagttggcgatacgtttcgttaagagttcgtatttcggcgttttacggttatcggaggcggggatagggagttcggcgcgggtcgggtcgggggatttgtagcggcggcgcgaaggtaattttttcgttagagtcgggaaagagtttcgagtagaggaggaagggagcggggatttgtttttcgtttgtcggtttttggaagaagcgttttttgattcggtttcggaataagaaattcggattttgtttgtcgggtttcgcgatgtcgtaggtatagagcgcgttttttcggggaggatgttttagggatttcgcgttgtattggttgcggtcgtggggtgcggcggtttttgagtgaagaggggattttgttagggattta

SEQ ID NO: 21590 - DNA, 693 bp, Artificial Sequence
  chemically treated genomic DNA (Homo sapiens) CpG-island No: 21590
taaatccctaacaaaatcccctcttcactcaaaaaccgccgcaccccacgaccgcaaccaatacaacgcgaaatccctaaaacatcctccccgaaaaaacgcgctctatacctacgacatcgcgaaacccgacaaacaaaatccgaatttcttattccgaaaccgaatcaaaaaacgcttcttccaaaaaccgacaaacgaaaaacaaatccccgctcccttcctcctctactcgaaactctttcccgactctaacgaaaaaattaccttcgcgccgccgctacaaatcccccgacccgacccgcgccgaactccctatccccgcctccgataaccgtaaaacgccgaaatacgaactcttaacgaaacgtatcgccaactaaactacaaaaaccgaaatcgccctaaacgaaaacgtccgaatcgccctaaacgaaaacgtctaaaactcccaaacgacaactcgcgacgaaaacgcgcgaaaaaaaaccgaaccaaacgaactacgcgttacccgactcaaacttcgaaacgaccgcctaaaacaaaaacgaaatcgctaaaactccgaacaaaactctacgtcaatcccgcgccgaaaacacccatacaaaacgactatacccgcctcgaaacacgaaactcctcgacgactcaccttaacaacccaacgccgtcgaaataaacgaacac

SEQ ID NO: 21591 - DNA, 693 bp, Artificial Sequence
  chemically treated genomic DNA (Homo sapiens) CpG-island No: 21591
tgaatttttggtaaagttttttttttatttagaagtcgtcgtattttacggtcgtagttagtgtagcgcggggtttttggagtatttttttcgggagggcgcgttttgtatttgcggtatcgcggagttcggtaggtaaggttcgggttttttatttcggggtcggattaggagacgttttttttagaagtcggtaggcgaagggtaggttttcgtttttttttttttttgttcggggttttttttcggttttggcgggggagttattttcgcgtcgtcgttgtagatttttcgattcggttcgcgtcggattttttgttttcgttttcggtggtcgtgaggcgtcgaggtgcgggtttttggcgaggcgtgtcgttagttgggttgtagaggtcgggatcgttttgggcgggagcgttcggatcgttttgggcgggagcgtttggagtttttaggcggtagttcgcgacgaggacgcgcgggagggagtcgggttaggcgggttgcgcgttgttcggtttaggtttcggaacggtcgtttggggtaggaacggggtcgttggggtttcgggtagggttttgcgttaatttcgcgtcgggggtatttatgtagggcggttgtgttcgtttcggggtacggggtttttcggcggtttattttggtagtttagcgtcgtcggagtggacggatat

SEQ ID NO: 21592 - DNA, 693 bp, Artificial Sequence
  chemically treated genomic DNA (Homo sapiens) CpG-island No: 21592
atatccgtccactccgacgacgctaaactaccaaaataaaccgccgaaaaaccccgtaccccgaaacgaacacaaccgccctacataaatacccccgacgcgaaattaacgcaaaaccctacccgaaaccccaacgaccccgttcctaccccaaacgaccgttccgaaacctaaaccgaacaacgcgcaacccgcctaacccgactccctcccgcgcgtcctcgtcgcgaactaccgcctaaaaactccaaacgctcccgcccaaaacgatccgaacgctcccgcccaaaacgatcccgacctctacaacccaactaacgacacgcctcgccaaaaacccgcacctcgacgcctcacgaccaccgaaaacgaaaacaaaaaatccgacgcgaaccgaatcgaaaaatctacaacgacgacgcgaaaataactcccccgccaaaaccgaaaaaaaaccccgaacaaaaaaaaaaaaaaacgaaaacctacccttcgcctaccgacttctaaaaaaaacgtctcctaatccgaccccgaaataaaaaacccgaaccttacctaccgaactccgcgataccgcaaatacaaaacgcgccctcccgaaaaaaatactccaaaaaccccgcgctacactaactacgaccgtaaaatacgacgacttctaaataaaaaaaaaactttaccaaaaattca

SEQ ID NO: 21593 - DNA, 621 bp, Artificial Sequence
  chemically treated genomic DNA (Homo sapiens) CpG-island No: 21593
gtttacgtaattcgtaagtgaacgaatttgggcgtttatggcgaggttttgttagtgacggtcggtggtggcgtcgttagttagtttttcgttttcgtgtatttgtgcgttttcgtagttgttaaagtaaacgtaggtttttcgatttcgttagatttttaaagcgggttgttagtttcgggttattgttacggtcgtttcgggtttttattttcggatttttcgtttatgcgttcggattatagcgtttgttgacgtattgtagcggtcgtttgcgcgttagcggggttcggcggttttttttgtagtcgttatcgggttttttcgaaaaagagtttttttcgatttggggttggggaggttgggggcggtgaaggttgtttcggttcggttggttttaggcggggtacggcggcggggaaggggtcggggtcgttggggtttgcgcgaggcgtagtacgggaattcgtttttttcgggatagcgcggcgggaaataaataggacgagttttttttttttcgtgttcgcgtttttaggcgttaggggtggtaacggttttaggggtcgagggaggcggttcgggtttttcgcgttgttaggtttaggtttgggttggggt

SEQ ID NO: 21594 - DNA, 621 bp, Artificial Sequence
  chemically treated genomic DNA (Homo sapiens) CpG-island No: 21594
accccaacccaaacctaaacctaacaacgcgaaaaacccgaaccgcctccctcgacccctaaaaccgttaccacccctaacgcctaaaaacgcgaacacgaaaaaaaaaaaactcgtcctatttatttcccgccgcgctatcccgaaaaaaacgaattcccgtactacgcctcgcgcaaaccccaacgaccccgaccccttccccgccgccgtaccccgcctaaaaccaaccgaaccgaaacaaccttcaccgcccccaacctccccaaccccaaatcgaaaaaaactctttttcgaaaaaacccgataacgactacaaaaaaaaccgccgaaccccgctaacgcgcaaacgaccgctacaatacgtcaacaaacgctataatccgaacgcataaacgaaaaatccgaaaataaaaacccgaaacgaccgtaacaataacccgaaactaacaacccgctttaaaaatctaacgaaatcgaaaaacctacgtttactttaacaactacgaaaacgcacaaatacacgaaaacgaaaaactaactaacgacgccaccaccgaccgtcactaacaaaacctcgccataaacgcccaaattcgttcacttacgaattacgtaaac

SEQ ID NO: 21595 - DNA, 621 bp, Artificial Sequence
  chemically treated genomic DNA (Homo sapiens) CpG-island No: 21595
gttttagtttaagtttgagtttggtagcgcggggagttcgagtcgtttttttcgatttttgaggtcgttgttatttttggcgtttgagggcgcgggtacggagaggagggagttcgttttgtttgtttttcgtcgcgttgtttcgggggggacggattttcgtattgcgtttcgcgtaagttttagcggtttcggtttttttttcgtcgtcgtgtttcgtttggggttagtcgggtcgaagtagtttttatcgtttttagtttttttagttttaggtcgggagggattttttttcgggaaaattcggtggcgattgtagagaaaatcgtcgggtttcgttggcgcgtaggcggtcgttatagtgcgttaataggcgttgtaattcgagcgtataaacgaggggttcgggggtgggggttcggggcggtcgtggtagtggttcggggttggtagttcgttttgaaaatttggcgaagtcggggagtttgcgtttgttttggtagttgcgaaggcgtataggtgtacgggggcggggggttggttggcggcgttattatcgatcgttattgatagagtttcgttatgggcgtttaaattcgtttatttgcgaattgcgtaagt

SEQ ID NO: 21596 - DNA, 621 bp, Artificial Sequence
  chemically treated genomic DNA (Homo sapiens) CpG-island No: 21596
acttacgcaattcgcaaataaacgaatttaaacgcccataacgaaactctatcaataacgatcgataataacgccgccaaccaaccccccgcccccgtacacctatacgccttcgcaactaccaaaacaaacgcaaactccccgacttcgccaaattttcaaaacgaactaccaaccccgaaccactaccacgaccgccccgaacccccacccccgaacccctcgtttatacgctcgaattacaacgcctattaacgcactataacgaccgcctacgcgccaacgaaacccgacgattttctctacaatcgccaccgaattttcccgaaaaaaaatccctcccgacctaaaactaaaaaaactaaaaacgataaaaactacttcgacccgactaaccccaaacgaaacacgacgacgaaaaaaaaaccgaaaccgctaaaacttacgcgaaacgcaatacgaaaatccgtcccccccgaaacaacgcgacgaaaaacaaacaaaacgaactccctcctctccgtacccgcgccctcaaacgccaaaaataacaacgacctcaaaaatcgaaaaaaacgactcgaactccccgcgctaccaaactcaaacttaaactaaaac

SEQ ID NO: 21597 - DNA, 935 bp, Artificial Sequence
  chemically treated genomic DNA (Homo sapiens) CpG-island No: 21597
cgcgagtcgcgtatacgttatcgtttgcggtttttttaggtagttcgagttcgttcgtttttagagtgttcgagttcggttcgtagttcgttgttttttgttttaggtggattaggggttttcggggtatttcgttttattttcgtaacgttattttttttcgggtagtaggtggttcgatcggcggtttaggcgttcggtcgttgttttcgtttcgtatttattcgtttcggacgtcgcgttggcgttcgtttcggtcggttggagaagttggtcggtttaaattttcggtcgtagttttttaggcggcgcgtattatcgcgttatcgttagagggggattttgcgtcgttcgtcgttatttcgcgtttttttcgcgcggtcgtttcgcgttcggtatttgttaatttcgcgcgcggggttttcgggattcgcgggggtttgagggggacgtcgggtggcgcgggggtcgcgcgggtttgggttgggcggagcgggcgtatttttacggttcggttagtggaaggcgcgggtagtagcggtttcgagtggtcgcggcggtgggttgtgtcggagttttttttttttggttcgttgtaggttggtggcgggaggaggggatagttgcgggcgcggggagggggcgtcgcgtcgcgggggttatggcggagttaggaagtcgggagttcgagattcgggtaattgtcgcggcgtggcggtttgtttttttggagggggagggagtggttttttgggggtgttcggcgcggggttttcgcgcgggatttgggcggaagagggggtttagtttaggagagaaggcgcgtcgttacgttggtattaagggtgattgttcgtttggggcggtttgtcgggtggggtcgtggcgagtggcgggtggggagttttgggtggaagtgggtgatttggtggtat

SEQ ID NO: 21598 - DNA, 935 bp, Artificial Sequence
  chemically treated genomic DNA (Homo sapiens) CpG-island No: 21598
ataccaccaaatcacccacttccacccaaaactccccacccgccactcgccacgaccccacccgacaaaccgccccaaacgaacaatcacccttaataccaacgtaacgacgcgccttctctcctaaactaaaccccctcttccgcccaaatcccgcgcgaaaaccccgcgccgaacacccccaaaaaaccactccctccccctccaaaaaaacaaaccgccacgccgcgacaattacccgaatctcgaactcccgacttcctaactccgccataacccccgcgacgcgacgccccctccccgcgcccgcaactatcccctcctcccgccaccaacctacaacgaaccaaaaaaaaaaaactccgacacaacccaccgccgcgaccactcgaaaccgctactacccgcgccttccactaaccgaaccgtaaaaatacgcccgctccgcccaacccaaacccgcgcgacccccgcgccacccgacgtccccctcaaacccccgcgaatcccgaaaaccccgcgcgcgaaattaacaaataccgaacgcgaaacgaccgcgcgaaaaaaacgcgaaataacgacgaacgacgcaaaatccccctctaacgataacgcgataatacgcgccgcctaaaaaactacgaccgaaaatttaaaccgaccaacttctccaaccgaccgaaacgaacgccaacgcgacgtccgaaacgaataaatacgaaacgaaaacaacgaccgaacgcctaaaccgccgatcgaaccacctactacccgaaaaaaaataacgttacgaaaataaaacgaaataccccgaaaacccctaatccacctaaaacaaaaaacaacgaactacgaaccgaactcgaacactctaaaaacgaacgaactcgaactacctaaaaaaaccgcaaacgataacgtatacgcgactcgcg

SEQ ID NO: 21599 - DNA, 935 bp, Artificial Sequence
  chemically treated genomic DNA (Homo sapiens) CpG-island No: 21599
gtgttattaggttatttatttttatttaaggttttttattcgttattcgttacgattttattcggtaggtcgttttaagcggatagttatttttagtgttaacgtagcggcgcgtttttttttttagattaagttttttttttcgtttaggtttcgcgcgggagtttcgcgtcgagtatttttaaagagttattttttttttttttagaaaggtaagtcgttacgtcgcggtagttattcgggtttcggattttcggttttttggtttcgttatggttttcgcggcgcggcgtttttttttcgcgttcgtagttgtttttttttttcgttattaatttgtagcggattaaagggaggagatttcggtatagtttatcgtcgcggttattcggagtcgttgttgttcgcgttttttattggtcgggtcgtgggggtacgttcgtttcgtttagtttaggttcgcgcggttttcgcgttattcggcgttttttttagattttcgcgggtttcggaggtttcgcgcgcgaggttggtaggtgtcgggcgcgaagcggtcgcgcgggggaggcgcgggatggcggcgggcggcgtagggtttttttttggcggtggcgcgatggtgcgcgtcgtttggggagttgcggtcgggggtttgaatcggttaatttttttagtcggtcggggcgagcgttagcgcggcgttcggggcgagtgagtgcggggcgggggtagcggtcgggcgtttgggtcgtcggtcgggttatttgttgttcggggaaggatagcgttgcgagagtgggacggggtgtttcgggaatttttgatttatttagggtagagggtagcgagttacgggtcggattcgggtattttggaggcgggcgagttcgggttgtttggggaggtcgtaggcgatggcgtgtgcgcggttcgcg

SEQ ID NO: 21600 - DNA, 935 bp, Artificial Sequence
  chemically treated genomic DNA (Homo sapiens) CpG-island No: 21600
cgcgaaccgcgcacacgccatcgcctacgacctccccaaacaacccgaactcgcccgcctccaaaatacccgaatccgacccgtaactcgctaccctctaccctaaataaatcaaaaattcccgaaacaccccgtcccactctcgcaacgctatccttccccgaacaacaaataacccgaccgacgacccaaacgcccgaccgctacccccgccccgcactcactcgccccgaacgccgcgctaacgctcgccccgaccgactaaaaaaattaaccgattcaaacccccgaccgcaactccccaaacgacgcgcaccatcgcgccaccgccaaaaaaaaaccctacgccgcccgccgccatcccgcgcctcccccgcgcgaccgcttcgcgcccgacacctaccaacctcgcgcgcgaaacctccgaaacccgcgaaaatctaaaaaaaacgccgaataacgcgaaaaccgcgcgaacctaaactaaacgaaacgaacgtacccccacgacccgaccaataaaaaacgcgaacaacaacgactccgaataaccgcgacgataaactataccgaaatctcctccctttaatccgctacaaattaataacgaaaaaaaaaaacaactacgaacgcgaaaaaaaaacgccgcgccgcgaaaaccataacgaaaccaaaaaaccgaaaatccgaaacccgaataactaccgcgacgtaacgacttacctttctaaaaaaaaaaaaaataactctttaaaaatactcgacgcgaaactcccgcgcgaaacctaaacgaaaaaaaaaacttaatctaaaaaaaaaaacgcgccgctacgttaacactaaaaataactatccgcttaaaacgacctaccgaataaaatcgtaacgaataacgaataaaaaaccttaaataaaaataaataacctaataacac

SEQ ID NO: 21601 - DNA, 708 bp, Artificial Sequence
  chemically treated genomic DNA (Homo sapiens) CpG-island No: 21601
atggtttcgtcgtagttttgtcgcgcgttggtgtcggcgtaatgggtggcggaggcgttgcgggtttcgcgcgttgggtagtttttgtagttgttggacgttttttggtatttgtcgaagttggggcgcgacgcgcgacgcgagttcgaggagcgttatatttcgggcgtcgtttttttcgatatcgattagtgtagcgatcgtatttcgttttacgattatatgttgttcggggtcgagtatttcgcggagtacgtaggtcgtttgggcgtgggcgcggttatttacgtcgtgatttacgacgttagcgattagggtttttatttcgtttcgcgcgtttggtggatgtttcgcgttttcggttattacgtcgtgttattgtttgatggcggttttcgttattggttgcgttagaatttttcgtttagtttcggtaagagttaatttgttttcgtcgagtttcgcgtttagttcgatttcgtttttattaagatttacgaggatattaaggagaatttggaatttcggcgtttttaggtggtggattttcgagttattggtaggtttcgcggtatcgagttcgagtttcgagacggtaacgcgggggaagggggtaggaggtcgtcgggggcgcggtttttacgttttgagtagtgttttggatttgattttttttttatttttttaatttattttgtttttattttt

SEQ ID NO: 21602 - DNA, 708 bp, Artificial Sequence
  chemically treated genomic DNA (Homo sapiens) CpG-island No: 21602
aaaaataaaaacaaaataaattaaaaaaataaaaaaaaaatcaaatccaaaacactactcaaaacgtaaaaaccgcgcccccgacgacctcctacccccttcccccgcgttaccgtctcgaaactcgaactcgataccgcgaaacctaccaataactcgaaaatccaccacctaaaaacgccgaaattccaaattctccttaatatcctcgtaaatcttaataaaaacgaaatcgaactaaacgcgaaactcgacgaaaacaaattaactcttaccgaaactaaacgaaaaattctaacgcaaccaataacgaaaaccgccatcaaacaataacacgacgtaataaccgaaaacgcgaaacatccaccaaacgcgcgaaacgaaataaaaaccctaatcgctaacgtcgtaaatcacgacgtaaataaccgcgcccacgcccaaacgacctacgtactccgcgaaatactcgaccccgaacaacatataatcgtaaaacgaaatacgatcgctacactaatcgatatcgaaaaaaacgacgcccgaaatataacgctcctcgaactcgcgtcgcgcgtcgcgccccaacttcgacaaataccaaaaaacgtccaacaactacaaaaactacccaacgcgcgaaacccgcaacgcctccgccacccattacgccgacaccaacgcgcgacaaaactacgacgaaaccat

SEQ ID NO: 21603 - DNA, 708 bp, Artificial Sequence
  chemically treated genomic DNA (Homo sapiens) CpG-island No: 21603
ggaaatgaaagtaagataaattaaaaaaataaaagaaaggttaagtttagggtattgtttagggcgtagaggtcgcgttttcgacgattttttgtttttttttttcgcgttatcgtttcggggttcgggttcggtgtcgcggaatttgttagtggttcgggagtttattatttggaagcgtcgggattttaggttttttttgatgttttcgtaggttttgatgaaggcggggtcgagttgagcgcggaattcggcgggagtaggttggtttttgtcggagttgagcgggaggttttggcgtagttagtggcggaggtcgttattaagtagtgatacggcgtggtggtcgaaggcgcggaatatttattagacgcgcggggcggagtagaggttttggtcgttggcgtcgtagattacgacgtgggtggtcgcgtttacgtttaggcggtttgcgtatttcgcgaaatgttcggtttcgggtagtatgtggtcgtagggcgaggtgcggtcgttgtattggtcgatgtcgaagaaagcggcgttcgggatgtggcgtttttcgaattcgcgtcgcgcgtcgcgttttagtttcggtaggtattaggaggcgtttagtagttgtagaggttgtttagcgcgcggggttcgtagcgttttcgttatttattgcgtcgatattagcgcgcggtagagttgcggcgaagttat

SEQ ID NO: 21604 - DNA, 708 bp, Artificial Sequence
  chemically treated genomic DNA (Homo sapiens) CpG-island No: 21604
ataacttcgccgcaactctaccgcgcgctaatatcgacgcaataaataacgaaaacgctacgaaccccgcgcgctaaacaacctctacaactactaaacgcctcctaatacctaccgaaactaaaacgcgacgcgcgacgcgaattcgaaaaacgccacatcccgaacgccgctttcttcgacatcgaccaatacaacgaccgcacctcgccctacgaccacatactacccgaaaccgaacatttcgcgaaatacgcaaaccgcctaaacgtaaacgcgaccacccacgtcgtaatctacgacgccaacgaccaaaacctctactccgccccgcgcgtctaataaatattccgcgccttcgaccaccacgccgtatcactacttaataacgacctccgccactaactacgccaaaacctcccgctcaactccgacaaaaaccaacctactcccgccgaattccgcgctcaactcgaccccgccttcatcaaaacctacgaaaacatcaaaaaaaacctaaaatcccgacgcttccaaataataaactcccgaaccactaacaaattccgcgacaccgaacccgaaccccgaaacgataacgcgaaaaaaaaaaacaaaaaatcgtcgaaaacgcgacctctacgccctaaacaataccctaaacttaacctttcttttatttttttaatttatcttactttcatttcc

SEQ ID NO: 21605 - DNA, 616 bp, Artificial Sequence
  chemically treated genomic DNA (Homo sapiens) CpG-island No: 21605
gcggcgtggagggttcgcgcgtgggtggcgaggttgtataaagtttcgcggcgttcgtttcgcgttcgttcgggggagaataaagggggttgttttttggcggtcgcgggtttgggggttattatagtggcggggttcggtcgggtagggggtcgggggtacgcgtatttggggtttcgcggttttttcgcggttttgttcgtcgtcggtcgtgattaagatggttcgcgcgggggacgcggttaggtcgatgaattatcgcgcggatcgtcgagaattgtttttcggttagcgtagttaagcgacggcgttggcgatggcggcgggcggttttcggtaggtgtagggatcgggttaggtcggggtcggggtaggggcggggtcggggtcgcggtagagggcgggttatcgcgcggtttttgtgcgggcggggtcggcgcggtggcggtggcgggcgggttttaggttggtttcgttggttgttatggatatcgatcgttttcgcgcgtgcggagacgatcgttgtttcgttttcggaagtgatgtataaagttttatttttttttattttttaattcgggttgttgttaatcggggaagattgtagttgttgcgg

SEQ ID NO: 21606 - DNA, 616 bp, Artificial Sequence
  chemically treated genomic DNA (Homo sapiens) CpG-island No: 21606
ccgcaacaactacaatcttccccgattaacaacaacccgaattaaaaaataaaaaaaaataaaactttatacatcacttccgaaaacgaaacaacgatcgtctccgcacgcgcgaaaacgatcgatatccataacaaccaacgaaaccaacctaaaacccgcccgccaccgccaccgcgccgaccccgcccgcacaaaaaccgcgcgataacccgccctctaccgcgaccccgaccccgcccctaccccgaccccgacctaacccgatccctacacctaccgaaaaccgcccgccgccatcgccaacgccgtcgcttaactacgctaaccgaaaaacaattctcgacgatccgcgcgataattcatcgacctaaccgcgtcccccgcgcgaaccatcttaatcacgaccgacgacgaacaaaaccgcgaaaaaaccgcgaaaccccaaatacgcgtacccccgaccccctacccgaccgaaccccgccactataataacccccaaacccgcgaccgccaaaaaacaaccccctttattctcccccgaacgaacgcgaaacgaacgccgcgaaactttatacaacctcgccacccacgcgcgaaccctccacgccgc

SEQ ID NO: 21607 - DNA, 616 bp, Artificial Sequence
  chemically treated genomic DNA (Homo sapiens) CpG-island No: 21607
tcgtagtaattatagtttttttcgattggtagtagttcgagttggggggtgggggggggtgggattttgtgtattattttcgggggcggggtagcggtcgttttcgtacgcgcgggagcggtcggtatttatggtaattagcggggttagtttaaggttcgttcgttatcgttatcgcgtcggtttcgttcgtataaaggtcgcgcggtgattcgttttttgtcgcgatttcggtttcgtttttgtttcggtttcggtttggttcggtttttgtatttgtcggaggtcgttcgtcgttatcgttagcgtcgtcgtttggttgcgttgatcgggaagtagttttcggcggttcgcgcggtgatttatcggtttggtcgcgtttttcgcgcgggttattttggttacggtcggcggcggatagagtcgcggaggaatcgcgagattttaggtacgcgtgttttcggttttttgttcggtcgggtttcgttattgtggtggtttttaggttcgcggtcgttaaggagtagttttttttgttttttttcgggcgggcgcggggcgggcgtcgcggggttttgtgtagtttcgttatttacgcgcgggttttttacgtcgt

SEQ ID NO: 21608 - DNA, 616 bp, Artificial Sequence
  chemically treated genomic DNA (Homo sapiens) CpG-island No: 21608
acgacgtaaaaaacccgcgcgtaaataacgaaactacacaaaaccccgcgacgcccgccccgcgcccgcccgaaaaaaaacaaaaaaaactactccttaacgaccgcgaacctaaaaaccaccacaataacgaaacccgaccgaacaaaaaaccgaaaacacgcgtacctaaaatctcgcgattcctccgcgactctatccgccgccgaccgtaaccaaaataacccgcgcgaaaaacgcgaccaaaccgataaatcaccgcgcgaaccgccgaaaactacttcccgatcaacgcaaccaaacgacgacgctaacgataacgacgaacgacctccgacaaatacaaaaaccgaaccaaaccgaaaccgaaacaaaaacgaaaccgaaatcgcgacaaaaaacgaatcaccgcgcgacctttatacgaacgaaaccgacgcgataacgataacgaacgaaccttaaactaaccccgctaattaccataaataccgaccgctcccgcgcgtacgaaaacgaccgctaccccgcccccgaaaataatacacaaaatcccacccccccccaccccccaactcgaactactaccaatcgaaaaaaactataattactacga

SEQ ID NO: 21609 - DNA, 522 bp, Artificial Sequence
  chemically treated genomic DNA (Homo sapiens) CpG-island No: 21609
gtcgagcgggtcggatttgggagagtgtttagggcggtaagtttcgattacgagtttttttcggtgtggttcggggcggaattcgtttttttttatcgttgtcgtcgtcgtcgttgtttacgagagagtggggaggaaaggaaaggggtgaaggaggagtcgtcgtcgtcgtcgtcgtcgtcgcgatttcgagcggtcggtcgcgggaggagtcgttcgtcgcgtttaagaagtgaagagataaagcggcgcggcgtttttttcgcgtttcgcgtttttagtttttgttcgtttgcggagagttacgttcgtaattttcggggcggtcgagaggagcggtcgggatttttcggttttattgtcggtttttttgggtttcgcgcgggtcgttcgttgggagttgtttgggtgggttgttcgcgtattggtaggttgttttttttcgttttttttaattcgttgcgggtcgttaattcgattaaaataaaatttcgaggaaggttttttaaaaaattaaaataa

SEQ ID NO: 21610 - DNA, 522 bp, Artificial Sequence
  chemically treated genomic DNA (Homo sapiens) CpG-island No: 21610
ttattttaattttttaaaaaaccttcctcgaaattttattttaatcgaattaacgacccgcaacgaattaaaaaaaacgaaaaaaaacaacctaccaatacgcgaacaacccacccaaacaactcccaacgaacgacccgcgcgaaacccaaaaaaaccgacaataaaaccgaaaaatcccgaccgctcctctcgaccgccccgaaaattacgaacgtaactctccgcaaacgaacaaaaactaaaaacgcgaaacgcgaaaaaaacgccgcgccgctttatctcttcacttcttaaacgcgacgaacgactcctcccgcgaccgaccgctcgaaatcgcgacgacgacgacgacgacgacgactcctccttcacccctttcctttcctccccactctctcgtaaacaacgacgacgacgacaacgataaaaaaaaacgaattccgccccgaaccacaccgaaaaaaactcgtaatcgaaacttaccgccctaaacactctcccaaatccgacccgctcgac

SEQ ID NO: 21611 - DNA, 522 bp, Artificial Sequence
  chemically treated genomic DNA (Homo sapiens) CpG-island No: 21611
ttgttttgattttttaaaaagtttttttcggggttttattttgatcgagttggcggttcgtagcggattgggagaggcgggggaaagtagtttgttagtgcgcgggtagtttatttaggtaatttttagcgagcggttcgcgcggagtttagggaggtcggtagtgaagtcggggagtttcggtcgtttttttcggtcgtttcgggggttgcgagcgtggtttttcgtaggcgggtagaagttgagggcgcggggcgcggaggaagcgtcgcgtcgttttgtttttttattttttgagcgcggcgagcggtttttttcgcggtcggtcgttcgggatcgcggcggcggcggcggcgacggcggttttttttttatttttttttttttttttttattttttcgtaggtagcggcggcggcggtagcggtggggaaaagcggatttcgtttcgaattatatcgaggggagttcgtggtcgagatttgtcgttttaagtatttttttaagttcgattcgttcggt

SEQ ID NO: 21612 - DNA, 522 bp, Artificial Sequence
  chemically treated genomic DNA (Homo sapiens) CpG-island No: 21612
accgaacgaatcgaacttaaaaaaatacttaaaacgacaaatctcgaccacgaactcccctcgatataattcgaaacgaaatccgcttttccccaccgctaccgccgccgccgctacctacgaaaaaataaaaaaaaaaaaaaaaaaataaaaaaaaaaccgccgtcgccgccgccgccgccgcgatcccgaacgaccgaccgcgaaaaaaaccgctcgccgcgctcaaaaaataaaaaaacaaaacgacgcgacgcttcctccgcgccccgcgccctcaacttctacccgcctacgaaaaaccacgctcgcaacccccgaaacgaccgaaaaaaacgaccgaaactccccgacttcactaccgacctccctaaactccgcgcgaaccgctcgctaaaaattacctaaataaactacccgcgcactaacaaactactttcccccgcctctcccaatccgctacgaaccgccaactcgatcaaaataaaaccccgaaaaaaactttttaaaaaatcaaaacaa

SEQ ID NO: 21613 - DNA, 574 bp, Artificial Sequence
  chemically treated genomic DNA (Homo sapiens) CpG-island No: 21613
aagtcggcgggtagaggaaaacgtttgtagtcggcgagtgaagacgaattatcgattgtcgtgttttttttttttttggaggttggagttttttgggcgtttttatacggttagacgtttcggttggttcgcgacgtagtttttcggtcgtggatgtttattcgggttcgggattcgtttaggtagcggtttcggatttaggttttgcgtttaggtttttttttgttttttagcgacggagtcggggtcgggggcggcggcgttcgggggttatgcgggtgagtcgcggttgtagaggtttgagcgtttgatcgtcgcggattcgagtcgagtttatttttttttttagttttttattttggtcgcgggggcggcgcgttcgatttacgcgttcggggtttcgcggggtcgggttcggagtcggtatgaatcgttgttgggcgttttttttgtttttttgttgttatttgcgtttggttagcgtcgaggtgagttgttacggcggttggggttggttttttatttattattttcgttttttttttttgatcgtttttttttttttttgtagtga

SEQ ID NO: 21614 - DNA, 574 bp, Artificial Sequence
  chemically treated genomic DNA (Homo sapiens) CpG-island No: 21614
tcactacaaaaaaaaaaaaaaacgatcaaaaaaaaaaaacgaaaataataaataaaaaaccaaccccaaccgccgtaacaactcacctcgacgctaaccaaacgcaaataacaacaaaaaaacaaaaaaaacgcccaacaacgattcataccgactccgaacccgaccccgcgaaaccccgaacgcgtaaatcgaacgcgccgcccccgcgaccaaaataaaaaactaaaaaaaaaaataaactcgactcgaatccgcgacgatcaaacgctcaaacctctacaaccgcgactcacccgcataacccccgaacgccgccgcccccgaccccgactccgtcgctaaaaaacaaaaaaaaacctaaacgcaaaacctaaatccgaaaccgctacctaaacgaatcccgaacccgaataaacatccacgaccgaaaaactacgtcgcgaaccaaccgaaacgtctaaccgtataaaaacgcccaaaaaactccaacctccaaaaaaaaaaaaaacacgacaatcgataattcgtcttcactcgccgactacaaacgttttcctctacccgccgactt

SEQ ID NO: 21615 - DNA, 574 bp, Artificial Sequence
  chemically treated genomic DNA (Homo sapiens) CpG-island No: 21615
ttattgtagggagaggagggggcggttagaaggggggggcgaaggtaatgaatgaagaattagttttagtcgtcgtggtaatttatttcggcgttgattagacgtaggtagtagtagagagataggaagagcgtttagtagcgatttatgtcgatttcgggttcggtttcgcggggtttcggacgcgtagatcgagcgcgtcgttttcgcggttagggtggggggttggggaggggggtgggttcggttcgggttcgcggcgattaggcgtttaggtttttgtagtcgcggtttattcgtatggttttcgggcgtcgtcgttttcggtttcggtttcgtcgttggggggtaggggaggatttgggcgtaggatttgggttcgaggtcgttatttgggcggatttcgagttcgagtgagtatttacggtcggggggttgcgtcgcgaattagtcgaggcgtttagtcgtgtgggggcgtttaggggattttaatttttaagaggaaaaggaatacggtagtcgatggttcgtttttattcgtcggttataggcgtttttttttgttcgtcggttt

SEQ ID NO: 21616 - DNA, 574 bp, Artificial Sequence
  chemically treated genomic DNA (Homo sapiens) CpG-island No: 21616
aaaccgacgaacaaaaaaaaacgcctataaccgacgaataaaaacgaaccatcgactaccgtattccttttcctcttaaaaattaaaatcccctaaacgcccccacacgactaaacgcctcgactaattcgcgacgcaaccccccgaccgtaaatactcactcgaactcgaaatccgcccaaataacgacctcgaacccaaatcctacgcccaaatcctcccctaccccccaacgacgaaaccgaaaccgaaaacgacgacgcccgaaaaccatacgaataaaccgcgactacaaaaacctaaacgcctaatcgccgcgaacccgaaccgaacccacccccctccccaaccccccaccctaaccgcgaaaacgacgcgctcgatctacgcgtccgaaaccccgcgaaaccgaacccgaaatcgacataaatcgctactaaacgctcttcctatctctctactactacctacgtctaatcaacgccgaaataaattaccacgacgactaaaactaattcttcattcattaccttcgccccccccttctaaccgccccctcctctccctacaataa

SEQ ID NO: 21617 - DNA, 526 bp, Artificial Sequence
  chemically treated genomic DNA (Homo sapiens) CpG-island No: 21617
gggtaggacgacgcgcgcggtggaggggaggagagggtagtcgggagcgcggcgtgattgggtatcgttttattttcgttcggttgcggtcgggagttcgtatttcgttcgtatttcgtcggttttcggggagggtcggtttttgcggtttttagttaggcgtaggaaggaggtagcggcggcgaaggggttaaggcggagggttcggaggtcgcggttcggttttgggttgtcgttagcgtaggttgttttgattacggaggagtcgtcgtcgtttttttttgttttcggggtttttcgagggtcgtaggtcgttcgttcgggggtttcgttttttcgcggtcgtttttcgcggttcgtattcgggagggaggacgcggggttcggtcgggtcgtttttaggtttttttcgacgtttttttttcgtttttttcgtagtttttcgggtcgcggttagttgttggggagggggtggtcggtcggttttagttgtcgtttcgtttcgtcgtgggatttgggggttggg

SEQ ID NO: 21618 - DNA, 526 bp, Artificial Sequence
  chemically treated genomic DNA (Homo sapiens) CpG-island No: 21618
cccaacccccaaatcccacgacgaaacgaaacgacaactaaaaccgaccgaccaccccctccccaacaactaaccgcgacccgaaaaactacgaaaaaaacgaaaaaaaaacgtcgaaaaaaacctaaaaacgacccgaccgaaccccgcgtcctccctcccgaatacgaaccgcgaaaaacgaccgcgaaaaaacgaaacccccgaacgaacgacctacgaccctcgaaaaaccccgaaaacaaaaaaaaacgacgacgactcctccgtaatcaaaacaacctacgctaacgacaacccaaaaccgaaccgcgacctccgaaccctccgccttaaccccttcgccgccgctacctccttcctacgcctaactaaaaaccgcaaaaaccgaccctccccgaaaaccgacgaaatacgaacgaaatacgaactcccgaccgcaaccgaacgaaaataaaacgatacccaatcacgccgcgctcccgactaccctctcctcccctccaccgcgcgcgtcgtcctaccc

SEQ ID NO: 21619 - DNA, 526 bp, Artificial Sequence
  chemically treated genomic DNA (Homo sapiens) CpG-island No: 21619
tttagtttttaggttttacggcgaggcgaggcggtagttggggtcggtcggttattttttttttaatagttggtcgcggttcggggggttgcgggagaggcggagagggggcgtcgggaggggtttgaaggcggttcggtcgagtttcgcgttttttttttcgggtgcgggtcgcggggggcggtcgcggaagggcggggttttcgggcgggcggtttgcggttttcgaggagtttcgagaataaaaggagacggcgacggttttttcgtggttaaaataatttgcgttggcggtagtttaaggtcgggtcgcggttttcgagtttttcgttttaattttttcgtcgtcgttgttttttttttgcgtttggttggaggtcgtaggggtcgatttttttcgggagtcggcgaggtgcgggcgaggtgcggattttcggtcgtagtcgggcggaggtgggacggtatttagttacgtcgcgttttcggttgttttttttttttttttatcgcgcgcgtcgttttgttt

SEQ ID NO: 21620 - DNA, 526 bp, Artificial Sequence
  chemically treated genomic DNA (Homo sapiens) CpG-island No: 21620
aaacaaaacgacgcgcgcgataaaaaaaaaaaaaaaacaaccgaaaacgcgacgtaactaaataccgtcccacctccgcccgactacgaccgaaaatccgcacctcgcccgcacctcgccgactcccgaaaaaaatcgacccctacgacctccaaccaaacgcaaaaaaaaaacaacgacgacgaaaaaattaaaacgaaaaactcgaaaaccgcgacccgaccttaaactaccgccaacgcaaattattttaaccacgaaaaaaccgtcgccgtctccttttattctcgaaactcctcgaaaaccgcaaaccgcccgcccgaaaaccccgcccttccgcgaccgccccccgcgacccgcacccgaaaaaaaaaacgcgaaactcgaccgaaccgccttcaaacccctcccgacgccccctctccgcctctcccgcaaccccccgaaccgcgaccaactattaaaaaaaaaataaccgaccgaccccaactaccgcctcgcctcgccgtaaaacctaaaaactaaa

SEQ ID NO: 21621 - DNA, 943 bp, Artificial Sequence
  chemically treated genomic DNA (Homo sapiens) CpG-island No: 21621
gtgcgggcgtcgaaaggaggaagagagcgttgaaaggagatttcggaattcgggtgtagagtagaagaaagtagggatttagagacgttgtacggagagcgcggttttttagggttttttagtgcggagattgagtacgatgtttcgttttagcggtttcgtttcggtcgttcggtcgtttttttcgtacgttttgttaattattacgtaggttattttgcggatagatagacggttagttcggggtcggagcggaaagtttttttgtggtcgttatagcgcggcgaacgtgcgttattgggcgtttagtatttgtttagtcggggtgtaaacgttcgggcgttagggtgcgcgttaggttttcggtttgggttagtcgcgttttttagtttttcgttcgtttaggttcgggtttcgttcgattatcggcgcgtatttatttggacggttttagtttggcgtcgcgtttgtcgtttattacggagggtatatagttggtgagttcggtttagtcggcgtgtaattcgtagttttagttcgtggagaatttggagaagagttaggtttttcgtttattcggtcggtggtaagtgtattttttttgatttacgcggtattcgtacggttgttttagttggatgttacgtattaagtggcggtcgaaagtggtgttttcggttttttggatgtgtaggaatacgattaggttatcgtttttgatgtcgaagtttattttgcgtaggaggtcgtcgcgggtgaaattgtagcggggtacgaatttggcggagtttttatttttcgagcggtacgggttcggtatcggggagttgaacgtttgtaggcggaggagttggtattttgtgtcggggtatacgtattggaggacgattacggtaaataggaagagtattattaaagttagtagtagtttgttggatttttt

SEQ ID NO: 21622 - DNA, 943 bp, Artificial Sequence
  chemically treated genomic DNA (Homo sapiens) CpG-island No: 21622
aaaaaatccaacaaactactactaactttaataatactcttcctatttaccgtaatcgtcctccaatacgtataccccgacacaaaataccaactcctccgcctacaaacgttcaactccccgataccgaacccgtaccgctcgaaaaataaaaactccgccaaattcgtaccccgctacaatttcacccgcgacgacctcctacgcaaaataaacttcgacatcaaaaacgataacctaatcgtattcctacacatccaaaaaaccgaaaacaccactttcgaccgccacttaatacgtaacatccaactaaaacaaccgtacgaataccgcgtaaatcaaaaaaaatacacttaccaccgaccgaataaacgaaaaacctaactcttctccaaattctccacgaactaaaactacgaattacacgccgactaaaccgaactcaccaactatataccctccgtaataaacgacaaacgcgacgccaaactaaaaccgtccaaataaatacgcgccgataatcgaacgaaacccgaacctaaacgaacgaaaaactaaaaaacgcgactaacccaaaccgaaaacctaacgcgcaccctaacgcccgaacgtttacaccccgactaaacaaatactaaacgcccaataacgcacgttcgccgcgctataacgaccacaaaaaaactttccgctccgaccccgaactaaccgtctatctatccgcaaaataacctacgtaataattaacaaaacgtacgaaaaaaacgaccgaacgaccgaaacgaaaccgctaaaacgaaacatcgtactcaatctccgcactaaaaaaccctaaaaaaccgcgctctccgtacaacgtctctaaatccctactttcttctactctacacccgaattccgaaatctcctttcaacgctctcttcctcctttcgacgcccgcac

SEQ ID NO: 21623 - DNA, 943 bp, Artificial Sequence
  chemically treated genomic DNA (Homo sapiens) CpG-island No: 21623
gagaaatttaataagttgttgttagttttggtgatgttttttttatttgtcgtgatcgttttttaatacgtgtgtttcggtatagaatgttagttttttcgtttgtaggcgtttagtttttcggtgtcggattcgtatcgttcggaggatgagagtttcgttaggttcgtgtttcgttataattttattcgcggcgattttttgcgtaaggtagatttcgatattaagggcgatgatttgatcgtgtttttgtatatttagaagatcgggggtattattttcggtcgttatttggtgcgtaatatttagttggagtagtcgtgcgagtgtcgcgtgggttagaagaaatgtatttgttatcggtcgggtaagcgggaaatttggtttttttttaggttttttacgggttggagttgcgggttgtacgtcgattggatcgagtttattagttgtgtgtttttcgtggtggacggtaagcgcgacgttaggttgagatcgtttaggtgagtgcgcgtcggtagtcgagcgggattcgggtttaggcgggcggagggttgggaggcgcggttggtttaagtcggggatttagcgcgtattttgacgttcgggcgtttgtatttcggttgggtaggtgttgggcgtttagtagcgtacgttcgtcgcgttgtggcggttatagaaaggtttttcgtttcggtttcggattgatcgtttgtttgttcgtagggtggtttgcgtgatggttggtagagcgtgcgggggaggcggtcgagcggtcggaacggggtcgttgggacggggtatcgtatttagttttcgtattggagagttttaaagagtcgcgtttttcgtgtagcgtttttggatttttgtttttttttattttgtattcgggtttcgaagtttttttttagcgtttttttttttttttcggcgttcgtat

SEQ ID NO: 21624 - DNA, 943 bp, Artificial Sequence
  chemically treated genomic DNA (Homo sapiens) CpG-island No: 21624
atacgaacgccgaaaaaaaaaaaaaaacgctaaaaaaaaacttcgaaacccgaatacaaaataaaaaaaaacaaaaatccaaaaacgctacacgaaaaacgcgactctttaaaactctccaatacgaaaactaaatacgataccccgtcccaacgaccccgttccgaccgctcgaccgcctcccccgcacgctctaccaaccatcacgcaaaccaccctacgaacaaacaaacgatcaatccgaaaccgaaacgaaaaacctttctataaccgccacaacgcgacgaacgtacgctactaaacgcccaacacctacccaaccgaaatacaaacgcccgaacgtcaaaatacgcgctaaatccccgacttaaaccaaccgcgcctcccaaccctccgcccgcctaaacccgaatcccgctcgactaccgacgcgcactcacctaaacgatctcaacctaacgtcgcgcttaccgtccaccacgaaaaacacacaactaataaactcgatccaatcgacgtacaacccgcaactccaacccgtaaaaaacctaaaaaaaaaccaaatttcccgcttacccgaccgataacaaatacatttcttctaacccacgcgacactcgcacgactactccaactaaatattacgcaccaaataacgaccgaaaataatacccccgatcttctaaatatacaaaaacacgatcaaatcatcgcccttaatatcgaaatctaccttacgcaaaaaatcgccgcgaataaaattataacgaaacacgaacctaacgaaactctcatcctccgaacgatacgaatccgacaccgaaaaactaaacgcctacaaacgaaaaaactaacattctataccgaaacacacgtattaaaaaacgatcacgacaaataaaaaaaacatcaccaaaactaacaacaacttattaaatttctc

SEQ ID NO: 21625 - DNA, 982 bp, Artificial Sequence
  chemically treated genomic DNA (Homo sapiens) CpG-island No: 21625
ttcgcgtgtttcgttttattttcggtggttttcgtttttatttttatttcgtttcgttcgtcggatttttcgggtttttttgtttttattttttttggagcgtatatttttgttcgggttttttttcgtatgtttcgaaattttttttttgtcggcgttcgcgttcgtttggttattcggtatgcggtttttaaggaagttcggaattcggggtttatattattttggggatatagtcggcggtatttaatttgttatcggagaatttgttttgtcggttgtcgcggaatatttataacggattcgcggcgttggtaaattgcgtcgtattttttcggaaattttagttcgggttattaatggtagttgaaatttacgtttttttttatttcgcgggtgtttttttttttcgtaatagtattttgcgtttgtttggaggcgcgattcggtttttatttagaacgtatttggttatggggtcgaaattttttggagaagatcgtacggagtacgtggtttagcgagtggtttagggcggttaggtttcgagtgagtagggttcggtagagggagtttagttttagcgtcgtttgagaacgtgtattcgtttgcggcgttttcgggatagtagcgcgaaaagcggggcgtacgcggttttcgttagggaagaagacgtttttcggggtttgtttaggagcggtcgggtgtggaattcgtgagatatatttttaggagggttcgcgcgaattgaggcggcgatcgattcgggtcggttcgttgttaattcggtttttattttggaatgtcggcggggataggtggtgcggacgggcgtttttcgtttcggttgtcgcggcggttcgaattttcggattgtatacgtaggtagtgttatttttttttttaggtaatttagggtattaaggattacgagcgagtttgaatttatataataatgttttacgtttaagagttcgagtta

SEQ ID NO: 21626 - DNA, 982 bp, Artificial Sequence
  chemically treated genomic DNA (Homo sapiens) CpG-island No: 21626
taactcgaactcttaaacgtaaaacattattatataaattcaaactcgctcgtaatccttaataccctaaattacctaaaaaaaaaaataacactacctacgtatacaatccgaaaattcgaaccgccgcgacaaccgaaacgaaaaacgcccgtccgcaccacctatccccgccgacattccaaaataaaaaccgaattaacaacgaaccgacccgaatcgatcgccgcctcaattcgcgcgaaccctcctaaaaatatatctcacgaattccacacccgaccgctcctaaacaaaccccgaaaaacgtcttcttccctaacgaaaaccgcgtacgccccgcttttcgcgctactatcccgaaaacgccgcaaacgaatacacgttctcaaacgacgctaaaactaaactccctctaccgaaccctactcactcgaaacctaaccgccctaaaccactcgctaaaccacgtactccgtacgatcttctccaaaaaatttcgaccccataaccaaatacgttctaaataaaaaccgaatcgcgcctccaaacaaacgcaaaatactattacgaaaaaaaaaaacacccgcgaaataaaaaaaaacgtaaatttcaactaccattaataacccgaactaaaatttccgaaaaaatacgacgcaatttaccaacgccgcgaatccgttataaatattccgcgacaaccgacaaaacaaattctccgataacaaattaaataccgccgactatatccccaaaataatataaaccccgaattccgaacttccttaaaaaccgcataccgaataaccaaacgaacgcgaacgccgacaaaaaaaaaatttcgaaacatacgaaaaaaaacccgaacaaaaatatacgctccaaaaaaaataaaaacaaaaaaacccgaaaaatccgacgaacgaaacgaaataaaaataaaaacgaaaaccaccgaaaataaaacgaaacacgcgaa

SEQ ID NO: 21627 - DNA, 982 bp, Artificial Sequence
  chemically treated genomic DNA (Homo sapiens) CpG-island No: 21627
tggttcgagtttttaggcgtgaggtattattatataaatttaagttcgttcgtgatttttagtattttgagttgtttgaaggggggaatggtattgtttgcgtgtgtagttcgggagttcgagtcgtcgcggtaatcggagcgaggagcgttcgttcgtattatttgttttcgtcggtattttagagtagaggtcgaattggtagcgagtcggttcgggtcggtcgtcgttttagttcgcgcgggtttttttaggggtgtgttttacggattttatattcggtcgtttttggataagtttcgaaaggcgtttttttttttggcgggagtcgcgtgcgtttcgtttttcgcgttgttgtttcgggggcgtcgtaggcggatgtacgtttttaggcgacgttgggattgggttttttttgtcgggttttgtttattcggggtttggtcgttttgggttattcgttgaattacgtgtttcgtgcgattttttttaaagaatttcggttttatggttaggtacgttttaggtgaaaatcgggtcgcgtttttaggtaggcgtaaggtgttgttacggggagggaaggtattcgcggggtagagaagggcgtaagttttagttgttattggtggttcgggttagggttttcggaagggtgcggcgtaatttgttaacgtcgcggattcgttgtaaatgtttcgcggtaatcggtagggtaggtttttcgatagtaagttgggtgtcgtcggttatatttttagggtaatatgagtttcgggtttcgagtttttttggaggtcgtatatcggatgattaagcgggcgcgggcgtcggtaaaaggagggtttcggggtatgcggggagaaattcggatagaggtgtgcgttttaaagaggataggggtagaagagttcggagagttcggcggacgaagcgggatggggatgggagcgggagttatcgagagtggagcgagatacgcggg

SEQ ID NO: 21628 - DNA, 982 bp, Artificial Sequence
  chemically treated genomic DNA (Homo sapiens) CpG-island No: 21628
cccgcgtatctcgctccactctcgataactcccgctcccatccccatcccgcttcgtccgccgaactctccgaactcttctacccctatcctctttaaaacgcacacctctatccgaatttctccccgcataccccgaaaccctccttttaccgacgcccgcgcccgcttaatcatccgatatacgacctccaaaaaaactcgaaacccgaaactcatattaccctaaaaatataaccgacgacacccaacttactatcgaaaaacctaccctaccgattaccgcgaaacatttacaacgaatccgcgacgttaacaaattacgccgcacccttccgaaaaccctaacccgaaccaccaataacaactaaaacttacgcccttctctaccccgcgaataccttccctccccgtaacaacaccttacgcctacctaaaaacgcgacccgattttcacctaaaacgtacctaaccataaaaccgaaattctttaaaaaaaatcgcacgaaacacgtaattcaacgaataacccaaaacgaccaaaccccgaataaacaaaacccgacaaaaaaaacccaatcccaacgtcgcctaaaaacgtacatccgcctacgacgcccccgaaacaacaacgcgaaaaacgaaacgcacgcgactcccgccaaaaaaaaaaacgcctttcgaaacttatccaaaaacgaccgaatataaaatccgtaaaacacacccctaaaaaaacccgcgcgaactaaaacgacgaccgacccgaaccgactcgctaccaattcgacctctactctaaaataccgacgaaaacaaataatacgaacgaacgctcctcgctccgattaccgcgacgactcgaactcccgaactacacacgcaaacaataccattccccccttcaaacaactcaaaatactaaaaatcacgaacgaacttaaatttatataataatacctcacgcctaaaaactcgaacca

SEQ ID NO: 21629 - DNA, 912 bp, Artificial Sequence
  chemically treated genomic DNA (Homo sapiens) CpG-island No: 21629
ggacgttttgaggttgtatttacgtggtaatggtgtttgtcgcgttgtcgtttggattcggtattattagcggagtcgagtagagtttagggttttaacgcgtagggaaaaggttgcgtcgttttcggggtggttttacgttttttttttgagtttgagcggcggcgcgggacggggacggttttggtcgggattagtaggtttcgggtattcgggacgtcggggtcgcgttttaggttaggggcgggggcgggatcggggcgggggtcggcggcggggtcgcgttttcggttttttttcggggcgatcgggcggttttatacgcgttgcgttcgtcgtcggttttacgcgcggtttatgtttttcgcgtcgcgttcgtttatttcgcggtttcgtaggatgaagaaggacgagtcgtttttgggtaagttgggcggtattttggttaggaagcggagggcgcgcgagggtgagtgcgcgttcgcgttcgtcgattttcggggatttgttcggcggtgttcgttttcggttttagagttttacgaggtcgttttcgtttttttttacgtatttcgttcggtttacgcggttgcgcgattttcgggataggttaggtttttgatttaggattcgtaaataacggtcgggatttggcgcgtggggtcgcggtggttttcggagtttgttaaacgcgcgtgcgggcgtttgcgcggcggggatttcgggttatcgtgcggggttcgcgtttgttttgtttgtcgggtgtttagtttttttttgggttagcggtatagttagtcgcgcggggtgatcgtttattttatgagtagtgacgtttacgtgtgtagggtattttgggtagatacggtttgggggatttattattgggtgttgcgcgggcgttttgtaggg

SEQ ID NO: 21630 - DNA, 912 bp, Artificial Sequence
  chemically treated genomic DNA (Homo sapiens) CpG-island No: 21630
ccctacaaaacgcccgcgcaacacccaataataaatcccccaaaccgtatctacccaaaataccctacacacgtaaacgtcactactcataaaataaacgatcaccccgcgcgactaactataccgctaacccaaaaaaaaactaaacacccgacaaacaaaacaaacgcgaaccccgcacgataacccgaaatccccgccgcgcaaacgcccgcacgcgcgtttaacaaactccgaaaaccaccgcgaccccacgcgccaaatcccgaccgttatttacgaatcctaaatcaaaaacctaacctatcccgaaaatcgcgcaaccgcgtaaaccgaacgaaatacgtaaaaaaaaacgaaaacgacctcgtaaaactctaaaaccgaaaacgaacaccgccgaacaaatccccgaaaatcgacgaacgcgaacgcgcactcaccctcgcgcgccctccgcttcctaaccaaaataccgcccaacttacccaaaaacgactcgtccttcttcatcctacgaaaccgcgaaataaacgaacgcgacgcgaaaaacataaaccgcgcgtaaaaccgacgacgaacgcaacgcgtataaaaccgcccgatcgccccgaaaaaaaaccgaaaacgcgaccccgccgccgacccccgccccgatcccgcccccgcccctaacctaaaacgcgaccccgacgtcccgaatacccgaaacctactaatcccgaccaaaaccgtccccgtcccgcgccgccgctcaaactcaaaaaaaaaacgtaaaaccaccccgaaaacgacgcaaccttttccctacgcgttaaaaccctaaactctactcgactccgctaataataccgaatccaaacgacaacgcgacaaacaccattaccacgtaaatacaacctcaaaacgtcc

SEQ ID NO: 21631 - DNA, 912 bp, Artificial Sequence
  chemically treated genomic DNA (Homo sapiens) CpG-island No: 21631
ttttgtagggcgttcgcgtaatatttagtagtgggttttttaggtcgtgtttgtttagagtgttttgtatacgtgagcgttattgtttatggaatgaacggttatttcgcgcggttggttatgtcgttggtttagggaagagttgaatattcggtaggtagagtaggcgcgggtttcgtacggtggttcgaggttttcgtcgcgtaggcgttcgtacgcgcgtttggtagatttcggaggttatcgcggttttacgcgttaggtttcggtcgttgtttacgggttttgggttaaaggtttggtttgtttcgaaggtcgcgtagtcgcgtgggtcgggcggggtgcgtgggggagggcgggggcggtttcgtggggttttagggtcgagggcgggtatcgtcgggtaggttttcgggggtcggcgggcgcgggcgcgtatttattttcgcgcgtttttcgttttttggttagggtgtcgtttagtttgtttaggaacgattcgtttttttttattttgcggggtcgcggggtgggcgagcgcggcgcggaggatatgggtcgcgcgtggggtcggcggcgggcgtagcgcgtgtggagtcgttcggtcgtttcggggagaggtcgagggcgcggtttcgtcgtcggttttcgtttcggtttcgttttcgtttttggtttggagcgcggtttcggcgtttcggatgttcgaggtttgttggtttcggttagagtcgttttcgtttcgcgtcgtcgtttaagtttagagaaggggcgtggggttatttcgggagcggcgtagttttttttttacgcgttggagttttgggttttgttcggtttcgttagtggtgtcggatttaggcgatagcgcgatagatattattgttacgtgggtgtagttttaggacgttt

SEQ ID NO: 21632 - DNA, 912 bp, Artificial Sequence
  chemically treated genomic DNA (Homo sapiens) CpG-island No: 21632
aaacgtcctaaaactacacccacgtaacaataatatctatcgcgctatcgcctaaatccgacaccactaacgaaaccgaacaaaacccaaaactccaacgcgtaaaaaaaaaactacgccgctcccgaaataaccccacgccccttctctaaacttaaacgacgacgcgaaacgaaaacgactctaaccgaaaccaacaaacctcgaacatccgaaacgccgaaaccgcgctccaaaccaaaaacgaaaacgaaaccgaaacgaaaaccgacgacgaaaccgcgccctcgacctctccccgaaacgaccgaacgactccacacgcgctacgcccgccgccgaccccacgcgcgacccatatcctccgcgccgcgctcgcccaccccgcgaccccgcaaaataaaaaaaaacgaatcgttcctaaacaaactaaacgacaccctaaccaaaaaacgaaaaacgcgcgaaaataaatacgcgcccgcgcccgccgacccccgaaaacctacccgacgatacccgccctcgaccctaaaaccccacgaaaccgcccccgccctcccccacgcaccccgcccgacccacgcgactacgcgaccttcgaaacaaaccaaacctttaacccaaaacccgtaaacaacgaccgaaacctaacgcgtaaaaccgcgataacctccgaaatctaccaaacgcgcgtacgaacgcctacgcgacgaaaacctcgaaccaccgtacgaaacccgcgcctactctacctaccgaatattcaactcttccctaaaccaacgacataaccaaccgcgcgaaataaccgttcattccataaacaataacgctcacgtatacaaaacactctaaacaaacacgacctaaaaaacccactactaaatattacgcgaacgccctacaaaa

SEQ ID NO: 21633 - DNA, 611 bp, Artificial Sequence
  chemically treated genomic DNA (Homo sapiens) CpG-island No: 21633
gtcgggcggatttaagatcgcggttacgtttagtaggacgcggattgagggagtcggggttgcgtcgttattttcgtgacgttattatgtcggttagtgataaatatttttttttcgtcgttttaggagtcgtcggtattgcgcgagtgggagggttgggtttttcgtgtattttttaaattttcgcgaggtttcgggcggtttttttttcgagggcggtacgagggttgggcggtggggtgcgggtgttcgggtgaggggcggagttgggggtatggcgttcggagcggttcgttggttagtattggtattcgttaggttcggggtttttcggagcgggtttagtttgaggaaagatggcgatgttttcgtcgtatggagcggtttaggtcggagtttggtatcgtcgaggttagttatcgttattcgtagcggcgttattttgtttaaatcggtgaaagtgagtgtttttttggagacggggcgaaggggttgaggttaattattgtggggagtgcgtgagggcggcgttgattgataggagttaaggttaattataacgattatcgtagattggaaggcggattaagaatacgttaatgagttgttaa

SEQ ID NO: 21634 - DNA, 611 bp, Artificial Sequence
  chemically treated genomic DNA (Homo sapiens) CpG-island No: 21634
ttaacaactcattaacgtattcttaatccgccttccaatctacgataatcgttataattaaccttaactcctatcaatcaacgccgccctcacgcactccccacaataattaacctcaaccccttcgccccgtctccaaaaaaacactcactttcaccgatttaaacaaaataacgccgctacgaataacgataactaacctcgacgataccaaactccgacctaaaccgctccatacgacgaaaacatcgccatctttcctcaaactaaacccgctccgaaaaaccccgaacctaacgaataccaatactaaccaacgaaccgctccgaacgccatacccccaactccgcccctcacccgaacacccgcaccccaccgcccaaccctcgtaccgccctcgaaaaaaaaaccgcccgaaacctcgcgaaaatttaaaaaatacacgaaaaacccaaccctcccactcgcgcaataccgacgactcctaaaacgacgaaaaaaaaatatttatcactaaccgacataataacgtcacgaaaataacgacgcaaccccgactccctcaatccgcgtcctactaaacgtaaccgcgatcttaaatccgcccgac

SEQ ID NO: 21635 - DNA, 611 bp, Artificial Sequence
  chemically treated genomic DNA (Homo sapiens) CpG-island No: 21635
ttagtaatttattagcgtatttttggttcgttttttagtttacggtaatcgttatgattggttttggtttttattaattagcgtcgtttttacgtattttttataatgattggttttagttttttcgtttcgtttttaggaggatatttatttttatcggtttgggtaaaatggcgtcgttgcgggtaacgatgattgatttcgacggtattaggtttcggtttgagtcgttttatgcggcggagatatcgttatttttttttaagttaggttcgtttcggagagtttcggatttgacgggtgttaatattagttagcgagtcgtttcggacgttatgtttttagtttcgttttttattcgggtattcgtattttatcgtttagttttcgtgtcgttttcgggaagaaagtcgttcgaagtttcgcgagagtttgaggagtatacgagaagtttagtttttttattcgcgtagtgtcggcggtttttggggcggcgggagggaggtgtttgttattggtcggtatggtggcgttacgagagtggcggcgtagtttcggtttttttagttcgcgttttgttgggcgtggtcgcggttttgggttcgttcggt

SEQ ID NO: 21636 - DNA, 611 bp, Artificial Sequence
  chemically treated genomic DNA (Homo sapiens) CpG-island No: 21636
accgaacgaacccaaaaccgcgaccacgcccaacaaaacgcgaactaaaaaaaccgaaactacgccgccactctcgtaacgccaccataccgaccaataacaaacacctccctcccgccgccccaaaaaccgccgacactacgcgaataaaaaaactaaacttctcgtatactcctcaaactctcgcgaaacttcgaacgactttcttcccgaaaacgacacgaaaactaaacgataaaatacgaatacccgaataaaaaacgaaactaaaaacataacgtccgaaacgactcgctaactaatattaacacccgtcaaatccgaaactctccgaaacgaacctaacttaaaaaaaaataacgatatctccgccgcataaaacgactcaaaccgaaacctaataccgtcgaaatcaatcatcgttacccgcaacgacgccattttacccaaaccgataaaaataaatatcctcctaaaaacgaaacgaaaaaactaaaaccaatcattataaaaaatacgtaaaaacgacgctaattaataaaaaccaaaaccaatcataacgattaccgtaaactaaaaaacgaaccaaaaatacgctaataaattactaa

SEQ ID NO: 21637 - DNA, 1007 bp, Artificial Sequence
  chemically treated genomic DNA (Homo sapiens) CpG-island No: 21637
cgttggatttttcgcgttcgcgggtttgttttttttgacggatgagcgagttggcgatagtcgtcgttatggttacgacgtttattattatcgttttttttgttgtttttttttgggttcgtttttttttttttttttttcgttgtttgttcgttgtttcgcgatttcgtcgttttggtttttttagtttgcgtttgttcgggttttttcgtattcgggttttagttaaggagggggtttagtatgtcgttcgagttttttcggcggcggttcggttttcgcgcgggttgttggttgtttgggtcggagtcgacgttatagtttcgggttcgggatcgcgggcgagattggtacgcggatgttgaattgcgcgattgcgtgtggtcggtttttgcgttcggcggatatcgtgtatgtttagttgtttcggttcgaatttcgtcggattttttcgttttgttgtttttttgatgggggttagaggagggaggcgggcggagggagtgagcgcgggcgggagagaggtcgggagttcgggcggtcggacggaggagggacgaggtagcgcgcgggggagcgcgttttcgttttggttttttcgagttttcgattagtttttgtaattttttggcgtgataatcgggaaaagttggttcgtgttaggttttcgatagggattaaataggtaatggtttcgtattttcgttgttgttgttgttttgggcgcggtatagtcgtagtataggaatttagtcgtcgtaggtatttttcggaatagcgcgatagtttttttgtagttttttttcgcgacggtttttttttttcggggttgagttcgtaggttcggagtcgtaggtcgttttttttatttttatttttatttttatttttttaagttttcggtcgttcgtttcggttaatatttgtaggggttttcgtattgttttagtcgtttaaattttttttttttttttttttcgaaaggagtttcgggaggaaatagtgat

SEQ ID NO: 21638 - DNA, 1007 bp, Artificial Sequence
  chemically treated genomic DNA (Homo sapiens) CpG-island No: 21638
atcactatttcctcccgaaactcctttcgaaaaaaaaaaaaaaaaaaaatttaaacgactaaaacaatacgaaaacccctacaaatattaaccgaaacgaacgaccgaaaacttaaaaaaataaaaataaaaataaaaataaaaaaaacgacctacgactccgaacctacgaactcaaccccgaaaaaaaaaaaccgtcgcgaaaaaaaactacaaaaaaactatcgcgctattccgaaaaatacctacgacgactaaattcctatactacgactataccgcgcccaaaacaacaacaacaacgaaaatacgaaaccattacctatttaatccctatcgaaaacctaacacgaaccaacttttcccgattatcacgccaaaaaattacaaaaactaatcgaaaactcgaaaaaaccaaaacgaaaacgcgctcccccgcgcgctacctcgtccctcctccgtccgaccgcccgaactcccgacctctctcccgcccgcgctcactccctccgcccgcctccctcctctaacccccatcaaaaaaacaacaaaacgaaaaaatccgacgaaattcgaaccgaaacaactaaacatacacgatatccgccgaacgcaaaaaccgaccacacgcaatcgcgcaattcaacatccgcgtaccaatctcgcccgcgatcccgaacccgaaactataacgtcgactccgacccaaacaaccaacaacccgcgcgaaaaccgaaccgccgccgaaaaaactcgaacgacatactaaaccccctccttaactaaaacccgaatacgaaaaaacccgaacaaacgcaaactaaaaaaaccaaaacgacgaaatcgcgaaacaacgaacaaacaacgaaaaaaaaaaaaaaaaaaacgaacccaaaaaaaaacaacaaaaaaaacgataataataaacgtcgtaaccataacgacgactatcgccaactcgctcatccgtcaaaaaaaacaaacccgcgaacgcgaaaaatccaacg

SEQ ID NO: 21639 - DNA, 1007 bp, Artificial Sequence
  chemically treated genomic DNA (Homo sapiens) CpG-island No: 21639
attattgttttttttcgaagtttttttcgggaaaaggaggggagaaggatttggacgattggggtagtgcggaagtttttataggtgttagtcggaacgggcggtcggggatttgggggggtgggggtgggggtgggggtgggaggggcggtttgcggtttcgagtttacgggtttagtttcgggagggaggggtcgtcgcgggagggggttgtaaggaggttgtcgcgttgtttcggagggtgtttgcggcggttgaatttttgtgttgcgattgtgtcgcgtttagagtagtagtaatagcgaagatgcgaggttattatttgtttgatttttgtcggaaatttggtacgggttaatttttttcgattattacgttaagaagttgtaaggattagtcgaagattcggaggggttagggcgagggcgcgttttttcgcgcgttgtttcgtttttttttcgttcggtcgttcgagttttcggtttttttttcgttcgcgtttatttttttcgttcgttttttttttttggtttttattagaagggtaatagggcgagggggttcggcgaaattcggatcggagtagttggatatgtacggtgttcgtcgggcgtaggggtcgattatacgtagtcgcgtagtttagtattcgcgtgttagtttcgttcgcgatttcgggttcggggttgtggcgtcgatttcgatttaggtagttagtagttcgcgcgggagtcggatcgtcgtcggaggagttcggacggtatgttgagttttttttttggttgaagttcgagtgcggagaagttcgggtaaacgtaggttaaggagattaaagcggcgaagtcgcgagatagcggataagtagcggaggagaaggaggaggaggcgaatttagagaggggtagtaaaagaagcggtggtggtgggcgtcgtggttatggcggcggttatcgttagttcgtttattcgttagaagaggtaagttcgcgagcgcgagaaatttaacg

SEQ ID NO: 21640 - DNA, 1007 bp, Artificial Sequence
  chemically treated genomic DNA (Homo sapiens) CpG-island No: 21640
cgttaaatttctcgcgctcgcgaacttacctcttctaacgaataaacgaactaacgataaccgccgccataaccacgacgcccaccaccaccgcttcttttactacccctctctaaattcgcctcctcctccttctcctccgctacttatccgctatctcgcgacttcgccgctttaatctccttaacctacgtttacccgaacttctccgcactcgaacttcaaccaaaaaaaaaactcaacataccgtccgaactcctccgacgacgatccgactcccgcgcgaactactaactacctaaatcgaaatcgacgccacaaccccgaacccgaaatcgcgaacgaaactaacacgcgaatactaaactacgcgactacgtataatcgacccctacgcccgacgaacaccgtacatatccaactactccgatccgaatttcgccgaaccccctcgccctattacccttctaataaaaaccaaaaaaaaaaaacgaacgaaaaaaataaacgcgaacgaaaaaaaaaccgaaaactcgaacgaccgaacgaaaaaaaaacgaaacaacgcgcgaaaaaacgcgccctcgccctaacccctccgaatcttcgactaatccttacaacttcttaacgtaataatcgaaaaaaattaacccgtaccaaatttccgacaaaaatcaaacaaataataacctcgcatcttcgctattactactactctaaacgcgacacaatcgcaacacaaaaattcaaccgccgcaaacaccctccgaaacaacgcgacaacctccttacaaccccctcccgcgacgacccctccctcccgaaactaaacccgtaaactcgaaaccgcaaaccgcccctcccacccccacccccacccccacccccccaaatccccgaccgcccgttccgactaacacctataaaaacttccgcactaccccaatcgtccaaatccttctcccctccttttcccgaaaaaaacttcgaaaaaaaacaataat

SEQ ID NO: 21641 - DNA, 930 bp, Artificial Sequence
  chemically treated genomic DNA (Homo sapiens) CpG-island No: 21641
ttacgtgcgcggaaaatgaattcgtattcgcgacgcggtcggcgggggcggatggtagcgagggtcggatagcgaatttttatttcgcggaggagtcggggtcggagttcgtacgtgggtttgcgacggtttcgttttttgggggcgtttttttagggattttagtttcggttggtgggttttgtaggttcgggttcgatcgcgttcgttaggtcgttcggaggtttcggcgagttcggcggaggcggcggttttttttcgttcgacggttacgttcgcgcggattggtcgtttttcgacggcggggcggggcgggacgggtcggggtagagttcgcggttaggtgaggcgtttcgtttttcggcggttttaggtgcggttgtgggatttcggatcgcggcggggtcggggttagggtcggggtcggggtcggggcgttatggtcgagttttagttgaattgtttggacgaggcgtacgtgaacgagaaggtgatcgaggcgtaggtcgttttttattattgcgagcggcggcgggtcgcgttggaggcgttgttgggcggcggcgagtaggtttatcgcgagcggtttaaggaggagtagttgcgggattttttttttagttcggagcgttaggttttgcgggtcgtttggagtttttacgaggacgtcgttttcgtcgttaacgttcggggtaagagtaaggttaaggttaaggttttcgcgtcggcgtcggttgagttcggcgagtttttggtttattggttcgatcgtttcgatatcgaggtgttttttttggatttgggttggacggatattggtttttatcgcggcgtgagtcgggttacgttttttatttattcgtttaaggacgagaaggcgtcgtattttaagtaggtggttaggtagatgatttaataggtttagaaggt

SEQ ID NO: 21642 - DNA, 930 bp, Artificial Sequence
  chemically treated genomic DNA (Homo sapiens) CpG-island No: 21642
accttctaaacctattaaatcatctacctaaccacctacttaaaatacgacgccttctcgtccttaaacgaataaataaaaaacgtaacccgactcacgccgcgataaaaaccaatatccgtccaacccaaatccaaaaaaaacacctcgatatcgaaacgatcgaaccaataaaccaaaaactcgccgaactcaaccgacgccgacgcgaaaaccttaaccttaaccttactcttaccccgaacgttaacgacgaaaacgacgtcctcgtaaaaactccaaacgacccgcaaaacctaacgctccgaactaaaaaaaaaatcccgcaactactcctccttaaaccgctcgcgataaacctactcgccgccgcccaacaacgcctccaacgcgacccgccgccgctcgcaataataaaaaacgacctacgcctcgatcaccttctcgttcacgtacgcctcgtccaaacaattcaactaaaactcgaccataacgccccgaccccgaccccgaccctaaccccgaccccgccgcgatccgaaatcccacaaccgcacctaaaaccgccgaaaaacgaaacgcctcacctaaccgcgaactctaccccgacccgtcccgccccgccccgccgtcgaaaaacgaccaatccgcgcgaacgtaaccgtcgaacgaaaaaaaaccgccgcctccgccgaactcgccgaaacctccgaacgacctaacgaacgcgatcgaacccgaacctacaaaacccaccaaccgaaactaaaatccctaaaaaaacgcccccaaaaaacgaaaccgtcgcaaacccacgtacgaactccgaccccgactcctccgcgaaataaaaattcgctatccgaccctcgctaccatccgcccccgccgaccgcgtcgcgaatacgaattcattttccgcgcacgtaa

SEQ ID NO: 21643 - DNA, 930 bp, Artificial Sequence
  chemically treated genomic DNA (Homo sapiens) CpG-island No: 21643
attttttgggtttgttggattatttgtttgattatttgtttgaggtgcggcgttttttcgtttttgggcgggtgggtgaagagcgtgattcggtttacgtcgcggtagaaattagtgttcgtttagtttaggtttagaggaggtatttcggtgtcggaacggtcgggttagtaggttagggattcgtcggatttagtcggcgtcggcgcgggggttttggttttggttttgtttttgtttcgggcgttggcggcggggacggcgttttcgtaggggttttaggcggttcgtagggtttggcgtttcgggttggagaggaagtttcgtagttgtttttttttgagtcgttcgcggtaggtttgttcgtcgtcgtttagtagcgtttttagcgcggttcgtcgtcgttcgtagtagtagaaggcggtttgcgtttcggttattttttcgtttacgtgcgtttcgtttaggtagtttagttgggattcggttatggcgtttcggtttcggtttcggttttggtttcggtttcgtcgcggttcgaggttttatagtcgtatttggagtcgtcgaggggcggggcgttttatttggtcgcgagttttgtttcggttcgtttcgtttcgtttcgtcgtcggggagcggttaattcgcgcgggcgtggtcgtcgggcggggaggggtcgtcgttttcgtcgggttcgtcgggattttcgggcggtttggcggacgcggtcgggttcgggtttgtagggtttattagtcggggttagagtttttgaggggacgtttttagggggcggggtcgtcgtagatttacgtgcgggtttcggtttcgattttttcgcggggtaaaggttcgttgttcggttttcgttgttattcgttttcgtcggtcgcgtcgcgggtacgagtttatttttcgcgtacgtgg

SEQ ID NO: 21644 - DNA, 930 bp, Artificial Sequence
  chemically treated genomic DNA (Homo sapiens) CpG-island No: 21644
ccacgtacgcgaaaaataaactcgtacccgcgacgcgaccgacgaaaacgaataacaacgaaaaccgaacaacgaacctttaccccgcgaaaaaatcgaaaccgaaacccgcacgtaaatctacgacgaccccgccccctaaaaacgtcccctcaaaaactctaaccccgactaataaaccctacaaacccgaacccgaccgcgtccgccaaaccgcccgaaaatcccgacgaacccgacgaaaacgacgacccctccccgcccgacgaccacgcccgcgcgaattaaccgctccccgacgacgaaacgaaacgaaacgaaccgaaacaaaactcgcgaccaaataaaacgccccgcccctcgacgactccaaatacgactataaaacctcgaaccgcgacgaaaccgaaaccaaaaccgaaaccgaaaccgaaacgccataaccgaatcccaactaaactacctaaacgaaacgcacgtaaacgaaaaaataaccgaaacgcaaaccgccttctactactacgaacgacgacgaaccgcgctaaaaacgctactaaacgacgacgaacaaacctaccgcgaacgactcaaaaaaaaacaactacgaaacttcctctccaacccgaaacgccaaaccctacgaaccgcctaaaacccctacgaaaacgccgtccccgccgccaacgcccgaaacaaaaacaaaaccaaaaccaaaacccccgcgccgacgccgactaaatccgacgaatccctaacctactaacccgaccgttccgacaccgaaatacctcctctaaacctaaactaaacgaacactaatttctaccgcgacgtaaaccgaatcacgctcttcacccacccgcccaaaaacgaaaaaacgccgcacctcaaacaaataatcaaacaaataatccaacaaacccaaaaaat

SEQ ID NO: 21645 - DNA, 673 bp, Artificial Sequence
  chemically treated genomic DNA (Homo sapiens) CpG-island No: 21645
tcggaggagagtcgaggtgtaaggggatagggagaagggaagagatgggttagtagtaaatttacggatgaaagggaaatgggtttagttcgtgcgttcgagttgttgacgtcgtgtcgtttttcgcgtttgtttgtcgtagttttcgttcgtcggttcgtcggttagtcggttcgttttttttttttgttagtagtagtttcggggtcggaggttgtgcggcgaggtcgttttttcgtttcgttgattggtcgcgtcgttcggttcgttacgtttttttgttttagtcgttagagattgaaagtaatcgcggttgttcggagggtcgaattggagggtgggcgtagttttggttgttttgggaatcgtgttgtttcgattcggttatttttcgttgggcggtcgtgcgtattcgttaggtcgggtagtttcgggtcgtttagcggtcgaggaggcggtagagatttcgtttttttgtagagttacggggatcggaaggcgaaatagagttgtggacgcgggagtatatgttgtttattagtggagtataagtaaagaaagaacgcgcgattgttcggcgcggagaggggtgggggaagtttcgttaggattgggcggcgttcggtttggagaattagtaattgcgaggtaggggatggagtatttttttggt

SEQ ID NO: 21646 - DNA, 673 bp, Artificial Sequence
  chemically treated genomic DNA (Homo sapiens) CpG-island No: 21646
accaaaaaaatactccatcccctacctcgcaattactaattctccaaaccgaacgccgcccaatcctaacgaaacttcccccacccctctccgcgccgaacaatcgcgcgttctttctttacttatactccactaataaacaacatatactcccgcgtccacaactctatttcgccttccgatccccgtaactctacaaaaaaacgaaatctctaccgcctcctcgaccgctaaacgacccgaaactacccgacctaacgaatacgcacgaccgcccaacgaaaaataaccgaatcgaaacaacacgattcccaaaacaaccaaaactacgcccaccctccaattcgaccctccgaacaaccgcgattactttcaatctctaacgactaaaacaaaaaaacgtaacgaaccgaacgacgcgaccaatcaacgaaacgaaaaaacgacctcgccgcacaacctccgaccccgaaactactactaacaaaaaaaaaaaacgaaccgactaaccgacgaaccgacgaacgaaaactacgacaaacaaacgcgaaaaacgacacgacgtcaacaactcgaacgcacgaactaaacccatttccctttcatccgtaaatttactactaacccatctcttcccttctccctatccccttacacctcgactctcctccga

SEQ ID NO: 21647 - DNA, 673 bp, Artificial Sequence
  chemically treated genomic DNA (Homo sapiens) CpG-island No: 21647
gttaagggagtgttttattttttgtttcgtagttattgattttttaagtcgggcgtcgtttagttttggcggggttttttttattttttttcgcgtcgggtaatcgcgcgttttttttttatttgtgttttattggtgggtagtatgtgttttcgcgtttatagttttgtttcgtttttcggttttcgtagttttgtaggggaacgggatttttgtcgttttttcggtcgttaagcgattcggggttgttcgatttagcgagtgcgtacgatcgtttagcgaggggtagtcgagtcgaggtagtacggtttttaaggtagttaaggttgcgtttattttttagttcggtttttcgggtagtcgcggttgtttttagtttttggcgattgagataaaagagcgtgacgggtcgggcgacgcggttaattagcggggcgagggggcggtttcgtcgtatagttttcggtttcgaagttattgttagtaagaagggggagcgggtcggttggtcggcgggtcggcgggcgggggttgcggtagataggcgcgggaggcggtacggcgttagtagttcggacgtacggattgggtttattttttttttattcgtgagtttgttgttaatttatttttttttttttttttatttttttatatttcggttttttttcgg

SEQ ID NO: 21648 - DNA, 673 bp, Artificial Sequence
  chemically treated genomic DNA (Homo sapiens) CpG-island No: 21648
ccgaaaaaaaaccgaaatataaaaaaataaaaaaaaaaaaaaaaataaattaacaacaaactcacgaataaaaaaaaaataaacccaatccgtacgtccgaactactaacgccgtaccgcctcccgcgcctatctaccgcaacccccgcccgccgacccgccgaccaaccgacccgctcccccttcttactaacaataacttcgaaaccgaaaactatacgacgaaaccgccccctcgccccgctaattaaccgcgtcgcccgacccgtcacgctcttttatctcaatcgccaaaaactaaaaacaaccgcgactacccgaaaaaccgaactaaaaaataaacgcaaccttaactaccttaaaaaccgtactacctcgactcgactacccctcgctaaacgatcgtacgcactcgctaaatcgaacaaccccgaatcgcttaacgaccgaaaaaacgacaaaaatcccgttcccctacaaaactacgaaaaccgaaaaacgaaacaaaactataaacgcgaaaacacatactacccaccaataaaacacaaataaaaaaaaaacgcgcgattacccgacgcgaaaaaaaataaaaaaaaccccgccaaaactaaacgacgcccgacttaaaaaatcaataactacgaaacaaaaaataaaacactcccttaac

SEQ ID NO: 21649 - DNA, 503 bp, Artificial Sequence
  chemically treated genomic DNA (Homo sapiens) CpG-island No: 21649
gtcgttttcggtgtatttatcgaagagttgtttcgcgagtcgtattttcggggtaatcgaatttcgtcgggtaggtatcgagaggttttcgagtttgtttttgttcgggtaggagcgagttatatattagttggttagattttggggtcgggcgtcgcgggcggcggagttatcgttagttatatacgggataggaaaggatttttttcgtttttttttcgtcgtttattcgtatttcggcgtcgcggagtttcgttgttaattatagagttaagtttcggttgtgcggatgggttattttttggcggggggtttttagttacgtaatttttatattttttcgaagttagaggaagtgggtgacgggacggtgggggatttttatttcggtaatatcggttttttcggaaagtagttgcgattgttttttcgtttttttgttagcgtttttaggttgtattgtttgttgggatatcggaggatttaaatgttattttttttcg

SEQ ID NO: 21650 - DNA, 503 bp, Artificial Sequence
  chemically treated genomic DNA (Homo sapiens) CpG-island No: 21650
cgaaaaaaaataacatttaaatcctccgatatcccaacaaacaatacaacctaaaaacgctaacaaaaaaacgaaaaaacaatcgcaactactttccgaaaaaaccgatattaccgaaataaaaatcccccaccgtcccgtcacccacttcctctaacttcgaaaaaatataaaaattacgtaactaaaaaccccccgccaaaaaataacccatccgcacaaccgaaacttaactctataattaacaacgaaactccgcgacgccgaaatacgaataaacgacgaaaaaaaaacgaaaaaaatcctttcctatcccgtatataactaacgataactccgccgcccgcgacgcccgaccccaaaatctaaccaactaatatataactcgctcctacccgaacaaaaacaaactcgaaaacctctcgatacctacccgacgaaattcgattaccccgaaaatacgactcgcgaaacaactcttcgataaatacaccgaaaacgac

SEQ ID NO: 21651 - DNA, 503 bp, Artificial Sequence
  chemically treated genomic DNA (Homo sapiens) CpG-island No: 21651
cggagagaggtggtatttgagtttttcggtattttagtaggtagtgtagtttagagacgttgataaaggagcggaggagtagtcgtagttgtttttcgaggaagtcggtgttgtcgaggtgagagttttttatcgtttcgttatttattttttttgatttcgggaaaatgtggaagttacgtggttgagagtttttcgttaaagaatgatttattcgtatagtcggagtttggttttgtgattgatagcggggtttcgcggcgtcgggatgcgggtgggcggcggggaggagacggaggggatttttttttgtttcgtgtgtgattggcggtggtttcgtcgttcgcggcgttcggttttagggtttggttagttggtgtgtagttcgtttttgttcgggtaaaggtaggttcgggagtttttcggtgtttgttcgacggagttcggttgtttcggggatgcggttcgcgggataatttttcggtggatgtatcgaggacggt

SEQ ID NO: 21652 - DNA, 503 bp, Artificial Sequence
  chemically treated genomic DNA (Homo sapiens) CpG-island No: 21652
accgtcctcgatacatccaccgaaaaattatcccgcgaaccgcatccccgaaacaaccgaactccgtcgaacaaacaccgaaaaactcccgaacctacctttacccgaacaaaaacgaactacacaccaactaaccaaaccctaaaaccgaacgccgcgaacgacgaaaccaccgccaatcacacacgaaacaaaaaaaaatcccctccgtctcctccccgccgcccacccgcatcccgacgccgcgaaaccccgctatcaatcacaaaaccaaactccgactatacgaataaatcattctttaacgaaaaactctcaaccacgtaacttccacattttcccgaaatcaaaaaaaataaataacgaaacgataaaaaactctcacctcgacaacaccgacttcctcgaaaaacaactacgactactcctccgctcctttatcaacgtctctaaactacactacctactaaaataccgaaaaactcaaataccacctctctccg

SEQ ID NO: 21653 - DNA, 776 bp, Artificial Sequence
  chemically treated genomic DNA (Homo sapiens) CpG-island No: 21653
tgtcgaagggggcggggttttcgttgatgggttggttttcgttagggatataggtagaagttggttggggagtgtgcgtgttagtttgacgcgatatagtgcgtatatgcgtgatgacgtagagggcgttgattgggatcgagtatagggttcgcgtatgcgtggattgtcgttttttgtttaagttggtcgtttttttgcgttaaaggtaagcgggtcgttatttatttgtgttgttcgttagttaggtttggtttcgtttcgtttcgttcggtcggtttcgcgcgtttttatagttttgttagagggttagcgttagttttaagtgtgcgaattcgaggagtagcgatagattcgagattacgtttttttttcgggaaggaggcggtatttcgcgtttgaggttcgtttgcgtttgaggttcgtttgcgtttgcggttcgtttgcgtttgaggtttgtttgcgtttgagattttattgggcgtgattgaggaatttggggaggtttttgggcggtattgaggacgagggggttcgttagttagtatagaattttggagcgggaattttttatcgtttaaatggcgtcgggggcgggattttcgggatttggttttcgcgggtcgtcgtcggttttgaaacgtgagggatagttgagatgaggtagttattgggatggtttttatgcgtatttatatgtagttcgattgtcgagttttcgaggtagtaggatttatcgtttatattttttattattaattaagtttttagaatag

SEQ ID NO: 21654 - DNA, 776 bp, Artificial Sequence
  chemically treated genomic DNA (Homo sapiens) CpG-island No: 21654
ctattctaaaaacttaattaataataaaaaatataaacgataaatcctactacctcgaaaactcgacaatcgaactacatataaatacgcataaaaaccatcccaataactacctcatctcaactatccctcacgtttcaaaaccgacgacgacccgcgaaaaccaaatcccgaaaatcccgcccccgacgccatttaaacgataaaaaattcccgctccaaaattctatactaactaacgaaccccctcgtcctcaataccgcccaaaaacctccccaaattcctcaatcacgcccaataaaatctcaaacgcaaacaaacctcaaacgcaaacgaaccgcaaacgcaaacgaacctcaaacgcaaacgaacctcaaacgcgaaataccgcctccttcccgaaaaaaaaacgtaatctcgaatctatcgctactcctcgaattcgcacacttaaaactaacgctaaccctctaacaaaactataaaaacgcgcgaaaccgaccgaacgaaacgaaacgaaaccaaacctaactaacgaacaacacaaataaataacgacccgcttacctttaacgcaaaaaaacgaccaacttaaacaaaaaacgacaatccacgcatacgcgaaccctatactcgatcccaatcaacgccctctacgtcatcacgcatatacgcactatatcgcgtcaaactaacacgcacactccccaaccaacttctacctatatccctaacgaaaaccaacccatcaacgaaaaccccgcccccttcgaca

SEQ ID NO: 21655 - DNA, 776 bp, Artificial Sequence
  chemically treated genomic DNA (Homo sapiens) CpG-island No: 21655
ttgttttaaaagtttggttagtagtgaggaatgtggacggtaaattttgttgtttcgaaagttcggtagtcggattgtatgtaaatgcgtatgggggttattttagtagttgttttattttagttattttttacgttttagggtcggcggcggttcgcggaagttagatttcggaggtttcgttttcgacgttatttagacggtgagggattttcgttttaggattttatgttgattaacggattttttcgtttttaatatcgtttaaaaatttttttaaattttttaattacgtttaatgagattttaaacgtagataggttttaagcgtaggcgggtcgtaagcgtaggcgggttttaaacgtaggcgggttttaaacgcgaggtgtcgtttttttttcgaggaaggagcgtggtttcgagtttgtcgttgtttttcggattcgtatatttaaggttaacgttaattttttagtaaggttatgggggcgcgcgagatcgatcgagcgaagcgggacgaggttaggtttagttggcgaataatataaatggataacggttcgtttatttttggcgtagggaagcgattaatttggatagaagacgataatttacgtatgcgcgggttttgtattcggttttaattaacgttttttacgttattacgtatgtgcgtattatatcgcgttaggttggtacgtatattttttaattagtttttatttatgtttttgacgaaagttaatttattagcgagagtttcgtttttttcggta

SEQ ID NO: 21656 - DNA, 776 bp, Artificial Sequence
  chemically treated genomic DNA (Homo sapiens) CpG-island No: 21656
taccgaaaaaaacgaaactctcgctaataaattaactttcgtcaaaaacataaataaaaactaattaaaaaatatacgtaccaacctaacgcgatataatacgcacatacgtaataacgtaaaaaacgttaattaaaaccgaatacaaaacccgcgcatacgtaaattatcgtcttctatccaaattaatcgcttccctacgccaaaaataaacgaaccgttatccatttatattattcgccaactaaacctaacctcgtcccgcttcgctcgatcgatctcgcgcgcccccataaccttactaaaaaattaacgttaaccttaaatatacgaatccgaaaaacaacgacaaactcgaaaccacgctccttcctcgaaaaaaaaacgacacctcgcgtttaaaacccgcctacgtttaaaacccgcctacgcttacgacccgcctacgcttaaaacctatctacgtttaaaatctcattaaacgtaattaaaaaatttaaaaaaatttttaaacgatattaaaaacgaaaaaatccgttaatcaacataaaatcctaaaacgaaaatccctcaccgtctaaataacgtcgaaaacgaaacctccgaaatctaacttccgcgaaccgccgccgaccctaaaacgtaaaaaataactaaaataaaacaactactaaaataacccccatacgcatttacatacaatccgactaccgaactttcgaaacaacaaaatttaccgtccacattcctcactactaaccaaacttttaaaacaa

SEQ ID NO: 21657 - DNA, 617 bp, Artificial Sequence
  chemically treated genomic DNA (Homo sapiens) CpG-island No: 21657
agcgttttgggttcgcgtaggcgtattttatatcgacgtaggttcgttttttaagtgcgtatgcgtgtagtttgcgcgggaaagagtgtcgttttagttgagggtaagcgaggagatggttgtgaggtaggcggcgacggcgggtattttcgggtttaggagagaggaagaggcggcgtttttattcgagagggtttattatcggtacgattcgcgttggttgttgttcgtgatttttcgtttgtgtttggtttgcgcgttggagttgttgtcggatttcggcgtgtcggtgcgggcggaattttttttttagaagatttgggtttggttattttttttagtaaacgcggttaggtttttgttagattcgtttcggtgaattcgacgcgaaatcgggttttcgcgttgtgtttatttttttttttgttagttcgtttcggattcggtcgtagcggtttttcgggttttttagttttaggtcggtttgcgggttttcgtggagttcggtttattggttttgcgtttgaaaggacggaaattcggatttttcgggattttatttagttttagggatatattttttcgtttttcgttttttggttttttttttttgttgt

SEQ ID NO: 21658 - DNA, 617 bp, Artificial Sequence
  chemically treated genomic DNA (Homo sapiens) CpG-island No: 21658
acaacaaaaaaaaaaaaccaaaaaacgaaaaacgaaaaaatatatccctaaaactaaataaaatcccgaaaaatccgaatttccgtcctttcaaacgcaaaaccaataaaccgaactccacgaaaacccgcaaaccgacctaaaactaaaaaacccgaaaaaccgctacgaccgaatccgaaacgaactaacaaaaaaaaaaataaacacaacgcgaaaacccgatttcgcgtcgaattcaccgaaacgaatctaacaaaaacctaaccgcgtttactaaaaaaaataaccaaacccaaatcttctaaaaaaaaaattccgcccgcaccgacacgccgaaatccgacaacaactccaacgcgcaaaccaaacacaaacgaaaaatcacgaacaacaaccaacgcgaatcgtaccgataataaaccctctcgaataaaaacgccgcctcttcctctctcctaaacccgaaaatacccgccgtcgccgcctacctcacaaccatctcctcgcttaccctcaactaaaacgacactctttcccgcgcaaactacacgcatacgcacttaaaaaacgaacctacgtcgatataaaatacgcctacgcgaacccaaaacgct

SEQ ID NO: 21659 - DNA, 617 bp, Artificial Sequence
  chemically treated genomic DNA (Homo sapiens) CpG-island No: 21659
gtagtaaagggaaggagttagaaggcggaaggcgggaaggtgtgtttttgagattgggtgaggtttcgggggattcggattttcgtttttttaggcgtagagttagtggatcgggttttacggaggttcgtaggtcggtttggggttgaggggttcgagaggtcgttgcggtcgggttcgggacgggttgatagggaggagagtgaatatagcgcgggggttcggtttcgcgtcgggtttatcggagcgggtttggtaagggtttggtcgcgtttgttgagggaaatggttaaatttaggttttttgaagaaaaggtttcgttcgtatcgatacgtcggggttcggtagtagttttagcgcgtaggttaggtataggcggggggttacgggtagtagttagcgcgggtcgtgtcggtaatgggttttttcgaatagaagcgtcgttttttttttttttttgggttcgggagtgttcgtcgtcgtcgtttgttttatagttattttttcgtttgtttttagttgaggcggtattttttttcgcgtagattgtacgtatgcgtatttggaggacggatttgcgtcggtgtggaatgcgtttgcgcggatttagggcgtt

SEQ ID NO: 21660 - DNA, 617 bp, Artificial Sequence
  chemically treated genomic DNA (Homo sapiens) CpG-island No: 21660
aacgccctaaatccgcgcaaacgcattccacaccgacgcaaatccgtcctccaaatacgcatacgtacaatctacgcgaaaaaaaataccgcctcaactaaaaacaaacgaaaaaataactataaaacaaacgacgacgacgaacactcccgaacccaaaaaaaaaaaaaaaacgacgcttctattcgaaaaaacccattaccgacacgacccgcgctaactactacccgtaaccccccgcctatacctaacctacgcgctaaaactactaccgaaccccgacgtatcgatacgaacgaaaccttttcttcaaaaaacctaaatttaaccatttccctcaacaaacgcgaccaaacccttaccaaacccgctccgataaacccgacgcgaaaccgaacccccgcgctatattcactctcctccctatcaacccgtcccgaacccgaccgcaacgacctctcgaacccctcaaccccaaaccgacctacgaacctccgtaaaacccgatccactaactctacgcctaaaaaaacgaaaatccgaatcccccgaaacctcacccaatctcaaaaacacaccttcccgccttccgccttctaactccttccctttactac

SEQ ID NO: 21661 - DNA, 733 bp, Artificial Sequence
  chemically treated genomic DNA (Homo sapiens) CpG-island No: 21661
tattgatttagaataaggaaatcggggagtgaatcgcgtttttatatatttttcgtagttggtaaggaaaggttattggatattttagcgggggttaagacggaatttcggtattattcggtcgggtttcgtttattaaagggttttcggttttgcgtaggcgtattattattagtagcgggcgaaattattattcgtagttttgttcgtttatttttgttatttattttattttcgttgtcgacgatggtttcgtttcgggttaaattattttttcggtttcgggtagggaacgtcggggtttaagcgtagttattttggagttgagttttcggttcgggttttttgttcgtgttcggtagtcgttttagaaatcgagttttttcgggttcgtttttatttgttacgtcgttatagtcgtcgtcgtttttattttgggtttttttttttgtttttttatagagttcgttttcgtcgtttttcggattttcgttattggttttgcgggatttagttttttatttttattgggttagggttacgtttgttaaggtaagattaacggaatgtgagtcgtgtttcggattaggaggggtcgtttgaaacgttaagatttggggtaagcgttcgttttgattcgcgtaggcgtagttgaggtaagatttgcgtgtttagggttttaattttaatagtggtatagacgtataaagtagaatataggttatttggggtt

SEQ ID NO: 21662 - DNA, 733 bp, Artificial Sequence
  chemically treated genomic DNA (Homo sapiens) CpG-island No: 21662
aaccccaaataacctatattctactttatacgtctataccactattaaaattaaaaccctaaacacgcaaatcttacctcaactacgcctacgcgaatcaaaacgaacgcttaccccaaatcttaacgtttcaaacgacccctcctaatccgaaacacgactcacattccgttaatcttaccttaacaaacgtaaccctaacccaataaaaataaaaaactaaatcccgcaaaaccaataacgaaaatccgaaaaacgacgaaaacgaactctataaaaaaacaaaaaaaaaaacccaaaataaaaacgacgacgactataacgacgtaacaaataaaaacgaacccgaaaaaactcgatttctaaaacgactaccgaacacgaacaaaaaacccgaaccgaaaactcaactccaaaataactacgcttaaaccccgacgttccctacccgaaaccgaaaaaataatttaacccgaaacgaaaccatcgtcgacaacgaaaataaaataaataacaaaaataaacgaacaaaactacgaataataatttcgcccgctactaataataatacgcctacgcaaaaccgaaaaccctttaataaacgaaacccgaccgaataataccgaaattccgtcttaacccccgctaaaatatccaataacctttccttaccaactacgaaaaatatataaaaacgcgattcactccccgatttccttattctaaatcaata

SEQ ID NO: 21663 - DNA, 733 bp, Artificial Sequence
  chemically treated genomic DNA (Homo sapiens) CpG-island No: 21663
agttttaaatgatttgtgttttgttttatacgtttatgttattgttggggttaaagttttaggtacgtaggttttgttttaattgcgtttgcgcgagttaggacgagcgtttgttttagattttgacgttttaggcggttttttttaattcggaatacgatttatatttcgttggttttgttttgatagacgtgattttgatttaataagggtggaaggttgagtttcgtagagttaataacgagagttcgagaggcgacggaggcggattttgtgaggaaataagaagagaggtttaagatggagacggcggcggttgtagcggcgtgataggtgagggcgggttcgggagggttcggtttttggagcggttgtcgggtacgggtagggagttcggatcgaaagtttagttttaggatggttgcgtttgggtttcggcgttttttgttcggaatcggaggagtggtttgattcggggcgagattatcgtcgatagcgggggtggggtgggtaataggaataggcgggtaaggttgcgggtgatggtttcgttcgttgttagtggtggtgcgtttgcgtagagtcggaagttttttggtaggcgggattcgatcgagtggtgtcgggatttcgttttaattttcgttaaggtgtttaatgatttttttttattaattgcggggagtgtgtggaaacgcggtttatttttcggtttttttattttggattagtg

SEQ ID NO: 21664 - DNA, 733 bp, Artificial Sequence
  chemically treated genomic DNA (Homo sapiens) CpG-island No: 21664
cactaatccaaaataaaaaaaccgaaaaataaaccgcgtttccacacactccccgcaattaataaaaaaaaatcattaaacaccttaacgaaaattaaaacgaaatcccgacaccactcgatcgaatcccgcctaccaaaaaacttccgactctacgcaaacgcaccaccactaacaacgaacgaaaccatcacccgcaaccttacccgcctattcctattacccaccccacccccgctatcgacgataatctcgccccgaatcaaaccactcctccgattccgaacaaaaaacgccgaaacccaaacgcaaccatcctaaaactaaactttcgatccgaactccctacccgtacccgacaaccgctccaaaaaccgaaccctcccgaacccgccctcacctatcacgccgctacaaccgccgccgtctccatcttaaacctctcttcttatttcctcacaaaatccgcctccgtcgcctctcgaactctcgttattaactctacgaaactcaaccttccacccttattaaatcaaaatcacgtctatcaaaacaaaaccaacgaaatataaatcgtattccgaattaaaaaaaaccgcctaaaacgtcaaaatctaaaacaaacgctcgtcctaactcgcgcaaacgcaattaaaacaaaacctacgtacctaaaactttaaccccaacaataacataaacgtataaaacaaaacacaaatcatttaaaact

SEQ ID NO: 21665 - DNA, 553 bp, Artificial Sequence
  chemically treated genomic DNA (Homo sapiens) CpG-island No: 21665
cgggttcggggggcggggggacgcggagcgatggttcgcgcggtcgtaggggcggataaaaagtcgtcgcgttgcgggagtgggcgggagggagaggggttgttcgagggttataagagtatgacggggttgtacgagttggtgtggcgggtgttgtacgcgttgttttgtttgtatcgtacgtttattttttggtttcgcgttcggttcggtatttggaattggatttggcggcgttgttgtcgagtcgtttttgtcgcggttttagcgtcgttcggttttacgtttcgtaagttttcggtagtcggtaggaatcgtcgttattatcggtattcgcgcggggggtcgtgtttggtagtcgtatattatcggatgcgttggcgcgcggacggtcgttttttggagaagttgtttgtgtatatgggtttggtgattatcgaggtggagtaggaatttagtttttcggatatcgcgagtttcgtggtgtggtgtatggtcgtgggtattttttatattagcgtttacgattattaaggtatttttaaaagaaata

SEQ ID NO: 21666 - DNA, 553 bp, Artificial Sequence
  chemically treated genomic DNA (Homo sapiens) CpG-island No: 21666
tatttcttttaaaaataccttaataatcgtaaacgctaatataaaaaatacccacgaccatacaccacaccacgaaactcgcgatatccgaaaaactaaattcctactccacctcgataatcaccaaacccatatacacaaacaacttctccaaaaaacgaccgtccgcgcgccaacgcatccgataatatacgactaccaaacacgaccccccgcgcgaataccgataataacgacgattcctaccgactaccgaaaacttacgaaacgtaaaaccgaacgacgctaaaaccgcgacaaaaacgactcgacaacaacgccgccaaatccaattccaaataccgaaccgaacgcgaaaccaaaaaataaacgtacgatacaaacaaaacaacgcgtacaacacccgccacaccaactcgtacaaccccgtcatactcttataaccctcgaacaacccctctccctcccgcccactcccgcaacgcgacgactttttatccgcccctacgaccgcgcgaaccatcgctccgcgtccccccgccccccgaacccg

SEQ ID NO: 21667 - DNA, 553 bp, Artificial Sequence
  chemically treated genomic DNA (Homo sapiens) CpG-island No: 21667
tattttttttgaaaatattttggtggtcgtagacgttaatgtaggagatgtttacggttatatattatattacgaggttcgcgatgttcgagaagttgggtttttgttttatttcggtgattattaggtttatatgtataggtagtttttttaaggaacgatcgttcgcgcgttagcgtattcggtggtgtgcggttgttaggtacgatttttcgcgcgggtgtcggtggtgacggcggtttttgtcgattgtcgggggtttgcggagcgtgaagtcgagcggcgttaggatcgcggtagaggcggttcggtagtagcgtcgttagatttagttttaggtgtcgaatcgaacgcggagttaggaggtgagcgtgcggtgtagatagagtagcgcgtgtagtattcgttatattagttcgtatagtttcgttatatttttgtggttttcggataatttttttttttttcgtttattttcgtagcgcgacggttttttattcgtttttgcggtcgcgcgggttatcgtttcgcgttttttcgtttttcgagttcg

SEQ ID NO: 21668 - DNA, 553 bp, Artificial Sequence
  chemically treated genomic DNA (Homo sapiens) CpG-island No: 21668
cgaactcgaaaaacgaaaaaacgcgaaacgataacccgcgcgaccgcaaaaacgaataaaaaaccgtcgcgctacgaaaataaacgaaaaaaaaaaaaattatccgaaaaccacaaaaatataacgaaactatacgaactaatataacgaatactacacgcgctactctatctacaccgcacgctcacctcctaactccgcgttcgattcgacacctaaaactaaatctaacgacgctactaccgaaccgcctctaccgcgatcctaacgccgctcgacttcacgctccgcaaacccccgacaatcgacaaaaaccgccgtcaccaccgacacccgcgcgaaaaatcgtacctaacaaccgcacaccaccgaatacgctaacgcgcgaacgatcgttccttaaaaaaactacctatacatataaacctaataatcaccgaaataaaacaaaaacccaacttctcgaacatcgcgaacctcgtaatataatatataaccgtaaacatctcctacattaacgtctacgaccaccaaaatattttcaaaaaaaata

SEQ ID NO: 21669 - DNA, 503 bp, Artificial Sequence
  chemically treated genomic DNA (Homo sapiens) CpG-island No: 21669
ttgaattttcgtaattttttgcgtttatagaggttaaattttcgttgttggcgattttcgttttttggtttaaatttgatacgtacgatttttttcgcggtaattgtataggttcggtgatagtcgagacgtcgagtgtttttcgtagtcggtcggggtttaggtcggaaatgtagttagtggggtcgttaggtgggttttagacgcggtgggcgcggggtttcggtcgtcgcgggagaggggtcgtcgcgttttatagagtagtgcggcggtaggggcgggggcgggtgcgtttcgcgatttgtttttgggggtgggggttgggcgatatttaaagaggcggaggtttttcggtagggacggtttgaggtcgagggtattttgagggcggaagaggtaaagcgtttcgttcgtcggggtttcggaggtgattaatttttagaggttgcggcggaggggagaagtttggtggtatattttatggtttagtgtttcggttattg

SEQ ID NO: 21670 - DNA, 503 bp, Artificial Sequence
  chemically treated genomic DNA (Homo sapiens) CpG-island No: 21670
caataaccgaaacactaaaccataaaatataccaccaaacttctcccctccgccgcaacctctaaaaattaatcacctccgaaaccccgacgaacgaaacgctttacctcttccgccctcaaaataccctcgacctcaaaccgtccctaccgaaaaacctccgcctctttaaatatcgcccaacccccacccccaaaaacaaatcgcgaaacgcacccgcccccgcccctaccgccgcactactctataaaacgcgacgacccctctcccgcgacgaccgaaaccccgcgcccaccgcgtctaaaacccacctaacgaccccactaactacatttccgacctaaaccccgaccgactacgaaaaacactcgacgtctcgactatcaccgaacctatacaattaccgcgaaaaaaatcgtacgtatcaaatttaaaccaaaaaacgaaaatcgccaacaacgaaaatttaacctctataaacgcaaaaaattacgaaaattcaa

SEQ ID NO: 21671 - DNA, 503 bp, Artificial Sequence
  chemically treated genomic DNA (Homo sapiens) CpG-island No: 21671
tagtggtcgaggtattgggttatggaatgtattattaggtttttttttttcgtcgtagtttttaggagttagttattttcgaggtttcggcgggcgaggcgttttgtttttttcgtttttagggtgttttcggttttaggtcgtttttatcggggagttttcgtttttttaaatatcgtttagtttttatttttaggagtaggtcgcgagacgtattcgttttcgtttttgtcgtcgtattgttttgtgggacgcggcgatttttttttcgcggcggtcgggatttcgcgtttatcgcgtttggagtttatttggcggttttattggttatattttcgatttggatttcggtcggttgcgggaaatattcggcgtttcggttgttatcgaatttgtgtagttgtcgcggggggagtcgtgcgtgttagatttaggttaggaagcggaagtcgttagtagcgagagtttaatttttgtgggcgtagagggttgcggggatttag

SEQ ID NO: 21672 - DNA, 503 bp, Artificial Sequence
  chemically treated genomic DNA (Homo sapiens) CpG-island No: 21672
ctaaatccccgcaaccctctacgcccacaaaaattaaactctcgctactaacgacttccgcttcctaacctaaatctaacacgcacgactccccccgcgacaactacacaaattcgataacaaccgaaacgccgaatatttcccgcaaccgaccgaaatccaaatcgaaaatataaccaataaaaccgccaaataaactccaaacgcgataaacgcgaaatcccgaccgccgcgaaaaaaaaatcgccgcgtcccacaaaacaatacgacgacaaaaacgaaaacgaatacgtctcgcgacctactcctaaaaataaaaactaaacgatatttaaaaaaacgaaaactccccgataaaaacgacctaaaaccgaaaacaccctaaaaacgaaaaaaacaaaacgcctcgcccgccgaaacctcgaaaataactaactcctaaaaactacgacgaaaaaaaaaaacctaataatacattccataacccaatacctcgaccacta

SEQ ID NO: 21673 - DNA, 1144 bp, Artificial Sequence
  chemically treated genomic DNA (Homo sapiens) CpG-island No: 21673
ttcgcgggtttcgcggcggcgtgttcgtgtggttgcgtgcgcgcggacggggcggggttgaggagggacgtgcgcgcgcgcggacggggcggggtggagttcggagggcggacgcgttcggggtcgtttggtcggtagggggcgttgcgtatttatgtcgcgttttgtttgttttcgggtgttgttcgcggcggttcgattggagtagtcgtcgaagagcgtttggcgttattttgaagcggagaggaggaggaacggtagggttggttgcggaaggggagggggggggagaaggcgattggatgcggcggcggcggcggatttcggagagtttcggagtgagcggagtagcgagtcggtaattcggaggtaggaaataatttagttaacggaaagaaaatgttttttttttttggttgcggcgttttattttttagcggtcgttattgtcgttgtgtgcgtgtgtgtggtagggttgaagcgtcgttcgtttgggtgttaggcgcgattcgtttttcggtatcgggggttgtagcgggtggttgtttggcggtggttcggggcgggggtcgcggggcgcgggtcggttgcgcggtgggggtggggagggtttcgcggtcggcgcgcgtttttacgtcgcgggttttgtcgtagtttttggaaaattaaatttgtcgttttgatttcggtcggggcggcggcggcggcgggcggtgattttgcgcgcgggcgggggtttcggggtcgttcggtcgttcgcgttttttcgtcgtcgtcgtcgtcgtcgtcgcgttttttttttcgcgtttcggtcggtcggcggttgtttttcgggcggtaggcgggcggcgcggtgtttttgttgaattttttcgcgggcgggtttttttttttttcgggcgaggggcgggcggggatcgcgggtcggggtcgcgggcgttttcgttttcgtcgtcgggttttcgcgcgtcgtttggttttcgtttcgggttaggggacgggttgagcgtgatatttttgtattgtttttcgtcgttcgtcggagggaaatcgcgtttatcgcgttatttcgagtggttttcgagtagttagttgaggaagagtttagtattggcgtggagggattttttttaggttataattg

SEQ ID NO: 21674 - DNA, 1144 bp, Artificial Sequence
  chemically treated genomic DNA (Homo sapiens) CpG-island No: 21674
caattataacctaaaaaaaatccctccacgccaatactaaactcttcctcaactaactactcgaaaaccactcgaaataacgcgataaacgcgatttccctccgacgaacgacgaaaaacaatacaaaaatatcacgctcaacccgtcccctaacccgaaacgaaaaccaaacgacgcgcgaaaacccgacgacgaaaacgaaaacgcccgcgaccccgacccgcgatccccgcccgcccctcgcccgaaaaaaaaaaaaacccgcccgcgaaaaaattcaacaaaaacaccgcgccgcccgcctaccgcccgaaaaacaaccgccgaccgaccgaaacgcgaaaaaaaaaacgcgacgacgacgacgacgacgacgaaaaaacgcgaacgaccgaacgaccccgaaacccccgcccgcgcgcaaaatcaccgcccgccgccgccgccgccccgaccgaaatcaaaacgacaaatttaattttccaaaaactacgacaaaacccgcgacgtaaaaacgcgcgccgaccgcgaaaccctccccacccccaccgcgcaaccgacccgcgccccgcgacccccgccccgaaccaccgccaaacaaccacccgctacaacccccgataccgaaaaacgaatcgcgcctaacacccaaacgaacgacgcttcaaccctaccacacacacgcacacaacgacaataacgaccgctaaaaaataaaacgccgcaaccaaaaaaaaaaaacattttctttccgttaactaaattatttcctacctccgaattaccgactcgctactccgctcactccgaaactctccgaaatccgccgccgccgccgcatccaatcgccttctccccccccctccccttccgcaaccaaccctaccgttcctcctcctctccgcttcaaaataacgccaaacgctcttcgacgactactccaatcgaaccgccgcgaacaacacccgaaaacaaacaaaacgcgacataaatacgcaacgccccctaccgaccaaacgaccccgaacgcgtccgccctccgaactccaccccgccccgtccgcgcgcgcgcacgtccctcctcaaccccgccccgtccgcgcgcacgcaaccacacgaacacgccgccgcgaaacccgcgaa

SEQ ID NO: 21675 - DNA, 1144 bp, Artificial Sequence
  chemically treated genomic DNA (Homo sapiens) CpG-island No: 21675
tagttgtggtttgggaggagtttttttacgttagtgttgggtttttttttaattggttgttcggggattattcggggtggcgcggtgagcgcgattttttttcggcgagcggcgagggatagtgtaaaaatgttacgtttagttcgttttttggttcgaagcggaggttaggcggcgcgcggggattcggcggcgggggcgagagcgttcgcggtttcgattcgcggttttcgttcgtttttcgttcggaagggggagaagttcgttcgcgggaggatttaataggagtatcgcgtcgttcgtttgtcgttcgggaaatagtcgtcggtcggtcggggcgcggggggaggggcgcggcggcggcgacggcggcggcgggagggcgcgggcggtcgggcggtttcgagattttcgttcgcgcgtaaggttatcgttcgtcgtcgtcgtcgtttcggtcgggattagagcggtaagtttaattttttagaggttgcggtagaattcgcggcgtggaggcgcgcgtcggtcgcggggttttttttatttttatcgcgtagtcggttcgcgtttcgcgattttcgtttcgggttatcgttaggtagttattcgttgtagttttcgatgtcgggaggcgagtcgcgtttggtatttaggcgggcggcgttttagttttgttatatatacgtatatagcggtagtggcggtcgttgaaaaatggagcgtcgtagttagagaagagagatatttttttttcgttaattgaattgttttttattttcgggttgtcgattcgttatttcgtttatttcggggtttttcgggattcgtcgtcgtcgtcgtatttaatcgtttttttttttttttttttttttcgtagttagttttgtcgttttttttttttttcgttttaaaatggcgttaagcgtttttcggcggttgttttaatcgaatcgtcgcggatagtattcgggggtaggtagagcgcggtatgggtgcgtagcgttttttgtcgattagacggtttcgagcgcgttcgtttttcgagttttatttcgtttcgttcgcgcgcgcgtacgtttttttttagtttcgtttcgttcgcgcgtacgtaattatacgggtacgtcgtcgcggggttcgcgag

SEQ ID NO: 21676 - DNA, 1144 bp, Artificial Sequence
  chemically treated genomic DNA (Homo sapiens) CpG-island No: 21676
ctcgcgaaccccgcgacgacgtacccgtataattacgtacgcgcgaacgaaacgaaactaaaaaaaaacgtacgcgcgcgcgaacgaaacgaaataaaactcgaaaaacgaacgcgctcgaaaccgtctaatcgacaaaaaacgctacgcacccataccgcgctctacctacccccgaatactatccgcgacgattcgattaaaacaaccgccgaaaaacgcttaacgccattttaaaacgaaaaaaaaaaaaaacgacaaaactaactacgaaaaaaaaaaaaaaaaaaaaaaacgattaaatacgacgacgacgacgaatcccgaaaaaccccgaaataaacgaaataacgaatcgacaacccgaaaataaaaaacaattcaattaacgaaaaaaaaatatctctcttctctaactacgacgctccatttttcaacgaccgccactaccgctatatacgtatatataacaaaactaaaacgccgcccgcctaaataccaaacgcgactcgcctcccgacatcgaaaactacaacgaataactacctaacgataacccgaaacgaaaatcgcgaaacgcgaaccgactacgcgataaaaataaaaaaaaccccgcgaccgacgcgcgcctccacgccgcgaattctaccgcaacctctaaaaaattaaacttaccgctctaatcccgaccgaaacgacgacgacgacgaacgataaccttacgcgcgaacgaaaatctcgaaaccgcccgaccgcccgcgccctcccgccgccgccgtcgccgccgccgcgcccctccccccgcgccccgaccgaccgacgactatttcccgaacgacaaacgaacgacgcgatactcctattaaatcctcccgcgaacgaacttctcccccttccgaacgaaaaacgaacgaaaaccgcgaatcgaaaccgcgaacgctctcgcccccgccgccgaatccccgcgcgccgcctaacctccgcttcgaaccaaaaaacgaactaaacgtaacatttttacactatccctcgccgctcgccgaaaaaaaatcgcgctcaccgcgccaccccgaataatccccgaacaaccaattaaaaaaaaacccaacactaacgtaaaaaaactcctcccaaaccacaacta

SEQ ID NO: 21677 - DNA, 686 bp, Artificial Sequence
  chemically treated genomic DNA (Homo sapiens) CpG-island No: 21677
gcgttttattggtcgttatatatttaattcgtttggtagtcgttatagagtcgcggtagcgtcgagtcggcgtttattagtattcgggtttcgggtagttgagggggcggcggcggcggtagcggagggtgtagttcgggttgcgtttggttatgatggtggaagtggtgagcggggtgatggtgtcgaatcggtttcgcgttttcggagtaggtatttaaggtagcgggcggaagcggcggttgtagaggtacggagtttttggcggcgcgtggagtttcgggcgttagggttgtagtcggcggtagttggcggtgtaagtgttgttgttgttgttggcgcgagatcgtgcgcgcgagttttaggaggtttacgggtattacggtttcgggatagcgtttttttaggaatttttggaagttttggatatttatgtttcgtcggtgggtagacgcgatagcggttgcgtaagtaggataggcgacgatttgggcgcgaagttgggggcgggcgcgtgcgtatttcgcggggggcgagggggggcgggaaaaggattttcgaggggaggggtgaggaagcgagggaatgagggcggggaggggaggagattataaattggatttgggtagagagaaggggaggggtagatcggattcgggagaggttgggaggataaaagcgaggat

SEQ ID NO: 21678 - DNA, 686 bp, Artificial Sequence
  chemically treated genomic DNA (Homo sapiens) CpG-island No: 21678
atcctcgcttttatcctcccaacctctcccgaatccgatctacccctccccttctctctacccaaatccaatttataatctcctcccctccccgccctcattccctcgcttcctcacccctcccctcgaaaatccttttcccgccccccctcgccccccgcgaaatacgcacgcgcccgcccccaacttcgcgcccaaatcgtcgcctatcctacttacgcaaccgctatcgcgtctacccaccgacgaaacataaatatccaaaacttccaaaaattcctaaaaaaacgctatcccgaaaccgtaatacccgtaaacctcctaaaactcgcgcgcacgatctcgcgccaacaacaacaacaacacttacaccgccaactaccgccgactacaaccctaacgcccgaaactccacgcgccgccaaaaactccgtacctctacaaccgccgcttccgcccgctaccttaaatacctactccgaaaacgcgaaaccgattcgacaccatcaccccgctcaccacttccaccatcataaccaaacgcaacccgaactacaccctccgctaccgccgccgccgccccctcaactacccgaaacccgaatactaataaacgccgactcgacgctaccgcgactctataacgactaccaaacgaattaaatatataacgaccaataaaacgc

SEQ ID NO: 21679 - DNA, 686 bp, Artificial Sequence
  chemically treated genomic DNA (Homo sapiens) CpG-island No: 21679
attttcgtttttatttttttagtttttttcgggttcggtttgtttttttttttttttttatttaaatttaatttgtggttttttttttttttcgtttttattttttcgtttttttattttttttttcgggaatttttttttcgttttttttcgtttttcgcggagtgcgtacgcgttcgtttttagtttcgcgtttagatcgtcgtttattttgtttgcgtagtcgttatcgcgtttgtttatcgacgaagtatgggtgtttagggtttttaagagtttttggagaagcgttgtttcggggtcgtggtgttcgtggattttttaaaattcgcgcgtacggtttcgcgttagtagtagtagtagtatttgtatcgttagttgtcgtcgattgtagttttagcgttcggggttttacgcgtcgttaggggtttcgtgtttttgtaatcgtcgttttcgttcgttgttttgggtgtttatttcgggggcgcggggtcgattcggtattattatttcgtttattatttttattattatggttaagcgtagttcgggttgtatttttcgttgtcgtcgtcgtcgtttttttagttgttcggggttcgggtgttggtggacgtcggttcggcgttgtcgcggttttatggcggttattagacggattgggtgtgtggcggttaatggaacgt

SEQ ID NO: 21680 - DNA, 686 bp, Artificial Sequence
  chemically treated genomic DNA (Homo sapiens) CpG-island No: 21680
acgttccattaaccgccacacacccaatccgtctaataaccgccataaaaccgcgacaacgccgaaccgacgtccaccaacacccgaaccccgaacaactaaaaaaacgacgacgacgacaacgaaaaatacaacccgaactacgcttaaccataataataaaaataataaacgaaataataataccgaatcgaccccgcgcccccgaaataaacacccaaaacaacgaacgaaaacgacgattacaaaaacacgaaacccctaacgacgcgtaaaaccccgaacgctaaaactacaatcgacgacaactaacgatacaaatactactactactactaacgcgaaaccgtacgcgcgaattttaaaaaatccacgaacaccacgaccccgaaacaacgcttctccaaaaactcttaaaaaccctaaacacccatacttcgtcgataaacaaacgcgataacgactacgcaaacaaaataaacgacgatctaaacgcgaaactaaaaacgaacgcgtacgcactccgcgaaaaacgaaaaaaaacgaaaaaaaaattcccgaaaaaaaaaataaaaaaacgaaaaaataaaaacgaaaaaaaaaaaaaaccacaaattaaatttaaataaaaaaaaaaaaaaaaacaaaccgaacccgaaaaaaactaaaaaaataaaaacgaaaat

SEQ ID NO: 21681 - DNA, 906 bp, Artificial Sequence
  chemically treated genomic DNA (Homo sapiens) CpG-island No: 21681
ggcgggggtgcgggtggagttcgggtcgggtggcgtggaaggtcgagtatagttgcgagcggcgagtttcgggagaggaggagcgggagaaagcggggcgggtttgcggtcggggttcggtcgggggagggggttttcgtttttttttttttattttcgttttttttggttttggtgacgttgcggtttttttttttttttagcggagttttagcgttcgtcgcgttttttttttcgtttttttcgtttatatttattcgttttcgtcggttcggtttttagtagcgtcgttcgaggttgtagtagcgtatttcggggtatggcgcggcgggggcgcggagggttcggttcggagggggtcgggagttcgggcgttttggagtgaggaggatcgggagttggttttggaggttgcggaggcgacgtcggagagaacgaagtttcggttgggagcggtaagtggaggggcgcgtaagggacgagttggggcgcgcggcgtaatttttttcgggagtttcgggcgggtagttttcggggttgtttcggcgcgggcgggagacggagagttacgttttcggttgagagcggagcgtcgcgggttgcgcgttcgggttcggttcggttggatttcgagagagcgtttgacgcgtgaagtttgagttacgggttttttcggcggcggagtagtttcgaggggtagtttttcgattttttttatttttttgaacgtcgagtatcgagtcgggaatacgatgagaatttggagatcgtatttcgtgcgtcggatttggtcggtttagtcgcgattttttcgacggtttttggggtttcggttttattttgcggggttgggtggtatattttcgcgttttttttttttttcgtattttagttatttgggggtag

SEQ ID NO: 21682 - DNA, 906 bp, Artificial Sequence
  chemically treated genomic DNA (Homo sapiens) CpG-island No: 21682
ctacccccaaataactaaaatacgaaaaaaaaaaaaaacgcgaaaatataccacccaaccccgcaaaataaaaccgaaaccccaaaaaccgtcgaaaaaatcgcgactaaaccgaccaaatccgacgcacgaaatacgatctccaaattctcatcgtattcccgactcgatactcgacgttcaaaaaaataaaaaaaatcgaaaaactacccctcgaaactactccgccgccgaaaaaacccgtaactcaaacttcacgcgtcaaacgctctctcgaaatccaaccgaaccgaacccgaacgcgcaacccgcgacgctccgctctcaaccgaaaacgtaactctccgtctcccgcccgcgccgaaacaaccccgaaaactacccgcccgaaactcccgaaaaaaattacgccgcgcgccccaactcgtcccttacgcgcccctccacttaccgctcccaaccgaaacttcgttctctccgacgtcgcctccgcaacctccaaaaccaactcccgatcctcctcactccaaaacgcccgaactcccgaccccctccgaaccgaaccctccgcgcccccgccgcgccataccccgaaatacgctactacaacctcgaacgacgctactaaaaaccgaaccgacgaaaacgaataaatataaacgaaaaaaacgaaaaaaaaaacgcgacgaacgctaaaactccgctaaaaaaaaaaaaaaaccgcaacgtcaccaaaaccaaaaaaaacgaaaataaaaaaaaaaaaacgaaaaccccctcccccgaccgaaccccgaccgcaaacccgccccgctttctcccgctcctcctctcccgaaactcgccgctcgcaactatactcgaccttccacgccacccgacccgaactccacccgcacccccgcc

SEQ ID NO: 21683 - DNA, 906 bp, Artificial Sequence
  chemically treated genomic DNA (Homo sapiens) CpG-island No: 21683
ttgtttttaaatggttggggtacggagggaaaggaggacgcgagggtgtgttatttaatttcgtagagtgaagtcgaggttttaaggatcgtcgaggaaatcgcggttgggtcggttagattcgacgtacggaatgcgatttttaggtttttatcgtgttttcggttcggtgttcggcgtttaagggggtggggaggatcgaaaagttgtttttcgaggttgtttcgtcgtcggggaagttcgtggtttaggttttacgcgttaggcgttttttcggagtttagtcgagtcgggttcgggcgcgtaattcgcggcgtttcgtttttagtcggggacgtggtttttcgtttttcgttcgcgtcgggatagtttcgaaggttattcgttcgaaattttcgaagaaagttgcgtcgcgcgttttagttcgttttttgcgcgtttttttatttatcgtttttagtcgaggtttcgtttttttcggcgtcgttttcgtagtttttagagttagttttcggttttttttattttagggcgttcgggttttcggtttttttcgaatcgagtttttcgcgttttcgtcgcgttatgtttcgggatgcgttgttgtagtttcgggcgacgttattgagagtcgggtcggcgggggcgggtaggtgtgggcgaaaggggcggagggagggacgcggcgggcgttgaggtttcgttggaggggggaggaaatcgtaacgttattagagttagaggagacgaggatgaggagagggaaacggggattttttttttcggtcgaatttcgatcgtaggttcgtttcgttttttttcgttttttttttttcgggattcgtcgttcgtagttgtgttcggttttttacgttattcggttcggattttattcgtattttcgtt

SEQ ID NO: 21684 - DNA, 906 bp, Artificial Sequence
  chemically treated genomic DNA (Homo sapiens) CpG-island No: 21684
aacgaaaatacgaataaaatccgaaccgaataacgtaaaaaaccgaacacaactacgaacgacgaatcccgaaaaaaaaaaaacgaaaaaaaacgaaacgaacctacgatcgaaattcgaccgaaaaaaaaaatccccgtttccctctcctcatcctcgtctcctctaactctaataacgttacgatttcctcccccctccaacgaaacctcaacgcccgccgcgtccctccctccgcccctttcgcccacacctacccgcccccgccgacccgactctcaataacgtcgcccgaaactacaacaacgcatcccgaaacataacgcgacgaaaacgcgaaaaactcgattcgaaaaaaaccgaaaacccgaacgccctaaaataaaaaaaaccgaaaactaactctaaaaactacgaaaacgacgccgaaaaaaacgaaacctcgactaaaaacgataaataaaaaaacgcgcaaaaaacgaactaaaacgcgcgacgcaactttcttcgaaaatttcgaacgaataaccttcgaaactatcccgacgcgaacgaaaaacgaaaaaccacgtccccgactaaaaacgaaacgccgcgaattacgcgcccgaacccgactcgactaaactccgaaaaaacgcctaacgcgtaaaacctaaaccacgaacttccccgacgacgaaacaacctcgaaaaacaacttttcgatcctccccacccccttaaacgccgaacaccgaaccgaaaacacgataaaaacctaaaaatcgcattccgtacgtcgaatctaaccgacccaaccgcgatttcctcgacgatccttaaaacctcgacttcactctacgaaattaaataacacaccctcgcgtcctcctttccctccgtaccccaaccatttaaaaacaa

SEQ ID NO: 21685 - DNA, 677 bp, Artificial Sequence
  chemically treated genomic DNA (Homo sapiens) CpG-island No: 21685
gcgacgtttcgggggacgaggtttatggagaagtttcgggcggtgttggatttgtacgttaagtattatagcgttttgggttacggtttggtgattttgttgacggcgggcggggagcgtatttttttcgtcgtggtattttagtgttcgtgtagcgtcgtttggaatttgttttacggtttggtttttttgttggtgtcggcgttcgcgtttttttttttgggttacgtgttgagcgtacgtacgtggcgtttgtttatcggatgttgttttagcgttcgcgcgagttgcggatcggcgttgcgcggttttttggtgtgtacgtaaattagcgcggtcgtcgcgttcgcgttttttatttgggtggtcgtggcgttgttcgggggcgttttttacgagtgcgcggttatcgggagcgcggttttcgcgtagcgtttgtgtttcggtcgtaatcgtagttgcgtcgcggagttgtcgttggtgtcgtgtaattaggttaaggcgtcggacgtgtaggattttttgaaggatttgaaggtttagtcgtaggtttgtcgttggcgttgggggcgtttgggaggagtcgagaggtcgagtttttttagggtcgttggggtgagggaaaaatcggtgatttttttttagatatatagtattttaagaaaatttagaatggt

SEQ ID NO: 21686 - DNA, 677 bp, Artificial Sequence
  chemically treated genomic DNA (Homo sapiens) CpG-island No: 21686
accattctaaattttcttaaaatactatatatctaaaaaaaaatcaccgatttttccctcaccccaacgaccctaaaaaaactcgacctctcgactcctcccaaacgcccccaacgccaacgacaaacctacgactaaaccttcaaatccttcaaaaaatcctacacgtccgacgccttaacctaattacacgacaccaacgacaactccgcgacgcaactacgattacgaccgaaacacaaacgctacgcgaaaaccgcgctcccgataaccgcgcactcgtaaaaaacgcccccgaacaacgccacgaccacccaaataaaaaacgcgaacgcgacgaccgcgctaatttacgtacacaccaaaaaaccgcgcaacgccgatccgcaactcgcgcgaacgctaaaacaacatccgataaacaaacgccacgtacgtacgctcaacacgtaacccaaaaaaaaaaacgcgaacgccgacaccaacaaaaaaaccaaaccgtaaaacaaattccaaacgacgctacacgaacactaaaataccacgacgaaaaaaatacgctccccgcccgccgtcaacaaaatcaccaaaccgtaacccaaaacgctataatacttaacgtacaaatccaacaccgcccgaaacttctccataaacctcgtcccccgaaacgtcgc

SEQ ID NO: 21687 - DNA, 677 bp, Artificial Sequence
  chemically treated genomic DNA (Homo sapiens) CpG-island No: 21687
gttattttagatttttttagggtattgtatatttggagaaaagttatcgattttttttttattttagcggttttgagaaagttcggtttttcggttttttttaaacgtttttagcgttagcggtagatttgcgattgagtttttagattttttaggaggttttgtacgttcgacgttttggtttggttgtacggtattagcggtagtttcgcggcgtagttgcggttgcggtcgaggtataggcgttgcgcgaaggtcgcgttttcggtggtcgcgtattcgtaaaaggcgttttcgagtagcgttacggttatttaggtgaggggcgcgagcgcggcggtcgcgttgatttgcgtgtatattagggagtcgcgtagcgtcgattcgtaattcgcgcgggcgttggagtagtattcggtgagtaggcgttacgtgcgtgcgtttagtacgtagtttaggaggaagagcgcgagcgtcggtattagtaagaagattaggtcgtagggtaggttttaggcggcgttgtacgggtattggaatgttacggcggagaagatgcgtttttcgttcgtcgttagtagggttattaggtcgtagtttaaggcgttgtggtgtttgacgtgtaggtttagtatcgttcgaaatttttttatgagtttcgtttttcggggcgtcgt

SEQ ID NO: 21688 - DNA, 677 bp, Artificial Sequence
  chemically treated genomic DNA (Homo sapiens) CpG-island No: 21688
acgacgccccgaaaaacgaaactcataaaaaaatttcgaacgatactaaacctacacgtcaaacaccacaacgccttaaactacgacctaataaccctactaacgacgaacgaaaaacgcatcttctccgccgtaacattccaatacccgtacaacgccgcctaaaacctaccctacgacctaatcttcttactaataccgacgctcgcgctcttcctcctaaactacgtactaaacgcacgcacgtaacgcctactcaccgaatactactccaacgcccgcgcgaattacgaatcgacgctacgcgactccctaatatacacgcaaatcaacgcgaccgccgcgctcgcgcccctcacctaaataaccgtaacgctactcgaaaacgccttttacgaatacgcgaccaccgaaaacgcgaccttcgcgcaacgcctatacctcgaccgcaaccgcaactacgccgcgaaactaccgctaataccgtacaaccaaaccaaaacgtcgaacgtacaaaacctcctaaaaaatctaaaaactcaatcgcaaatctaccgctaacgctaaaaacgtttaaaaaaaaccgaaaaaccgaactttctcaaaaccgctaaaataaaaaaaaaatcgataacttttctccaaatatacaataccctaaaaaaatctaaaataac

SEQ ID NO: 21689 - DNA, 505 bp, Artificial Sequence
  chemically treated genomic DNA (Homo sapiens) CpG-island No: 21689
tttttcgtcgttcgttttttttttgtttcgcgcgtttttttcgtgtcgtcgtcgtcgttcgtttttttgattttttatttatgtttagcggacggttcggagtagtgtgagttagtgtagagatcgcgatatcggagaggttcgtatatttgtttcgattataacgcgatagtgaggagagggggcggtggattcgaaatttcgcggttttgcgttcgtttaggtcgattagttttttgttttttttcgtaggaagatattttagattgtggtcgcggggtttttttttcgtcgtcgttgggcgttttggtttttttgtaattgttgttttttttgggtttgtcgtttcggtcgtagttttaagttttcgtttacgtttttcgtcgtttttgagtattttgttttattttatttttatttttattttattcggttttttcgttttttttatttttttgttttatatttttcgttttagagtttcgttttttttttattgaaggat

SEQ ID NO: 21690 - DNA, 505 bp, Artificial Sequence
  chemically treated genomic DNA (Homo sapiens) CpG-island No: 21690
atccttcaataaaaaaaaaacgaaactctaaaacgaaaaatataaaacaaaaaaataaaaaaaacgaaaaaaccgaataaaataaaaataaaaataaaataaaacaaaatactcaaaaacgacgaaaaacgtaaacgaaaacttaaaactacgaccgaaacgacaaacccaaaaaaaacaacaattacaaaaaaaccaaaacgcccaacgacgacgaaaaaaaaaccccgcgaccacaatctaaaatatcttcctacgaaaaaaaacaaaaaactaatcgacctaaacgaacgcaaaaccgcgaaatttcgaatccaccgccccctctcctcactatcgcgttataatcgaaacaaatatacgaacctctccgatatcgcgatctctacactaactcacactactccgaaccgtccgctaaacataaataaaaaatcaaaaaaacgaacgacgacgacgacacgaaaaaaacgcgcgaaacaaaaaaaaaacgaacgacgaaaaa

SEQ ID NO: 21691 - DNA, 505 bp, Artificial Sequence
  chemically treated genomic DNA (Homo sapiens) CpG-island No: 21691
gttttttagtgagggagggacgaggttttaaggcggggagtgtggggtaggagggtgggaaaggcgaagaggtcgggtgaggtgggagtggaggtggggtggggtagggtgtttagaggcggcgagaggcgtggacgaggatttgaggttgcggtcggggcggtaggtttaggaggagtagtagttgtagggagattaggacgtttagcgacggcgggaaggaggtttcgcggttatagtttgaggtatttttttgcggggagagataaggagttggtcggtttgggcgggcgtaaggtcgcgggatttcgggtttatcgttttttttttttattgtcgcgttgtagtcgaagtagatgtgcgggttttttcggtatcgcggtttttgtattagtttatattgtttcgggtcgttcgttgggtatgggtggggagttaaggaggcggacggcggcggcggtacggagggggcgcgcggggtagagggggagcgggcggcggggag

SEQ ID NO: 21692 - DNA, 505 bp, Artificial Sequence
  chemically treated genomic DNA (Homo sapiens) CpG-island No: 21692
ctccccgccgcccgctccccctctaccccgcgcgccccctccgtaccgccgccgccgtccgcctccttaactccccacccatacccaacgaacgacccgaaacaatataaactaatacaaaaaccgcgataccgaaaaaacccgcacatctacttcgactacaacgcgacaataaaaaaaaaaaacgataaacccgaaatcccgcgaccttacgcccgcccaaaccgaccaactccttatctctccccgcaaaaaaatacctcaaactataaccgcgaaacctccttcccgccgtcgctaaacgtcctaatctccctacaactactactcctcctaaacctaccgccccgaccgcaacctcaaatcctcgtccacgcctctcgccgcctctaaacaccctaccccaccccacctccactcccacctcacccgacctcttcgcctttcccaccctcctaccccacactccccgccttaaaacctcgtccctccctcactaaaaaac

SEQ ID NO: 21693 - DNA, 738 bp, Artificial Sequence
  chemically treated genomic DNA (Homo sapiens) CpG-island No: 21693
gggcggtttcgggcggcgcggtgggtcgagcgcgggtttcgtttttttgaggcgggttcgggcggggcggttgtatattagggtcgcgttgagttgcgttagttgaggtgtgagtagttgtcgaagttagttttttgtggagtcggagttgggcgcggattcgtcgaggtatcgaggtatttagaggaggtgagagagcggcggtagataataggggatttcgggtcggcggtttagagtcgagttaagcgtgttcgcgtgtgtttttgcgtgttcgcgaggatgcgtgttcgcgggtgtgtgttgcgtttataggtgtttttgcggtaggtgaatgacgggcgtgggtcggtgcgcgttcggtttgcgtatacggtgtttttaagtgcgcgggtgacgagagtcgggatgtgtcggagatttcggggcggagagcgggattataagtataggaatttttggttacgtttttcgtttttggaaatttagttggggcgagggagggcgtggacgggatcgttttgggagttcgtttttggttgcggttggttttaggttttaggcgtagtttgttcgcggcgtggggatgaagttcgtgtttttggaggggtttaggaagggcgaggaaagcggagtggagtaagttcgtttaggatcggtttcgggtggttttgggatttaatttgcgtcgttttggtttaggttttaggtttaggttttttacgttattgtgtttat

SEQ ID NO: 21694 - DNA, 738 bp, Artificial Sequence
  chemically treated genomic DNA (Homo sapiens) CpG-island No: 21694
ataaacacaataacgtaaaaaacctaaacctaaaacctaaaccaaaacgacgcaaattaaatcccaaaaccacccgaaaccgatcctaaacgaacttactccactccgctttcctcgcccttcctaaacccctccaaaaacacgaacttcatccccacgccgcgaacaaactacgcctaaaacctaaaaccaaccgcaaccaaaaacgaactcccaaaacgatcccgtccacgccctccctcgccccaactaaatttccaaaaacgaaaaacgtaaccaaaaattcctatacttataatcccgctctccgccccgaaatctccgacacatcccgactctcgtcacccgcgcacttaaaaacaccgtatacgcaaaccgaacgcgcaccgacccacgcccgtcattcacctaccgcaaaaacacctataaacgcaacacacacccgcgaacacgcatcctcgcgaacacgcaaaaacacacgcgaacacgcttaactcgactctaaaccgccgacccgaaatcccctattatctaccgccgctctctcacctcctctaaatacctcgatacctcgacgaatccgcgcccaactccgactccacaaaaaactaacttcgacaactactcacacctcaactaacgcaactcaacgcgaccctaatatacaaccgccccgcccgaacccgcctcaaaaaaacgaaacccgcgctcgacccaccgcgccgcccgaaaccgccc

SEQ ID NO: 21695 - DNA, 738 bp, Artificial Sequence
  chemically treated genomic DNA (Homo sapiens) CpG-island No: 21695
gtggatatagtggcgtaaaggatttgaatttgggatttgggttagggcggcgtagattggattttagagttattcgggatcgattttagacgaatttattttatttcgtttttttcgttttttttgggtttttttagggatacggattttatttttacgtcgcgagtaaattgcgtttggggtttggagttaatcgtagttaaaggcgagtttttagaacggtttcgtttacgttttttttcgttttagttgggtttttaggggcggggagcgtgattagggatttttgtatttgtaatttcgtttttcgtttcggggttttcggtatatttcgattttcgttattcgcgtatttagagatatcgtgtgcgtaagtcgagcgcgtatcgatttacgttcgttatttatttgtcgtagaaatatttgtgaacgtagtatatattcgcgaatacgtattttcgcggatacgtagggatatacgcgggtacgtttggttcggttttgggtcgtcggttcggggttttttgttgtttgtcgtcgtttttttattttttttgagtgtttcggtgtttcggcgaattcgcgtttagtttcggttttataaggaattgatttcggtagttgtttatattttagttggcgtagtttagcgcggttttgatatataatcgtttcgttcgggttcgttttaaggaggcgggattcgcgttcggtttatcgcgtcgttcgggatcgttt

SEQ ID NO: 21696 - DNA, 738 bp, Artificial Sequence
  chemically treated genomic DNA (Homo sapiens) CpG-island No: 21696
aaacgatcccgaacgacgcgataaaccgaacgcgaatcccgcctccttaaaacgaacccgaacgaaacgattatatatcaaaaccgcgctaaactacgccaactaaaatataaacaactaccgaaatcaattccttataaaaccgaaactaaacgcgaattcgccgaaacaccgaaacactcaaaaaaaataaaaaaacgacgacaaacaacaaaaaaccccgaaccgacgacccaaaaccgaaccaaacgtacccgcgtatatccctacgtatccgcgaaaatacgtattcgcgaatatatactacgttcacaaatatttctacgacaaataaataacgaacgtaaatcgatacgcgctcgacttacgcacacgatatctctaaatacgcgaataacgaaaatcgaaatataccgaaaaccccgaaacgaaaaacgaaattacaaatacaaaaatccctaatcacgctccccgcccctaaaaacccaactaaaacgaaaaaaaacgtaaacgaaaccgttctaaaaactcgcctttaactacgattaactccaaaccccaaacgcaatttactcgcgacgtaaaaataaaatccgtatccctaaaaaaacccaaaaaaaacgaaaaaaacgaaataaaataaattcgtctaaaatcgatcccgaataactctaaaatccaatctacgccgccctaacccaaatcccaaattcaaatcctttacgccactatatccac

SEQ ID NO: 21697 - DNA, 564 bp, Artificial Sequence
  chemically treated genomic DNA (Homo sapiens) CpG-island No: 21697
gggaaacgcggagtcgtggagaggggtattaggagagggacgcgcgtttgtgggtagaggtagaggggatgtagaagatagggagaggggcgtgaggagcgggaggcgtcggatggggcgttggcggcgggggtggcggggcgtcggtagcgcggagttcgagcgttcgggttgcgtcgtttttttttgggttttggcgtcggcggcgacggggttgagacgcggttgcgagcgttattttttcggttcgggtttcggtttcggggcgttcgggttgcgggaaaattaaatttgttcgaagtcgtagtttttcgtcgttcgggaacgttagagggggcgttcgtaggggtcggggcggggtcgcgggcggggtttgcgcgtagggtgagtgtgagcgtgtgtgtgtgcgcgtgtgtgtgtgtgtgcgcgcgtggcgggtcgggggacgcggtttagatgttggggacgtggcgggtgatagtaagaggtggttttggtcgcgcgtatttttatttgcgttcgtttttttttattatttttattttttattaggggtttttattt

SEQ ID NO: 21698 - DNA, 564 bp, Artificial Sequence
  chemically treated genomic DNA (Homo sapiens) CpG-island No: 21698
aaataaaaacccctaataaaaaataaaaataataaaaaaaaacgaacgcaaataaaaatacgcgcgaccaaaaccacctcttactatcacccgccacgtccccaacatctaaaccgcgtcccccgacccgccacgcgcgcacacacacacacacgcgcacacacacacgctcacactcaccctacgcgcaaaccccgcccgcgaccccgccccgacccctacgaacgccccctctaacgttcccgaacgacgaaaaactacgacttcgaacaaatttaattttcccgcaacccgaacgccccgaaaccgaaacccgaaccgaaaaaataacgctcgcaaccgcgtctcaaccccgtcgccgccgacgccaaaacccaaaaaaaaacgacgcaacccgaacgctcgaactccgcgctaccgacgccccgccacccccgccgccaacgccccatccgacgcctcccgctcctcacgcccctctccctatcttctacatcccctctacctctacccacaaacgcgcgtccctctcctaatacccctctccacgactccgcgtttccc

SEQ ID NO: 21699 - DNA, 564 bp, Artificial Sequence
  chemically treated genomic DNA (Homo sapiens) CpG-island No: 21699
ggatggagatttttgatgggagataggggtggtgagagggggcgggcgtaaatgaagatgcgcgcgattaggattattttttgttgttattcgttacgtttttagtatttggatcgcgtttttcggttcgttacgcgcgtatatatatatatacgcgtatatatatacgtttatatttattttgcgcgtagatttcgttcgcggtttcgtttcggtttttgcgggcgttttttttggcgttttcgggcggcgggaggttgcggtttcgggtagatttgattttttcgtagttcgggcgtttcggagtcgaagttcgagtcgaggaggtggcgttcgtagtcgcgttttagtttcgtcgtcgtcggcgttaagatttagggagaggcggcgtagttcgggcgttcgggtttcgcgttgtcggcgtttcgttattttcgtcgttagcgttttattcggcgtttttcgttttttacgtttttttttttgttttttgtattttttttatttttgtttatagacgcgcgttttttttttggtgtttttttttacgatttcgcgtttttt

SEQ ID NO: 21700 - DNA, 564 bp, Artificial Sequence
  chemically treated genomic DNA (Homo sapiens) CpG-island No: 21700
aaaaaacgcgaaatcgtaaaaaaaaacaccaaaaaaaaaacgcgcgtctataaacaaaaataaaaaaaatacaaaaaacaaaaaaaaaaacgtaaaaaacgaaaaacgccgaataaaacgctaacgacgaaaataacgaaacgccgacaacgcgaaacccgaacgcccgaactacgccgcctctccctaaatcttaacgccgacgacgacgaaactaaaacgcgactacgaacgccacctcctcgactcgaacttcgactccgaaacgcccgaactacgaaaaaatcaaatctacccgaaaccgcaacctcccgccgcccgaaaacgccaaaaaaaacgcccgcaaaaaccgaaacgaaaccgcgaacgaaatctacgcgcaaaataaatataaacgtatatatatacgcgtatatatatatatacgcgcgtaacgaaccgaaaaacgcgatccaaatactaaaaacgtaacgaataacaacaaaaaataatcctaatcgcgcgcatcttcatttacgcccgccccctctcaccacccctatctcccatcaaaaatctccatcc

SEQ ID NO: 21701 - DNA, 529 bp, Artificial Sequence
  chemically treated genomic DNA (Homo sapiens) CpG-island No: 21701
gatattttttttacgtcgtacgcgttttgtttttcgttttttttgattttattcggagcggattttttagttacgtattttgtagtcgttataggtgaggtcggcgttacgtttggttaagacgtattttatttttaggaagaaggagcgttcgattttatattttgggagagaggaacgaagggaagtttaggtcgtgtgatatcggcggcgtgggatagtacgcgtttttgttacgattaattggggaaaaattataagcggattgcgatgggtttgagcgtcgtaggtatgtgtttattttattttgtacgaagtgagagtggtagggttgatgggcggtgagtatcgtcgttatttcgtcgtggtttgtcgggtgaatgtatttataaatgttgttttcggttagttttatttgtaaagaggaggatgtcgtcgtcgtcgtggcggtggaatgttcggtgaagggattgaaagattaggttaggggatttgtaggattatgaggatagtagttagaattttggaa

SEQ ID NO: 21702 - DNA, 529 bp, Artificial Sequence
  chemically treated genomic DNA (Homo sapiens) CpG-island No: 21702
ttccaaaattctaactactatcctcataatcctacaaatcccctaacctaatctttcaatcccttcaccgaacattccaccgccacgacgacgacgacatcctcctctttacaaataaaactaaccgaaaacaacatttataaatacattcacccgacaaaccacgacgaaataacgacgatactcaccgcccatcaaccctaccactctcacttcgtacaaaataaaataaacacatacctacgacgctcaaacccatcgcaatccgcttataatttttccccaattaatcgtaacaaaaacgcgtactatcccacgccgccgatatcacacgacctaaacttcccttcgttcctctctcccaaaatataaaatcgaacgctccttcttcctaaaaataaaatacgtcttaaccaaacgtaacgccgacctcacctataacgactacaaaatacgtaactaaaaaatccgctccgaataaaatcaaaaaaaacgaaaaacaaaacgcgtacgacgtaaaaaaaatatc

SEQ ID NO: 21703 - DNA, 529 bp, Artificial Sequence
  chemically treated genomic DNA (Homo sapiens) CpG-island No: 21703
ttttagaattttggttgttgtttttatggttttgtagattttttggtttaattttttagtttttttatcgggtattttatcgttacggcgacggcgatatttttttttttataggtagagttgatcggaaatagtatttatgaatatatttattcggtagattacgacgagatgacggcggtgtttatcgtttattaattttattatttttatttcgtgtagggtaaggtagatatatgtttgcgacgtttaggtttatcgtagttcgtttgtggtttttttttaattagtcgtggtagagacgcgtgttgttttacgtcgtcggtgttatacgatttgagttttttttcgttttttttttttagagtatgagatcgagcgttttttttttttgaggatgaagtgcgttttggttaagcgtaacgtcggttttatttgtggcggttataaggtgcgtagttggaagattcgtttcgggtggagttagaggaggcgggaagtaaggcgcgtgcggcgtgggaggaatgtt

SEQ ID NO: 21704 - DNA, 529 bp, Artificial Sequence
  chemically treated genomic DNA (Homo sapiens) CpG-island No: 21704
aacattcctcccacgccgcacgcgccttacttcccgcctcctctaactccacccgaaacgaatcttccaactacgcaccttataaccgccacaaataaaaccgacgttacgcttaaccaaaacgcacttcatcctcaaaaaaaaaaaacgctcgatctcatactctaaaaaaaaaaaacgaaaaaaaactcaaatcgtataacaccgacgacgtaaaacaacacgcgtctctaccacgactaattaaaaaaaaaccacaaacgaactacgataaacctaaacgtcgcaaacatatatctaccttaccctacacgaaataaaaataataaaattaataaacgataaacaccgccgtcatctcgtcgtaatctaccgaataaatatattcataaatactatttccgatcaactctacctataaaaaaaaaaatatcgccgtcgccgtaacgataaaatacccgataaaaaaactaaaaaattaaaccaaaaaatctacaaaaccataaaaacaacaaccaaaattctaaaa

SEQ ID NO: 21705 - DNA, 1046 bp, Artificial Sequence
  chemically treated genomic DNA (Homo sapiens) CpG-island No: 21705
gtcgcgtgtagaatttcgtttggttttgtgttcgagacgggcggaggttggaatttgagattttaataaaggaagtagagtcgttgtcggtattgcgtgttattttatagcgcggcgggttcgtcgtaggttcgcggggtagttggcgggcgggggttttcggcggggttgtcgttatggtaatcggcggcgtttatagtcgttttcggggcggtttttttagtgtttttcgtagaggtttttttcggggcgggttaaaggaggttattttcggggttcgtttcggttttcggtcgttgttacgacgacgaagttgtcggttaatggttggcggatgggtttaaggttttcggcgtgtagcgcggttgtttgagggcggtaggtttatggcgtcggcgtcgcggttgttcgcgttttgggcgttggcggttgtggttttattcggtttcggggcggagggcgacggcgggtggtgagcggttcgggaggggtcgggcggtggggttacgtgcggcgggcggggcgcgggttgatttagttgtgttcgtaggcgttcgggcgggtcgggggtcgtggcggaggaggagcgttgtacggtggagcgtcgggtcgattttatttacgcggagttcgtgtagtagtacgtgcgtttttgatcgcggaggtcgcgttttgtttatcggttcgtttgtttcgatcgtttaaggtcgtttttttttgatttcgcgcgtacgcgtggggttggggcggcgaggttggcggttcggtttggtcgcgattttgtttttttttttaggtacgttttcgttaggttcgttattttgtagggatttacggataattcggtgagcgcgtgttcgttcgttttcggttattttcgttcgtgttgggttcggttattaagtttttttttcgttttcgtagaggtttcgggttttgtgttttcgcgataggttgttggtttcgtttggggatagagtggttcggttgagtatcgttaatatttatttttattataaaggtacgcggttttatttttggggttt

SEQ ID NO: 21706 - DNA, 1046 bp, Artificial Sequence
  chemically treated genomic DNA (Homo sapiens) CpG-island No: 21706
aaaccccaaaaataaaaccgcgtacctttataataaaaataaatattaacgatactcaaccgaaccactctatccccaaacgaaaccaacaacctatcgcgaaaacacaaaacccgaaacctctacgaaaacgaaaaaaaaacttaataaccgaacccaacacgaacgaaaataaccgaaaacgaacgaacacgcgctcaccgaattatccgtaaatccctacaaaataacgaacctaacgaaaacgtacctaaaaaaaaaaacaaaatcgcgaccaaaccgaaccgccaacctcgccgccccaaccccacgcgtacgcgcgaaatcaaaaaaaaacgaccttaaacgatcgaaacaaacgaaccgataaacaaaacgcgacctccgcgatcaaaaacgcacgtactactacacgaactccgcgtaaataaaatcgacccgacgctccaccgtacaacgctcctcctccgccacgacccccgacccgcccgaacgcctacgaacacaactaaatcaacccgcgccccgcccgccgcacgtaaccccaccgcccgacccctcccgaaccgctcaccacccgccgtcgccctccgccccgaaaccgaataaaaccacaaccgccaacgcccaaaacgcgaacaaccgcgacgccgacgccataaacctaccgccctcaaacaaccgcgctacacgccgaaaaccttaaacccatccgccaaccattaaccgacaacttcgtcgtcgtaacaacgaccgaaaaccgaaacgaaccccgaaaataacctcctttaacccgccccgaaaaaaacctctacgaaaaacactaaaaaaaccgccccgaaaacgactataaacgccgccgattaccataacgacaaccccgccgaaaacccccgcccgccaactaccccgcgaacctacgacgaacccgccgcgctataaaataacacgcaataccgacaacgactctacttcctttattaaaatctcaaattccaacctccgcccgtctcgaacacaaaaccaaacgaaattctacacgcgac

SEQ ID NO: 21707 - DNA, 1046 bp, Artificial Sequence
  chemically treated genomic DNA (Homo sapiens) CpG-island No: 21707
gggttttaggggtgaggtcgcgtatttttgtggtaggagtaggtgttggcggtgtttagtcggattattttgtttttaaacgaagttagtaatttgtcgcgggagtatagggttcggaatttttgcgggggcggggaggggatttagtggtcgggtttagtacgggcgagagtggtcggggacggacgggtacgcgtttatcgagttgttcgtgagtttttgtaggatgacgggtttgacgaaggcgtatttggaaagaagggtagagtcgcggttaggtcggatcgttagtttcgtcgttttagttttacgcgtgcgcgcgaggttaggggaaggcggttttgggcggtcggggtagacgggtcggtgaataggacgcgattttcgcgattaggggcgtacgtattgttgtacgaatttcgcgtaggtgaggtcggttcgacgttttatcgtgtagcgtttttttttcgttacggttttcggttcgttcgggcgtttgcgggtatagttgggttagttcgcgtttcgttcgtcgtacgtgattttatcgttcggtttttttcgggtcgtttattattcgtcgtcgtttttcgtttcggagtcgggtagagttatagtcgttagcgtttagagcgcgagtaatcgcgacgtcggcgttatgagtttgtcgtttttaggtagtcgcgttgtacgtcgggaattttgggtttattcgttagttattggtcggtagtttcgtcgtcgtggtaacggtcgggaatcgggacggatttcggaagtgattttttttggttcgtttcggaagaggtttttacgggaggtattgggaaggtcgtttcgagagcgattatgggcgtcgtcggttattatggcgataatttcgtcgaaagttttcgttcgttagttgtttcgcgggtttacggcgagttcgtcgcgttatggggtgatacgtagtgtcgatagcggttttattttttttattgaggttttaagttttagttttcgttcgtttcgggtataagattaggcggggttttgtacgcggt

SEQ ID NO: 21708 - DNA, 1046 bp, Artificial Sequence
  chemically treated genomic DNA (Homo sapiens) CpG-island No: 21708
accgcgtacaaaaccccgcctaatcttatacccgaaacgaacgaaaactaaaacttaaaacctcaataaaaaaaataaaaccgctatcgacactacgtatcaccccataacgcgacgaactcgccgtaaacccgcgaaacaactaacgaacgaaaactttcgacgaaattatcgccataataaccgacgacgcccataatcgctctcgaaacgaccttcccaatacctcccgtaaaaacctcttccgaaacgaaccaaaaaaaatcacttccgaaatccgtcccgattcccgaccgttaccacgacgacgaaactaccgaccaataactaacgaataaacccaaaattcccgacgtacaacgcgactacctaaaaacgacaaactcataacgccgacgtcgcgattactcgcgctctaaacgctaacgactataactctacccgactccgaaacgaaaaacgacgacgaataataaacgacccgaaaaaaaccgaacgataaaatcacgtacgacgaacgaaacgcgaactaacccaactatacccgcaaacgcccgaacgaaccgaaaaccgtaacgaaaaaaaaacgctacacgataaaacgtcgaaccgacctcacctacgcgaaattcgtacaacaatacgtacgcccctaatcgcgaaaatcgcgtcctattcaccgacccgtctaccccgaccgcccaaaaccgccttcccctaacctcgcgcgcacgcgtaaaactaaaacgacgaaactaacgatccgacctaaccgcgactctacccttctttccaaatacgccttcgtcaaacccgtcatcctacaaaaactcacgaacaactcgataaacgcgtacccgtccgtccccgaccactctcgcccgtactaaacccgaccactaaatcccctccccgcccccgcaaaaattccgaaccctatactcccgcgacaaattactaacttcgtttaaaaacaaaataatccgactaaacaccgccaacacctactcctaccacaaaaatacgcgacctcacccctaaaaccc

SEQ ID NO: 21709 - DNA, 812 bp, Artificial Sequence
  chemically treated genomic DNA (Homo sapiens) CpG-island No: 21709
attcggcgttgggttcgagaattacggttgggttttgggagtcgaggatacgtttcgaagaggagttagattttcggtggggtcggtcgggttcgggttcggtttttttcggtgttatcgtcgtcgtttttttcgcgcgggcgtatttacgatcgcgcggtcgtagtaggtcgtcgttttcgggtattttcggtttacgaatagacgattgttttgttttttgagtttttgcgcgttcgggtttttttcggggttttcgtcgttagcgtttagtcgtgcgtcgtttttttttttttttttgttttttatggcgtcgcgcggtacggtttgggtttcgtttttaagtttcgcgtttcgcggtttagcgttcgtagtcggagtttcgtagttcgagttcgcgattcgttcgggttcggtttagtttcgtcgtcggaattttcggtcgggggcgggattagcggggacgtacgcgtgggggcgagtggggtcgcgcgtgcgtttaattagtttggacggggatattgggttcgcgacgtcgggggttgggaggaacgttttagttttttgttttcgcgtttttaagggtgggcgttcgcgtaggttttggtttgttttgttgaggttttttcggaattcgtttcggcggcggtcgttatatatattcgatttttttagtgagatgttttatttgtttcgttgagggcgcgttttcgtaatagtttgtttcgattatttggggtttcgtttttgttttaacgcgtagagatttttttttcggtagtcggttttatttagaggtttcgtttttagta

SEQ ID NO: 21710 - DNA, 812 bp, Artificial Sequence
  chemically treated genomic DNA (Homo sapiens) CpG-island No: 21710
tactaaaaacgaaacctctaaataaaaccgactaccgaaaaaaaaatctctacgcgttaaaacaaaaacgaaaccccaaataatcgaaacaaactattacgaaaacgcgccctcaacgaaacaaataaaacatctcactaaaaaaatcgaatatatataacgaccgccgccgaaacgaattccgaaaaaacctcaacaaaacaaaccaaaacctacgcgaacgcccacccttaaaaacgcgaaaacaaaaaactaaaacgttcctcccaacccccgacgtcgcgaacccaatatccccgtccaaactaattaaacgcacgcgcgaccccactcgcccccacgcgtacgtccccgctaatcccgcccccgaccgaaaattccgacgacgaaactaaaccgaacccgaacgaatcgcgaactcgaactacgaaactccgactacgaacgctaaaccgcgaaacgcgaaacttaaaaacgaaacccaaaccgtaccgcgcgacgccataaaaaacaaaaaaaaaaaaaaaaacgacgcacgactaaacgctaacgacgaaaaccccgaaaaaaacccgaacgcgcaaaaactcaaaaaacaaaacaatcgtctattcgtaaaccgaaaatacccgaaaacgacgacctactacgaccgcgcgatcgtaaatacgcccgcgcgaaaaaaacgacgacgataacaccgaaaaaaaccgaacccgaacccgaccgaccccaccgaaaatctaactcctcttcgaaacgtatcctcgactcccaaaacccaaccgtaattctcgaacccaacgccgaat

SEQ ID NO: 21711 - DNA, 812 bp, Artificial Sequence
  chemically treated genomic DNA (Homo sapiens) CpG-island No: 21711
tgttgggggcggggtttttggatggggtcggttgtcgggggaggggtttttgcgcgttgggataggggcggaattttaggtggtcgggataggttgttgcgggagcgcgtttttagcgaagtaagtgaggtattttattgggaaagtcgaatgtgtgtggcggtcgtcgtcgaggcgggtttcgaagagattttagtagggtaggttagggtttacgcgaacgtttatttttaagagcgcggggatagggaattggagcgttttttttagttttcgacgtcgcgggtttagtgttttcgtttaggttggttgggcgtacgcgcggttttattcgtttttacgcgtgcgttttcgttggtttcgttttcggtcggaagtttcggcggcggagttgggtcgggttcgagcggatcgcgggttcgggttgcggggtttcggttgcgggcgttgggtcgcgaggcgcggagtttgggagcggagtttaggtcgtgtcgcgcggcgttatgaagggtaaggaggagaaggagggcggcgtacggttgggcgttggcggcggaagtttcgagaagagttcgagcgcgtaggagtttaaggagtagggtaatcgtttgttcgtgggtcgaaagtattcggaggcggcggtttgttacggtcgcgcgatcgtgagtgcgttcgcgcggggagggcggcggcggtggtatcggggagggtcgggttcgggttcggtcggttttatcgagggtttggttttttttcggggcgtgttttcggtttttaaagtttagtcgtggttttcgagtttagcgtcgggt

SEQ ID NO: 21712 - DNA, 812 bp, Artificial Sequence
  chemically treated genomic DNA (Homo sapiens) CpG-island No: 21712
acccgacgctaaactcgaaaaccacgactaaactttaaaaaccgaaaacacgccccgaaaaaaaaccaaaccctcgataaaaccgaccgaacccgaacccgaccctccccgataccaccgccgccgccctccccgcgcgaacgcactcacgatcgcgcgaccgtaacaaaccgccgcctccgaatactttcgacccacgaacaaacgattaccctactccttaaactcctacgcgctcgaactcttctcgaaacttccgccgccaacgcccaaccgtacgccgccctccttctcctccttacccttcataacgccgcgcgacacgacctaaactccgctcccaaactccgcgcctcgcgacccaacgcccgcaaccgaaaccccgcaacccgaacccgcgatccgctcgaacccgacccaactccgccgccgaaacttccgaccgaaaacgaaaccaacgaaaacgcacgcgtaaaaacgaataaaaccgcgcgtacgcccaaccaacctaaacgaaaacactaaacccgcgacgtcgaaaactaaaaaaaacgctccaattccctatccccgcgctcttaaaaataaacgttcgcgtaaaccctaacctaccctactaaaatctcttcgaaacccgcctcgacgacgaccgccacacacattcgactttcccaataaaatacctcacttacttcgctaaaaacgcgctcccgcaacaacctatcccgaccacctaaaattccgcccctatcccaacgcgcaaaaacccctcccccgacaaccgaccccatccaaaaaccccgcccccaaca

SEQ ID NO: 21713 - DNA, 875 bp, Artificial Sequence
  chemically treated genomic DNA (Homo sapiens) CpG-island No: 21713
aagcggattaggtcgagttcgcgtttagtttttttttcgtttcgcgtattacgggtattttgtggattttttttcgtagtttttcgttcgtttgttcggtttttagggggataaagagattttattgcggatttagtaggttcgtcggatcgttgcgggtcgggttttcgggaggttacggtcgttatttgagtagtttacgatgtgggtgggtatttttttcggggtgacgttcgcggggatggtgatttttttcgcgcggggagggatttgtaagggattcgcgcgtttattagggattttcggttgggttcgtttttattttcgcggcgggcgtgttttttattttttcggggaatttttcgtttattagggataggattagcgacgttttttttatttgggttgcgcggggcgaggcggttagcgcgagggttaaggttacggcgtttttcgattttcgagatttttatttcgttttacggtcgtcgtagtttcgagattttcgggtcggcgtttattttcgtttagtaataggatgcgtacgtttcgttttatagttgtcgttcggagtcgtttttcgattcggaattcggtttcgatttggtttttaagtttttcgttttgttttcgcgttcgtttcgtattttcggttttcggtttcgcgttgtttttatattttcggtttcgttcgtatagtcgtattagcgagtcgggcgggttagagcggataggttgtgcggcgcgttatcgtgtggacgcgtcggttacggcggatagcgtagggttttggcgttttggtaggtcgagcggttattgttttacggtattataggggttttgataaatagtcgattaagggacgggtagaggtt

SEQ ID NO: 21714 - DNA, 875 bp, Artificial Sequence
  chemically treated genomic DNA (Homo sapiens) CpG-island No: 21714
aacctctacccgtcccttaatcgactatttatcaaaacccctataataccgtaaaacaataaccgctcgacctaccaaaacgccaaaaccctacgctatccgccgtaaccgacgcgtccacacgataacgcgccgcacaacctatccgctctaacccgcccgactcgctaatacgactatacgaacgaaaccgaaaatataaaaacaacgcgaaaccgaaaaccgaaaatacgaaacgaacgcgaaaacaaaacgaaaaacttaaaaaccaaatcgaaaccgaattccgaatcgaaaaacgactccgaacgacaactataaaacgaaacgtacgcatcctattactaaacgaaaataaacgccgacccgaaaatctcgaaactacgacgaccgtaaaacgaaataaaaatctcgaaaatcgaaaaacgccgtaaccttaaccctcgcgctaaccgcctcgccccgcgcaacccaaataaaaaaaacgtcgctaatcctatccctaataaacgaaaaattccccgaaaaaataaaaaacacgcccgccgcgaaaataaaaacgaacccaaccgaaaatccctaataaacgcgcgaatcccttacaaatccctccccgcgcgaaaaaaatcaccatccccgcgaacgtcaccccgaaaaaaatacccacccacatcgtaaactactcaaataacgaccgtaacctcccgaaaacccgacccgcaacgatccgacgaacctactaaatccgcaataaaatctctttatccccctaaaaaccgaacaaacgaacgaaaaactacgaaaaaaaatccacaaaatacccgtaatacgcgaaacgaaaaaaaaactaaacgcgaactcgacctaatccgctt

SEQ ID NO: 21715 - DNA, 875 bp, Artificial Sequence
  chemically treated genomic DNA (Homo sapiens) CpG-island No: 21715
agtttttgttcgttttttaatcggttgtttgttaaggtttttgtggtgtcgtgaagtaatggtcgttcggtttgttagggcgttaggattttgcgttgttcgtcgtggtcggcgcgtttatacggtggcgcgtcgtatagtttgttcgttttggttcgttcggttcgttggtgcggttgtgcgggcggggtcggaagtgtggggatagcgcggggtcgagaatcggaagtgcggggcgggcgcgggggtagagcgaaaggtttgaggattaggtcggggtcgggtttcgggtcggggagcggtttcgggcggtagttatgaggcgggacgtgcgtattttgttattgggcgagggtaggcgtcggttcgggggtttcggagttgcggcggtcgtgaggcggggtgagggtttcgggggtcggggggcgtcgtgattttggttttcgcgttgatcgtttcgtttcgcgtagtttaggtggggaagacgtcgttgattttgtttttggtgggcgaggagtttttcgaggaggtaaggggtacgttcgtcgcgggggtgggagcgggtttagtcgggggtttttggtgagcgcgcgggttttttgtaggttttttttcgcgcggaggagattattattttcgcggacgttatttcggagaaggtgtttatttatatcgtggattatttaggtagcggtcgtagtttttcgggggttcggttcgtagcggttcggcgggtttgttgggttcgtagtggagtttttttgtttttttagaagtcgagtagacggacgaggagttgcgggaggagatttataaggtattcgtggtgcgcgggacgagggaggggttgggcgcgggttcggtttaattcgttt

SEQ ID NO: 21716 - DNA, 875 bp, Artificial Sequence
  chemically treated genomic DNA (Homo sapiens) CpG-island No: 21716
aaacgaattaaaccgaacccgcgcccaacccctccctcgtcccgcgcaccacgaataccttataaatctcctcccgcaactcctcgtccgtctactcgacttctaaaaaaacaaaaaaactccactacgaacccaacaaacccgccgaaccgctacgaaccgaacccccgaaaaactacgaccgctacctaaataatccacgatataaataaacaccttctccgaaataacgtccgcgaaaataataatctcctccgcgcgaaaaaaaacctacaaaaaacccgcgcgctcaccaaaaacccccgactaaacccgctcccacccccgcgacgaacgtaccccttacctcctcgaaaaactcctcgcccaccaaaaacaaaatcaacgacgtcttccccacctaaactacgcgaaacgaaacgatcaacgcgaaaaccaaaatcacgacgccccccgacccccgaaaccctcaccccgcctcacgaccgccgcaactccgaaacccccgaaccgacgcctaccctcgcccaataacaaaatacgcacgtcccgcctcataactaccgcccgaaaccgctccccgacccgaaacccgaccccgacctaatcctcaaacctttcgctctacccccgcgcccgccccgcacttccgattctcgaccccgcgctatccccacacttccgaccccgcccgcacaaccgcaccaacgaaccgaacgaaccaaaacgaacaaactatacgacgcgccaccgtataaacgcgccgaccacgacgaacaacgcaaaatcctaacgccctaacaaaccgaacgaccattacttcacgacaccacaaaaaccttaacaaacaaccgattaaaaaacgaacaaaaact

SEQ ID NO: 21717 - DNA, 827 bp, Artificial Sequence
  chemically treated genomic DNA (Homo sapiens) CpG-island No: 21717
tcgtatagtatttatttatagttagcgaagtatcgcgttcggacgcgttgtttattcggtcgggcggttagtttattatttttaagagcggtacggtatagtttttcgtcggcgtttttcgtcgtaaagttgttttggcgggcggttttcgttttcgcgtagcgtacgtttttacgagttagtttttagttcggggtttggtagggttggatgcgttggcgcgtgtgcgggttttattagcgtttgtcgttttcgcgcgtcgtcgtttaagtcggtttggtcgtttatttgacgttgaatcgggtgttagttcgttttgggtatgggggcgtagtatttcgtcgtcggtcgatttttttcgcgggggcgtcggggaaattatagtttacgggttttttgttgcgtttggtgcgtcgaggcggggggcggtcgttagagtttattaggggacgattgagtaaaagcgttagtaaagtggagatttagacgggtagcggaggcgaagcggttgcgtagttttagtttcggttttagtttcggttttagtttcggttttcgttttcgttaagtttttattcgtcggtttcgtcgtggtatttgtgtagtggagttagggcgagcgtcgggttatggtcgcggaggttcgttcgttttttcgttcgcggcgggtcggggcggggtaggcgcggtcggacggggcgtcggtattttattggaagcgggtttaggagcgtaattgatttttgtcggttaatttttttcggttttttggattggtcgttggtggcgggttgtggatcgttgtcgggtaaagtgggtgtagtttt

SEQ ID NO: 21718 - DNA, 827 bp, Artificial Sequence
  chemically treated genomic DNA (Homo sapiens) CpG-island No: 21718
aaaactacacccactttacccgacaacgatccacaacccgccaccaacgaccaatccaaaaaaccgaaaaaaattaaccgacaaaaatcaattacgctcctaaacccgcttccaataaaataccgacgccccgtccgaccgcgcctaccccgccccgacccgccgcgaacgaaaaaacgaacgaacctccgcgaccataacccgacgctcgccctaactccactacacaaataccacgacgaaaccgacgaataaaaacttaacgaaaacgaaaaccgaaactaaaaccgaaactaaaaccgaaactaaaactacgcaaccgcttcgcctccgctacccgtctaaatctccactttactaacgcttttactcaatcgtcccctaataaactctaacgaccgccccccgcctcgacgcaccaaacgcaacaaaaaacccgtaaactataatttccccgacgcccccgcgaaaaaaatcgaccgacgacgaaatactacgcccccatacccaaaacgaactaacacccgattcaacgtcaaataaacgaccaaaccgacttaaacgacgacgcgcgaaaacgacaaacgctaataaaacccgcacacgcgccaacgcatccaaccctaccaaaccccgaactaaaaactaactcgtaaaaacgtacgctacgcgaaaacgaaaaccgcccgccaaaacaactttacgacgaaaaacgccgacgaaaaactataccgtaccgctcttaaaaataataaactaaccgcccgaccgaataaacaacgcgtccgaacgcgatacttcgctaactataaataaatactatacga

SEQ ID NO: 21719 - DNA, 827 bp, Artificial Sequence
  chemically treated genomic DNA (Homo sapiens) CpG-island No: 21719
agagttgtatttattttgttcggtagcggtttatagttcgttattagcggttagtttagggaatcggagaggattggtcggtaaaagttagttgcgtttttgggttcgtttttagtagagtgtcggcgtttcgttcggtcgcgtttgtttcgtttcggttcgtcgcgagcgagagagcgaacgagttttcgcggttatggttcggcgttcgttttagttttattgtatagatgttacggcggagtcggcgggtaggaatttggcgggggcgggggtcgggattggggtcgggattggggtcggggttggggttgcgtaatcgtttcgttttcgttgttcgtttgggtttttattttgttggcgtttttgtttaatcgttttttggtgggttttggcggtcgtttttcgtttcggcgtattaggcgtagtaggaagttcgtgggttgtggttttttcggcgttttcgcggaggaaatcggtcggcggcggggtgttgcgtttttatgtttagggcgggttggtattcggtttagcgttaggtgggcggttaagtcggtttgggcggcggcgcgcgggggcggtaggcgttggtgaagttcgtatacgcgttagcgtatttagttttattaagtttcgggttgggagttggttcgtgggggcgtgcgttgcgcgaaagcgaaagtcgttcgttagagtaattttgcggcggaaggcgtcgacgaggagttgtgtcgtgtcgtttttggggatggtgagttggtcgttcggtcgggtgggtagcgcgttcgggcgcggtgtttcgttagttataaataggtgttgtgcgg

SEQ ID NO: 21720 - DNA, 827 bp, Artificial Sequence
  chemically treated genomic DNA (Homo sapiens) CpG-island No: 21720
ccgcacaacacctatttataactaacgaaacaccgcgcccgaacgcgctacccacccgaccgaacgaccaactcaccatccccaaaaacgacacgacacaactcctcgtcgacgccttccgccgcaaaattactctaacgaacgactttcgctttcgcgcaacgcacgcccccacgaaccaactcccaacccgaaacttaataaaactaaatacgctaacgcgtatacgaacttcaccaacgcctaccgcccccgcgcgccgccgcccaaaccgacttaaccgcccacctaacgctaaaccgaataccaacccgccctaaacataaaaacgcaacaccccgccgccgaccgatttcctccgcgaaaacgccgaaaaaaccacaacccacgaacttcctactacgcctaatacgccgaaacgaaaaacgaccgccaaaacccaccaaaaaacgattaaacaaaaacgccaacaaaataaaaacccaaacgaacaacgaaaacgaaacgattacgcaaccccaaccccgaccccaatcccgaccccaatcccgacccccgcccccgccaaattcctacccgccgactccgccgtaacatctatacaataaaactaaaacgaacgccgaaccataaccgcgaaaactcgttcgctctctcgctcgcgacgaaccgaaacgaaacaaacgcgaccgaacgaaacgccgacactctactaaaaacgaacccaaaaacgcaactaacttttaccgaccaatcctctccgattccctaaactaaccgctaataacgaactataaaccgctaccgaacaaaataaatacaactct

SEQ ID NO: 21721 - DNA, 1163 bp, Artificial Sequence
  chemically treated genomic DNA (Homo sapiens) CpG-island No: 21721
tagtacgggattacgatttagatatagatttacggtgatagtacgggattacgatttagatatagatttacggtgatagtacgggattacgatttagatagatttacggtgatagtacgggattacgatttagatatagatttacggtgatagtacgggattacgatttagatatagatttacggtgatagtacgggattacgatttagatagatttacggtgatagtacgggattacgatttagatagatttacggtgatagtacgggattacgatttagatatagatttacggtgatagtacgggattacgatttagatatagatttacggtgatagtacgggattacgatttagatatagatttacggtgatagtacgggattacgatttagatagatttacggtgatagtacgggattacgatttagatatagatttacggtgatagtacgggattacgatttagatatagatttacggtgatagtacgggattacgatttagatatagatttacggtgatagtacgggattacgatttagatatagatttacggtgatagtacgggattacgatttagatatagatttacggtgatagtacgggattacgatttagatatagatttacggtgatagtacgggattacgatttagatagatttacggtgatagtacgggattacgatttagatatagatttacggtgatagtacgggattacgatttagatatagatttacggtgatagtacgggattacgatttagatatagatttacggtgatagtacgggattacgatttagatatagatttacggtgatagtacgggattattatttagatagatttacggtgatagtacgggattacgatttagatatagatttacggtgatagtacgggattacgatttagatatagatttacggtgatagtacgggattacgatttagatatagatttacggtgatagtacgggattacgatttagatatagatttacggtgatagtacgggattacgatttagatatagatttacggtgatagtatgggattacgatttagatatagatttacggtgatagaacgggattacgatttagagggaaaataaatgggcgtgggtttatagtgataaaattagtgattataaat

SEQ ID NO: 21722 - DNA, 1163 bp, Artificial Sequence
  chemically treated genomic DNA (Homo sapiens) CpG-island No: 21722
atttataatcactaattttatcactataaacccacgcccatttattttccctctaaatcgtaatcccgttctatcaccgtaaatctatatctaaatcgtaatcccatactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatctaaataataatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatctaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatctaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatctaaatcgtaatcccgtactatcaccgtaaatctatctaaatcgtaatcccgtactatcaccgtaaatctatatctaaatcgtaatcccgtactatcaccgtaaatctatatctaaatcgtaatcccgtactatcaccgtaaatctatctaaatcgtaatcccgtactatcaccgtaaatctatatctaaatcgtaatcccgtactatcaccgtaaatctatatctaaatcgtaatcccgtacta

SEQ ID NO: 21723 - DNA, 1163 bp, Artificial Sequence
  chemically treated genomic DNA (Homo sapiens) CpG-island No: 21723
gtttgtggttattgattttgttattatggatttacgtttatttattttttttttgggtcgtgatttcgttttgttatcgtgagtttgtgtttgggtcgtgattttatgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtttgggtggtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtttgggtcgtgatttcgtgttgttatcgtgagtttgtttgggtcgtgatttcgtgttgttatcgtgagtttgtgtttgggtcgtgatttcgtgttgttatcgtgagtttgtgtttgggtcgtgatttcgtgttgttatcgtgagtttgtttgggtcgtgatttcgtgttgttatcgtgagtttgtgtttgggtcgtgatttcgtgttgttatcgtgagtttgtgtttgggtcgtgatttcgtgttg

SEQ ID NO: 21724 - DNA, 1163 bp, Artificial Sequence
  chemically treated genomic DNA (Homo sapiens) CpG-island No: 21724
caacacgaaatcacgacccaaacacaaactcacgataacaacacgaaatcacgacccaaacacaaactcacgataacaacacgaaatcacgacccaaacaaactcacgataacaacacgaaatcacgacccaaacacaaactcacgataacaacacgaaatcacgacccaaacacaaactcacgataacaacacgaaatcacgacccaaacaaactcacgataacaacacgaaatcacgacccaaacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaacacaaactcacgataacaacacgaaatcaccacccaaacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaacacaaactcacgataacaacataaaatcacgacccaaacacaaactcacgataacaaaacgaaatcacgacccaaaaaaaaaataaataaacgtaaatccataataacaaaatcaataaccacaaac

SEQ ID NO: 21725 - DNA, 886 bp, Artificial Sequence
  chemically treated genomic DNA (Homo sapiens) CpG-island No: 21725
gagttttcgggtttcgatatcgggattcgttggcggcgaagcgacgaggcgttgcgcgtgaacgtgggtggcgtgcggcggtagttgagcgcgcgcgttttggcgcgtttttcgggtacgcggttgggtcgtttgtaggtcgcggcgtcggaggagtaggcgcggcgtttgtgcgacgattacgacgaggcggcgcgcgaattttatttcgatcggtattcgggtttttttttgagtttgttgtatttttatcgtattggttatttgtacgtgttcgacgagttgtgcgttttcgtttttggttaggaggtcgattattggggtttaggcgagaacgcgtttgtcgcgtgttgtcgcgcgcgttatttggagaggcggttgatttagtcgtacgtttgggacgaggatagcgatacgtcgagtagcgtggattcgtgtttcgacgagattttcgacgtgtagcgagaattggcgcgttatggcgcggcgcgttgtggtcgtttgcgtcgtcgtttttggttgattatggagaattcgggttattcgttgtcgagtaagttttttagttgcgtttttattagcgtggtgttcgtttttatcgtcgttatgtgtatttatagtttgttcgagtattaggttcgcgaggcggcggtcgtcgtggttgcggtggtcgcgggtcgtagttcggaaggcgtgcgcgacgattcggtgttgcgacgtttcgagtatttttgtatcgtttggtttagtttcgaggtgtcgtcgcgttttttgttggcgtttagtacgcgtaattttttttgttattcgtttaattttatcgatattgtgtttgtgttgtttttttattttacgttgttggttggtgtggtattgggcgattagg

SEQ ID NO: 21726 - DNA, 886 bp, Artificial Sequence
  chemically treated genomic DNA (Homo sapiens) CpG-island No: 21726
cctaatcgcccaataccacaccaaccaacaacgtaaaataaaaaaacaacacaaacacaatatcgataaaattaaacgaataacaaaaaaaattacgcgtactaaacgccaacaaaaaacgcgacgacacctcgaaactaaaccaaacgatacaaaaatactcgaaacgtcgcaacaccgaatcgtcgcgcacgccttccgaactacgacccgcgaccaccgcaaccacgacgaccgccgcctcgcgaacctaatactcgaacaaactataaatacacataacgacgataaaaacgaacaccacgctaataaaaacgcaactaaaaaacttactcgacaacgaataacccgaattctccataatcaaccaaaaacgacgacgcaaacgaccacaacgcgccgcgccataacgcgccaattctcgctacacgtcgaaaatctcgtcgaaacacgaatccacgctactcgacgtatcgctatcctcgtcccaaacgtacgactaaatcaaccgcctctccaaataacgcgcgcgacaacacgcgacaaacgcgttctcgcctaaaccccaataatcgacctcctaaccaaaaacgaaaacgcacaactcgtcgaacacgtacaaataaccaatacgataaaaatacaacaaactcaaaaaaaaacccgaataccgatcgaaataaaattcgcgcgccgcctcgtcgtaatcgtcgcacaaacgccgcgcctactcctccgacgccgcgacctacaaacgacccaaccgcgtacccgaaaaacgcgccaaaacgcgcgcgctcaactaccgccgcacgccacccacgttcacgcgcaacgcctcgtcgcttcgccgccaacgaatcccgatatcgaaacccgaaaactc

SEQ ID NO: 21727 - DNA, 886 bp, Artificial Sequence
  chemically treated genomic DNA (Homo sapiens) CpG-island No: 21727
tttggtcgtttagtgttatattagttagtagcgtgagatagaagggtagtatagatataatgtcgatgaggttgagcgggtggtagaagaagttgcgcgtattgggcgttagtaggaggcgcgacgatatttcgaagttgaattaggcgatgtagaagtattcgaggcgtcgtagtatcgggtcgtcgcgtacgtttttcgggttgcggttcgcggttatcgtagttacggcggtcgtcgtttcgcgggtttggtattcgggtaggttgtggatgtatatggcggcgatggaggcgagtattacgttgatggagacgtagttgaagagtttgttcggtagcgagtagttcgggttttttatggttagttagaggcggcggcgtaggcggttatagcgcgtcgcgttatagcgcgttagttttcgttgtacgtcggagatttcgtcggggtacgggtttacgttgttcggcgtgtcgttgttttcgttttaggcgtgcggttgggttagtcgtttttttaggtagcgcgcgcggtagtacgcggtaagcgcgttttcgtttaggttttagtagtcggttttttggttaaaggcgaagacgtatagttcgtcgagtacgtgtaggtggttagtgcggtagaagtgtagtaggtttaggaagaagttcgggtgtcggtcgaagtagaattcgcgcgtcgtttcgtcgtagtcgtcgtataggcgtcgcgtttgttttttcgacgtcgcggtttgtaggcggtttagtcgcgtgttcgggaagcgcgttagggcgcgcgcgtttagttgtcgtcgtacgttatttacgtttacgcgtagcgtttcgtcgtttcgtcgttagcggatttcggtgtcggggttcgggaattt

SEQ ID NO: 21728 - DNA, 886 bp, Artificial Sequence
  chemically treated genomic DNA (Homo sapiens) CpG-island No: 21728
aaattcccgaaccccgacaccgaaatccgctaacgacgaaacgacgaaacgctacgcgtaaacgtaaataacgtacgacgacaactaaacgcgcgcgccctaacgcgcttcccgaacacgcgactaaaccgcctacaaaccgcgacgtcgaaaaaacaaacgcgacgcctatacgacgactacgacgaaacgacgcgcgaattctacttcgaccgacacccgaacttcttcctaaacctactacacttctaccgcactaaccacctacacgtactcgacgaactatacgtcttcgcctttaaccaaaaaaccgactactaaaacctaaacgaaaacgcgcttaccgcgtactaccgcgcgcgctacctaaaaaaacgactaacccaaccgcacgcctaaaacgaaaacaacgacacgccgaacaacgtaaacccgtaccccgacgaaatctccgacgtacaacgaaaactaacgcgctataacgcgacgcgctataaccgcctacgccgccgcctctaactaaccataaaaaacccgaactactcgctaccgaacaaactcttcaactacgtctccatcaacgtaatactcgcctccatcgccgccatatacatccacaacctacccgaataccaaacccgcgaaacgacgaccgccgtaactacgataaccgcgaaccgcaacccgaaaaacgtacgcgacgacccgatactacgacgcctcgaatacttctacatcgcctaattcaacttcgaaatatcgtcgcgcctcctactaacgcccaatacgcgcaacttcttctaccacccgctcaacctcatcgacattatatctatactacccttctatctcacgctactaactaatataacactaaacgaccaaa

SEQ ID NO: 21729 - DNA, 1401 bp, Artificial Sequence
  chemically treated genomic DNA (Homo sapiens) CpG-island No: 21729
gggattgaggcgagagttagtagtattgcgcggggagtttgagtcgtttcgtacgtttcgggtcgacgggttttagagcgtttcggggtttgggttcgcggcggttttagcggggttcgattattttcgtttggacgagaagcggcgtttcggtttcgaggagttttacggtggggaggtggggcgacgataataaaaagaagttaagtgggaggggattcgtcggcgaggggggcgacggcggtcgttaagggagaggaggcggatattttcgaagggatttgcggcgtcgggagtttagcgattttgtttacgagcgattggcgggttcgggaggacgtttcgcggcgtatagtcgggagtttcgcggttcgttttttcgtatcgttcgcgtttttttcgcgttttcgtttcgttttttcgtttagcgtcgttcgcgcgtagcgtttcgcgtcggttcggttcgttcgtcgggaaatagtcgcgagagtagcggtcgcggcggtcgttagcgcgtttttttttttcgcgttttcgcgtcgttttcgttttcggcgtttcgttttcgggtcgcgcgttcgcgtttcggttaacgttttttttcggtttttcgggttcgtcgtttattttcgcgttttcgagttttttaatcgtcgcggtttttttgggcgcgcggttcgtcgtttgttttcggggcgggcggattgggcgtttggtgtcggcggtcgtagcgatagcgttttcgggaagtagaggaggaaggagagaagaggtggaggtggtcgtaggttgagtcgcggtcgggatgttcgggtagtcgtcgtcgtcgtcgtcgtagtagtagtaatagtagtagtagttgtcgtcgttatcgtcggcggttttggttttagttttcggagtcgttttgtcggcgttttcggtcgttagcgtcggttttttttcggtcggttcgttcggcggcggtgcgggcggcgaaggtttaggggtcgcggcggtcgttttgtttttttatttttcgtcgtcgtcgttttcggttatcgcggtttcgtcgttttcgtcgtcgttttcgtttttttttgttttagcggttgttttcgttagcgggtcgttcgttttttcgggttttgtagcgggtttcggttcggttggaggagtttcgattttagttttggtggcgggtagtagcgtcgcggttttttttttttacggggattcggttttgaacgagtaggagaaggagttgtagcggcggttgaagcgtttttattcggtcgtggacgaataagagacgtcgttgtttcggttttggagttcgaaggataagtttagttatatcggttttttttagaataatttgcgggtgtattataaaggtattgggcgtgtgttttgcggtgg

SEQ ID NO: 21730 - DNA, 1401 bp, Artificial Sequence
  chemically treated genomic DNA (Homo sapiens) CpG-island No: 21730
ccaccgcaaaacacacgcccaatacctttataatacacccgcaaattattctaaaaaaaaccgatataactaaacttatccttcgaactccaaaaccgaaacaacgacgtctcttattcgtccacgaccgaataaaaacgcttcaaccgccgctacaactccttctcctactcgttcaaaaccgaatccccgtaaaaaaaaaaaaccgcgacgctactacccgccaccaaaactaaaatcgaaactcctccaaccgaaccgaaacccgctacaaaacccgaaaaaacgaacgacccgctaacgaaaacaaccgctaaaacaaaaaaaaacgaaaacgacgacgaaaacgacgaaaccgcgataaccgaaaacgacgacgacgaaaaataaaaaaacaaaacgaccgccgcgacccctaaaccttcgccgcccgcaccgccgccgaacgaaccgaccgaaaaaaaaccgacgctaacgaccgaaaacgccgacaaaacgactccgaaaactaaaaccaaaaccgccgacgataacgacgacaactactactactattactactactacgacgacgacgacgacgactacccgaacatcccgaccgcgactcaacctacgaccacctccacctcttctctccttcctcctctacttcccgaaaacgctatcgctacgaccgccgacaccaaacgcccaatccgcccgccccgaaaacaaacgacgaaccgcgcgcccaaaaaaaccgcgacgattaaaaaactcgaaaacgcgaaaataaacgacgaacccgaaaaaccgaaaaaaaacgttaaccgaaacgcgaacgcgcgacccgaaaacgaaacgccgaaaacgaaaacgacgcgaaaacgcgaaaaaaaaaaacgcgctaacgaccgccgcgaccgctactctcgcgactatttcccgacgaacgaaccgaaccgacgcgaaacgctacgcgcgaacgacgctaaacgaaaaaacgaaacgaaaacgcgaaaaaaacgcgaacgatacgaaaaaacgaaccgcgaaactcccgactatacgccgcgaaacgtcctcccgaacccgccaatcgctcgtaaacaaaatcgctaaactcccgacgccgcaaatcccttcgaaaatatccgcctcctctcccttaacgaccgccgtcgcccccctcgccgacgaatcccctcccacttaacttctttttattatcgtcgccccacctccccaccgtaaaactcctcgaaaccgaaacgccgcttctcgtccaaacgaaaataatcgaaccccgctaaaaccgccgcgaacccaaaccccgaaacgctctaaaacccgtcgacccgaaacgtacgaaacgactcaaactccccgcgcaatactactaactctcgcctcaatccc

SEQ ID NO: 21731 - DNA, 1401 bp, Artificial Sequence
  chemically treated genomic DNA (Homo sapiens) CpG-island No: 21731
ttatcgtaggatatacgtttagtatttttgtagtgtattcgtaggttgttttgagagaggtcgatgtagttgaatttgtttttcgggttttaggatcgaggtagcggcgttttttgttcgtttacggtcgggtagagacgttttagtcgtcgttgtaatttttttttttgttcgtttagggtcgagttttcgtgagggaagggggtcgcggcgttgttgttcgttattagagttggggtcggggtttttttagtcgggtcggggttcgttgtaaggttcgggggagcgggcggttcgttggcgggggtagtcgttgaggtagggggaggcgggggcggcggcgggggcggcggggtcgcggtggtcgggggcggcggcggcggagggtggaggagtagggcggtcgtcgcggtttttaagttttcgtcgttcgtatcgtcgtcgggcgagtcggtcggagaagagtcggcgttgacggtcgggggcgtcggtaggacgatttcggagattggggttaaggtcgtcggcggtggcggcgatagttgttgttgttgttgttgttgttgcggcggcggcggcggcggttgttcggatatttcggtcgcgatttagtttgcggttatttttattttttttttttttttttttttgtttttcgggggcgttgtcgttgcggtcgtcggtattaggcgtttagttcgttcgtttcggaagtaggcggcgggtcgcgcgtttagggagatcgcggcggttgaggagttcggagacgcgggagtaggcggcgggttcgggaggtcgggagagaacgttggtcggagcgcgggcgcgcggttcggggacgaggcgtcgagggcgggggcgacgcgggagcgcgggaggggaaggcgcgttggcggtcgtcgcggtcgttgttttcgcggttgtttttcggcgggcgggtcgggtcggcgcgagacgttgcgcgcgggcggcgttaggcgagggggcgggacggaggcgcgagagaggcgcgagcggtgcgagggggcgggtcgcggggttttcggttgtgcgtcgcgaggcgttttttcgggttcgttagtcgttcgtgggtaggatcgttgggttttcggcgtcgtaggttttttcggaggtgttcgtttttttttttttggcggtcgtcgtcgtttttttcgtcggcgaatttttttttatttgatttttttttgttgtcgtcgttttatttttttatcgtagggtttttcggagtcgaggcgtcgtttttcgtttaggcgagagtaatcgagtttcgttggggtcgtcgcgagtttaggtttcggggcgttttaggattcgtcggttcggggcgtgcggagcggtttaggtttttcgcgtagtgttgttagttttcgttttagtttt

SEQ ID NO: 21732 - DNA, 1401 bp, Artificial Sequence
  chemically treated genomic DNA (Homo sapiens) CpG-island No: 21732
aaaactaaaacgaaaactaacaacactacgcgaaaaacctaaaccgctccgcacgccccgaaccgacgaatcctaaaacgccccgaaacctaaactcgcgacgaccccaacgaaactcgattactctcgcctaaacgaaaaacgacgcctcgactccgaaaaaccctacgataaaaaaataaaacgacgacaacaaaaaaaaatcaaataaaaaaaaattcgccgacgaaaaaaacgacgacgaccgccaaaaaaaaaaaaacgaacacctccgaaaaaacctacgacgccgaaaacccaacgatcctacccacgaacgactaacgaacccgaaaaaacgcctcgcgacgcacaaccgaaaaccccgcgacccgccccctcgcaccgctcgcgcctctctcgcgcctccgtcccgccccctcgcctaacgccgcccgcgcgcaacgtctcgcgccgacccgacccgcccgccgaaaaacaaccgcgaaaacaacgaccgcgacgaccgccaacgcgccttcccctcccgcgctcccgcgtcgcccccgccctcgacgcctcgtccccgaaccgcgcgcccgcgctccgaccaacgttctctcccgacctcccgaacccgccgcctactcccgcgtctccgaactcctcaaccgccgcgatctccctaaacgcgcgacccgccgcctacttccgaaacgaacgaactaaacgcctaataccgacgaccgcaacgacaacgcccccgaaaaacaaaaaaaaaaaaaaaaaaaaaataaaaataaccgcaaactaaatcgcgaccgaaatatccgaacaaccgccgccgccgccgccgcaacaacaacaacaacaacaacaactatcgccgccaccgccgacgaccttaaccccaatctccgaaatcgtcctaccgacgcccccgaccgtcaacgccgactcttctccgaccgactcgcccgacgacgatacgaacgacgaaaacttaaaaaccgcgacgaccgccctactcctccaccctccgccgccgccgcccccgaccaccgcgaccccgccgcccccgccgccgcccccgcctccccctacctcaacgactacccccgccaacgaaccgcccgctcccccgaaccttacaacgaaccccgacccgactaaaaaaaccccgaccccaactctaataacgaacaacaacgccgcgacccccttccctcacgaaaactcgaccctaaacgaacaaaaaaaaaaattacaacgacgactaaaacgtctctacccgaccgtaaacgaacaaaaaacgccgctacctcgatcctaaaacccgaaaaacaaattcaactacatcgacctctctcaaaacaacctacgaatacactacaaaaatactaaacgtatatcctacgataa

SEQ ID NO: 21733 - DNA, 964 bp, Artificial Sequence
  chemically treated genomic DNA (Homo sapiens) CpG-island No: 21733
gcgatttcggtggcggttgggcgcgtttcgcggttttttttagttttttttgggtcggcgttatgaggtttgggttcgtttttttttttttgggcgtgggtttgagtttgagcgtcggtcgtttttcgttgtcgtcggtttttcgcggggtataagtcgtcgttttcggggcgttcggtggtttttttaggggcgtttcgggtttcggggtgcgcggcggtcgcgttttttttagtttgcggtttagcgcggtgcgggcgggcggcgttgttttgagcggtcgcggtagtttttgttttttttatggcgggatcgggcggcgttggtattgtttcgatttgcgcgttttgtttagcgtttaacgtttgttttggtcggtcgcgttcgcgttcgcgttcgtcgatttgtagtttttcgcgcgcggcggtcgtttttttttgacgtggttcgtgcggttgtcgcgttcgttcgggcgtttggtttgggtttttcgtttgcggttgttcggattcggcgtcgttcgttcggtttttttcgcggttcgcgttttttcgcgtttcgtcgcgttaggttcgcggttttagtagggtttcgtggttcgtatcgagtgttttatagacggtttcgcgcgcgtgatgttgtaggtcgttaattcgtttagttatagagtcgtcgagtcgttcgtgttttgttagataaacgtttgcgttatttagcgcgtgaggattaatacggattagaagggcgttttcgtgcgtttgagtatgtaggcggaggttattattaacgtttcggtgtagttggattgttcggtcgcgcgcgttatcgtttagtattggtaggtgtttttcgtgttcgtcgtgggttaggcgttcgattggacgtagtttttggatttgttttagttcgagattaggaatagttttttgtttatttatatttttaataattcgttatagtgggg

SEQ ID NO: 21734 - DNA, 964 bp, Artificial Sequence
  chemically treated genomic DNA (Homo sapiens) CpG-island No: 21734
ccccactataacgaattattaaaaatataaataaacaaaaaactattcctaatctcgaactaaaacaaatccaaaaactacgtccaatcgaacgcctaacccacgacgaacacgaaaaacacctaccaatactaaacgataacgcgcgcgaccgaacaatccaactacaccgaaacgttaataataacctccgcctacatactcaaacgcacgaaaacgcccttctaatccgtattaatcctcacgcgctaaataacgcaaacgtttatctaacaaaacacgaacgactcgacgactctataactaaacgaattaacgacctacaacatcacgcgcgcgaaaccgtctataaaacactcgatacgaaccacgaaaccctactaaaaccgcgaacctaacgcgacgaaacgcgaaaaaacgcgaaccgcgaaaaaaaccgaacgaacgacgccgaatccgaacaaccgcaaacgaaaaacccaaaccaaacgcccgaacgaacgcgacaaccgcacgaaccacgtcaaaaaaaaacgaccgccgcgcgcgaaaaactacaaatcgacgaacgcgaacgcgaacgcgaccgaccaaaacaaacgttaaacgctaaacaaaacgcgcaaatcgaaacaataccaacgccgcccgatcccgccataaaaaaaacaaaaactaccgcgaccgctcaaaacaacgccgcccgcccgcaccgcgctaaaccgcaaactaaaaaaaacgcgaccgccgcgcaccccgaaacccgaaacgcccctaaaaaaaccaccgaacgccccgaaaacgacgacttataccccgcgaaaaaccgacgacaacgaaaaacgaccgacgctcaaactcaaacccacgcccaaaaaaaaaaaaacgaacccaaacctcataacgccgacccaaaaaaaactaaaaaaaaccgcgaaacgcgcccaaccgccaccgaaatcgc

SEQ ID NO: 21735 - DNA, 964 bp, Artificial Sequence
  chemically treated genomic DNA (Homo sapiens) CpG-island No: 21735
ttttattgtaacgaattattggggatgtgaatgaataaggggttgtttttgatttcgagttggggtagatttaagggttgcgtttagtcgggcgtttgatttacggcgggtacggagaatatttgttagtattgggcgatggcgcgcgcggtcgggtagtttagttgtatcgaggcgttgatggtggttttcgtttgtatgtttaggcgtacgggggcgtttttttggttcgtgttgatttttacgcgttggatgacgtaggcgtttatttgataggatacggacgattcgacggttttgtggttggacgagttgacggtttgtaatattacgcgcgcggggtcgtttgtggggtattcggtgcgggttacgaagttttgttggggtcgcgggtttggcgcggcggagcgcggggagacgcgggtcgcgggggaggtcgggcgggcggcgtcgggttcgagtagtcgtaggcggaaggtttaggttaggcgttcgggcgagcgcggtagtcgtacggattacgttagggagaggcggtcgtcgcgcgcggagagttgtaggtcgacgagcgcgagcgcgggcgcggtcggttagggtaggcgttgggcgttgagtaggacgcgtaagtcgaggtagtattagcgtcgttcggtttcgttatgggggaagtagaggttgtcgcggtcgtttaggatagcgtcgttcgttcgtatcgcgttgggtcgtagattgaggagggcgcggtcgtcgcgtatttcgaggttcggggcgtttttgaggaggttatcgggcgtttcggagacggcggtttgtgtttcgcgaggaatcggcggtagcgggaggcggtcgacgtttaggtttaggtttacgtttagaaggaggagagcgggtttaggttttatggcgtcggtttaggagaagttgggagaggtcgcgaggcgcgtttaatcgttatcggggtcgt

SEQ ID NO: 21736 - DNA, 964 bp, Artificial Sequence
  chemically treated genomic DNA (Homo sapiens) CpG-island No: 21736
acgaccccgataacgattaaacgcgcctcgcgacctctcccaacttctcctaaaccgacgccataaaacctaaacccgctctcctccttctaaacgtaaacctaaacctaaacgtcgaccgcctcccgctaccgccgattcctcgcgaaacacaaaccgccgtctccgaaacgcccgataacctcctcaaaaacgccccgaacctcgaaatacgcgacgaccgcgccctcctcaatctacgacccaacgcgatacgaacgaacgacgctatcctaaacgaccgcgacaacctctacttcccccataacgaaaccgaacgacgctaatactacctcgacttacgcgtcctactcaacgcccaacgcctaccctaaccgaccgcgcccgcgctcgcgctcgtcgacctacaactctccgcgcgcgacgaccgcctctccctaacgtaatccgtacgactaccgcgctcgcccgaacgcctaacctaaaccttccgcctacgactactcgaacccgacgccgcccgcccgacctcccccgcgacccgcgtctccccgcgctccgccgcgccaaacccgcgaccccaacaaaacttcgtaacccgcaccgaataccccacaaacgaccccgcgcgcgtaatattacaaaccgtcaactcgtccaaccacaaaaccgtcgaatcgtccgtatcctatcaaataaacgcctacgtcatccaacgcgtaaaaatcaacacgaaccaaaaaaacgcccccgtacgcctaaacatacaaacgaaaaccaccatcaacgcctcgatacaactaaactacccgaccgcgcgcgccatcgcccaatactaacaaatattctccgtacccgccgtaaatcaaacgcccgactaaacgcaacccttaaatctaccccaactcgaaatcaaaaacaaccccttattcattcacatccccaataattcgttacaataaaa

SEQ ID NO: 21737 - DNA, 860 bp, Artificial Sequence
  chemically treated genomic DNA (Homo sapiens) CpG-island No: 21737
gtagggtatggaggtataaggcggagagggggtttattagcggaggcggagtttagggggagggcgagtttaggcgtatttcgggcggtttcgtcgtaagtttgtttttagttgttgaatgcgttggcggaggtcggattcggattcggattcggatttcgcggggtgagtagcgtagggggtcgcggtcgggataggggttcgttaggtcggggttcgggttcgtggggtcgttttcgttttttcgggcgttgtagttgtagcggcggcgttaggcgcggttttagtttcgcgggcgtgtgtttgcgagcgcgcgtgtgttcgtggagcgtgcggtcggttcgggggcgggagcgggtttgttgcggaaaggtttgcggagggtatcgggagcgggcgggttggcggacggatagacggggacggatagacggatatagtttgtcgcggtttttgacgcgcgtcgtttggtttttttcgggcgtttttttcgtcgaggtaggggtagaggcgcggcggcggggaggagggggcggcggcgtttgcgcgtatacgcgcgtttttagatatatatatagatatacgcgggttattttacggttacgtatttcgtatttatattcgcgtttatatttatatttatatttatatttatacgcgtaggtttcgcggtcgtcgtttttcggaggcggtgtttggttcggatttcggttggggttggggtaagtgaatttttttggattcgagcgtcgcgatcgatcggggagacggtgggagtcggggttggagtcggagggtatttttttcgttagtgggggtggggtttggagagggatacggaaggggggatgagacgggga

SEQ ID NO: 21738 - DNA, 860 bp, Artificial Sequence
  chemically treated genomic DNA (Homo sapiens) CpG-island No: 21738
tccccgtctcatccccccttccgtatccctctccaaaccccacccccactaacgaaaaaaataccctccgactccaaccccgactcccaccgtctccccgatcgatcgcgacgctcgaatccaaaaaaattcacttaccccaaccccaaccgaaatccgaaccaaacaccgcctccgaaaaacgacgaccgcgaaacctacgcgtataaatataaatataaatataaatataaacgcgaatataaatacgaaatacgtaaccgtaaaataacccgcgtatatctatatatatatctaaaaacgcgcgtatacgcgcaaacgccgccgccccctcctccccgccgccgcgcctctacccctacctcgacgaaaaaaacgcccgaaaaaaaccaaacgacgcgcgtcaaaaaccgcgacaaactatatccgtctatccgtccccgtctatccgtccgccaacccgcccgctcccgataccctccgcaaacctttccgcaacaaacccgctcccgcccccgaaccgaccgcacgctccacgaacacacgcgcgctcgcaaacacacgcccgcgaaactaaaaccgcgcctaacgccgccgctacaactacaacgcccgaaaaaacgaaaacgaccccacgaacccgaaccccgacctaacgaacccctatcccgaccgcgaccccctacgctactcaccccgcgaaatccgaatccgaatccgaatccgacctccgccaacgcattcaacaactaaaaacaaacttacgacgaaaccgcccgaaatacgcctaaactcgccctccccctaaactccgcctccgctaataaaccccctctccgccttatacctccataccctac

SEQ ID NO: 21739 - DNA, 860 bp, Artificial Sequence
  chemically treated genomic DNA (Homo sapiens) CpG-island No: 21739
ttttcgttttattttttttttcgtgtttttttttaagttttatttttattgacggagggggtgtttttcggttttagtttcgatttttatcgttttttcggtcggtcgcggcgttcggatttagaggaatttatttattttagttttagtcgggattcgggttaagtatcgttttcgggaagcggcggtcgcggggtttgcgcgtgtgagtgtgagtgtgaatgtgagtgtgagcgcgggtgtgggtgcggggtgcgtggtcgtggggtggttcgcgtgtgtttgtgtgtgtgtttgggagcgcgcgtgtgcgcgtagacgtcgtcgttttttttttttcgtcgtcgcgtttttgtttttgtttcggcggggagggcgttcgggaggggttaaacggcgcgcgttagggatcgcggtaggttgtgttcgtttgttcgttttcgtttgttcgttcgttagttcgttcgttttcggtgtttttcgtaggttttttcgtagtaagttcgttttcgttttcgagtcggtcgtacgttttacggatatacgcgcgttcgtagatatacgttcgcggggttggggtcgcgtttggcgtcgtcgttgtagttgtagcgttcggggaggcgaaggcggttttacggattcgagtttcggtttggcggatttttgtttcggtcgcggttttttgcgttgtttatttcgcgggattcgggttcgggttcgggttcggttttcgttagcgtatttaatagttgggggtaaatttgcggcggggtcgttcgaagtgcgtttggattcgttttttttttggatttcgttttcgttgatgggtttttttttcgttttgtatttttatgttttgt

SEQ ID NO: 21740 - DNA, 860 bp, Artificial Sequence
  chemically treated genomic DNA (Homo sapiens) CpG-island No: 21740
acaaaacataaaaatacaaaacgaaaaaaaaacccatcaacgaaaacgaaatccaaaaaaaaaacgaatccaaacgcacttcgaacgaccccgccgcaaatttacccccaactattaaatacgctaacgaaaaccgaacccgaacccgaacccgaatcccgcgaaataaacaacgcaaaaaaccgcgaccgaaacaaaaatccgccaaaccgaaactcgaatccgtaaaaccgccttcgcctccccgaacgctacaactacaacgacgacgccaaacgcgaccccaaccccgcgaacgtatatctacgaacgcgcgtatatccgtaaaacgtacgaccgactcgaaaacgaaaacgaacttactacgaaaaaacctacgaaaaacaccgaaaacgaacgaactaacgaacgaacaaacgaaaacgaacaaacgaacacaacctaccgcgatccctaacgcgcgccgtttaacccctcccgaacgccctccccgccgaaacaaaaacaaaaacgcgacgacgaaaaaaaaaaaacgacgacgtctacgcgcacacgcgcgctcccaaacacacacacaaacacacgcgaaccaccccacgaccacgcaccccgcacccacacccgcgctcacactcacattcacactcacactcacacgcgcaaaccccgcgaccgccgcttcccgaaaacgatacttaacccgaatcccgactaaaactaaaataaataaattcctctaaatccgaacgccgcgaccgaccgaaaaaacgataaaaatcgaaactaaaaccgaaaaacaccccctccgtcaataaaaataaaacttaaaaaaaaacacgaaaaaaaaaataaaacgaaaa

SEQ ID NO: 21741 - DNA, 736 bp, Artificial Sequence
  chemically treated genomic DNA (Homo sapiens) CpG-island No: 21741
gcggcgaagagggcggagagtagagaagacgttttggaggaggcgatcgacgtatagtcgcgtagcggtggttcgatatggtttatttatttggcggaggtagatttgggtttggaggtcggttgggattgttcgttttgggggcgtacggggcgggtgcgcgatggttgttgggtcggaggagggggcgggcgggaattgtcgcggatttggcgtggtggggacgggagcgcgcgttcggagtttcgtcggggtcgtatcgttattttgttttttttcgatttcgtcgcgttttttattttcgtatcgtttttcgtcgttcgcggtttttcgaggttttcgtttttcgcggtttatttcgttagttttcggaatttgcgttcggttggttcggtttttttttttatttgtttgtgtttagaatttgtagtcgtagtttttgacgttcgtagttaatttcgtagtttttgggttttgcgcggtgttcgggatcggaaagcgatcggtaggggcgggggttggcggcggggcgggtcgcgttgggtaggggtatagggggcgatcggagttaggattcggcgagttgttggcgagggggtgtgtgtgtcgggtgggtgtggacggtatggggacgcgtcgcgtgaattgttttgggagcgttgtggcgtgtaggcgtggttgtgttgggggtgtgttggtttatgtgtattggtacgtgtgttcgggagtggttttt

SEQ ID NO: 21742 - DNA, 736 bp, Artificial Sequence
  chemically treated genomic DNA (Homo sapiens) CpG-island No: 21742
aaaaaccactcccgaacacacgtaccaatacacataaaccaacacacccccaacacaaccacgcctacacgccacaacgctcccaaaacaattcacgcgacgcgtccccataccgtccacacccacccgacacacacaccccctcgccaacaactcgccgaatcctaactccgatcgccccctatacccctacccaacgcgacccgccccgccgccaacccccgcccctaccgatcgctttccgatcccgaacaccgcgcaaaacccaaaaactacgaaattaactacgaacgtcaaaaactacgactacaaattctaaacacaaacaaataaaaaaaaaaaccgaaccaaccgaacgcaaattccgaaaactaacgaaataaaccgcgaaaaacgaaaacctcgaaaaaccgcgaacgacgaaaaacgatacgaaaataaaaaacgcgacgaaatcgaaaaaaaacaaaataacgatacgaccccgacgaaactccgaacgcgcgctcccgtccccaccacgccaaatccgcgacaattcccgcccgccccctcctccgacccaacaaccatcgcgcacccgccccgtacgcccccaaaacgaacaatcccaaccgacctccaaacccaaatctacctccgccaaataaataaaccatatcgaaccaccgctacgcgactatacgtcgatcgcctcctccaaaacgtcttctctactctccgccctcttcgccgc

SEQ ID NO: 21743 - DNA, 736 bp, Artificial Sequence
  chemically treated genomic DNA (Homo sapiens) CpG-island No: 21743
gggaattattttcggatatacgtgttaatgtatatgagttaatatatttttagtatagttacgtttgtacgttatagcgtttttagggtagtttacgcggcgcgtttttatgtcgtttatatttattcggtatatatattttttcgttagtaattcgtcgggttttggtttcggtcgttttttgtgtttttgtttagcgcggttcgtttcgtcgttagttttcgtttttgtcggtcgtttttcgatttcgggtatcgcgtagagtttagaggttgcgaaattggttgcgagcgttaggggttgcggttgtaaattttaaatataggtaagtaaggaggaaagtcgggttagtcgggcgtaagtttcggaggttggcggggtgggtcgcgggggacgggggtttcgaagagtcgcggacggcggaggacggtgcggaggtggggagcgcggcgaggtcgggggggagtagggtggcggtgcggtttcggcggggtttcgagcgcgcgttttcgtttttattacgttaggttcgcggtagttttcgttcgttttttttttcggtttagtagttatcgcgtattcgtttcgtgcgtttttaggacggataattttagtcggtttttagatttaggtttgttttcgttaagtggatggattatatcgagttatcgttacgcggttgtgcgtcggtcgttttttttaggacgttttttttgtttttcgtttttttcgtcgt

SEQ ID NO: 21744 - DNA, 736 bp, Artificial Sequence
  chemically treated genomic DNA (Homo sapiens) CpG-island No: 21744
acgacgaaaaaaacgaaaaacaaaaaaaacgtcctaaaaaaaacgaccgacgcacaaccgcgtaacgataactcgatataatccatccacttaacgaaaacaaacctaaatctaaaaaccgactaaaattatccgtcctaaaaacgcacgaaacgaatacgcgataactactaaaccgaaaaaaaaaacgaacgaaaactaccgcgaacctaacgtaataaaaacgaaaacgcgcgctcgaaaccccgccgaaaccgcaccgccaccctactcccccccgacctcgccgcgctccccacctccgcaccgtcctccgccgtccgcgactcttcgaaacccccgtcccccgcgacccaccccgccaacctccgaaacttacgcccgactaacccgactttcctccttacttacctatatttaaaatttacaaccgcaacccctaacgctcgcaaccaatttcgcaacctctaaactctacgcgatacccgaaatcgaaaaacgaccgacaaaaacgaaaactaacgacgaaacgaaccgcgctaaacaaaaacacaaaaaacgaccgaaaccaaaacccgacgaattactaacgaaaaaatatatataccgaataaatataaacgacataaaaacgcgccgcgtaaactaccctaaaaacgctataacgtacaaacgtaactatactaaaaatatattaactcatatacattaacacgtatatccgaaaataattccc

SEQ ID NO: 21745 - DNA, 572 bp, Artificial Sequence
  chemically treated genomic DNA (Homo sapiens) CpG-island No: 21745
ttttcgtgcgcgattttagttttttcggttgtagtttagtttatcggttttgcgcgggaatagtgttattcgggtattcgggttagaataggttacgcgtgttttaggagcgcgggaagtttttacgttttttttttcgtatcgtttttttggttggtagagcgggtttttagcgcgttttagtcgtattaagcgtttttcgttttcgcgttattcgggcgcgttgttggggtttgatttttataataattagttagagatttttcgaaaaggttgggagcggtcgtcgtcgtttatcggggaagttttcgagggtgggcgtttttttttttattttttttgtcgtcgtcgggagggagtttcgtttttaaaagttttcgagaaatcgttcgtgcgtaggaggtagttgggagatatttaggatgtcgtttttcgtattaaggagggggacggcggtgggggaggtgggagaggtcgcggcgtaggtgtagattaggtttagaggtaaggaggggaggagggaaattgaggtagtcgcggggtggggagacgttttaaggtatatttttatt

SEQ ID NO: 21746 - DNA, 572 bp, Artificial Sequence
  chemically treated genomic DNA (Homo sapiens) CpG-island No: 21746
aataaaaatataccttaaaacgtctccccaccccgcgactacctcaatttccctcctcccctccttacctctaaacctaatctacacctacgccgcgacctctcccacctcccccaccgccgtccccctccttaatacgaaaaacgacatcctaaatatctcccaactacctcctacgcacgaacgatttctcgaaaacttttaaaaacgaaactccctcccgacgacgacaaaaaaaataaaaaaaaaaacgcccaccctcgaaaacttccccgataaacgacgacgaccgctcccaaccttttcgaaaaatctctaactaattattataaaaatcaaaccccaacaacgcgcccgaataacgcgaaaacgaaaaacgcttaatacgactaaaacgcgctaaaaacccgctctaccaaccaaaaaaacgatacgaaaaaaaaaacgtaaaaacttcccgcgctcctaaaacacgcgtaacctattctaacccgaatacccgaataacactattcccgcgcaaaaccgataaactaaactacaaccgaaaaaactaaaatcgcgcacgaaaa

SEQ ID NO: 21747 - DNA, 572 bp, Artificial Sequence
  chemically treated genomic DNA (Homo sapiens) CpG-island No: 21747
agtgagaatatattttgaaacgtttttttatttcgcggttgttttagtttttttttttttttttttgtttttgagtttggtttatatttgcgtcgcggttttttttattttttttatcgtcgtttttttttttaatgcggagaacgatattttgggtgttttttagttgttttttgcgtacggacggtttttcgaaagtttttaaaaacgaggttttttttcggcggcggtagggagggtgggaaggggggcgtttattttcgggagttttttcggtgggcggcggcggtcgtttttagttttttcgggagatttttggttgattattatggaaattaggttttagtagcgcgttcgggtggcgcgggagcgggaggcgtttggtgcggttgagacgcgttgaggattcgttttgttagttaaaggagcggtgcgggggagggggcgtgggagtttttcgcgtttttgggatacgcgtggtttgttttggttcgggtgttcgggtgatattgttttcgcgtagggtcgatgggttgagttgtagtcggaggggttggggtcgcgtacggaaa

SEQ ID NO: 21748 - DNA, 572 bp, Artificial Sequence
  chemically treated genomic DNA (Homo sapiens) CpG-island No: 21748
tttccgtacgcgaccccaacccctccgactacaactcaacccatcgaccctacgcgaaaacaatatcacccgaacacccgaaccaaaacaaaccacgcgtatcccaaaaacgcgaaaaactcccacgccccctcccccgcaccgctcctttaactaacaaaacgaatcctcaacgcgtctcaaccgcaccaaacgcctcccgctcccgcgccacccgaacgcgctactaaaacctaatttccataataatcaaccaaaaatctcccgaaaaaactaaaaacgaccgccgccgcccaccgaaaaaactcccgaaaataaacgccccccttcccaccctccctaccgccgccgaaaaaaaacctcgtttttaaaaactttcgaaaaaccgtccgtacgcaaaaaacaactaaaaaacacccaaaatatcgttctccgcattaaaaaaaaaaacgacgataaaaaaaataaaaaaaaccgcgacgcaaatataaaccaaactcaaaaacaaaaaaaaaaaaaaaaaaactaaaacaaccgcgaaataaaaaaacgtttcaaaatatattctcact

SEQ ID NO: 21749 - DNA, 722 bp, Artificial Sequence
  chemically treated genomic DNA (Homo sapiens) CpG-island No: 21749
gtttggggaggagagggcggggtcggggaggaggcgtttgtaagtttgtatcgtaatgtttttattggtttttagagggcgtaattattcgaggtttcgttttaagcgaggcggggcggaagcgtgttgtgtataggcgtaagatgggttttgggtagtttagagttttcgattggtttttttgtggtggcggggcggggttagaacgagatggttgtgtgcgtaggcgtaagattagcgtttttgggatcggaagttaaggcgttcgcggcgtgtggtaagtgaggggggcgggacgggtgtatcgggttgtggcggcgatggttgtcggagttgggtcgtttgggggtagtttggggtgcgagtttaggggcgagggtattttcgagatgaggagaaatgtaggaggtagtcgaagggtcggtaaacgcggatagagatggtatttgagcgtttttgggagaatttgggcgataggttagagatcgaaagaaatggaggtacgaaaagaagtttcgagaaattgagggattgaaagacgagggtgttgggagaggagggaagttgaaaattagagagcgtgggcgagagtgtcgatgggttttagcgagagttttagagtttacgaggtcgagaggcgtggtcgtttatgaatttggggagtggagggaaaagtcggaaattgatcgtggatattagaaatagaaaaaatggaatttaga

SEQ ID NO: 21750 - DNA, 722 bp, Artificial Sequence
  chemically treated genomic DNA (Homo sapiens) CpG-island No: 21750
tctaaattccattttttctatttctaatatccacgatcaatttccgacttttccctccactccccaaattcataaacgaccacgcctctcgacctcgtaaactctaaaactctcgctaaaacccatcgacactctcgcccacgctctctaattttcaacttccctcctctcccaacaccctcgtctttcaatccctcaatttctcgaaacttcttttcgtacctccatttctttcgatctctaacctatcgcccaaattctcccaaaaacgctcaaataccatctctatccgcgtttaccgacccttcgactacctcctacatttctcctcatctcgaaaataccctcgcccctaaactcgcaccccaaactacccccaaacgacccaactccgacaaccatcgccgccacaacccgatacacccgtcccgcccccctcacttaccacacgccgcgaacgccttaacttccgatcccaaaaacgctaatcttacgcctacgcacacaaccatctcgttctaaccccgccccgccaccacaaaaaaaccaatcgaaaactctaaactacccaaaacccatcttacgcctatacacaacacgcttccgccccgcctcgcttaaaacgaaacctcgaataattacgccctctaaaaaccaataaaaacattacgatacaaacttacaaacgcctcctccccgaccccgccctctcctccccaaac

SEQ ID NO: 21751 - DNA, 722 bp, Artificial Sequence
  chemically treated genomic DNA (Homo sapiens) CpG-island No: 21751
tttaaattttattttttttgtttttagtgtttacgattagttttcgatttttttttttattttttaagtttatgggcgattacgtttttcggtttcgtgggttttaagattttcgttggaatttatcggtattttcgtttacgttttttagtttttagtttttttttttttttaatattttcgttttttagttttttagtttttcgaagttttttttcgtgtttttatttttttcggtttttggtttgtcgtttaggtttttttagggacgtttaggtgttatttttgttcgcgtttgtcggtttttcggttgttttttatatttttttttatttcgagagtgttttcgtttttggattcgtattttaaattatttttaagcggtttaatttcgatagttatcgtcgttataattcggtatattcgtttcgttttttttatttattatacgtcgcgaacgttttaattttcggttttaagagcgttagttttgcgtttgcgtatatagttatttcgttttgatttcgtttcgttattatagaagagttaatcggaagttttgggttgtttaagatttattttgcgtttgtgtatagtacgttttcgtttcgtttcgtttggggcggagtttcgagtgattgcgttttttagaggttagtagaggtattgcggtatagatttgtaagcgtttttttttcggtttcgtttttttttttttaagt

SEQ ID NO: 21752 - DNA, 722 bp, Artificial Sequence
  chemically treated genomic DNA (Homo sapiens) CpG-island No: 21752
acttaaaaaaaaaaaaacgaaaccgaaaaaaaaacgcttacaaatctataccgcaatacctctactaacctctaaaaaacgcaatcactcgaaactccgccccaaacgaaacgaaacgaaaacgtactatacacaaacgcaaaataaatcttaaacaacccaaaacttccgattaactcttctataataacgaaacgaaatcaaaacgaaataactatatacgcaaacgcaaaactaacgctcttaaaaccgaaaattaaaacgttcgcgacgtataataaataaaaaaaacgaaacgaatataccgaattataacgacgataactatcgaaattaaaccgcttaaaaataatttaaaatacgaatccaaaaacgaaaacactctcgaaataaaaaaaaatataaaaaacaaccgaaaaaccgacaaacgcgaacaaaaataacacctaaacgtccctaaaaaaacctaaacgacaaaccaaaaaccgaaaaaaataaaaacacgaaaaaaaacttcgaaaaactaaaaaactaaaaaacgaaaatattaaaaaaaaaaaaaaactaaaaactaaaaaacgtaaacgaaaataccgataaattccaacgaaaatcttaaaacccacgaaaccgaaaaacgtaatcgcccataaacttaaaaaataaaaaaaaaaatcgaaaactaatcgtaaacactaaaaacaaaaaaaataaaatttaaa

SEQ ID NO: 21753 - DNA, 806 bp, Artificial Sequence
  chemically treated genomic DNA (Homo sapiens) CpG-island No: 21753
ttttaacgtttttatttttgacgtttttcgtaattttacggttgttgtaagttaatttttacgcgttttggcgttcgtttgggggttttcgcgcgtttgggcgaggttggggatttcggaggcggggacgcgtcgtttttttttttagttttttcgttaatagacgttgagcgttttttaggcgttgggttcgaagcgggaagcgtggtaacgggggttcggtggatgtcgtatttcgcggaaagcgttcgggacgtcgagcgggtgcggattttagaatcgcgcgttcgcgtcgtttgtttgttttttagattttagtttttagtttcggagttcgagtagtcgcgtcgggttcggaggtagtcgttaggacggagggttgttaggcgttcgaggtcgattcgtacggtttttagttcgcgttttcggttgtaattcgaggttattttttgtcgttttagggttatttatcgtggcgagacgcggcgaggtagttttacgtatttagcgattttcggttttttagtcgttttagtcggggaagggggaggtgttcgcgcgggggcggggtcgcggcgacgtgacgtacgggggcgggttcgatacgcggtttcgtttcgtttcgttttattttttttattgcgtttcgggatcgcgaggtgagtagaggttggtcgggaagtttttcggaggttcgtttcgggaatttcgtttcgtcgttttggaagtttttgtttgttcgttggtttatttttaggacgggtagtttattatttttttcggttagttttgtttaagagaagttt

SEQ ID NO: 21754 - DNA, 806 bp, Artificial Sequence
  chemically treated genomic DNA (Homo sapiens) CpG-island No: 21754
aaacttctcttaaacaaaactaaccgaaaaaaataataaactacccgtcctaaaaataaaccaacgaacaaacaaaaacttccaaaacgacgaaacgaaattcccgaaacgaacctccgaaaaacttcccgaccaacctctactcacctcgcgatcccgaaacgcaataaaaaaaataaaacgaaacgaaacgaaaccgcgtatcgaacccgcccccgtacgtcacgtcgccgcgaccccgcccccgcgcgaacacctcccccttccccgactaaaacgactaaaaaaccgaaaatcgctaaatacgtaaaactacctcgccgcgtctcgccacgataaataaccctaaaacgacaaaaaataacctcgaattacaaccgaaaacgcgaactaaaaaccgtacgaatcgacctcgaacgcctaacaaccctccgtcctaacgactacctccgaacccgacgcgactactcgaactccgaaactaaaaactaaaatctaaaaaacaaacaaacgacgcgaacgcgcgattctaaaatccgcacccgctcgacgtcccgaacgctttccgcgaaatacgacatccaccgaacccccgttaccacgcttcccgcttcgaacccaacgcctaaaaaacgctcaacgtctattaacgaaaaaactaaaaaaaaaaacgacgcgtccccgcctccgaaatccccaacctcgcccaaacgcgcgaaaacccccaaacgaacgccaaaacgcgtaaaaattaacttacaacaaccgtaaaattacgaaaaacgtcaaaaataaaaacgttaaaa

SEQ ID NO: 21755 - DNA, 806 bp, Artificial Sequence
  chemically treated genomic DNA (Homo sapiens) CpG-island No: 21755
gaattttttttaaatagaattgatcgggagaagtggtgagttgttcgttttaggggtaagttagcgagtagataggggtttttagggcggcggggcggggttttcggggcgagttttcgggaaatttttcgattagtttttgtttatttcgcggtttcgaggcgtagtggaggggatggggcggggcggggcggggtcgcgtatcgggttcgttttcgtacgttacgtcgtcgcggtttcgttttcgcgcgggtatttttttttttttcggttggggcggttggagagtcgggagtcgttgggtgcgtggggttgtttcgtcgcgtttcgttacggtaggtggttttggggcggtagggggtggtttcgggttgtaatcgggggcgcgggttgggggtcgtgcgggtcggtttcgggcgtttggtagtttttcgttttggcggttgttttcgggttcggcgcgattgttcgggtttcggggttgggagttgggatttgggaggtaggtaggcggcgcgggcgcgcggttttgggattcgtattcgttcggcgtttcgagcgtttttcgcggggtgcggtatttatcgggttttcgttattacgtttttcgtttcggatttagcgtttgggagacgtttagcgtttgttggcggggggattgggggggagggcggcgcgttttcgttttcggagtttttaatttcgtttaggcgcgcggggatttttaggcgggcgttagggcgcgtggaagttaatttgtagtagtcgtggagttgcgaggagcgttagaagtggaggcgttgggg

SEQ ID NO: 21756 - DNA, 806 bp, Artificial Sequence
  chemically treated genomic DNA (Homo sapiens) CpG-island No: 21756
ccccaacgcctccacttctaacgctcctcgcaactccacgactactacaaattaacttccacgcgccctaacgcccgcctaaaaatccccgcgcgcctaaacgaaattaaaaactccgaaaacgaaaacgcgccgccctcccccccaatccccccgccaacaaacgctaaacgtctcccaaacgctaaatccgaaacgaaaaacgtaataacgaaaacccgataaataccgcaccccgcgaaaaacgctcgaaacgccgaacgaatacgaatcccaaaaccgcgcgcccgcgccgcctacctacctcccaaatcccaactcccaaccccgaaacccgaacaatcgcgccgaacccgaaaacaaccgccaaaacgaaaaactaccaaacgcccgaaaccgacccgcacgacccccaacccgcgcccccgattacaacccgaaaccaccccctaccgccccaaaaccacctaccgtaacgaaacgcgacgaaacaaccccacgcacccaacgactcccgactctccaaccgccccaaccgaaaaaaaaaaaaatacccgcgcgaaaacgaaaccgcgacgacgtaacgtacgaaaacgaacccgatacgcgaccccgccccgccccgccccatcccctccactacgcctcgaaaccgcgaaataaacaaaaactaatcgaaaaatttcccgaaaactcgccccgaaaaccccgccccgccgccctaaaaacccctatctactcgctaacttacccctaaaacgaacaactcaccacttctcccgatcaattctatttaaaaaaaattc

SEQ ID NO: 21757 - DNA, 916 bp, Artificial Sequence
  chemically treated genomic DNA (Homo sapiens) CpG-island No: 21757
atattcgtttttaagatcgagattttgttacggttatattaatataggttttttttttttcggcgtttttttttttcggaggagtttcgtttgcgacgttttttagttaattatttttagtattttttttcgtttttatttagaattttcgtcgcgttttttttttttaggcgggattttcgtcggcgttttttttttcgcggcgtcgtttttttttttcgtttgaggcgagtttgggtttagtttagagtttttcggcggcggcgtagttttagggtagcgcgggttgtagcggcggcggcggttagggttgtgtagggcgaggttttttttttttttttcgttattttattttttttttttcgttatttttttttttcgtttttttcgtttttttttttttcgttaggttcgatttagttgtgagcggtaagatggcggcgtttaggtcgtcgtttgttaggttgtcgggcgttatggtgtcggcgtttatttaagatttggaggttttgcgcgcgtttacggcgttttttaaagagtagcggaatcggtaacgggttcggtcggggggttgtttcgggtaggggagggcggtcgggattttcgcggcggtttcggtttggatttaggcgtcgttttcgtttcgttggagacgcggagggcgaggtttgcgcgggttgtttgagcgttatttaggtttttcgatttttaggtatcgtttcgtgttcgtgggttttcgcggggtttggggcgggcgtttcgtttttttatcgtagttagttcgggtgcgaagtcgcgatttcgggagtttttgtcgcggcgtgtcggtgatgttgatttaatatacggttaggttttttttgttatgtgcgagggttgcgttaggttttggttgtaagatttacgcggtttttag

SEQ ID NO: 21758 - DNA, 916 bp, Artificial Sequence
  chemically treated genomic DNA (Homo sapiens) CpG-island No: 21758
ctaaaaaccgcgtaaatcttacaaccaaaacctaacgcaaccctcgcacataacaaaaaaaacctaaccgtatattaaatcaacatcaccgacacgccgcgacaaaaactcccgaaatcgcgacttcgcacccgaactaactacgataaaaaaacgaaacgcccgccccaaaccccgcgaaaacccacgaacacgaaacgatacctaaaaatcgaaaaacctaaataacgctcaaacaacccgcgcaaacctcgccctccgcgtctccaacgaaacgaaaacgacgcctaaatccaaaccgaaaccgccgcgaaaatcccgaccgccctcccctacccgaaacaaccccccgaccgaacccgttaccgattccgctactctttaaaaaacgccgtaaacgcgcgcaaaacctccaaatcttaaataaacgccgacaccataacgcccgacaacctaacaaacgacgacctaaacgccgccatcttaccgctcacaactaaatcgaacctaacgaaaaaaaaaaaaacgaaaaaaacgaaaaaaaaaaataacgaaaaaaaaaaaataaaataacgaaaaaaaaaaaaaaaacctcgccctacacaaccctaaccgccgccgccgctacaacccgcgctaccctaaaactacgccgccgccgaaaaactctaaactaaacccaaactcgcctcaaacgaaaaaaaaaaacgacgccgcgaaaaaaaaaacgccgacgaaaatcccgcctaaaaaaaaaaaacgcgacgaaaattctaaataaaaacgaaaaaaaatactaaaaataattaactaaaaaacgtcgcaaacgaaactcctccgaaaaaaaaaaacgccgaaaaaaaaaaaacctatattaatataaccgtaacaaaatctcgatcttaaaaacgaatat

SEQ ID NO: 21759 - DNA, 916 bp, Artificial Sequence
  chemically treated genomic DNA (Homo sapiens) CpG-island No: 21759
ttgggggtcgcgtgggttttgtagttagggtttggcgtagttttcgtatatgataggggaggtttaatcgtgtgttgggttaatattatcggtacgtcgcggtaagggttttcgggatcgcggtttcgtattcggattggttgcggtgggggagcggggcgttcgttttaggtttcgcggggatttacgagtacgaggcggtgtttgggagtcgggaggtttgggtggcgtttaggtagttcgcgtaggtttcgtttttcgcgtttttagcgaggcgggggcggcgtttgggtttaggtcggggtcgtcgcgggagtttcggtcgtttttttttgttcggggtagtttttcggtcggattcgttatcggtttcgttgttttttgaagagcgtcgtgagcgcgcgtagggtttttaggttttggatgggcgtcggtattatgacgttcgatagtttggtaggcggcggtttgggcgtcgttattttgtcgtttatagttgggtcgagtttgacgaggaggaggaaggcgaggaggacgaagggggaggatgacgaggagggaggagtaggatggcgaggaggaagggggaggtttcgttttatatagttttaatcgtcgtcgtcgttgtagttcgcgttgttttgaagttgcgtcgtcgtcggagagttttaggttgagtttagattcgttttaggcgggaggaggagacggcgtcgcgggggagggggcgtcggcggaagtttcgtttgaggggagggggcgcggcggaagttttgggtgagagcggggagggatgttgggggtgattgattgggaagcgtcgtagacggggttttttcgaggggaggggacgtcggggggagggggatttgtgttgatgtggtcgtaatagggtttcggttttgggagcgggtat

SEQ ID NO: 21760 - DNA, 916 bp, Artificial Sequence
  chemically treated genomic DNA (Homo sapiens) CpG-island No: 21760
atacccgctcccaaaaccgaaaccctattacgaccacatcaacacaaatccccctccccccgacgtcccctcccctcgaaaaaaccccgtctacgacgcttcccaatcaatcacccccaacatccctccccgctctcacccaaaacttccgccgcgccccctcccctcaaacgaaacttccgccgacgccccctcccccgcgacgccgtctcctcctcccgcctaaaacgaatctaaactcaacctaaaactctccgacgacgacgcaacttcaaaacaacgcgaactacaacgacgacgacgattaaaactatataaaacgaaacctcccccttcctcctcgccatcctactcctccctcctcgtcatcctcccccttcgtcctcctcgccttcctcctcctcgtcaaactcgacccaactataaacgacaaaataacgacgcccaaaccgccgcctaccaaactatcgaacgtcataataccgacgcccatccaaaacctaaaaaccctacgcgcgctcacgacgctcttcaaaaaacaacgaaaccgataacgaatccgaccgaaaaactaccccgaacaaaaaaaaacgaccgaaactcccgcgacgaccccgacctaaacccaaacgccgcccccgcctcgctaaaaacgcgaaaaacgaaacctacgcgaactacctaaacgccacccaaacctcccgactcccaaacaccgcctcgtactcgtaaatccccgcgaaacctaaaacgaacgccccgctcccccaccgcaaccaatccgaatacgaaaccgcgatcccgaaaacccttaccgcgacgtaccgataatattaacccaacacacgattaaacctcccctatcatatacgaaaactacgccaaaccctaactacaaaacccacgcgacccccaa

SEQ ID NO: 21761 - DNA, 673 bp, Artificial Sequence
  chemically treated genomic DNA (Homo sapiens) CpG-island No: 21761
ttaaattttttatttttagcgaaagttcgcgtcggagggcgattgtcggcgagcgggagcggcgtagggttcggggcgggcggttagtttagttttagcgttagcgttagcgttagcgcgggttgagttcgcgggaagaagggagattttaggcgcgatagtagtcgcggtttttagttttagcgtcgtttaatgttttcgattcgcgggaaaagacgaagaggttttgtggtgtttaaggttttggaacggtcgtagagagtaatcgttgtcggttgttttgtttagttcgaggtttagcgaacgcgtagagagcgggcgtttcgaggattcgtcgagggagcgtcgagggaatttgttcgtcgcgttttcgttcgttcgtcggttttcgggttttgtgtcgtattgggtttcggcgtagaagagttagtcggtattcgagcgtcgaggggggtatcgcgttcgttattagttcgagtggagttagtcggtaaggtagtcgtacgttggaggtagagggaagagcgagttagcgcgagtcgggaaggaagttattaggttaaggcggtggaacgcgcgtttcgagggagtttagagtcgagcgggaggattgttagtttttatttagttttcgggtttttgtttttaattttattggagcgttgagttcgga

SEQ ID NO: 21762 - DNA, 673 bp, Artificial Sequence
  chemically treated genomic DNA (Homo sapiens) CpG-island No: 21762
tccgaactcaacgctccaataaaattaaaaacaaaaacccgaaaactaaataaaaactaacaatcctcccgctcgactctaaactccctcgaaacgcgcgttccaccgccttaacctaataacttccttcccgactcgcgctaactcgctcttccctctacctccaacgtacgactaccttaccgactaactccactcgaactaataacgaacgcgatacccccctcgacgctcgaataccgactaactcttctacgccgaaacccaatacgacacaaaacccgaaaaccgacgaacgaacgaaaacgcgacgaacaaattccctcgacgctccctcgacgaatcctcgaaacgcccgctctctacgcgttcgctaaacctcgaactaaacaaaacaaccgacaacgattactctctacgaccgttccaaaaccttaaacaccacaaaacctcttcgtcttttcccgcgaatcgaaaacattaaacgacgctaaaactaaaaaccgcgactactatcgcgcctaaaatctcccttcttcccgcgaactcaacccgcgctaacgctaacgctaacgctaaaactaaactaaccgcccgccccgaaccctacgccgctcccgctcgccgacaatcgccctccgacgcgaactttcgctaaaaataaaaaatttaa

SEQ ID NO: 21763 - DNA, 673 bp, Artificial Sequence
  chemically treated genomic DNA (Homo sapiens) CpG-island No: 21763
ttcgagtttagcgttttagtggagttgggggtaagagttcgggggttgggtggaagttgatagttttttcgttcggttttgagttttttcggagcgcgcgttttatcgttttggtttggtggtttttttttcggttcgcgttagttcgtttttttttttatttttagcgtgcggttgttttgtcgattgattttattcgggttggtggcgggcgcggtgtttttttcggcgttcgagtgtcggttgatttttttgcgtcggagtttagtgcggtataaagttcgagggtcggcgggcgggcggagacgcggcgagtaggttttttcggcgttttttcggcgagttttcggagcgttcgttttttgcgcgttcgttgggtttcgggttggataaagtagtcggtagcggttgttttttgcggtcgttttagggttttgggtattatagagttttttcgttttttttcgcgggtcgggagtattgggcgacgttggggttaggagtcgcggttgttgtcgcgtttggagtttttttttttttcgcgagtttagttcgcgttggcgttggcgttggcgttggggttgagttggtcgttcgtttcgagttttgcgtcgttttcgttcgtcggtagtcgtttttcgacgcgggttttcgttggaagtagaaagtttgg

SEQ ID NO: 21764 - DNA, 673 bp, Artificial Sequence
  chemically treated genomic DNA (Homo sapiens) CpG-island No: 21764
ccaaactttctacttccaacgaaaacccgcgtcgaaaaacgactaccgacgaacgaaaacgacgcaaaactcgaaacgaacgaccaactcaaccccaacgccaacgccaacgccaacgcgaactaaactcgcgaaaaaaaaaaaaactccaaacgcgacaacaaccgcgactcctaaccccaacgtcgcccaatactcccgacccgcgaaaaaaaacgaaaaaactctataatacccaaaaccctaaaacgaccgcaaaaaacaaccgctaccgactactttatccaacccgaaacccaacgaacgcgcaaaaaacgaacgctccgaaaactcgccgaaaaaacgccgaaaaaacctactcgccgcgtctccgcccgcccgccgaccctcgaactttataccgcactaaactccgacgcaaaaaaatcaaccgacactcgaacgccgaaaaaaacaccgcgcccgccaccaacccgaataaaatcaatcgacaaaacaaccgcacgctaaaaataaaaaaaaaaacgaactaacgcgaaccgaaaaaaaaaccaccaaaccaaaacgataaaacgcgcgctccgaaaaaactcaaaaccgaacgaaaaaactatcaacttccacccaacccccgaactcttacccccaactccactaaaacgctaaactcgaa

SEQ ID NO: 21765 - DNA, 528 bp, Artificial Sequence
  chemically treated genomic DNA (Homo sapiens) CpG-island No: 21765
tcgtcgcgcgttgtcgggataacggcgcgttaggaacgcggaaatagtcgaaggtgagcgaggcggtttcgaggattttcgaagcgtttcgagcggtcggaaagagtcgaaggcgatcgggtacgtacgtgtagtttcgaggttcgagcgtcgggggttaggttatttcgttttgtaagagagaagcgggacgagttttttttaggagagacggcggcgtagggtcggcgtttgggttttttttgtgtggagggcgcgttgttatagtttcgattaatcgcggtattttttttttttgggcgtgtttttttttcgtgtatttcgaggcggagtttttttagtacgcggcggtttcggtttaggttttttttgggtttcgtttttttagtttcggagcggagggcgtgggttaagcgtttttgggaaagtcgatgcgttcggtagtgttttgaggtgttgggtgattgagggtttgttttatcgtcgggtttcggattttatagagttaagcgaggtagggagcgtttt

SEQ ID NO: 21766 - DNA, 528 bp, Artificial Sequence
  chemically treated genomic DNA (Homo sapiens) CpG-island No: 21766
aaaacgctccctacctcgcttaactctataaaatccgaaacccgacgataaaacaaaccctcaatcacccaacacctcaaaacactaccgaacgcatcgactttcccaaaaacgcttaacccacgccctccgctccgaaactaaaaaaacgaaacccaaaaaaaacctaaaccgaaaccgccgcgtactaaaaaaactccgcctcgaaatacacgaaaaaaaaacacgcccaaaaaaaaaaaataccgcgattaatcgaaactataacaacgcgccctccacacaaaaaaaacccaaacgccgaccctacgccgccgtctctcctaaaaaaaactcgtcccgcttctctcttacaaaacgaaataacctaacccccgacgctcgaacctcgaaactacacgtacgtacccgatcgccttcgactctttccgaccgctcgaaacgcttcgaaaatcctcgaaaccgcctcgctcaccttcgactatttccgcgttcctaacgcgccgttatcccgacaacgcgcgacga

SEQ ID NO: 21767 - DNA, 528 bp, Artificial Sequence
  chemically treated genomic DNA (Homo sapiens) CpG-island No: 21767
ggggcgttttttgtttcgtttggttttgtggagttcggggttcggcgatggaataggtttttagttatttaatattttaggatattgtcgagcgtatcgatttttttagaaacgtttgatttacgtttttcgtttcgaaattagaaaagcggagtttagggaaggtttgggtcgagatcgtcgcgtgttggaaaggtttcgtttcgggatgtacgggaagggaatacgtttaggaggggaggatgtcgcggttgatcggggttgtgatagcgcgttttttatataaaggggatttagacgtcggttttgcgtcgtcgttttttttagaaaaagttcgtttcgttttttttttgtagagcggaataatttggttttcgacgttcgggtttcggagttgtacgtgcgtgttcgatcgttttcggtttttttcggtcgttcggggcgtttcgggagttttcggggtcgtttcgtttattttcggttattttcgcgtttttggcgcgtcgttgtttcggtaacgcgcggcgg

SEQ ID NO: 21768 - DNA, 528 bp, Artificial Sequence
  chemically treated genomic DNA (Homo sapiens) CpG-island No: 21768
ccgccgcgcgttaccgaaacaacgacgcgccaaaaacgcgaaaataaccgaaaataaacgaaacgaccccgaaaactcccgaaacgccccgaacgaccgaaaaaaaccgaaaacgatcgaacacgcacgtacaactccgaaacccgaacgtcgaaaaccaaattattccgctctacaaaaaaaaaacgaaacgaactttttctaaaaaaaacgacgacgcaaaaccgacgtctaaatcccctttatataaaaaacgcgctatcacaaccccgatcaaccgcgacatcctcccctcctaaacgtattcccttcccgtacatcccgaaacgaaacctttccaacacgcgacgatctcgacccaaaccttccctaaactccgcttttctaatttcgaaacgaaaaacgtaaatcaaacgtttctaaaaaaatcgatacgctcgacaatatcctaaaatattaaataactaaaaacctattccatcgccgaaccccgaactccacaaaaccaaacgaaacaaaaaacgcccc

SEQ ID NO: 21769 - DNA, 1231 bp, Artificial Sequence
  chemically treated genomic DNA (Homo sapiens) CpG-island No: 21769
atattttatttaggaaagggtgcgtttaattgttttagacgtgtttttatattttttagaatttaggttcgcgttcgattttatatttcgagttattacgtcgttttttttttacgtattcgttaatattgttgcggttaattatagtacgggttttggtttattggttgtttgtttattaatttaaagagacgtatagttcgtaaggtcgcgaggttggcgttataatattattggcgtcgcgggttcgttttcgacgtttatcgggttcgtacgtgcgagcgcgttcgtttagcgttagttaatgggagcgtcgttttggggagacgggttcgaagaaatattgggggtgttcgttttcgcgttcgtcgtttcgtttcggcgttcgcgtatttcggtttcgttttcgcgcgtcgttcgtgaggtttttatcggtcgtcgtagtcggaattgttgttgagggcggcgggtcggtttcgttagggtgagtggcggtagtatttgcgttcgtagttttcgtagtcgcgcgtcggttcgcggaggggacgtgtcggggttagcgtcgttcgattagtcgttttcgaggcggacgattagttcggcgttgcggtttttttgtagtcggcgttcgggggtcggggttgttcggttcggttggttttgcgggtattcggggaggtttcgggaagttaggttgtcgttcggcgttgatgaaaaaggtgattaaggttgggcggcggggttgttatggcgaggttcggtcggggggttttgtcgggcggcgcgggagagcgcggggggggcgtcgtttttatagcgttcggtatagttataattggttttagggcgaggaggtttttgcgtttttatttcgagacgcgagtcggtgcggagcgggacggggttggaggagattgcgttttcgagaaaagttcggtttcgttggaggttttcgcgaaaaggaggttatttttttgtttgttggtttttagggtaaagtttggacggcgtcggtttttttagtggcgaaaagcgttttttcgtgttcggtcggcgttttgggtgtggagttcggcgagcgggcgagtttattttggtggtcgagtttgttttgtttgggtttcgggtggtttgcgggcggataggtttttgggtagcggggtttttagttcgagacgaggtttttgggggtttaggttttttgagtggaaagaggtgggttgagggggaa

SEQ ID NO: 21770 - DNA, 1231 bp, Artificial Sequence
  chemically treated genomic DNA (Homo sapiens) CpG-island No: 21770
ttccccctcaacccacctctttccactcaaaaaacctaaacccccaaaaacctcgtctcgaactaaaaaccccgctacccaaaaacctatccgcccgcaaaccacccgaaacccaaacaaaacaaactcgaccaccaaaataaactcgcccgctcgccgaactccacacccaaaacgccgaccgaacacgaaaaaacgcttttcgccactaaaaaaaccgacgccgtccaaactttaccctaaaaaccaacaaacaaaaaaataacctccttttcgcgaaaacctccaacgaaaccgaacttttctcgaaaacgcaatctcctccaaccccgtcccgctccgcaccgactcgcgtctcgaaataaaaacgcaaaaacctcctcgccctaaaaccaattataactataccgaacgctataaaaacgacgccccccccgcgctctcccgcgccgcccgacaaaaccccccgaccgaacctcgccataacaaccccgccgcccaaccttaatcacctttttcatcaacgccgaacgacaacctaacttcccgaaacctccccgaatacccgcaaaaccaaccgaaccgaacaaccccgacccccgaacgccgactacaaaaaaaccgcaacgccgaactaatcgtccgcctcgaaaacgactaatcgaacgacgctaaccccgacacgtcccctccgcgaaccgacgcgcgactacgaaaactacgaacgcaaatactaccgccactcaccctaacgaaaccgacccgccgccctcaacaacaattccgactacgacgaccgataaaaacctcacgaacgacgcgcgaaaacgaaaccgaaatacgcgaacgccgaaacgaaacgacgaacgcgaaaacgaacacccccaatatttcttcgaacccgtctccccaaaacgacgctcccattaactaacgctaaacgaacgcgctcgcacgtacgaacccgataaacgtcgaaaacgaacccgcgacgccaataatattataacgccaacctcgcgaccttacgaactatacgtctctttaaattaataaacaaacaaccaataaaccaaaacccgtactataattaaccgcaacaatattaacgaatacgtaaaaaaaaaacgacgtaataactcgaaatataaaatcgaacgcgaacctaaattctaaaaaatataaaaacacgtctaaaacaattaaacgcaccctttcctaaataaaatat

SEQ ID NO: 21771 - DNA, 1231 bp, Artificial Sequence
  chemically treated genomic DNA (Homo sapiens) CpG-island No: 21771
tttttttttaatttatttttttttatttaagaaatttaaatttttaaagatttcgtttcgggttgagaatttcgttgtttagggatttgttcgttcgtaggttattcgggatttaagtaaaataaattcggttattagagtgaattcgttcgttcgtcgggttttatatttaagacgtcgatcgagtacggggaagcgtttttcgttattgaaaggatcgacgtcgtttagattttattttaagggttaataagtagggggatggtttttttttcgcgagaatttttaacgagatcggatttttttcggaggcgtagttttttttagtttcgtttcgtttcgtatcggttcgcgtttcgggatggggacgtagaagttttttcgttttgaggttagttgtggttgtatcgggcgttgtggaagcgacgtttttttcgcgttttttcgcgtcgttcgataggatttttcggtcgggtttcgttatgatagtttcgtcgtttagttttggttattttttttattaacgtcgggcggtagtttggtttttcggggttttttcgggtgttcgtagaattagtcgggtcgggtagtttcggttttcgagcgtcggttgtagggaggtcgtaacgtcgggttggtcgttcgtttcggaagcgattggtcgagcggcgttagtttcggtacgtttttttcgcgggtcggcgcgcggttgcgggggttgcggacgtagatattgtcgttatttattttagcgaagtcggttcgtcgtttttagtagtagtttcggttacggcggtcggtggggattttacggacggcgcgcgggggcggggtcggggtgcgcgggcgtcggggcggggcgacgaacgcgggggcgagtatttttaatgttttttcgggttcgtttttttaaaacggcgtttttattggttagcgttgggcgggcgcgttcgtacgtacgagttcggtgggcgtcgggggcgagttcgcggcgttagtagtgttgtgacgttagtttcgcgattttgcggattgtgcgtttttttggattggtggatagatagttaataggttagggttcgtgttgtgattggtcgtagtagtgttgacggatacgtgagaagaaaacggcgtggtagttcggagtgtggaatcgggcgcgaatttgagttttgagaagtgtggaagtacgtttgaggtagttaagcgtatttttttttgggtggagtat

SEQ ID NO: 21772 - DNA, 1231 bp, Artificial Sequence
  chemically treated genomic DNA (Homo sapiens) CpG-island No: 21772
atactccacccaaaaaaaaatacgcttaactacctcaaacgtacttccacacttctcaaaactcaaattcgcgcccgattccacactccgaactaccacgccgttttcttctcacgtatccgtcaacactactacgaccaatcacaacacgaaccctaacctattaactatctatccaccaatccaaaaaaacgcacaatccgcaaaatcgcgaaactaacgtcacaacactactaacgccgcgaactcgcccccgacgcccaccgaactcgtacgtacgaacgcgcccgcccaacgctaaccaataaaaacgccgttttaaaaaaacgaacccgaaaaaacattaaaaatactcgcccccgcgttcgtcgccccgccccgacgcccgcgcaccccgaccccgcccccgcgcgccgtccgtaaaatccccaccgaccgccgtaaccgaaactactactaaaaacgacgaaccgacttcgctaaaataaataacgacaatatctacgtccgcaacccccgcaaccgcgcgccgacccgcgaaaaaaacgtaccgaaactaacgccgctcgaccaatcgcttccgaaacgaacgaccaacccgacgttacgacctccctacaaccgacgctcgaaaaccgaaactacccgacccgactaattctacgaacacccgaaaaaaccccgaaaaaccaaactaccgcccgacgttaataaaaaaaataaccaaaactaaacgacgaaactatcataacgaaacccgaccgaaaaatcctatcgaacgacgcgaaaaaacgcgaaaaaaacgtcgcttccacaacgcccgatacaaccacaactaacctcaaaacgaaaaaacttctacgtccccatcccgaaacgcgaaccgatacgaaacgaaacgaaactaaaaaaaactacgcctccgaaaaaaatccgatctcgttaaaaattctcgcgaaaaaaaaaccatccccctacttattaacccttaaaataaaatctaaacgacgtcgatcctttcaataacgaaaaacgcttccccgtactcgatcgacgtcttaaatataaaacccgacgaacgaacgaattcactctaataaccgaatttattttacttaaatcccgaataacctacgaacgaacaaatccctaaacaacgaaattctcaacccgaaacgaaatctttaaaaatttaaatttcttaaataaaaaaaaataaattaaaaaaaaa

SEQ ID NO: 21773 - DNA, 972 bp, Artificial Sequence
  chemically treated genomic DNA (Homo sapiens) CpG-island No: 21773
agtttttcgtgcgggtaggcgagttcgcgtttttttcgtttcggggtggattcggttttttttgtttttttttagggttagttttgggggtcggcgcgtggggtaggtgcgcggggttcgggagtttcgcgtttttcggggggcggggagggggtgggacgaggggttagggttggggttgcggttcggtcggtcgaggcggcgtagggagcgaggtcggcgcgtagggttaggttatgagtcgcggtttcgtcgggtaggtggttgtgggcggggtagcggttcggattcgtaatcgtgtttagattcgcgttcgcgtcggggtttttatagatttcggggtcggggtcggggtcggggtcgggtagggttcgtcgagttgtcgcgttttttcgtcgtcggttcgggcgtttggacgcgagtttcggttagggggcgttcggggaggttcgggagggtttcgggttggtgggtagggtcgggggcggcggcgtgggggcggtaggggtcgcggcgggttcgggcgggttcgggcgggtcgggtcgagtcgtcgagaggggatttggaataaataacggcggttatgttgagagcgcgtcggggtcgttaaatttttcggtttgcgttcgttttatcggtcgttttttttttttcggtcgtaggatgatagtgaagttgggcgacggcggtagcggggaggacgggtttaagaagttgggtaagcgggcggtcgatgaggagtttttggaaggagaaggggtcggcggcgtagacgcggtcgaggagagtagcggtataaagagggacgagaagatttttcgggtcggcgtcgacggttttttcgcgtttttcggcgcgtcgtaggcgtcgttttcgtcgtagggtagtttttaggattagtattatttttttcggtttagcgtgcggtcgtagagtaagaggtttaggaaggatttttcgagcgttgtggg

SEQ ID NO: 21774 - DNA, 972 bp, Artificial Sequence
  chemically treated genomic DNA (Homo sapiens) CpG-island No: 21774
cccacaacgctcgaaaaatccttcctaaacctcttactctacgaccgcacgctaaaccgaaaaaaataatactaatcctaaaaactaccctacgacgaaaacgacgcctacgacgcgccgaaaaacgcgaaaaaaccgtcgacgccgacccgaaaaatcttctcgtccctctttataccgctactctcctcgaccgcgtctacgccgccgaccccttctccttccaaaaactcctcatcgaccgcccgcttacccaacttcttaaacccgtcctccccgctaccgccgtcgcccaacttcactatcatcctacgaccgaaaaaaaaaaaacgaccgataaaacgaacgcaaaccgaaaaatttaacgaccccgacgcgctctcaacataaccgccgttatttattccaaatcccctctcgacgactcgacccgacccgcccgaacccgcccgaacccgccgcgacccctaccgcccccacgccgccgcccccgaccctacccaccaacccgaaaccctcccgaacctccccgaacgccccctaaccgaaactcgcgtccaaacgcccgaaccgacgacgaaaaaacgcgacaactcgacgaaccctacccgaccccgaccccgaccccgaccccgaaatctataaaaaccccgacgcgaacgcgaatctaaacacgattacgaatccgaaccgctaccccgcccacaaccacctacccgacgaaaccgcgactcataacctaaccctacgcgccgacctcgctccctacgccgcctcgaccgaccgaaccgcaaccccaaccctaacccctcgtcccaccccctccccgccccccgaaaaacgcgaaactcccgaaccccgcgcacctaccccacgcgccgacccccaaaactaaccctaaaaaaaaacaaaaaaaaccgaatccaccccgaaacgaaaaaaacgcgaactcgcctacccgcacgaaaaact

SEQ ID NO: 21775 - DNA, 972 bp, Artificial Sequence
  chemically treated genomic DNA (Homo sapiens) CpG-island No: 21775
tttatagcgttcggaggattttttttgggttttttgttttgcggtcgtacgttggatcggaggaagtggtgttggttttgggggttgttttgcggcggggacggcgtttgcggcgcgtcggggggcgcgggggggtcgtcggcgtcggttcggggggttttttcgtttttttttgtgtcgttgtttttttcggtcgcgtttgcgtcgtcggttttttttttttttagggattttttatcggtcgttcgtttgtttagttttttgagttcgtttttttcgttgtcgtcgtcgtttaattttattgttattttgcggtcgggagaggggaggcggtcggtgaggcgggcgtaggtcgggaagtttagcggtttcgacgcgtttttaatatggtcgtcgttgtttgttttaaattttttttcggcggttcggttcggttcgttcgagttcgttcgagttcgtcgcggtttttgtcgtttttacgtcgtcgttttcggttttgtttattagttcgggattttttcgggttttttcggacgttttttggtcgaggttcgcgtttagacgttcgggtcggcggcgggagggcgcgatagttcggcggattttgttcggtttcggtttcggtttcggtttcggggtttatgggagtttcggcgcgggcgcgggtttgggtacggttgcgggttcgggtcgttgtttcgtttatagttatttattcggcggggtcgcggtttatggtttggttttgcgcgtcggtttcgttttttgcgtcgtttcggtcggtcgggtcgtagttttagttttagtttttcgttttatttttttttcgtttttcgaaaggcgcggggttttcgggtttcgcgtatttgttttacgcgtcggtttttagagttggttttggaggaggatagaggaggtcggatttatttcgggacgggagaagcgcgggttcgtttgttcgtacggggaatt

SEQ ID NO: 21776 - DNA, 972 bp, Artificial Sequence
  chemically treated genomic DNA (Homo sapiens) CpG-island No: 21776
aattccccgtacgaacaaacgaacccgcgcttctcccgtcccgaaataaatccgacctcctctatcctcctccaaaaccaactctaaaaaccgacgcgtaaaacaaatacgcgaaacccgaaaaccccgcgcctttcgaaaaacgaaaaaaaaataaaacgaaaaactaaaactaaaactacgacccgaccgaccgaaacgacgcaaaaaacgaaaccgacgcgcaaaaccaaaccataaaccgcgaccccgccgaataaataactataaacgaaacaacgacccgaacccgcaaccgtacccaaacccgcgcccgcgccgaaactcccataaaccccgaaaccgaaaccgaaaccgaaaccgaacaaaatccgccgaactatcgcgccctcccgccgccgacccgaacgtctaaacgcgaacctcgaccaaaaaacgtccgaaaaaacccgaaaaaatcccgaactaataaacaaaaccgaaaacgacgacgtaaaaacgacaaaaaccgcgacgaactcgaacgaactcgaacgaaccgaaccgaaccgccgaaaaaaaatttaaaacaaacaacgacgaccatattaaaaacgcgtcgaaaccgctaaacttcccgacctacgcccgcctcaccgaccgcctcccctctcccgaccgcaaaataacaataaaattaaacgacgacgacaacgaaaaaaacgaactcaaaaaactaaacaaacgaacgaccgataaaaaatccctaaaaaaaaaaaaaaccgacgacgcaaacgcgaccgaaaaaaacaacgacacaaaaaaaaacgaaaaaaccccccgaaccgacgccgacgacccccccgcgccccccgacgcgccgcaaacgccgtccccgccgcaaaacaacccccaaaaccaacaccacttcctccgatccaacgtacgaccgcaaaacaaaaaacccaaaaaaaatcctccgaacgctataaa

SEQ ID NO: 21777 - DNA, 837 bp, Artificial Sequence
  chemically treated genomic DNA (Homo sapiens) CpG-island No: 21777
ttatcgcgttcgggcgcgtagggggagcggttatcgcgtcgaggttttatttgaaagaaaaaagggtacgaaaaaggaggtggtggagaaggaggaggaggaggaggaggaggagggggaggaggaagaaaacgaaaaggagcgaggagaggaggagaaagaggaggaggaggagaaaggcgaagaaaaagagtttgagagacggagaaagagcgagagaggaagaaagagaggtagaaagggcgtgtttttggcgttgcgttttttttttttttttttaggtttttcgttcgggttttgcgcgtttttcggttgtagttttttttcggcgaagttgggaattgggtgggattatacggagtagtttcgtcgtcgtcgttggtagaggtcggtttggagagggcgggggttttttttcgttagtcgtttttggcgtttttcgtttcgtcgtatttttcgtttcgtttttttcgacgttcggttaggaggagtcggtagtatcgggagtttcgcgtcgagggcgtcgcggttcgcgtttcgcgattgtagttttcggtttggtttcggcggggcgttttttttttttttttttttgcgagttgggattcggtcggttttcgtttttttttggtcgcgagatcggtttcggcggttgggtcgttagtagttttagttatgggttcggggcgcgtattcgggttttgtttgtttgttttgttggtttacgttcgcgtcgtttagtatagtaaagtcgcgtaaggtaaggaaggaggggcgcgcggtttgggggttgttttggttgttgggttttagggtttaggagcgattttcgagggg

SEQ ID NO: 21778 - DNA, 837 bp, Artificial Sequence
  chemically treated genomic DNA (Homo sapiens) CpG-island No: 21778
cccctcgaaaatcgctcctaaaccctaaaacccaacaaccaaaacaacccccaaaccgcgcgcccctccttccttaccttacgcgactttactatactaaacgacgcgaacgtaaaccaacaaaacaaacaaacaaaacccgaatacgcgccccgaacccataactaaaactactaacgacccaaccgccgaaaccgatctcgcgaccaaaaaaaaacgaaaaccgaccgaatcccaactcgcaaaaaaaaaaaaaaaaaaaacgccccgccgaaaccaaaccgaaaactacaatcgcgaaacgcgaaccgcgacgccctcgacgcgaaactcccgatactaccgactcctcctaaccgaacgtcgaaaaaaacgaaacgaaaaatacgacgaaacgaaaaacgccaaaaacgactaacgaaaaaaaacccccgccctctccaaaccgacctctaccaacgacgacgacgaaactactccgtataatcccacccaattcccaacttcgccgaaaaaaaactacaaccgaaaaacgcgcaaaacccgaacgaaaaacctaaaaaaaaaaaaaaaaaacgcaacgccaaaaacacgccctttctacctctctttcttcctctctcgctctttctccgtctctcaaactctttttcttcgcctttctcctcctcctcctctttctcctcctctcctcgctccttttcgttttcttcctcctccccctcctcctcctcctcctcctcctccttctccaccacctcctttttcgtacccttttttctttcaaataaaacctcgacgcgataaccgctccccctacgcgcccgaacgcgataa

SEQ ID NO: 21779 - DNA, 837 bp, Artificial Sequence
  chemically treated genomic DNA (Homo sapiens) CpG-island No: 21779
tttttcgggaatcgtttttaggttttgaggtttagtagttaggatagtttttaggtcgcgcgtttttttttttttattttgcgcggttttgttgtattgggcggcgcgggcgtggattagtaggataagtaggtagagttcgggtacgcgtttcgagtttatggttggagttattggcggtttagtcgtcggggtcggtttcgcggttaggggagggcggaagtcggtcggattttagttcgtaggagggggaggggagggggcgtttcgtcggggttaggtcgggggttgtagtcgcggggcgcggatcgcggcgttttcggcgcgaggttttcgatgttatcggttttttttggtcggacgtcggggagagcgaggcggagagtgcgacgaggcgaggggcgttaggggcgattgacggaggggaattttcgttttttttaagtcggtttttgttagcggcggcggcggggttgtttcgtgtaattttatttaatttttagtttcgtcgggagagagttgtagtcggagagcgcgtagagttcgagcgaaggatttgagaaaggggaggggaaacgtagcgttagaaatacgttttttttgtttttttttttttttttttcgtttttttttcgttttttaggtttttttttttcgttttttttttttttttttttttttttttttttttttcgttttttttcgttttttttttttttttttttttttttttttttttttttttttttttttattattttttttttcgtgttttttttttttttaaatggggtttcggcgcggtggtcgttttttttgcgcgttcgggcgcggtgg

SEQ ID NO: 21780 - DNA, 837 bp, Artificial Sequence
  chemically treated genomic DNA (Homo sapiens) CpG-island No: 21780
ccaccgcgcccgaacgcgcaaaaaaaacgaccaccgcgccgaaaccccatttaaaaaaaaaaaaaacacgaaaaaaaaaataataaaaaaaaaaaaaaaaaaaaaaaaaaaaaaaaaaaaaaaaaaaaaaaacgaaaaaaaacgaaaaaaaaaaaaaaaaaaaaaaaaaaaaaaaaaaaacgaaaaaaaaaaacctaaaaaacgaaaaaaaaacgaaaaaaaaaaaaaaaaaaacaaaaaaaacgtatttctaacgctacgtttcccctcccctttctcaaatccttcgctcgaactctacgcgctctccgactacaactctctcccgacgaaactaaaaattaaataaaattacacgaaacaaccccgccgccgccgctaacaaaaaccgacttaaaaaaaacgaaaattcccctccgtcaatcgcccctaacgcccctcgcctcgtcgcactctccgcctcgctctccccgacgtccgaccaaaaaaaaccgataacatcgaaaacctcgcgccgaaaacgccgcgatccgcgccccgcgactacaacccccgacctaaccccgacgaaacgccccctcccctccccctcctacgaactaaaatccgaccgacttccgccctcccctaaccgcgaaaccgaccccgacgactaaaccgccaataactccaaccataaactcgaaacgcgtacccgaactctacctacttatcctactaatccacgcccgcgccgcccaatacaacaaaaccgcgcaaaataaaaaaaaaaaaacgcgcgacctaaaaactatcctaactactaaacctcaaaacctaaaaacgattcccgaaaaa

SEQ ID NO: 21781 - DNA, 858 bp, Artificial Sequence
  chemically treated genomic DNA (Homo sapiens) CpG-island No: 21781
gggatcgtaagatagtgagtgttgagcgcgcggtcgggaagaagtttggaggttttgagttcggaggatagagatcgaagttttagggtttgcgttttttataatttgcgttttttgttttttcgcgttattttcgaagcgtattttttcgttcgtaggtcgtagaagtgatgacgtaaagttttcggggttttcgttatttttttacgtttttgttggatcgaatttttggaatggataggtagcggttttcgattgttatagcgacgattcggtttcgagtcgcgtttaggttttgattcgggcgtcgtgacgttagtacgttttttttgggcgtttagtttcgttggttatgcgttatttcggttttggtgggggcggggtttcgaagagttcggtttagatttcggtcgtttgggttttaggagtttcggaattaggataagttggatggttgtcgcggcgaagcggggggcggggtggatcgtgttcggtattttttatacgggtttcggggttcggtagaggcgcgttaagaggaaaggaaagtgcggcggttttggaatttggatatcgcgcgaggtaagttgcgcgcgggcgggcgggttatggcgtaggcgggttgtggggtcggcgttggtggcggggttcggtgtatggcggtttgtcggcggagtcgttttcgggggttgttaggttggtggttgcgggaggagtgggttaattatgtttagggcgggaggtcgggcgggcgtaggatttcgggaaggtttcgagttcggcgtgtttattttttttcggttttagtagggcggtttggtcgttggatcgcggtcgggtttttttttttatttaggg

SEQ ID NO: 21782 - DNA, 858 bp, Artificial Sequence
  chemically treated genomic DNA (Homo sapiens) CpG-island No: 21782
ccctaaataaaaaaaaaaacccgaccgcgatccaacgaccaaaccgccctactaaaaccgaaaaaaaataaacacgccgaactcgaaaccttcccgaaatcctacgcccgcccgacctcccgccctaaacataattaacccactcctcccgcaaccaccaacctaacaacccccgaaaacgactccgccgacaaaccgccatacaccgaaccccgccaccaacgccgaccccacaacccgcctacgccataacccgcccgcccgcgcgcaacttacctcgcgcgatatccaaattccaaaaccgccgcactttcctttcctcttaacgcgcctctaccgaaccccgaaacccgtataaaaaataccgaacacgatccaccccgccccccgcttcgccgcgacaaccatccaacttatcctaattccgaaactcctaaaacccaaacgaccgaaatctaaaccgaactcttcgaaaccccgcccccaccaaaaccgaaataacgcataaccaacgaaactaaacgcccaaaaaaaacgtactaacgtcacgacgcccgaatcaaaacctaaacgcgactcgaaaccgaatcgtcgctataacaatcgaaaaccgctacctatccattccaaaaattcgatccaacaaaaacgtaaaaaaataacgaaaaccccgaaaactttacgtcatcacttctacgacctacgaacgaaaaaatacgcttcgaaaataacgcgaaaaaacaaaaaacgcaaattataaaaaacgcaaaccctaaaacttcgatctctatcctccgaactcaaaacctccaaacttcttcccgaccgcgcgctcaacactcactatcttacgatccc

SEQ ID NO: 21783 - DNA, 858 bp, Artificial Sequence
  chemically treated genomic DNA (Homo sapiens) CpG-island No: 21783
ttttgggtgggggagggggttcggtcgcggtttagcggttaggtcgttttgttagggtcggagggaggtgggtacgtcgggttcgggattttttcggggttttgcgttcgttcggtttttcgttttgggtatggttggtttatttttttcgtagttattaatttgatagttttcgagggcgatttcgtcgatagatcgttatgtatcgggtttcgttattagcgtcggttttataattcgtttgcgttatagttcgttcgttcgcgcgtagtttgtttcgcgcgatatttaggttttagggtcgtcgtatttttttttttttttggcgcgtttttatcgggtttcggaattcgtatagaaaatatcgggtacggtttatttcgtttttcgtttcgtcgcggtagttatttaatttattttggtttcggggtttttggagtttaggcggtcgggatttgaatcgagtttttcggagtttcgtttttattaaggtcggggtgacgtatggttagcgaggttgagcgtttagggaaggcgtgttgacgttacgacgttcgggttagggtttgggcgcggttcggagtcgggtcgtcgttatagtaatcgggaatcgttatttgtttattttaaggattcggtttagtagaagcgtgaggaggtggcggaggtttcgagggttttgcgttattatttttgcggtttgcgggcgagaaggtgcgtttcgggagtagcgcgggaggataggaggcgtaggttgtgagggacgtaggttttggggtttcggtttttgtttttcgagtttagagtttttaggttttttttcggtcgcgcgtttagtatttattgttttacggtttt

SEQ ID NO: 21784 - DNA, 858 bp, Artificial Sequence
  chemically treated genomic DNA (Homo sapiens) CpG-island No: 21784
aaaaccgtaaaacaataaatactaaacgcgcgaccgaaaaaaaacctaaaaactctaaactcgaaaaacaaaaaccgaaaccccaaaacctacgtccctcacaacctacgcctcctatcctcccgcgctactcccgaaacgcaccttctcgcccgcaaaccgcaaaaataataacgcaaaaccctcgaaacctccgccacctcctcacgcttctactaaaccgaatccttaaaataaacaaataacgattcccgattactataacgacgacccgactccgaaccgcgcccaaaccctaacccgaacgtcgtaacgtcaacacgccttccctaaacgctcaacctcgctaaccatacgtcaccccgaccttaataaaaacgaaactccgaaaaactcgattcaaatcccgaccgcctaaactccaaaaaccccgaaaccaaaataaattaaataactaccgcgacgaaacgaaaaacgaaataaaccgtacccgatattttctatacgaattccgaaacccgataaaaacgcgccaaaaaaaaaaaaaaatacgacgaccctaaaacctaaatatcgcgcgaaacaaactacgcgcgaacgaacgaactataacgcaaacgaattataaaaccgacgctaataacgaaacccgatacataacgatctatcgacgaaatcgccctcgaaaactatcaaattaataactacgaaaaaaataaaccaaccatacccaaaacgaaaaaccgaacgaacgcaaaaccccgaaaaaatcccgaacccgacgtacccacctccctccgaccctaacaaaacgacctaaccgctaaaccgcgaccgaaccccctcccccacccaaaa

SEQ ID NO: 21785 - DNA, 820 bp, Artificial Sequence
  chemically treated genomic DNA (Homo sapiens) CpG-island No: 21785
cgcgtcgttgatatttattacgtcgcggcggggattcgggagatttggcggtttttgtgtattttcgcggtagtttgcgggtaacgggggcgggaggcgtcgggcgtttttgattcggtcgtatatttgcgtcgtagttcgtttttcgttcgttgtttttcgggttttcggtcgttttatcgcgcgtttcgagagttgagtcggtttcggcgtacgaggtcggtgagtgcgcgttagggggcggcggggggcgcgcgggcggcgggggcgcggggttcgggtcgggggttgttttttttttttcgtcgcgagcgcggtcggaggtcgtagcgtttttcggagttcggagtttaggcgtacgcgcgttcgtttttgtcgttaatttcgggaggtgcgagcggcgtcggggggacgcgggcggcggcggaggttgcgggagtcgttgtcgttcgagggatcgcggattcgggaggttcggttttcggcgtcgggttttagttttttttacgggagtcgtattttatttttagagttttagcgcgttcgcggggttcgagtcgcggtcggcgcggggcggggaggggcgggaagtttgcgttttatacgcggtttcgtagatttggcggtttcgttttcggtcgggcgtaggtaggagcggcgggagtcgcgggggcggttagttgggcgtcgcggggtcggttggacgcggggcgcgggggtagcgggtggttaggcgtgtggggggcgcggggggcggtcgggttttttttatttttttttcgaagtttaggagtagcgcggggggagggagggtcgtttt

SEQ ID NO: 21786 - DNA, 820 bp, Artificial Sequence
  chemically treated genomic DNA (Homo sapiens) CpG-island No: 21786
aaaacgaccctccctccccccgcgctactcctaaacttcgaaaaaaaaataaaaaaaacccgaccgccccccgcgccccccacacgcctaaccacccgctacccccgcgccccgcgtccaaccgaccccgcgacgcccaactaaccgcccccgcgactcccgccgctcctacctacgcccgaccgaaaacgaaaccgccaaatctacgaaaccgcgtataaaacgcaaacttcccgcccctccccgccccgcgccgaccgcgactcgaaccccgcgaacgcgctaaaactctaaaaataaaatacgactcccgtaaaaaaaactaaaacccgacgccgaaaaccgaacctcccgaatccgcgatccctcgaacgacaacgactcccgcaacctccgccgccgcccgcgtccccccgacgccgctcgcacctcccgaaattaacgacaaaaacgaacgcgcgtacgcctaaactccgaactccgaaaaacgctacgacctccgaccgcgctcgcgacgaaaaaaaaaaaacaacccccgacccgaaccccgcgcccccgccgcccgcgcgccccccgccgccccctaacgcgcactcaccgacctcgtacgccgaaaccgactcaactctcgaaacgcgcgataaaacgaccgaaaacccgaaaaacaacgaacgaaaaacgaactacgacgcaaatatacgaccgaatcaaaaacgcccgacgcctcccgcccccgttacccgcaaactaccgcgaaaatacacaaaaaccgccaaatctcccgaatccccgccgcgacgtaataaatatcaacgacgcg

SEQ ID NO: 21787 - DNA, 820 bp, Artificial Sequence
  chemically treated genomic DNA (Homo sapiens) CpG-island No: 21787
agggcggtttttttttttttcgcgttgtttttggatttcgagaagagggtgggggggattcggtcgtttttcgcgttttttatacgtttggttattcgttgttttcgcgtttcgcgtttagtcggtttcgcgacgtttaattggtcgttttcgcggttttcgtcgtttttatttgcgttcggtcgggagcggagtcgttaagtttgcgaggtcgcgtgtagggcgtaaatttttcgttttttttcgtttcgcgtcggtcgcgattcggatttcgcggacgcgttggggttttgggggtgggatgcggttttcgtgggggaaattgaggttcggcgtcgggagtcggatttttcgggttcgcggtttttcgagcggtagcgattttcgtagttttcgtcgtcgttcgcgttttttcgacgtcgttcgtatttttcgaagttggcggtagaggcgggcgcgcgtgcgtttgggtttcgggtttcggggggcgttgcgattttcgatcgcgttcgcggcgggagggaaggagtagttttcggttcgaatttcgcgttttcgtcgttcgcgcgtttttcgtcgttttttggcgcgtatttatcggtttcgtgcgtcgggatcggtttagttttcggggcgcgcggtggagcggtcgggaattcgggaggtagcggacggagagcggattgcggcgtaggtgtgcggtcgagttaggggcgttcggcgtttttcgttttcgttgttcgtaggttgtcgcgggggtgtatagaggtcgttaggtttttcgggttttcgtcgcggcgtgatgggtgttagcggcgcg

SEQ ID NO: 21788 - DNA, 820 bp, Artificial Sequence
  chemically treated genomic DNA (Homo sapiens) CpG-island No: 21788
cgcgccgctaacacccatcacgccgcgacgaaaacccgaaaaacctaacgacctctatacacccccgcgacaacctacgaacaacgaaaacgaaaaacgccgaacgcccctaactcgaccgcacacctacgccgcaatccgctctccgtccgctacctcccgaattcccgaccgctccaccgcgcgccccgaaaactaaaccgatcccgacgcacgaaaccgataaatacgcgccaaaaaacgacgaaaaacgcgcgaacgacgaaaacgcgaaattcgaaccgaaaactactccttccctcccgccgcgaacgcgatcgaaaatcgcaacgccccccgaaacccgaaacccaaacgcacgcgcgcccgcctctaccgccaacttcgaaaaatacgaacgacgtcgaaaaaacgcgaacgacgacgaaaactacgaaaatcgctaccgctcgaaaaaccgcgaacccgaaaaatccgactcccgacgccgaacctcaatttcccccacgaaaaccgcatcccacccccaaaaccccaacgcgtccgcgaaatccgaatcgcgaccgacgcgaaacgaaaaaaaacgaaaaatttacgccctacacgcgacctcgcaaacttaacgactccgctcccgaccgaacgcaaataaaaacgacgaaaaccgcgaaaacgaccaattaaacgtcgcgaaaccgactaaacgcgaaacgcgaaaacaacgaataaccaaacgtataaaaaacgcgaaaaacgaccgaatcccccccaccctcttctcgaaatccaaaaacaacgcgaaaaaaaaaaaaaccgccct

SEQ ID NO: 21789 - DNA, 812 bp, Artificial Sequence
  chemically treated genomic DNA (Homo sapiens) CpG-island No: 21789
ttttcgggcggggcggtgggtttttattggtagtgttggtggtgggtgggaacgggaggggtggtgagcgttgattggtcgtagtggcggggcggggcggaggaggaggaggtgtgcgtgtcggggcgcggagcggcgggcgttgattggtggtagtggtggtgggcgtggtgtaggcgtggcgcgtggtcggcgttggtattcgtaggggaggcggagaaggaggcggagggagcgattgtggtttcggtcgcggtggtcggcgcggtttgttttttgtgatcgtagttcgcgttttacgtttcgcgtttatggtcgtcgtgtcgggttttttggttacgcgtgttcgttcgcggatttgagtttcgcgtttgggatgtcggggatgcgcgtttttcggttttgcggttgtttcgggttgggcgcggggcgatggatttgagtatgaagaagttcgtcgtgcgtaggtttttttttgtgtatttgcgtaggaagtcgcgttttaagagttttagtttgagtcggttcgaggtaatgcggtcgttttcggggcgcgtaggtgtcgggtattgagcgggtcgtggtcgttcgagttcgtttcgttatttttgggtggatttcgagattcgttagggagtttaagttattggaaagttggttcggtttcgaaaatcgaattaaacggttttaaacgttatcgttgggatttcgtagtaattgggcggttcgtgggttttcgcgggggtaattttatttttattgtatttttagttggttttttcgtcgttggttgtacggggtgtgggatggtt

SEQ ID NO: 21790 - DNA, 812 bp, Artificial Sequence
  chemically treated genomic DNA (Homo sapiens) CpG-island No: 21790
aaccatcccacaccccgtacaaccaacgacgaaaaaaccaactaaaaatacaataaaaataaaattacccccgcgaaaacccacgaaccgcccaattactacgaaatcccaacgataacgtttaaaaccgtttaattcgattttcgaaaccgaaccaactttccaataacttaaactccctaacgaatctcgaaatccacccaaaaataacgaaacgaactcgaacgaccacgacccgctcaatacccgacacctacgcgccccgaaaacgaccgcattacctcgaaccgactcaaactaaaactcttaaaacgcgacttcctacgcaaatacacaaaaaaaaacctacgcacgacgaacttcttcatactcaaatccatcgccccgcgcccaacccgaaacaaccgcaaaaccgaaaaacgcgcatccccgacatcccaaacgcgaaactcaaatccgcgaacgaacacgcgtaaccaaaaaacccgacacgacgaccataaacgcgaaacgtaaaacgcgaactacgatcacaaaaaacaaaccgcgccgaccaccgcgaccgaaaccacaatcgctccctccgcctccttctccgcctcccctacgaataccaacgccgaccacgcgccacgcctacaccacgcccaccaccactaccaccaatcaacgcccgccgctccgcgccccgacacgcacacctcctcctcctccgccccgccccgccactacgaccaatcaacgctcaccacccctcccgttcccacccaccaccaacactaccaataaaaacccaccgccccgcccgaaaa

SEQ ID NO: 21791 - DNA, 812 bp, Artificial Sequence
  chemically treated genomic DNA (Homo sapiens) CpG-island No: 21791
gattattttatatttcgtgtagttagcggcggagaaattagttggaaatgtagtgggggtggagttgttttcgcgaggatttacggatcgtttaattattacggagttttagcgataacgtttggagtcgtttggttcgattttcggaatcggattagttttttagtaatttgaattttttgacgggtttcggggtttatttaggggtggcgaggcgggttcgggcgattacggttcgtttagtgttcggtatttgcgcgtttcgagggcggtcgtattatttcgagtcggtttaggttggagtttttggagcgcgattttttgcgtaggtatatagagaagaatttgcgtacggcgaatttttttatgtttaggtttatcgtttcgcgtttagttcggagtagtcgtagggtcgggggacgcgtattttcggtattttaggcgcggggtttaggttcgcgggcgggtacgcgtggttagggagttcggtacggcggttatgggcgcggggcgtggggcgcgagttgcggttataaagggtaggtcgcgtcggttatcgcggtcggggttataatcgtttttttcgttttttttttcgttttttttgcgagtattagcgtcggttacgcgttacgtttatattacgtttattattattattattaattagcgttcgtcgtttcgcgtttcggtacgtatatttttttttttttcgtttcgtttcgttattacggttaattagcgtttattatttttttcgtttttatttattattagtattgttaatgagagtttatcgtttcgttcgggag

SEQ ID NO: 21792 - DNA, 812 bp, Artificial Sequence
  chemically treated genomic DNA (Homo sapiens) CpG-island No: 21792
ctcccgaacgaaacgataaactctcattaacaatactaataataaataaaaacgaaaaaaataataaacgctaattaaccgtaataacgaaacgaaacgaaaaaaaaaaaaatatacgtaccgaaacgcgaaacgacgaacgctaattaataataataataataaacgtaatataaacgtaacgcgtaaccgacgctaatactcgcaaaaaaaacgaaaaaaaaaacgaaaaaaacgattataaccccgaccgcgataaccgacgcgacctaccctttataaccgcaactcgcgccccacgccccgcgcccataaccgccgtaccgaactccctaaccacgcgtacccgcccgcgaacctaaaccccgcgcctaaaataccgaaaatacgcgtcccccgaccctacgactactccgaactaaacgcgaaacgataaacctaaacataaaaaaattcgccgtacgcaaattcttctctatatacctacgcaaaaaatcgcgctccaaaaactccaacctaaaccgactcgaaataatacgaccgccctcgaaacgcgcaaataccgaacactaaacgaaccgtaatcgcccgaacccgcctcgccacccctaaataaaccccgaaacccgtcaaaaaattcaaattactaaaaaactaatccgattccgaaaatcgaaccaaacgactccaaacgttatcgctaaaactccgtaataattaaacgatccgtaaatcctcgcgaaaacaactccacccccactacatttccaactaatttctccgccgctaactacacgaaatataaaataatc

SEQ ID NO: 21793 - DNA, 637 bp, Artificial Sequence
  chemically treated genomic DNA (Homo sapiens) CpG-island No: 21793
gcgtttttagtcggtatttttcgtttcgggtttcgtaggcggttgggtttcgttagttcgggtttagtcgtcgcgtcggtcgttttttgcgttttttgcgttttttgtttacggttttcgtagttcggcgggcgtacggtttcggcggttgggttttcgcgcgggcgtaggtgtgtagggtaagcgcggacgggtttcgtgggtcgtcggcgaggtaggcgtagcggtttgtcgggtcgcggaagttcgcgcggtgagatttatgagtgtgtacgcgtggtttttttttacgtcgatatttgcgattatggacgggggtttcgatttttttttgttatagttaagtgagggttaaagttatttttaagaaggtcgggtagagtaggtcgttgggcggattttcggcgcggtcgtagtattttcgggaggggtcgttttagaagtcgcgcgtttttttttttttttttttttgttttattttttttttcgttttttttttttttttcggagaggaatttcgagggcgggaattgtttcggcgtttatggattcgggggcggtagttcgagtttttttttgtatcgtgtttgggagggtttgaagtttaaatttttcgggttgagaagggttcggggtt

SEQ ID NO: 21794 - DNA, 637 bp, Artificial Sequence
  chemically treated genomic DNA (Homo sapiens) CpG-island No: 21794
aaccccgaacccttctcaacccgaaaaatttaaacttcaaaccctcccaaacacgatacaaaaaaaaactcgaactaccgcccccgaatccataaacgccgaaacaattcccgccctcgaaattcctctccgaaaaaaaaaaaaaaaacgaaaaaaaaaataaaacaaaaaaaaaaaaaaaaaaaaacgcgcgacttctaaaacgacccctcccgaaaatactacgaccgcgccgaaaatccgcccaacgacctactctacccgaccttcttaaaaataactttaaccctcacttaactataacaaaaaaaaatcgaaacccccgtccataatcgcaaatatcgacgtaaaaaaaaaccacgcgtacacactcataaatctcaccgcgcgaacttccgcgacccgacaaaccgctacgcctacctcgccgacgacccacgaaacccgtccgcgcttaccctacacacctacgcccgcgcgaaaacccaaccgccgaaaccgtacgcccgccgaactacgaaaaccgtaaacaaaaaacgcaaaaaacgcaaaaaacgaccgacgcgacgactaaacccgaactaacgaaacccaaccgcctacgaaacccgaaacgaaaaataccgactaaaaacgc

SEQ ID NO: 21795 - DNA, 637 bp, Artificial Sequence
  chemically treated genomic DNA (Homo sapiens) CpG-island No: 21795
ggtttcggattttttttagttcgaggagtttgggttttaggtttttttagatacggtgtaaggagaggttcgggttgtcgttttcgagtttatgagcgtcggagtagttttcgttttcgaagttttttttcgggagagagggagagagcgagggagagaatgagatagggagggagggagagaggggcgcgcggtttttgaggcgatttttttcggagatgttgcggtcgcgtcgggaattcgtttagcgatttgttttgttcggtttttttagaaataattttggtttttatttggttgtagtagaaaggaatcgaggttttcgtttataatcgtaggtgtcggcgtggaaaggagttacgcgtgtatatttatgggttttatcgcgcgggttttcgcggttcggtaagtcgttgcgtttgtttcgtcggcggtttacggagttcgttcgcgtttgttttgtatatttgcgttcgcgcgaggatttagtcgtcgaggtcgtgcgttcgtcgggttgcgggggtcgtgggtagggggcgtagggggcgtagggggcggtcggcgcggcggttgaattcgggttgacgaggtttagtcgtttgcggggttcggagcgggaggtatcggttaggggcgt

SEQ ID NO: 21796 - DNA, 637 bp, Artificial Sequence
  chemically treated genomic DNA (Homo sapiens) CpG-island No: 21796
acgcccctaaccgatacctcccgctccgaaccccgcaaacgactaaacctcgtcaacccgaattcaaccgccgcgccgaccgccccctacgccccctacgccccctacccacgacccccgcaacccgacgaacgcacgacctcgacgactaaatcctcgcgcgaacgcaaatatacaaaacaaacgcgaacgaactccgtaaaccgccgacgaaacaaacgcaacgacttaccgaaccgcgaaaacccgcgcgataaaacccataaatatacacgcgtaactcctttccacgccgacacctacgattataaacgaaaacctcgattcctttctactacaaccaaataaaaaccaaaattatttctaaaaaaaccgaacaaaacaaatcgctaaacgaattcccgacgcgaccgcaacatctccgaaaaaaatcgcctcaaaaaccgcgcgcccctctctccctccctccctatctcattctctccctcgctctctccctctctcccgaaaaaaaacttcgaaaacgaaaactactccgacgctcataaactcgaaaacgacaacccgaacctctccttacaccgtatctaaaaaaacctaaaacccaaactcctcgaactaaaaaaaatccgaaacc

SEQ ID NO: 21797 - DNA, 607 bp, Artificial Sequence
  chemically treated genomic DNA (Homo sapiens) CpG-island No: 21797
gaacgtagtcgacggttatttttatagcggaggtcgtcgtcggtttagcgaggtaagaaatttgtaggacgttcggaatttttagagggttgggcgtttaagggttaggattttcgagatgtaattgtttaaagcggtgggtgttcgtggttatcggttggcgagtttcggttacggatattttaatgtattatttcgtttcgtttcgcgtttaacgtcggttggagagcgcgcggtcgtagggtaggcgttttttcgtacgcgcgaaggtttgcggttcggaggtagtcggtagttaatggggcggggcgtcgcgcgtagggggcggggtcgtgacgcgtttttttcgtgattcggttttcggtttgcgttcgcggaaatcggaagcggcggttgttcgcggtgtcggttgggggcggagaggcggcggtgggttttttggggtgtgtgagttcggtgatggagtcgggttcgatagtcgcgtagcggaggtgttcgttgtcgtcgtggttgtcgttggggttgttgttgtggtcggggttggttttgggcgcgttttttttcggtagtagttcgtatagggttttttacgattttttgtcggagt

SEQ ID NO: 21798 - DNA, 607 bp, Artificial Sequence
  chemically treated genomic DNA (Homo sapiens) CpG-island No: 21798
actccgacaaaaaatcgtaaaaaaccctatacgaactactaccgaaaaaaaacgcgcccaaaaccaaccccgaccacaacaacaaccccaacgacaaccacgacgacaacgaacacctccgctacgcgactatcgaacccgactccatcaccgaactcacacaccccaaaaaacccaccgccgcctctccgcccccaaccgacaccgcgaacaaccgccgcttccgatttccgcgaacgcaaaccgaaaaccgaatcacgaaaaaaacgcgtcacgaccccgccccctacgcgcgacgccccgccccattaactaccgactacctccgaaccgcaaaccttcgcgcgtacgaaaaaacgcctaccctacgaccgcgcgctctccaaccgacgttaaacgcgaaacgaaacgaaataatacattaaaatatccgtaaccgaaactcgccaaccgataaccacgaacacccaccgctttaaacaattacatctcgaaaatcctaacccttaaacgcccaaccctctaaaaattccgaacgtcctacaaatttcttacctcgctaaaccgacgacgacctccgctataaaaataaccgtcgactacgttc

SEQ ID NO: 21799 - DNA, 607 bp, Artificial Sequence
  chemically treated genomic DNA (Homo sapiens) CpG-island No: 21799
gtttcgataggaggtcgtggaagattttgtgcggattgttgtcgaaggggagcgcgtttagggttagtttcgattatagtagtagttttagcggtagttacggcggtaacgaatattttcgttgcgcggttgtcgggttcggttttattatcgggtttatatattttagggagtttatcgtcgttttttcgtttttagtcggtatcgcggatagtcgtcgttttcggttttcgcgagcgtaggtcgagagtcgggttacgaggagggcgcgttacggtttcgttttttgcgcgcggcgtttcgttttattggttgtcggttgttttcgggtcgtaggttttcgcgcgtgcgggagggcgtttattttgcggtcgcgcgttttttagtcggcgttaggcgcggggcggggcggagtggtgtattggggtattcgtagtcgaggttcgttagtcggtgattacgagtatttatcgttttggataattgtatttcgggggttttgatttttgaacgtttaattttttgggagtttcgggcgttttataagttttttatttcgttggatcgacgacggttttcgttgtggaaatggtcgtcggttgcgttt

SEQ ID NO: 21800 - DNA, 607 bp, Artificial Sequence
  chemically treated genomic DNA (Homo sapiens) CpG-island No: 21800
aaacgcaaccgacgaccatttccacaacgaaaaccgtcgtcgatccaacgaaataaaaaacttataaaacgcccgaaactcccaaaaaattaaacgttcaaaaatcaaaacccccgaaatacaattatccaaaacgataaatactcgtaatcaccgactaacgaacctcgactacgaataccccaatacaccactccgccccgccccgcgcctaacgccgactaaaaaacgcgcgaccgcaaaataaacgccctcccgcacgcgcgaaaacctacgacccgaaaacaaccgacaaccaataaaacgaaacgccgcgcgcaaaaaacgaaaccgtaacgcgccctcctcgtaacccgactctcgacctacgctcgcgaaaaccgaaaacgacgactatccgcgataccgactaaaaacgaaaaaacgacgataaactccctaaaatatataaacccgataataaaaccgaacccgacaaccgcgcaacgaaaatattcgttaccgccgtaactaccgctaaaactactactataatcgaaactaaccctaaacgcgctccccttcgacaacaatccgcacaaaatcttccacgacctcctatcgaaac

SEQ ID NO: 21801 - DNA, 975 bp, Artificial Sequence
  chemically treated genomic DNA (Homo sapiens) CpG-island No: 21801
gataaagacgcgtagtttcgtttttttggggttttagttcgtgagatcgtcgggtgtatttcgattttcgtcggtacgtgcgtttttttagggtagggtttgtttgttttttttcgcgggtcgttagtagttagtataggtcgtaaacggcggttcgtagagcggattaacggagtcgattttcgtaggtttggagtcggacgcggcggggtagagttttcgaggttgtagttcgtcggaattcgcgggagggtagtcgggttgggcggagcgtatagcgttacggatcgatcgcgtaggttttgtcggttattttcggtgtcgcgcggcggttttcggtaggaggtagagggtatatcgttagttttaggttaggttgcgagggtcgcggattcgagtcgggaaggattttgggcggacgagtcgcgcgtttcgtagttatggagtaggacgattcggtcgaggcgttgacggagttgcgcgagcggcggttgggcgcgttggagttgttgtaggcggcggtcggttcgggtttggtagtttacgcggtgtgggcgttgttgttttagttcggttttcggcgcgtgtcgttgcggttgtaggtgcggggcggggttaggtcgggtaggggagttcggttgtcgtttagggttttaaggtttgggcgtggtcggggtgagtttcgtttcgtcgtgtggtagttcgggtcgggttgcgggcggggcgggagcggttagtggattttcgtcgttattcggtttaggtgttttacgtcggcgcgagcgcgcggtaggtggagtacgtgttgtcgttgttgcgaggacgtttcggaaaaacggtggatttgggttttggcgacggtaggatcgtaagtgtttgcgtttgggttttcgtcgttttatatcgtttatttgttggcgggcgtttttgtttatattttggtttttatattttcggtgtttataggtgttggcg

SEQ ID NO: 21802 - DNA, 975 bp, Artificial Sequence
  chemically treated genomic DNA (Homo sapiens) CpG-island No: 21802
cgccaacacctataaacaccgaaaatataaaaaccaaaatataaacaaaaacgcccgccaacaaataaacgatataaaacgacgaaaacccaaacgcaaacacttacgatcctaccgtcgccaaaacccaaatccaccgtttttccgaaacgtcctcgcaacaacgacaacacgtactccacctaccgcgcgctcgcgccgacgtaaaacacctaaaccgaataacgacgaaaatccactaaccgctcccgccccgcccgcaacccgacccgaactaccacacgacgaaacgaaactcaccccgaccacgcccaaaccttaaaaccctaaacgacaaccgaactcccctacccgacctaaccccgccccgcacctacaaccgcaacgacacgcgccgaaaaccgaactaaaacaacaacgcccacaccgcgtaaactaccaaacccgaaccgaccgccgcctacaacaactccaacgcgcccaaccgccgctcgcgcaactccgtcaacgcctcgaccgaatcgtcctactccataactacgaaacgcgcgactcgtccgcccaaaatccttcccgactcgaatccgcgaccctcgcaacctaacctaaaactaacgatataccctctacctcctaccgaaaaccgccgcgcgacaccgaaaataaccgacaaaacctacgcgatcgatccgtaacgctatacgctccgcccaacccgactaccctcccgcgaattccgacgaactacaacctcgaaaactctaccccgccgcgtccgactccaaacctacgaaaatcgactccgttaatccgctctacgaaccgccgtttacgacctatactaactactaacgacccgcgaaaaaaaacaaacaaaccctaccctaaaaaaacgcacgtaccgacgaaaatcgaaatacacccgacgatctcacgaactaaaaccccaaaaaaacgaaactacgcgtctttatc

SEQ ID NO: 21803 - DNA, 975 bp, Artificial Sequence
  chemically treated genomic DNA (Homo sapiens) CpG-island No: 21803
cgttagtatttgtgggtatcgagagtgtgggaattaggatgtgggtaggggcgttcgttagtaggtgggcggtgtggggcggcgaagatttagacgtaggtatttacgattttgtcgtcgttagagtttagatttatcgttttttcggggcgttttcgtagtagcgataatacgtgttttatttgtcgcgcgttcgcgtcgacgtagggtatttggatcgggtggcggcgagagtttattggtcgttttcgtttcgttcgtagttcggttcgaattattatacggcggggcggagtttatttcggttacgtttagattttgagattttgagcggtagtcgagtttttttgttcggtttggtttcgtttcgtatttgtagtcgtagcggtacgcgtcggaagtcgggttggagtagtagcgtttatatcgcgtaggttgttaagttcgagtcggtcgtcgtttgtagtagttttagcgcgtttagtcgtcgttcgcgtagtttcgttagcgtttcgatcgggtcgttttgttttatggttgcgggacgcgcggttcgttcgtttaaggtttttttcggttcgggttcgcggttttcgtagtttggtttggggttggcggtgtgttttttgttttttgtcgggagtcgtcgcgcgatatcggaagtggtcggtagagtttgcgcggtcggttcgtggcgttgtgcgtttcgtttagttcggttgttttttcgcgggtttcggcgagttgtagtttcgggggttttgtttcgtcgcgttcggttttaagtttgcgagggtcggtttcgttggttcgttttgcggatcgtcgtttgcggtttgtgttggttgttggcgattcgcggaaggggataggtaggttttgttttgggggagcgtacgtgtcggcgggagtcgggatatattcggcgattttacgggttagagttttagggaaacggggttgcgcgtttttgtt

SEQ ID NO: 21804 - DNA, 975 bp, Artificial Sequence
  chemically treated genomic DNA (Homo sapiens) CpG-island No: 21804
aacaaaaacgcgcaaccccgtttccctaaaactctaacccgtaaaatcgccgaatatatcccgactcccgccgacacgtacgctcccccaaaacaaaacctacctatccccttccgcgaatcgccaacaaccaacacaaaccgcaaacgacgatccgcaaaacgaaccaacgaaaccgaccctcgcaaacttaaaaccgaacgcgacgaaacaaaacccccgaaactacaactcgccgaaacccgcgaaaaaacaaccgaactaaacgaaacgcacaacgccacgaaccgaccgcgcaaactctaccgaccacttccgatatcgcgcgacgactcccgacaaaaaacaaaaaacacaccgccaaccccaaaccaaactacgaaaaccgcgaacccgaaccgaaaaaaaccttaaacgaacgaaccgcgcgtcccgcaaccataaaacaaaacgacccgatcgaaacgctaacgaaactacgcgaacgacgactaaacgcgctaaaactactacaaacgacgaccgactcgaacttaacaacctacgcgatataaacgctactactccaacccgacttccgacgcgtaccgctacgactacaaatacgaaacgaaaccaaaccgaacaaaaaaactcgactaccgctcaaaatctcaaaatctaaacgtaaccgaaataaactccgccccgccgtataataattcgaaccgaactacgaacgaaacgaaaacgaccaataaactctcgccgccacccgatccaaataccctacgtcgacgcgaacgcgcgacaaataaaacacgtattatcgctactacgaaaacgccccgaaaaaacgataaatctaaactctaacgacgacaaaatcgtaaatacctacgtctaaatcttcgccgccccacaccgcccacctactaacgaacgcccctacccacatcctaattcccacactctcgatacccacaaatactaacg

SEQ ID NO: 21805 - DNA, 602 bp, Artificial Sequence
  chemically treated genomic DNA (Homo sapiens) CpG-island No: 21805
ggaaacgattggtttagtcggggcgtcgggagggttttttggaggaggtgttagcgtcgggcgcggcggggtcggagcgtgcgcgtggcgttttatcgggtacgcgtatcgtcggcgggttttgtggttttatcgcgcgtaggattcgggtcgggcgggggcgggggcggggcgcgttcgcggaggggggcggttggcggttttcgagtttagcgtcgcgtttagttcggatttcgtgatcggcggtcgaggtttcgttttcgttagtttgtttttcgggtttttagtatagtcgtgtcggtgaggcgggcggcgggggaacgcggttgtttcgggttaggggttttgcggcggtagggcggggggtcgaggggcggggtttgggaggaaggcgtggtttttggggattggggttcggattgggggcggagtcggggttggttggggatcggtcgggtttcgtttttgttggagttcggtgcgtggaattttacgcgagtgtcggggagtttttggggagtcgggttttttttttggtttttagcgtgttgatcgagttcgtttcgtatagttttttttagggtgtggagagcgggtttcgt

SEQ ID NO: 21806 - DNA, 602 bp, Artificial Sequence
  chemically treated genomic DNA (Homo sapiens) CpG-island No: 21806
acgaaacccgctctccacaccctaaaaaaaactatacgaaacgaactcgatcaacacgctaaaaaccaaaaaaaaaacccgactccccaaaaactccccgacactcgcgtaaaattccacgcaccgaactccaacaaaaacgaaacccgaccgatccccaaccaaccccgactccgcccccaatccgaaccccaatccccaaaaaccacgccttcctcccaaaccccgcccctcgaccccccgccctaccgccgcaaaacccctaacccgaaacaaccgcgttcccccgccgcccgcctcaccgacacgactatactaaaaacccgaaaaacaaactaacgaaaacgaaacctcgaccgccgatcacgaaatccgaactaaacgcgacgctaaactcgaaaaccgccaaccgcccccctccgcgaacgcgccccgcccccgcccccgcccgacccgaatcctacgcgcgataaaaccacaaaacccgccgacgatacgcgtacccgataaaacgccacgcgcacgctccgaccccgccgcgcccgacgctaacacctcctccaaaaaaccctcccgacgccccgactaaaccaatcgtttcc

SEQ ID NO: 21807 - DNA, 602 bp, Artificial Sequence
  chemically treated genomic DNA (Homo sapiens) CpG-island No: 21807
gcggggttcgttttttatattttaggaagggttgtgcgaagcgggttcggttaatacgttgggggttaaaagagaagttcggttttttaggaatttttcggtattcgcgtggaattttacgtatcgggttttagtaggagcggaattcggtcggtttttaattagtttcggtttcgtttttagttcgagttttagtttttaaaggttacgttttttttttaggtttcgtttttcggtttttcgttttgtcgtcgtaagatttttgattcgggatagtcgcgttttttcgtcgttcgttttatcggtacggttgtgttgaggattcgaaggatagattgacggaggcggggtttcggtcgtcggttacggggttcggattgagcgcggcgttgggttcgggagtcgttaatcgttttttttcgcggacgcgtttcgttttcgttttcgttcggttcggattttgcgcgcgatgagattataaggttcgtcggcggtgcgcgtgttcggtggggcgttacgcgtacgtttcgatttcgtcgcgttcggcgttggtattttttttaggaagttttttcgacgtttcggttgagttagtcgttttt

SEQ ID NO: 21808 - DNA, 602 bp, Artificial Sequence
  chemically treated genomic DNA (Homo sapiens) CpG-island No: 21808
aaaaacgactaactcaaccgaaacgtcgaaaaaacttcctaaaaaaaataccaacgccgaacgcgacgaaatcgaaacgtacgcgtaacgccccaccgaacacgcgcaccgccgacgaaccttataatctcatcgcgcgcaaaatccgaaccgaacgaaaacgaaaacgaaacgcgtccgcgaaaaaaaacgattaacgactcccgaacccaacgccgcgctcaatccgaaccccgtaaccgacgaccgaaaccccgcctccgtcaatctatccttcgaatcctcaacacaaccgtaccgataaaacgaacgacgaaaaaacgcgactatcccgaatcaaaaatcttacgacgacaaaacgaaaaaccgaaaaacgaaacctaaaaaaaaaacgtaacctttaaaaactaaaactcgaactaaaaacgaaaccgaaactaattaaaaaccgaccgaattccgctcctactaaaacccgatacgtaaaattccacgcgaataccgaaaaattcctaaaaaaccgaacttctcttttaacccccaacgtattaaccgaacccgcttcgcacaacccttcctaaaatataaaaaacgaaccccgc

SEQ ID NO: 21809 - DNA, 581 bp, Artificial Sequence
  chemically treated genomic DNA (Homo sapiens) CpG-island No: 21809
gcgtcggcggggcgcggggaggtacgaggacgtcgttttgttttaattcgatttaattcggttttcgttcgttcgttcgtagggattacgcgcggggaaattcggagttggcgcggtttcgtttcgggttggcggtgttgggcgcggacgagcgtattttttcgttgacgcgtaggttggcgtacggcgaggagttgcgggtgagcgcgcgttttcgggaggggcggggagggcgtttcgggtttattcgtttttataggttcgtttgttttttcgtcgtagttcggggttatttacgtgcgttgttttttgacgttcggttatatcgtcggttatatgagttattttttgtgggaggacgattgttcggatttattcgttttgttttcgggtattcgtagcgcggagcgcgtttatttcgtttttcgtcggtttcgttttatttgttttgattcgttttttttcgttaggcgacgcgttgtcggtggtcggttgcggttcgtgtttggagggtagcgtttagtagatgtattagagtttggtcgagttgggtattttgtttttcgagacggtgagcgggt

SEQ ID NO: 21810 - DNA, 581 bp, Artificial Sequence
  chemically treated genomic DNA (Homo sapiens) CpG-island No: 21810
acccgctcaccgtctcgaaaaacaaaatacccaactcgaccaaactctaatacatctactaaacgctaccctccaaacacgaaccgcaaccgaccaccgacaacgcgtcgcctaacgaaaaaaaacgaatcaaaacaaataaaacgaaaccgacgaaaaacgaaataaacgcgctccgcgctacgaatacccgaaaacaaaacgaataaatccgaacaatcgtcctcccacaaaaaataactcatataaccgacgatataaccgaacgtcaaaaaacaacgcacgtaaataaccccgaactacgacgaaaaaacaaacgaacctataaaaacgaataaacccgaaacgccctccccgcccctcccgaaaacgcgcgctcacccgcaactcctcgccgtacgccaacctacgcgtcaacgaaaaaatacgctcgtccgcgcccaacaccgccaacccgaaacgaaaccgcgccaactccgaatttccccgcgcgtaatccctacgaacgaacgaacgaaaaccgaattaaatcgaattaaaacaaaacgacgtcctcgtacctccccgcgccccgccgacgc

SEQ ID NO: 21811 - DNA, 581 bp, Artificial Sequence
  chemically treated genomic DNA (Homo sapiens) CpG-island No: 21811
gttcgtttatcgtttcggggggtagggtatttagttcggttaggttttggtatatttgttgggcgttgttttttaggtacgagtcgtagtcggttatcgatagcgcgtcgtttggcgggggagggcgggttagagtagatggggcggggtcggcgggaggcggggtgggcgcgtttcgcgttgcgggtattcgagaatagggcgggtgggttcgggtaatcgtttttttataggaagtagtttatgtggtcggcggtgtggtcgggcgttaggaggtaacgtacgtggatggtttcgaattgcggcggaggagtaggcggatttgtgagggcgggtggattcggggcgtttttttcgtttttttcgggagcgcgcgtttattcgtagtttttcgtcgtgcgttagtttgcgcgttagcgagaagatgcgttcgttcgcgtttagtatcgttagttcgggacgaagtcgcgttagtttcgggttttttcgcgcgtggtttttgcgggcgggcgggcgggggtcgggttaggtcgggttgggataaggcggcgttttcgtgttttttcgcgtttcgtcggcgt

SEQ ID NO: 21812 - DNA, 581 bp, Artificial Sequence
  chemically treated genomic DNA (Homo sapiens) CpG-island No: 21812
acgccgacgaaacgcgaaaaaacacgaaaacgccgccttatcccaacccgacctaacccgacccccgcccgcccgcccgcaaaaaccacgcgcgaaaaaacccgaaactaacgcgacttcgtcccgaactaacgatactaaacgcgaacgaacgcatcttctcgctaacgcgcaaactaacgcacgacgaaaaactacgaataaacgcgcgctcccgaaaaaaacgaaaaaaacgccccgaatccacccgccctcacaaatccgcctactcctccgccgcaattcgaaaccatccacgtacgttacctcctaacgcccgaccacaccgccgaccacataaactacttcctataaaaaaacgattacccgaacccacccgccctattctcgaatacccgcaacgcgaaacgcgcccaccccgcctcccgccgaccccgccccatctactctaacccgccctcccccgccaaacgacgcgctatcgataaccgactacgactcgtacctaaaaaacaacgcccaacaaatataccaaaacctaaccgaactaaataccctaccccccgaaacgataaacgaac

SEQ ID NO: 21813 - DNA, 690 bp, Artificial Sequence
  chemically treated genomic DNA (Homo sapiens) CpG-island No: 21813
gggtcgatagagtttttgacggtttagatcgggttttcgggattcggattttattttttaggggaggaagtggggcgtagagtaattttttttcgcgcgatagggtatcgagcgtagtttcgatttcgttcgtttaggtcggtttatttgagacggttcgatgaagttatttaggttcgttagttgtagcgtttcgttgaagggcgacgttatgacggtcgtattgtcgtcgcgcgtaggtgtcgttaaacggcgcgaaacgaagtggttggtttcgttacgttgtcggaaagcgtttttaggacgtatgcgtatttcgtttcggggtcggcgttttttgttgacgagtttcggcgttgcggtttttcgtttatttcgcgggaattcgggatttatcgtttcgtttatttttcgcgcgttttaggtttcgggttggggtgtagggggcgtaggggttggtcgggttagcgtcgtagtttcggtttcggagttttttcgtttttataaggaagcggaggggatttggtttcgtttatttttttattttttgcgtatttgcggattaggtgttttcggatgtaatttaagaattcggaacgcgtttggtatataggaggcgtttagttcgtgttggggaatttaggtagggaagaaagtatggataggtacgaggttttttttttttgggga

SEQ ID NO: 21814 - DNA, 690 bp, Artificial Sequence
  chemically treated genomic DNA (Homo sapiens) CpG-island No: 21814
tccccaaaaaaaaaaaacctcgtacctatccatactttcttccctacctaaattccccaacacgaactaaacgcctcctatataccaaacgcgttccgaattcttaaattacatccgaaaacacctaatccgcaaatacgcaaaaaataaaaaaataaacgaaaccaaatcccctccgcttccttataaaaacgaaaaaactccgaaaccgaaactacgacgctaacccgaccaacccctacgccccctacaccccaacccgaaacctaaaacgcgcgaaaaataaacgaaacgataaatcccgaattcccgcgaaataaacgaaaaaccgcaacgccgaaactcgtcaacaaaaaacgccgaccccgaaacgaaatacgcatacgtcctaaaaacgctttccgacaacgtaacgaaaccaaccacttcgtttcgcgccgtttaacgacacctacgcgcgacgacaatacgaccgtcataacgtcgcccttcaacgaaacgctacaactaacgaacctaaataacttcatcgaaccgtctcaaataaaccgacctaaacgaacgaaatcgaaactacgctcgataccctatcgcgcgaaaaaaaattactctacgccccacttcctcccctaaaaaataaaatccgaatcccgaaaacccgatctaaaccgtcaaaaactctatcgaccc

SEQ ID NO: 21815 - DNA, 690 bp, Artificial Sequence
  chemically treated genomic DNA (Homo sapiens) CpG-island No: 21815
tttttaggaaggggagatttcgtgtttatttatgtttttttttttgtttgaattttttaatacgagttgagcgttttttgtgtgttaggcgcgtttcgggtttttgggttgtattcgggagtatttggttcgtaggtacgtagaggatgaggaaatggacggagttagatttttttcgtttttttgtgaaggcggagagatttcggggtcggagttgcggcgttggttcgattaatttttgcgttttttgtattttaattcggggtttggggcgcgcgggaggtggacgaagcggtaggtttcgggttttcgcgaggtgggcggggagtcgtagcgtcggggttcgttagtagagggcgtcggtttcgggacgaggtgcgtatgcgttttgggggcgtttttcggtagcgtggcggaattagttatttcgtttcgcgtcgtttagcgatatttgcgcgcggcggtagtgcggtcgttatggcgtcgttttttagcggggcgttgtagttgacggatttggatgattttatcgggtcgttttaggtgggtcggtttgggcgggcggggtcgaggttgcgttcggtgttttgtcgcgcggagggaaattgttttgcgttttatttttttttttgaggaatgagattcgaatttcgggagttcggtttgggtcgttagggattttatcgattt

SEQ ID NO: 21816 - DNA, 690 bp, Artificial Sequence
  chemically treated genomic DNA (Homo sapiens) CpG-island No: 21816
aaatcgataaaatccctaacgacccaaaccgaactcccgaaattcgaatctcattcctcaaaaaaaaaaataaaacgcaaaacaatttccctccgcgcgacaaaacaccgaacgcaacctcgaccccgcccgcccaaaccgacccacctaaaacgacccgataaaatcatccaaatccgtcaactacaacgccccgctaaaaaacgacgccataacgaccgcactaccgccgcgcgcaaatatcgctaaacgacgcgaaacgaaataactaattccgccacgctaccgaaaaacgcccccaaaacgcatacgcacctcgtcccgaaaccgacgccctctactaacgaaccccgacgctacgactccccgcccacctcgcgaaaacccgaaacctaccgcttcgtccacctcccgcgcgccccaaaccccgaattaaaatacaaaaaacgcaaaaattaatcgaaccaacgccgcaactccgaccccgaaatctctccgccttcacaaaaaaacgaaaaaaatctaactccgtccatttcctcatcctctacgtacctacgaaccaaatactcccgaatacaacccaaaaacccgaaacgcgcctaacacacaaaaaacgctcaactcgtattaaaaaattcaaacaaaaaaaaaaacataaataaacacgaaatctccccttcctaaaaa

SEQ ID NO: 21817 - DNA, 756 bp, Artificial Sequence
  chemically treated genomic DNA (Homo sapiens) CpG-island No: 21817
gcggtttcgcggagattaaatttttttttttgtttatttgagtttacgttgaggtttagattttgggttacgtttttcgaggggttcgcgaagggtttttcgggttcggtttacgcggcgttcgtcggttcgtttttgtcggagagttcgtagggaggattgtcgggcgcgggcgtcggggcggttgcgaggcgggtcgggcgtttcgaggcggttggtattagtagcggtttatagcgcgggtcgaagtgcggcgcgtagatttcgtgtacggcggcggggcgcgggtagggggcggtttgggcgtcgagggcgtcgtttagggcgtaggggtgatgcgggtgcgcgtggtgcgggtgcgcgtggtgttagggtttcgtggcgttttggtgtaggtggttatgtagcgcggcgggcgagtaggggtcggcggcggcgaagggtagtttcgagtgcgcggtggttagagggttgtttagcggcgggggtattggcgtttggtacgcgttattttagaaggaggcggggaagttgcgttggtttatcgggaaggagtagtttgtaggtcggtcggggaggcggagtggaggaaaggaaaagaggtgcgtgttattgcggttggatttagcgtcgatttgtacgtttcgttcgagagacgaaggcgtcgggcgggtatagggttggttagttatggtcggggttgatgggtagttttcgtttttgtagcggcgtttttttaagggggttgtaatttgt

SEQ ID NO: 21818 - DNA, 756 bp, Artificial Sequence
  chemically treated genomic DNA (Homo sapiens) CpG-island No: 21818
acaaattacaacccccttaaaaaaacgccgctacaaaaacgaaaactacccatcaaccccgaccataactaaccaaccctatacccgcccgacgccttcgtctctcgaacgaaacgtacaaatcgacgctaaatccaaccgcaataacacgcacctcttttcctttcctccactccgcctccccgaccgacctacaaactactccttcccgataaaccaacgcaacttccccgcctccttctaaaataacgcgtaccaaacgccaatacccccgccgctaaacaaccctctaaccaccgcgcactcgaaactacccttcgccgccgccgacccctactcgcccgccgcgctacataaccacctacaccaaaacgccacgaaaccctaacaccacgcgcacccgcaccacgcgcacccgcatcacccctacgccctaaacgacgccctcgacgcccaaaccgccccctacccgcgccccgccgccgtacacgaaatctacgcgccgcacttcgacccgcgctataaaccgctactaataccaaccgcctcgaaacgcccgacccgcctcgcaaccgccccgacgcccgcgcccgacaatcctccctacgaactctccgacaaaaacgaaccgacgaacgccgcgtaaaccgaacccgaaaaacccttcgcgaacccctcgaaaaacgtaacccaaaatctaaacctcaacgtaaactcaaataaacaaaaaaaaaaatttaatctccgcgaaaccgc

SEQ ID NO: 21819 - DNA, 756 bp, Artificial Sequence
  chemically treated genomic DNA (Homo sapiens) CpG-island No: 21819
ataggttgtagtttttttagaaaaacgtcgttgtagaggcgggggttgtttattagtttcggttatggttagttagttttgtgttcgttcggcgttttcgtttttcgggcgggacgtgtaggtcggcgttgagtttagtcgtagtgatacgtattttttttttttttttttatttcgttttttcggtcggtttatagattgttttttttcgatgagttagcgtagttttttcgtttttttttggaatagcgcgtattaggcgttagtgttttcgtcgttgggtagttttttggttatcgcgtattcggagttgtttttcgtcgtcgtcgatttttattcgttcgtcgcgttgtatggttatttgtattagggcgttacggagttttggtattacgcgtattcgtattacgcgtattcgtattatttttacgttttgggcggcgttttcggcgtttaggtcgttttttattcgcgtttcgtcgtcgtgtacgaagtttacgcgtcgtatttcgattcgcgttatgggtcgttgttgatgttagtcgtttcggggcgttcggttcgtttcgtaatcgtttcggcgttcgcgttcggtagttttttttgcgagtttttcggtaaaggcgagtcggcgggcgtcgcgtgggtcgggttcgggggatttttcgcgagtttttcgggggacgtggtttagggtttgggttttagcgtggatttaggtaagtagaggaagaagtttggttttcgcggagtcgt

SEQ ID NO: 21820 - DNA, 756 bp, Artificial Sequence
  chemically treated genomic DNA (Homo sapiens) CpG-island No: 21820
acgactccgcgaaaaccaaacttcttcctctacttacctaaatccacgctaaaacccaaaccctaaaccacgtcccccgaaaaactcgcgaaaaatcccccgaacccgacccacgcgacgcccgccgactcgcctttaccgaaaaactcgcaaaaaaaactaccgaacgcgaacgccgaaacgattacgaaacgaaccgaacgccccgaaacgactaacatcaacaacgacccataacgcgaatcgaaatacgacgcgtaaacttcgtacacgacgacgaaacgcgaataaaaaacgacctaaacgccgaaaacgccgcccaaaacgtaaaaataatacgaatacgcgtaatacgaatacgcgtaataccaaaactccgtaacgccctaatacaaataaccatacaacgcgacgaacgaataaaaatcgacgacgacgaaaaacaactccgaatacgcgataaccaaaaaactacccaacgacgaaaacactaacgcctaatacgcgctattccaaaaaaaaacgaaaaaactacgctaactcatcgaaaaaaaacaatctataaaccgaccgaaaaaacgaaataaaaaaaaaaaaaaaaaatacgtatcactacgactaaactcaacgccgacctacacgtcccgcccgaaaaacgaaaacgccgaacgaacacaaaactaactaaccataaccgaaactaataaacaacccccgcctctacaacgacgtttttctaaaaaaactacaacctat

SEQ ID NO: 21821 - DNA, 536 bp, Artificial Sequence
  chemically treated genomic DNA (Homo sapiens) CpG-island No: 21821
gggtgttgtatgggcggcgtttggattcgcgttttggagttattaggcggagtaaagttagcgcgtttcgcggttcggaatttagttggttcgttatttttttatttttgcgattttattttcgatcgcgttttagggtagaagcgtttgagttttcgttagtgggtatttaaagtttatgttcggcgggcgtgttgacgttattcgggggttgcggagcgggagggggcggtggggggcggggatcggggggttaatggggagcgagggacgtttgttggaggggtagcgagtgtgtttttcggggtttatttttgataagtatgcggttaagggtgtcggagattatgcggtttttagcggattcgaggtttcgtatcgcgagtaggaattttttaggataaaataggagagagagagaaagagagagagagaaggaggcggggacgaagggattcgggtttatatacgtagagaaagaaagttggagaaaggttttttaggaaagtttttgttttatattgtagttgagtggg

SEQ ID NO: 21822 - DNA, 536 bp, Artificial Sequence
  chemically treated genomic DNA (Homo sapiens) CpG-island No: 21822
cccactcaactacaatataaaacaaaaactttcctaaaaaacctttctccaactttctttctctacgtatataaacccgaatcccttcgtccccgcctccttctctctctctctttctctctctctcctattttatcctaaaaaattcctactcgcgatacgaaacctcgaatccgctaaaaaccgcataatctccgacacccttaaccgcatacttatcaaaaataaaccccgaaaaacacactcgctacccctccaacaaacgtccctcgctccccattaaccccccgatccccgccccccaccgccccctcccgctccgcaacccccgaataacgtcaacacgcccgccgaacataaactttaaatacccactaacgaaaactcaaacgcttctaccctaaaacgcgatcgaaaataaaatcgcaaaaataaaaaaataacgaaccaactaaattccgaaccgcgaaacgcgctaactttactccgcctaataactccaaaacgcgaatccaaacgccgcccatacaacaccc

SEQ ID NO: 21823 - DNA, 536 bp, Artificial Sequence
  chemically treated genomic DNA (Homo sapiens) CpG-island No: 21823
tttatttaattatagtatgagataagggtttttttaagagatttttttttaattttttttttttgcgtgtatgagttcggattttttcgttttcgttttttttttttttttttttttttttttttttttattttgttttgggagatttttattcgcggtgcgaagtttcggattcgttgggaatcgtatagttttcggtatttttggtcgtatgtttgttagaggtgggtttcgggaaatatattcgttgtttttttaataagcgtttttcgttttttattggtttttcggttttcgttttttatcgttttttttcgtttcgtagttttcgagtggcgttagtacgttcgtcgggtatgggttttaaatgtttattagcgggagtttaggcgtttttgttttggagcgcggtcgggagtaaaatcgtaggagtgggagggtagcgagttagttggatttcgagtcgcggagcgcgttggttttgtttcgtttgatgattttagagcgcgggtttaagcgtcgtttatgtagtattt

SEQ ID NO: 21824 - DNA, 536 bp, Artificial Sequence
  chemically treated genomic DNA (Homo sapiens) CpG-island No: 21824
aaatactacataaacgacgcttaaacccgcgctctaaaatcatcaaacgaaacaaaaccaacgcgctccgcgactcgaaatccaactaactcgctaccctcccactcctacgattttactcccgaccgcgctccaaaacaaaaacgcctaaactcccgctaataaacatttaaaacccatacccgacgaacgtactaacgccactcgaaaactacgaaacgaaaaaaaacgataaaaaacgaaaaccgaaaaaccaataaaaaacgaaaaacgcttattaaaaaaacaacgaatatatttcccgaaacccacctctaacaaacatacgaccaaaaataccgaaaactatacgattcccaacgaatccgaaacttcgcaccgcgaataaaaatctcccaaaacaaaataaaaaaaaaaaaaaaaaaaaaaaaaaaaaaaaaacgaaaacgaaaaaatccgaactcatacacgcaaaaaaaaaaaattaaaaaaaaatctcttaaaaaaacccttatctcatactataattaaataaa

SEQ ID NO: 21825 - DNA, 754 bp, Artificial Sequence
  chemically treated genomic DNA (Homo sapiens) CpG-island No: 21825
gtacgttcgtcgtcgtttgcgcgtaatttcgggttgggcgggcgttgcgtttcggggcgtattgttaggatttttcggagcggcggcgggcgcggtttcgggtcgtttttcgtattgcgagcgtaggtgtcgggtgtaggggggttttcggtttcgtttcgtaggtttcgttttttcgtattttttttttcggcggtttagcgcgcgcggtattgtgggagttgtggttttcgcggtttcgcggagcgtagcgcggcgtcggtatcggtaggggtatcggcgcggtttaggttcgggttcgggtttcggttcgggttttcgcggcgtgggttgggtagtagttaggcggcggtttcgcggcgtcgggtaggggtcgttcgcgggttcgcgttttcgggcggcggcgttttttgggtttcggtagtcgttcgcgcgttcgggcgtaggtaagtttcgttttcgggggttgtcggggcgggagggcggcgcggttgggtcgattttaggataggggttggaggcgggagttcggtagttgtaggtttacggtttttttttatcggcgtcgtcgtcgtcgtcgttttcgtcgaggatgtttcgggattcgggcgttcgtatttcggttcggtcgaggttagtgttcgtacgtgttaagcgtcgtcgtttcggagtcgggtattattttttttagatttttttttattttttttttttgttttatcgtggtttttttttttatttttttttttttttg

SEQ ID NO: 21826 - DNA, 754 bp, Artificial Sequence
  chemically treated genomic DNA (Homo sapiens) CpG-island No: 21826
caaaaaaaaaaaaaaataaaaaaaaaaaccacgataaaacaaaaaaaaaaaataaaaaaaaatctaaaaaaaataatacccgactccgaaacgacgacgcttaacacgtacgaacactaacctcgaccgaaccgaaatacgaacgcccgaatcccgaaacatcctcgacgaaaacgacgacgacgacgacgccgataaaaaaaaaccgtaaacctacaactaccgaactcccgcctccaacccctatcctaaaatcgacccaaccgcgccgccctcccgccccgacaacccccgaaaacgaaacttacctacgcccgaacgcgcgaacgactaccgaaacccaaaaaacgccgccgcccgaaaacgcgaacccgcgaacgacccctacccgacgccgcgaaaccgccgcctaactactacccaacccacgccgcgaaaacccgaaccgaaacccgaacccgaacctaaaccgcgccgatacccctaccgataccgacgccgcgctacgctccgcgaaaccgcgaaaaccacaactcccacaataccgcgcgcgctaaaccgccgaaaaaaaaaatacgaaaaaacgaaacctacgaaacgaaaccgaaaacccccctacacccgacacctacgctcgcaatacgaaaaacgacccgaaaccgcgcccgccgccgctccgaaaaatcctaacaatacgccccgaaacgcaacgcccgcccaacccgaaattacgcgcaaacgacgacgaacgtac

SEQ ID NO: 21827 - DNA, 754 bp, Artificial Sequence
  chemically treated genomic DNA (Homo sapiens) CpG-island No: 21827
taggggagaagggagatggaggaagggattacgatggggtagggaagaggagtaggaggaggtttagggagggtgatgttcggtttcgaggcggcggcgtttagtacgtacgagtattggtttcggtcgggtcgggatgcgggcgttcgggtttcggagtattttcggcgggggcggcggcggcggcggcgtcggtaagggagggtcgtgggtttgtagttgtcgggttttcgtttttaatttttgttttggggtcggtttagtcgcgtcgttttttcgtttcggtagttttcggagacgaagtttatttgcgttcgggcgcgcggacggttgtcgggatttaggagacgtcgtcgttcgagggcgcggattcgcggacggtttttgttcggcgtcgcggagtcgtcgtttggttgttgtttagtttacgtcgcgggagttcgagtcggagttcgagttcgagtttaagtcgcgtcggtgtttttgtcggtgtcgacgtcgcgttgcgtttcgcggggtcgcgaagattataatttttataatgtcgcgcgcgttgggtcgtcgggggagggggtacgggggggcggggtttgcggggcggggtcggggatttttttgtattcggtatttgcgttcgtagtgcgggaggcgattcgaggtcgcgttcgtcgtcgtttcggagggttttggtagtgcgtttcgagacgtagcgttcgtttagttcgaggttgcgcgtaggcggcgacgggcgtgt

SEQ ID NO: 21828 - DNA, 754 bp, Artificial Sequence
  chemically treated genomic DNA (Homo sapiens) CpG-island No: 21828
acacgcccgtcgccgcctacgcgcaacctcgaactaaacgaacgctacgtctcgaaacgcactaccaaaaccctccgaaacgacgacgaacgcgacctcgaatcgcctcccgcactacgaacgcaaataccgaatacaaaaaaatccccgaccccgccccgcaaaccccgcccccccgtaccccctcccccgacgacccaacgcgcgcgacattataaaaattataatcttcgcgaccccgcgaaacgcaacgcgacgtcgacaccgacaaaaacaccgacgcgacttaaactcgaactcgaactccgactcgaactcccgcgacgtaaactaaacaacaaccaaacgacgactccgcgacgccgaacaaaaaccgtccgcgaatccgcgccctcgaacgacgacgtctcctaaatcccgacaaccgtccgcgcgcccgaacgcaaataaacttcgtctccgaaaactaccgaaacgaaaaaacgacgcgactaaaccgaccccaaaacaaaaattaaaaacgaaaacccgacaactacaaacccacgaccctcccttaccgacgccgccgccgccgccgcccccgccgaaaatactccgaaacccgaacgcccgcatcccgacccgaccgaaaccaatactcgtacgtactaaacgccgccgcctcgaaaccgaacatcaccctccctaaacctcctcctactcctcttccctaccccatcgtaatcccttcctccatctcccttctccccta

SEQ ID NO: 21829 - DNA, 773 bp, Artificial Sequence
  chemically treated genomic DNA (Homo sapiens) CpG-island No: 21829
ggagtgcgcgtttttttcgcgtaggtggcgttcgtgggttgtgtagggttttaggtgcgttcgcggttttattgcggtttttttatttggcgtagtaaatttagtcgtttttggtggttttttttttttagttcggaggtagttcgtttttattgttcgtgtcgtttagtttcgcgtagcgtagcgttgttatggttgattgtggaggtatttggtttttttatcgttcgttgtcgggtttattcgtttaggaatttattttcgttttaaacgagattcgcgcgcgtcggggttcgatcgtttacgtttgcgtattgcgttttttaggggtcgtttcgtcgattacgaagttgaaatttagttttcgtaatatcgcgacggtcggcgttaaaggggtagggtttggagaggaaggcggtgaaagtgtttaagagatcgcgttgtcgtcgggttagatagtaaagtcggagagcgtttcgaggcgttagagatagagcggagttttgttagttttttcgtcgtagggaaggggcgtgcgtatttagtttcgggttaggatttcgttcgttgttgggcgattcgtaattattttcgcgttgttttggttaattttgtaggagttcggtaattggatatgggaaatgtagtttaggtggcgtttgattaaaaagcggcgttcgattaaaaagcggcgtttatgttgttgttttgggtttttgtttttttttgttttggggtttcgtgaaagttcgtgattataaattttttagggt

SEQ ID NO: 21830 - DNA, 773 bp, Artificial Sequence
  chemically treated genomic DNA (Homo sapiens) CpG-island No: 21830
accctaaaaaatttataatcacgaactttcacgaaaccccaaaacaaaaaaaaacaaaaacccaaaacaacaacataaacgccgctttttaatcgaacgccgctttttaatcaaacgccacctaaactacatttcccatatccaattaccgaactcctacaaaattaaccaaaacaacgcgaaaataattacgaatcgcccaacaacgaacgaaatcctaacccgaaactaaatacgcacgccccttccctacgacgaaaaaactaacaaaactccgctctatctctaacgcctcgaaacgctctccgactttactatctaacccgacgacaacgcgatctcttaaacactttcaccgccttcctctccaaaccctacccctttaacgccgaccgtcgcgatattacgaaaactaaatttcaacttcgtaatcgacgaaacgacccctaaaaaacgcaatacgcaaacgtaaacgatcgaaccccgacgcgcgcgaatctcgtttaaaacgaaaataaattcctaaacgaataaacccgacaacgaacgataaaaaaaccaaatacctccacaatcaaccataacaacgctacgctacgcgaaactaaacgacacgaacaataaaaacgaactacctccgaactaaaaaaaaaaaaccaccaaaaacgactaaatttactacgccaaataaaaaaaccgcaataaaaccgcgaacgcacctaaaaccctacacaacccacgaacgccacctacgcgaaaaaaacgcgcactcc

SEQ ID NO: 21831 - DNA, 773 bp, Artificial Sequence
  chemically treated genomic DNA (Homo sapiens) CpG-island No: 21831
gttttggaaggtttgtgattacggatttttacgagattttaaggtaaggagagatagaagtttaggataatagtatgggcgtcgttttttagtcgggcgtcgttttttggttaggcgttatttggattatattttttatatttaattgtcgggtttttgtaggattggttagaataacgcggaagtgattacgggtcgtttagtaacgggcggagttttggttcgaaattggatgcgtacgttttttttttgcggcggggaggttgataaggtttcgttttatttttagcgtttcggagcgtttttcggttttgttgtttagttcggcggtagcgcgattttttaggtatttttatcgtttttttttttaggttttgtttttttgacgtcggtcgtcgcgatattgcggagattggattttagtttcgtggtcggcggagcggtttttggagggcgtagtgcgtaggcgtgagcggtcgggtttcgacgcgcgcgggtttcgtttggagcgggagtgagtttttgagcgagtggattcggtagcgggcgataggggggttaggtgtttttatagttagttatggtagcgttgcgttacgcggggttggacgatacggatagtgaggacgagttgttttcgggttgggaggagagaattattaaggacggttgggtttattacgttaagtaagggggtcgtagtggggtcgcggacgtatttgggattttgtatagtttacggacgttatttgcgcggggaggacgcgtatttt

SEQ ID NO: 21832 - DNA, 773 bp, Artificial Sequence
  chemically treated genomic DNA (Homo sapiens) CpG-island No: 21832
aaaatacgcgtcctccccgcgcaaataacgtccgtaaactatacaaaatcccaaatacgtccgcgaccccactacgacccccttacttaacgtaataaacccaaccgtccttaataattctctcctcccaacccgaaaacaactcgtcctcactatccgtatcgtccaaccccgcgtaacgcaacgctaccataactaactataaaaacacctaacccccctatcgcccgctaccgaatccactcgctcaaaaactcactcccgctccaaacgaaacccgcgcgcgtcgaaacccgaccgctcacgcctacgcactacgccctccaaaaaccgctccgccgaccacgaaactaaaatccaatctccgcaatatcgcgacgaccgacgtcaaaaaaacaaaacctaaaaaaaaaaacgataaaaatacctaaaaaatcgcgctaccgccgaactaaacaacaaaaccgaaaaacgctccgaaacgctaaaaataaaacgaaaccttatcaacctccccgccgcaaaaaaaaaacgtacgcatccaatttcgaaccaaaactccgcccgttactaaacgacccgtaatcacttccgcgttattctaaccaatcctacaaaaacccgacaattaaatataaaaaatataatccaaataacgcctaaccaaaaaacgacgcccgactaaaaaacgacgcccatactattatcctaaacttctatctctccttaccttaaaatctcgtaaaaatccgtaatcacaaaccttccaaaac

SEQ ID NO: 21833 - DNA, 996 bp, Artificial Sequence
  chemically treated genomic DNA (Homo sapiens) CpG-island No: 21833
tcgtattcgcgtgtttgagcgtttagttttcgcgatgaggacgcgttcgggatatttacgttttttgtatcggttttcgtcgtttgcgattggcgtaggtgatgttggcgttgttgttgtttatggtgtttagtcgacggcggcggttatttttcgggtattggcggtcgggttttcggaattcggtgtaggttgggattattgcggcggtcggcgtcgggtttcgcgaagtcgcgttcgttttatttgcgttttttcgggatagtggcgtgggcgtcgcgttttaacgtttcggtttacgtaggttttcgtagttcgcgttagtataggtgagttgtttgggtttggcgtagtgagggtgggcgaggggcggagattcgcgagtaaggcggcgtaggtgtcgtttatatcggcggaggcggcgcggtaatgttcgtaggtgaggcggttcgggcggaggaggagtttgggtcgtttatttagaattttggtttgggtcgtttacggtggcgtcgcgtttcgtgatcgtcgtcgcggttttttgggtgagggaggtgtcgtcgcgttgttttcgggattttttaaatttagggtgtttttcgtttgcggagttcgggcgcgggttattagtttcggttgtttttagttttcgttcggttatacggttgtttttgttttgagttggcggttcggggtacgttttcggaatagagcgtcgacgggattttttagttattgtttttcgtcgtcgcgcgtatcggttgaatagtaggagtattttcgattttttatcggtttcgtttcgtttagatttcgcgtagtttcgtttcgttttgtttgttttcgtttatttggattttatttcgttttttttgagggttttatttttatttcggtacgtgatgacgtaggacgtaaggacgttttttttcgtcggtagttattttcgtgtataggtaaatttattgtagttagattgtataaagtatattaaga

SEQ ID NO: 21834 - DNA, 996 bp, Artificial Sequence
  chemically treated genomic DNA (Homo sapiens) CpG-island No: 21834
tcttaatatactttatacaatctaactacaataaatttacctatacacgaaaataactaccgacgaaaaaaaacgtccttacgtcctacgtcatcacgtaccgaaataaaaataaaaccctcaaaaaaaacgaaataaaatccaaataaacgaaaacaaacaaaacgaaacgaaactacgcgaaatctaaacgaaacgaaaccgataaaaaatcgaaaatactcctactattcaaccgatacgcgcgacgacgaaaaacaataactaaaaaatcccgtcgacgctctattccgaaaacgtaccccgaaccgccaactcaaaacaaaaacaaccgtataaccgaacgaaaactaaaaacaaccgaaactaataacccgcgcccgaactccgcaaacgaaaaacaccctaaatttaaaaaatcccgaaaacaacgcgacgacacctccctcacccaaaaaaccgcgacgacgatcacgaaacgcgacgccaccgtaaacgacccaaaccaaaattctaaataaacgacccaaactcctcctccgcccgaaccgcctcacctacgaacattaccgcgccgcctccgccgatataaacgacacctacgccgccttactcgcgaatctccgcccctcgcccaccctcactacgccaaacccaaacaactcacctatactaacgcgaactacgaaaacctacgtaaaccgaaacgttaaaacgcgacgcccacgccactatcccgaaaaaacgcaaataaaacgaacgcgacttcgcgaaacccgacgccgaccgccgcaataatcccaacctacaccgaattccgaaaacccgaccgccaatacccgaaaaataaccgccgccgtcgactaaacaccataaacaacaacaacgccaacatcacctacgccaatcgcaaacgacgaaaaccgatacaaaaaacgtaaatatcccgaacgcgtcctcatcgcgaaaactaaacgctcaaacacgcgaatacga

SEQ ID NO: 21835 - DNA, 996 bp, Artificial Sequence
  chemically treated genomic DNA (Homo sapiens) CpG-island No: 21835
ttttgatatattttgtatagtttagttataataagtttgtttatgtacgaagatggttatcggcgggggggggcgtttttacgttttacgttattacgtgtcgggatgagggtggggtttttaaggaagacggaatggaatttagatgggcgggggtaagtaggacggggcggggttacgcgggatttgggcggggcggggtcggtgaggggtcgggggtgtttttgttatttagtcggtgcgcgcggcggcgggaggtagtggttggggagtttcgtcgacgttttgtttcgagagcgtgtttcggatcgttagtttagaataggggtagtcgtgtagtcgaacggaagttgggagtagtcgggattggtggttcgcgttcgagtttcgtaggcgggaagtattttggatttaggaagtttcgggagtagcgcggcggtattttttttatttaaggggtcgcggcgacggttacggggcgcggcgttatcgtgagcgatttaggttaggattttaaatagacggtttaggtttttttttcgttcgggtcgttttatttgcgggtattgtcgcgtcgttttcgtcggtgtagacggtatttgcgtcgttttgttcgcgggttttcgtttttcgtttatttttattgcgttaggtttaggtagtttatttgtattggcgcgggttgcggaagtttgcgtgagtcgaggcgttgaggcgcggcgtttacgttattgtttcgagaggacgtaggtggagcgggcgcggtttcgcggaattcggcgtcggtcgtcgtagtggttttagtttatatcgggtttcggggattcggtcgttagtgttcggggagtagtcgtcgtcgtcggttgggtattatgaatagtagtagcgttaatattatttacgttagtcgtaagcggcggaagtcggtgtagaaaacgtgagtgtttcgagcgcgtttttatcgcgggggttgggcgtttaggtacgcgggtgcgg

SEQ ID NO: 21836 - DNA, 996 bp, Artificial Sequence
  chemically treated genomic DNA (Homo sapiens) CpG-island No: 21836
ccgcacccgcgtacctaaacgcccaacccccgcgataaaaacgcgctcgaaacactcacgttttctacaccgacttccgccgcttacgactaacgtaaataatattaacgctactactattcataatacccaaccgacgacgacgactactccccgaacactaacgaccgaatccccgaaacccgatataaactaaaaccactacgacgaccgacgccgaattccgcgaaaccgcgcccgctccacctacgtcctctcgaaacaataacgtaaacgccgcgcctcaacgcctcgactcacgcaaacttccgcaacccgcgccaatacaaataaactacctaaacctaacgcaataaaaataaacgaaaaacgaaaacccgcgaacaaaacgacgcaaataccgtctacaccgacgaaaacgacgcgacaatacccgcaaataaaacgacccgaacgaaaaaaaaacctaaaccgtctatttaaaatcctaacctaaatcgctcacgataacgccgcgccccgtaaccgtcgccgcgaccccttaaataaaaaaaataccgccgcgctactcccgaaacttcctaaatccaaaatacttcccgcctacgaaactcgaacgcgaaccaccaatcccgactactcccaacttccgttcgactacacgactacccctattctaaactaacgatccgaaacacgctctcgaaacaaaacgtcgacgaaactccccaaccactacctcccgccgccgcgcgcaccgactaaataacaaaaacacccccgacccctcaccgaccccgccccgcccaaatcccgcgtaaccccgccccgtcctacttacccccgcccatctaaattccattccgtcttccttaaaaaccccaccctcatcccgacacgtaataacgtaaaacgtaaaaacgcccccccccgccgataaccatcttcgtacataaacaaacttattataactaaactatacaaaatatatcaaaa

SEQ ID NO: 21837 - DNA, 603 bp, Artificial Sequence
  chemically treated genomic DNA (Homo sapiens) CpG-island No: 21837
gtcgtatcgggtagtcgcgaaagtacggtttttttcggtttgttgataggacggtcgttttttttttttcgttagttacggtttttacgtagtagaggtatcgcgtttgtaggtcgggttttcggggtcggattcggttttaaggcgcggaggaggaaggcgtaaagtataaacgagtgggttgcggcggttgaagatttgaaaacgcgttacgcggtcgcggcgtcgatacgcgcgtttcgtttcgttttacgttacgcgtcgtgtttcgtttcgcgttcgtttttcgtgtttgttttttcgcgttgcgcgtttcgtttttttacgtcgtcgtttttttcgcgtttcgttttggttttgtaggttgtgttttcgtttttatttcgtttttatttcgttgtttttttagttttagattcgggttttcggttcgtcgttttaggttttggcgtagttttagagagttggcgcggttttgtgttgattaaatttagtggatgtagttagcgtcggagttcggtttcgttcgttattagggttattttcgttttttaggtttgttaggattgtcggttttgtagttgttttttgttttaggtatgt

SEQ ID NO: 21838 - DNA, 603 bp, Artificial Sequence
  chemically treated genomic DNA (Homo sapiens) CpG-island No: 21838
acatacctaaaacaaaaaacaactacaaaaccgacaatcctaacaaacctaaaaaacgaaaataaccctaataacgaacgaaaccgaactccgacgctaactacatccactaaatttaatcaacacaaaaccgcgccaactctctaaaactacgccaaaacctaaaacgacgaaccgaaaacccgaatctaaaactaaaaaaacaacgaaataaaaacgaaataaaaacgaaaacacaacctacaaaaccaaaacgaaacgcgaaaaaaacgacgacgtaaaaaaacgaaacgcgcaacgcgaaaaaacaaacacgaaaaacgaacgcgaaacgaaacacgacgcgtaacgtaaaacgaaacgaaacgcgcgtatcgacgccgcgaccgcgtaacgcgttttcaaatcttcaaccgccgcaacccactcgtttatactttacgccttcctcctccgcgccttaaaaccgaatccgaccccgaaaacccgacctacaaacgcgatacctctactacgtaaaaaccgtaactaacgaaaaaaaaaaaacgaccgtcctatcaacaaaccgaaaaaaaccgtactttcgcgactacccgatacgac

SEQ ID NO: 21839 - DNA, 603 bp, Artificial Sequence
  chemically treated genomic DNA (Homo sapiens) CpG-island No: 21839
gtatatttggggtagaaggtagttgtagggtcggtagttttggtaaatttagaaggcgggaataattttggtgacgggcggggtcgggtttcggcgttaattgtatttattaggtttggttaatatagagtcgcgttaattttttgaggttgcgttaagatttgaagcggcggatcgagagttcgggtttgagattgagagagtaacggaatggaggcggggtagaggcggaaatataatttgtagggttagagcgaggcgcgagaaggacggcggcgtgagggggcggggcgcgtagcgcgagaaggtaggtacgaggggcgagcgcgaggcggggtacggcgcgtggcgtgagacggggcggggcgcgcgtatcggcgtcgcggtcgcgtgacgcgtttttaaatttttaatcgtcgtagtttattcgtttgtgttttgcgtttttttttttcgcgttttggagtcggattcggtttcggaaattcgatttgtagacgcggtatttttattgcgtagaggtcgtagttggcggaaggagagaggcggtcgttttgttaataggtcgggggaagtcgtgttttcgcggttgttcggtgcgat

SEQ ID NO: 21840 - DNA, 603 bp, Artificial Sequence
  chemically treated genomic DNA (Homo sapiens) CpG-island No: 21840
atcgcaccgaacaaccgcgaaaacacgacttcccccgacctattaacaaaacgaccgcctctctccttccgccaactacgacctctacgcaataaaaataccgcgtctacaaatcgaatttccgaaaccgaatccgactccaaaacgcgaaaaaaaaaaacgcaaaacacaaacgaataaactacgacgattaaaaatttaaaaacgcgtcacgcgaccgcgacgccgatacgcgcgccccgccccgtctcacgccacgcgccgtaccccgcctcgcgctcgcccctcgtacctaccttctcgcgctacgcgccccgccccctcacgccgccgtccttctcgcgcctcgctctaaccctacaaattatatttccgcctctaccccgcctccattccgttactctctcaatctcaaacccgaactctcgatccgccgcttcaaatcttaacgcaacctcaaaaaattaacgcgactctatattaaccaaacctaataaatacaattaacgccgaaacccgaccccgcccgtcaccaaaattattcccgccttctaaatttaccaaaactaccgaccctacaactaccttctaccccaaatatac

SEQ ID NO: 21841 - DNA, 509 bp, Artificial Sequence
  chemically treated genomic DNA (Homo sapiens) CpG-island No: 21841
gttgattgcgagttggggcgggacgcggtgatgggaggggatcgggtcgggaatgcgggaggcgaggggagcgacgggatttgtcgtttcggcggtcgggtagttaatcgattcgttttttttaggaaggagcgaggggagggtggtttagagagaaagcgtcgcgcggtttcggttgttttcggttcgggatatttaaatagattaaagaggattcggagtggagttcggagcggatttcgtagttcgcgttcgtcgcgtatttattcgcgcgttcgttgttgggttttcggtagtcgcgttttttgcgttggcggagtcggaggagtttgcgttgggtcggcggggggcgggcgtttggggagggcggagagagggttcgttcgtcgggatttttgttcggttcgggcgttttagagtcgcgggattggtcgtcggaggttgcgggaggggttcgggttagattttttagaagttttagagagagtcgttttttttttttcgtgtga

SEQ ID NO: 21842 - DNA, 509 bp, Artificial Sequence
  chemically treated genomic DNA (Homo sapiens) CpG-island No: 21842
tcacacgaaaaaaaaaaaacgactctctctaaaacttctaaaaaatctaacccgaacccctcccgcaacctccgacgaccaatcccgcgactctaaaacgcccgaaccgaacaaaaatcccgacgaacgaaccctctctccgccctccccaaacgcccgccccccgccgacccaacgcaaactcctccgactccgccaacgcaaaaaacgcgactaccgaaaacccaacaacgaacgcgcgaataaatacgcgacgaacgcgaactacgaaatccgctccgaactccactccgaatcctctttaatctatttaaatatcccgaaccgaaaacaaccgaaaccgcgcgacgctttctctctaaaccaccctcccctcgctccttcctaaaaaaaacgaatcgattaactacccgaccgccgaaacgacaaatcccgtcgctcccctcgcctcccgcattcccgacccgatcccctcccatcaccgcgtcccgccccaactcgcaatcaac

SEQ ID NO: 21843 - DNA, 509 bp, Artificial Sequence
  chemically treated genomic DNA (Homo sapiens) CpG-island No: 21843
ttatacgaaggaggggaagcggttttttttggggtttttgggaggtttggttcgggtttttttcgtagttttcggcggttagtttcgcggttttggggcgttcggatcgagtaaaggtttcggcgggcgggtttttttttcgttttttttaagcgttcgtttttcgtcggtttagcgtaggttttttcgatttcgttagcgtagggggcgcggttgtcggggatttagtagcgggcgcgcgggtaagtgcgcggcgggcgcgggttgcgggattcgtttcgggttttatttcggattttttttggtttgtttgggtgtttcgggtcgggggtagtcgaggtcgcgcggcgttttttttttgggttatttttttttcgtttttttttaggggagacgaatcgattggttgttcggtcgtcggaacggtaggtttcgtcgtttttttcgtttttcgtattttcggttcggtttttttttattatcgcgtttcgttttaattcgtagttagt

SEQ ID NO: 21844 - DNA, 509 bp, Artificial Sequence
  chemically treated genomic DNA (Homo sapiens) CpG-island No: 21844
actaactacgaattaaaacgaaacgcgataataaaaaaaaaccgaaccgaaaatacgaaaaacgaaaaaaacgacgaaacctaccgttccgacgaccgaacaaccaatcgattcgtctcccctaaaaaaaaacgaaaaaaaaataacccaaaaaaaaaacgccgcgcgacctcgactacccccgacccgaaacacccaaacaaaccaaaaaaaatccgaaataaaacccgaaacgaatcccgcaacccgcgcccgccgcgcacttacccgcgcgcccgctactaaatccccgacaaccgcgccccctacgctaacgaaatcgaaaaaacctacgctaaaccgacgaaaaacgaacgcttaaaaaaaacgaaaaaaaaacccgcccgccgaaacctttactcgatccgaacgccccaaaaccgcgaaactaaccgccgaaaactacgaaaaaaacccgaaccaaacctcccaaaaaccccaaaaaaaaccgcttcccctccttcgtataa

SEQ ID NO: 21845 - DNA, 555 bp, Artificial Sequence
  chemically treated genomic DNA (Homo sapiens) CpG-island No: 21845
gggtcggggcgttcgtcggtggggaggggcgcgggcgggttttagtaggcgttttttagttcggtttggttggttttggcgtttcgggcgcggggtcgcggttttcggtttttttgcggtcgagcggtttcggtttcgaagtttttgagtttcgattggttgtggaagcgggtgaggcgtttgtatttgtacgaggttattaggcgtattttgcgcgcgcgcggcgttttattatcgggatatagtagttgtacgcgttgcgcgcggtagcggtcggggatgtagcggaagtcgggtttattaggtcgttattatttgtcgcggtcgatggcgttgggtagtaggcgcgtcgggtcgtattggtcggagtatattagttcggtgatcggtttggcgttgcggtacggtttatcggttacgtagcgggtgaagtgtagttcgcggtagttgtattcggatacgtttgtggagagaggcgcgcgtgagggtggtcgttcgtttggttatttttgttttggatcggttcgtttttttttattttagttttgtttttgt

SEQ ID NO: 21846 - DNA, 555 bp, Artificial Sequence
  chemically treated genomic DNA (Homo sapiens) CpG-island No: 21846
acaaaaacaaaactaaaataaaaaaaaacgaaccgatccaaaacaaaaataaccaaacgaacgaccaccctcacgcgcgcctctctccacaaacgtatccgaatacaactaccgcgaactacacttcacccgctacgtaaccgataaaccgtaccgcaacgccaaaccgatcaccgaactaatatactccgaccaatacgacccgacgcgcctactacccaacgccatcgaccgcgacaaataataacgacctaataaacccgacttccgctacatccccgaccgctaccgcgcgcaacgcgtacaactactatatcccgataataaaacgccgcgcgcgcgcaaaatacgcctaataacctcgtacaaatacaaacgcctcacccgcttccacaaccaatcgaaactcaaaaacttcgaaaccgaaaccgctcgaccgcaaaaaaaccgaaaaccgcgaccccgcgcccgaaacgccaaaaccaaccaaaccgaactaaaaaacgcctactaaaacccgcccgcgcccctccccaccgacgaacgccccgaccc

SEQ ID NO: 21847 - DNA, 555 bp, Artificial Sequence
  chemically treated genomic DNA (Homo sapiens) CpG-island No: 21847
gtaaaagtagggttggggtggagagagacgggtcggtttagggtaggggtggttaggcgggcggttatttttacgcgcgtttttttttatagacgtgttcgagtatagttgtcgcgagttgtattttattcgttacgtgatcgatgggtcgtgtcgtagcgttaagtcggttatcgagttggtgtgtttcggttagtgcggttcggcgcgtttgttgtttaacgttatcggtcgcggtaagtggtggcgatttagtgggttcgattttcgttgtattttcgatcgttatcgcgcgtagcgcgtgtagttgttgtgtttcggtggtgaggcgtcgcgcgcgcgtaaggtgcgtttggtggtttcgtgtaagtgtaagcgttttattcgtttttataattagtcggagtttaaggatttcgggatcgaggtcgttcggtcgtagaagggtcggaagtcgcggtttcgcgttcggagcgttaaagttaattaggtcgagttggagaacgtttattagagttcgttcgcgtttttttttatcggcgggcgtttcggttt

SEQ ID NO: 21848 - DNA, 555 bp, Artificial Sequence
  chemically treated genomic DNA (Homo sapiens) CpG-island No: 21848
aaaccgaaacgcccgccgataaaaaaaaacgcgaacgaactctaataaacgttctccaactcgacctaattaactttaacgctccgaacgcgaaaccgcgacttccgacccttctacgaccgaacgacctcgatcccgaaatccttaaactccgactaattataaaaacgaataaaacgcttacacttacacgaaaccaccaaacgcaccttacgcgcgcgcgacgcctcaccaccgaaacacaacaactacacgcgctacgcgcgataacgatcgaaaatacaacgaaaatcgaacccactaaatcgccaccacttaccgcgaccgataacgttaaacaacaaacgcgccgaaccgcactaaccgaaacacaccaactcgataaccgacttaacgctacgacacgacccatcgatcacgtaacgaataaaatacaactcgcgacaactatactcgaacacgtctataaaaaaaaacgcgcgtaaaaataaccgcccgcctaaccacccctaccctaaaccgacccgtctctctccaccccaaccctacttttac

SEQ ID NO: 21849 - DNA, 914 bp, Artificial Sequence
  chemically treated genomic DNA (Homo sapiens) CpG-island No: 21849
tttatgttcgaattgtgacgtcggttcgttgttatggcggcgaaggtagatatttcgcggtgattttattgtagaattaggtagttgttatatgacgcgcgggtaggagatcggtcgggcgatcgagggttatttgttaagtgaatatggtagtttcgatttcgtttaaggttaagttttaagcgggtggcggttgggattcgggtaggcgttattcgggtttcgtgtatttcgttacggggaagggtcgcgttcggttaggtagggttttagttttttggttttacgcgcgggggtaggcgtcgattttaggttttttttaagttttcgttgtggttttcggaggggttatcgcgttcgggtttttttaatttaagattcgcgatatttcgattttagtttcgggtgggcggggcgtttcgagagggacggcggggtcgggttcgcgaaagggatttacgcgttgtttacgtagattcgcggggtgatttcgttgtagggttggttcgggaggttgtagtagtcgttgtcgttcgagagtaggtcgttgagattttgtatcgagagttcgaacgagttcgatatggcggcggcggggttttgtacgttcggtaggagtaagcgaggcggagagcggcggattagttgggcgggggttcgcgtcgggagtcgtttcgtttcgtttttggggcgggttcgtcgggtttcgggagttgcggagcgcgggcgtcgtgacgcgggggtttcgcgcgttatttttgggcgcgtttcggggggaagacgttatcgttttggagttttaggggttttcgttttatttcggtttaggtcgtttgtgtatttttgtaaattggtaagcgcggtaatttttttttttgaattaaatgtagggtttaataaatatttcgtggcgg

SEQ ID NO: 21850 - DNA, 914 bp, Artificial Sequence
  chemically treated genomic DNA (Homo sapiens) CpG-island No: 21850
ccgccacgaaatatttattaaaccctacatttaattcaaaaaaaaaaattaccgcgcttaccaatttacaaaaatacacaaacgacctaaaccgaaataaaacgaaaacccctaaaactccaaaacgataacgtcttccccccgaaacgcgcccaaaaataacgcgcgaaacccccgcgtcacgacgcccgcgctccgcaactcccgaaacccgacgaacccgccccaaaaacgaaacgaaacgactcccgacgcgaacccccgcccaactaatccgccgctctccgcctcgcttactcctaccgaacgtacaaaaccccgccgccgccatatcgaactcgttcgaactctcgatacaaaatctcaacgacctactctcgaacgacaacgactactacaacctcccgaaccaaccctacaacgaaatcaccccgcgaatctacgtaaacaacgcgtaaatccctttcgcgaacccgaccccgccgtccctctcgaaacgccccgcccacccgaaactaaaatcgaaatatcgcgaatcttaaattaaaaaaacccgaacgcgataacccctccgaaaaccacaacgaaaacttaaaaaaaacctaaaatcgacgcctacccccgcgcgtaaaaccaaaaaactaaaaccctacctaaccgaacgcgacccttccccgtaacgaaatacacgaaacccgaataacgcctacccgaatcccaaccgccacccgcttaaaacttaaccttaaacgaaatcgaaactaccatattcacttaacaaataaccctcgatcgcccgaccgatctcctacccgcgcgtcatataacaactacctaattctacaataaaatcaccgcgaaatatctaccttcgccgccataacaacgaaccgacgtcacaattcgaacataaa

SEQ ID NO: 21851 - DNA, 914 bp, Artificial Sequence
  chemically treated genomic DNA (Homo sapiens) CpG-island No: 21851
tcgttacgaaatgtttattgggttttgtatttaatttagggaaggaagttatcgcgtttgttagtttataaagatatataaacggtttggatcgggatggggcgaggatttttgagattttagggcggtggcgtttttttttcgggacgcgtttaggagtggcgcgcggggttttcgcgttacggcgttcgcgtttcgtagttttcggagttcggcgggttcgttttaggggcgggacggggcggttttcggcgcgagttttcgtttagttgattcgtcgtttttcgtttcgtttgtttttgtcgggcgtgtagggtttcgtcgtcgttatgtcgggttcgttcgagttttcggtgtaggattttaacgatttgttttcggacggtagcggttgttatagtttttcgagttagttttgtaacgaggttatttcgcggatttacgtgggtaacgcgtgagtttttttcgcgagttcggtttcgtcgtttttttcgggacgtttcgtttattcgaggttggggtcggggtgtcgcgagttttgggttgggggagttcgggcgcgatggttttttcgggagttatagcgggggtttgggaggggtttggagtcgacgtttattttcgcgcgtggggttaaggaattggaattttgtttggtcgggcgcggttttttttcgtggcggggtgtacggagttcgggtggcgtttgttcgggttttagtcgttattcgtttggggtttggttttgggcggggtcggggttattatgtttatttaataggtgattttcggtcgttcggtcggttttttgttcgcgcgttatgtgatagttgtttggttttgtagtgaggttatcgcggaatgtttgttttcgtcgttatggtaacgggtcgacgttataattcgggtatgga

SEQ ID NO: 21852 - DNA, 914 bp, Artificial Sequence
  chemically treated genomic DNA (Homo sapiens) CpG-island No: 21852
tccatacccgaattataacgtcgacccgttaccataacgacgaaaacaaacattccgcgataacctcactacaaaaccaaacaactatcacataacgcgcgaacaaaaaaccgaccgaacgaccgaaaatcacctattaaataaacataataaccccgaccccgcccaaaaccaaaccccaaacgaataacgactaaaacccgaacaaacgccacccgaactccgtacaccccgccacgaaaaaaaaccgcgcccgaccaaacaaaattccaattccttaaccccacgcgcgaaaataaacgtcgactccaaacccctcccaaacccccgctataactcccgaaaaaaccatcgcgcccgaactcccccaacccaaaactcgcgacaccccgaccccaacctcgaataaacgaaacgtcccgaaaaaaacgacgaaaccgaactcgcgaaaaaaactcacgcgttacccacgtaaatccgcgaaataacctcgttacaaaactaactcgaaaaactataacaaccgctaccgtccgaaaacaaatcgttaaaatcctacaccgaaaactcgaacgaacccgacataacgacgacgaaaccctacacgcccgacaaaaacaaacgaaacgaaaaacgacgaatcaactaaacgaaaactcgcgccgaaaaccgccccgtcccgcccctaaaacgaacccgccgaactccgaaaactacgaaacgcgaacgccgtaacgcgaaaaccccgcgcgccactcctaaacgcgtcccgaaaaaaaaacgccaccgccctaaaatctcaaaaatcctcgccccatcccgatccaaaccgtttatatatctttataaactaacaaacgcgataacttccttccctaaattaaatacaaaacccaataaacatttcgtaacga

SEQ ID NO: 21853 - DNA, 581 bp, Artificial Sequence
  chemically treated genomic DNA (Homo sapiens) CpG-island No: 21853
gtttttttatgtttttttacgtttttttttacgtttttttacgtttttttttacgtttttttacgtttttttttacgtttttttacgtttttttacgtttttttttacgtttttttacgtttttttacgttttttttcgtttttttttacgtttttttacgtttttttttacgtttttttatttttttttttacgtttttttacgtttttttttacgtttttttacgtttttttttacgtttttttacgtttttttttacgtttttttacgtttttttacgtttttttttacgtttttttacgtttttttttacgttttttttcgtttttttttacgtttttttacgtttttttttacgtttttttacgtttttttttacgtttttttttacgtttttttacgtttttttttacgtttttttacgtttttttttacgtttttttacgtttttttttacgtttttttacgtttttttttacgtttttttacgtttttttttatatttttttacgtttttttttatgtttttgttgatttgattgatgaatgttgaaggaggaataaggcgtgtgtaattcgg

SEQ ID NO: 21854 - DNA, 581 bp, Artificial Sequence
  chemically treated genomic DNA (Homo sapiens) CpG-island No: 21854
ccgaattacacacgccttattcctccttcaacattcatcaatcaaatcaacaaaaacataaaaaaaaacgtaaaaaaatataaaaaaaaacgtaaaaaaacgtaaaaaaaaacgtaaaaaaacgtaaaaaaaaacgtaaaaaaacgtaaaaaaaaacgtaaaaaaacgtaaaaaaaaacgtaaaaaaacgtaaaaaaaaacgtaaaaaaaaacgtaaaaaaacgtaaaaaaaaacgtaaaaaaacgtaaaaaaaaacgaaaaaaaacgtaaaaaaaaacgtaaaaaaacgtaaaaaaaaacgtaaaaaaacgtaaaaaaacgtaaaaaaaaacgtaaaaaaacgtaaaaaaaaacgtaaaaaaacgtaaaaaaaaacgtaaaaaaacgtaaaaaaaaaaataaaaaaacgtaaaaaaaaacgtaaaaaaacgtaaaaaaaaacgaaaaaaaacgtaaaaaaacgtaaaaaaacgtaaaaaaaaacgtaaaaaaacgtaaaaaaacgtaaaaaaaaacgtaaaaaaacgtaaaaaaaaacgtaaaaaaacgtaaaaaaaaacgtaaaaaaacataaaaaaac

SEQ ID NO: 21855 - DNA, 581 bp, Artificial Sequence
  chemically treated genomic DNA (Homo sapiens) CpG-island No: 21855
tcgggttatatacgttttgttttttttttaatatttattaattaaattagtagaggtatggagaaaggcgtggagaggtgtagagagaggcgtggagaggcgtggagagaggcgtggagaggcgtggagagaggcgtggagaggcgtggagagaggcgtggagaggcgtggagagaggcgtggagaggcgtggagagaggcgtggagagaggcgtggagaggcgtggagagaggcgtggagaggcgtggagagaggcggggagaggcgtggagagaggcgtggagaggcgtggagagaggcgtggagaggcgtggagaggcgtggagagaggcgtggagaggcgtggagagaggcgtggagaggcgtggagagaggcgtggagaggcgtggagagaggggtggagaggcgtagagagaggcgtggagaggcgtggagagaggcggggagaggcgtggagaggcgtggagaggcgtggagagaggcgtggagaggcgtggagaggcgtagagagaggcgtggagaggcgtggagagaggcgtggagaggcgtggagagaggcgtggagaggtatggagaggt

SEQ ID NO: 21856 - DNA, 581 bp, Artificial Sequence
  chemically treated genomic DNA (Homo sapiens) CpG-island No: 21856
acctctccatacctctccacgcctctctccacgcctctccacgcctctctccacgcctctccacgcctctctctacgcctctccacgcctctccacgcctctctccacgcctctccacgcctctccacgcctctccccgcctctctccacgcctctccacgcctctctctacgcctctccacccctctctccacgcctctccacgcctctctccacgcctctccacgcctctctccacgcctctccacgcctctctccacgcctctccacgcctctccacgcctctctccacgcctctccacgcctctctccacgcctctccccgcctctctccacgcctctccacgcctctctccacgcctctccacgcctctctccacgcctctctccacgcctctccacgcctctctccacgcctctccacgcctctctccacgcctctccacgcctctctccacgcctctccacgcctctctccacgcctctccacgcctctctctacacctctccacgcctttctccatacctctactaatttaattaataaatattaaaaaaaaaacaaaacgtatataacccga

SEQ ID NO: 21857 - DNA, 888 bp, Artificial Sequence
  chemically treated genomic DNA (Homo sapiens) CpG-island No: 21857
gcggcggcggatcgtgtggggcggggtgcgtagtgtgagtcggggagcgtcggtcggaattttatagtgcggtgataaaaaatcgtgagggtggcgtagaacgggtaagagattatagcgtttatttggtaggggcgcgagtttatacgtcgatttttggagttttagttagggttgttttgagttgggcgcgttaggcgagttttattttcggaggcggggtcgtcgcgcggttattggtcggcgttttggagttatttgtttttattttgggggcggggttatttgggtttcgtttcgcggttcgggtttcggggtcgcgtttttgtttttcgttttcgttttcgtttcgtttcggcgcgaaggtttcgttttcgagtttcggggtttaggcgtttcgtgatgttatcgtagtttgatataaagagtttttcggtttacgcgggtttttcggtaacgggcgggggcggggtcgcgttttttattggtgtttagaagtgcgagcggataggtcggtcgcgattgtttttgcgtttcggggttgttcgtcgttttcgtcgtcgtcgattcgcgttttttggttttcgcgtttttgtcggggagcggttcgcggatgcgtatttcgttagttttcgggagttaggtaagcggcggtttcggggttggcgttcgtagggtttcggcggcgcgtatttggttcggttcggttcgcggtttcgggaagttggcggagagcggatttggtttgggaggtcgtgttatttgagttatttcgttcggtcgcgagtagaagtcgttgttaggtgcgcgggtggcggttttttttttagcgtagttttaggaagtgtttttagtggattaggaagggggttcgtttgttggggcgtt

SEQ ID NO: 21858 - DNA, 888 bp, Artificial Sequence
  chemically treated genomic DNA (Homo sapiens) CpG-island No: 21858
aacgccccaacaaacgaacccccttcctaatccactaaaaacacttcctaaaactacgctaaaaaaaaaaccgccacccgcgcacctaacaacgacttctactcgcgaccgaacgaaataactcaaataacacgacctcccaaaccaaatccgctctccgccaacttcccgaaaccgcgaaccgaaccgaaccaaatacgcgccgccgaaaccctacgaacgccaaccccgaaaccgccgcttacctaactcccgaaaactaacgaaatacgcatccgcgaaccgctccccgacaaaaacgcgaaaaccaaaaaacgcgaatcgacgacgacgaaaacgacgaacaaccccgaaacgcaaaaacaatcgcgaccgacctatccgctcgcacttctaaacaccaataaaaaacgcgaccccgcccccgcccgttaccgaaaaacccgcgtaaaccgaaaaactctttatatcaaactacgataacatcacgaaacgcctaaaccccgaaactcgaaaacgaaaccttcgcgccgaaacgaaacgaaaacgaaaacgaaaaacaaaaacgcgaccccgaaacccgaaccgcgaaacgaaacccaaataaccccgcccccaaaataaaaacaaataactccaaaacgccgaccaataaccgcgcgacgaccccgcctccgaaaataaaactcgcctaacgcgcccaactcaaaacaaccctaactaaaactccaaaaatcgacgtataaactcgcgcccctaccaaataaacgctataatctcttacccgttctacgccaccctcacgattttttatcaccgcactataaaattccgaccgacgctccccgactcacactacgcaccccgccccacacgatccgccgccgc

SEQ ID NO: 21859 - DNA, 888 bp, Artificial Sequence
  chemically treated genomic DNA (Homo sapiens) CpG-island No: 21859
ggcgttttagtagacgagttttttttttagtttattaaaagtattttttggaattgcgttggggaaggagtcgttattcgcgtatttggtagcggtttttattcgcggtcgaacgagatggtttaggtaatacgattttttaggttaagttcgtttttcgttaatttttcggggtcgcgggtcgggtcgagttaggtgcgcgtcgtcggagttttgcgagcgttagtttcggggtcgtcgtttatttggttttcgagagttggcggggtgcgtattcgcgggtcgtttttcggtagaggcgcggaagttagagggcgcgggtcggcggcggcggggacggcgggtagtttcgaagcgtaggaataatcgcggtcggtttgttcgttcgtatttttgggtattagtggaaggcgcggtttcgttttcgttcgttgtcgggagattcgcgtgggtcgaagggttttttgtattaagttgcggtgatattacgaggcgtttgggtttcgggattcgggggcggggttttcgcgtcggggcggggcgggggcgggggcggaggatagggacgcggtttcggaattcgagtcgcggggcggggtttaggtaatttcgtttttaaggtaggggtaggtggttttagggcgtcgattaatggtcgcgcggcggtttcgttttcggaggtggagttcgtttggcgcgtttagtttagggtagttttggttgggattttaggagtcggcgtgtgagttcgcgtttttgttaggtaggcgttgtagttttttgttcgttttgcgttatttttacggttttttgttatcgtattgtgagatttcggtcggcgtttttcggtttatattgcgtatttcgttttatacggttcgtcgtcgt

SEQ ID NO: 21860 - DNA, 888 bp, Artificial Sequence
  chemically treated genomic DNA (Homo sapiens) CpG-island No: 21860
acgacgacgaaccgtataaaacgaaatacgcaatataaaccgaaaaacgccgaccgaaatctcacaatacgataacaaaaaaccgtaaaaataacgcaaaacgaacaaaaaactacaacgcctacctaacaaaaacgcgaactcacacgccgactcctaaaatcccaaccaaaactaccctaaactaaacgcgccaaacgaactccacctccgaaaacgaaaccgccgcgcgaccattaatcgacgccctaaaaccacctacccctaccttaaaaacgaaattacctaaaccccgccccgcgactcgaattccgaaaccgcgtccctatcctccgcccccgcccccgccccgccccgacgcgaaaaccccgcccccgaatcccgaaacccaaacgcctcgtaatatcaccgcaacttaatacaaaaaacccttcgacccacgcgaatctcccgacaacgaacgaaaacgaaaccgcgccttccactaatacccaaaaatacgaacgaacaaaccgaccgcgattattcctacgcttcgaaactacccgccgtccccgccgccgccgacccgcgccctctaacttccgcgcctctaccgaaaaacgacccgcgaatacgcaccccgccaactctcgaaaaccaaataaacgacgaccccgaaactaacgctcgcaaaactccgacgacgcgcacctaactcgacccgacccgcgaccccgaaaaattaacgaaaaacgaacttaacctaaaaaatcgtattacctaaaccatctcgttcgaccgcgaataaaaaccgctaccaaatacgcgaataacgactccttccccaacgcaattccaaaaaatacttttaataaactaaaaaaaaaactcgtctactaaaacgcc

SEQ ID NO: 21861 - DNA, 570 bp, Artificial Sequence
  chemically treated genomic DNA (Homo sapiens) CpG-island No: 21861
gcgtttcgagtttggttttatgttttaggtttttcgcgtttttttcggagcgttggtttcgttttagttttcgttttcggtcgcgtcgttttttttggtttgcgttttggtttttattaatttcgttcgagtttttacggattttgttcggttcgacggaaatgattcggttagggttatatacggtttttgttcgtttcgttgcggttattttcgttttcgttttcgttttcgtcgaggttttttttcgatttaggtacggttttgtgtcgtagttttcgattttatcgttaggtcgttgttcgttttaggcgtgggttgggtttcggggtatcgttcgcggcgggcgcggggcgagagaggagggaggagggtcgggttttttaagacgtcggttcgggtttcgtaggcggcgggcgcgggatttgtttttgatcgggcgggagcggtgttcgtagagttaagttcgggtttgcgggtggggtttgcgggggcgggatcgggggcggggtcgaggtcgtagtttttagtcggtattattttttttttattgagagattttatcggttt

SEQ ID NO: 21862 - DNA, 570 bp, Artificial Sequence
  chemically treated genomic DNA (Homo sapiens) CpG-island No: 21862
aaaccgataaaatctctcaataaaaaaaaaataataccgactaaaaactacgacctcgaccccgcccccgatcccgcccccgcaaaccccacccgcaaacccgaacttaactctacgaacaccgctcccgcccgatcaaaaacaaatcccgcgcccgccgcctacgaaacccgaaccgacgtcttaaaaaacccgaccctcctccctcctctctcgccccgcgcccgccgcgaacgataccccgaaacccaacccacgcctaaaacgaacaacgacctaacgataaaatcgaaaactacgacacaaaaccgtacctaaatcgaaaaaaaacctcgacgaaaacgaaaacgaaaacgaaaataaccgcaacgaaacgaacaaaaaccgtatataaccctaaccgaatcatttccgtcgaaccgaacaaaatccgtaaaaactcgaacgaaattaataaaaaccaaaacgcaaaccaaaaaaaacgacgcgaccgaaaacgaaaactaaaacgaaaccaacgctccgaaaaaaacgcgaaaaacctaaaacataaaaccaaactcgaaacgc

SEQ ID NO: 21863 - DNA, 570 bp, Artificial Sequence
  chemically treated genomic DNA (Homo sapiens) CpG-island No: 21863
ggatcggtggaattttttagtggaggggaggtggtatcggttgggagttgcggtttcggtttcgttttcggtttcgttttcgtaagttttattcgtaagttcgggtttgattttgcgagtatcgttttcgttcggttaggggtaggtttcgcgttcgtcgtttgcgggattcgaatcggcgttttgagaagttcggttttttttttttttttttcgtttcgcgttcgtcgcgagcgatgtttcgagatttagtttacgtttagagcgggtagcggtttggcggtggggtcgaaagttacggtatagagtcgtgtttgagtcggaaagaagtttcggcggaagcggaagcggaagcggagatggtcgtagcggagcgggtaggggtcgtgtgtgattttggtcgggttattttcgtcgggtcgggtagggttcgtgggggttcgggcggggttggtggggattagggcgtaagttaagaagggcggcgcggtcgggggcggggattgggacggggttagcgtttcgaggaagacgcggggagtttggggtatggggttaggttcggggcgt

SEQ ID NO: 21864 - DNA, 570 bp, Artificial Sequence
  chemically treated genomic DNA (Homo sapiens) CpG-island No: 21864
acgccccgaacctaaccccataccccaaactccccgcgtcttcctcgaaacgctaaccccgtcccaatccccgcccccgaccgcgccgcccttcttaacttacgccctaatccccaccaaccccgcccgaacccccacgaaccctacccgacccgacgaaaataacccgaccaaaatcacacacgacccctacccgctccgctacgaccatctccgcttccgcttccgcttccgccgaaacttctttccgactcaaacacgactctataccgtaactttcgaccccaccgccaaaccgctacccgctctaaacgtaaactaaatctcgaaacatcgctcgcgacgaacgcgaaacgaaaaaaaaaaaaaaaaaaccgaacttctcaaaacgccgattcgaatcccgcaaacgacgaacgcgaaacctacccctaaccgaacgaaaacgatactcgcaaaatcaaacccgaacttacgaataaaacttacgaaaacgaaaccgaaaacgaaaccgaaaccgcaactcccaaccgataccacctcccctccactaaaaaattccaccgatcc

SEQ ID NO: 21865 - DNA, 962 bp, Artificial Sequence
  chemically treated genomic DNA (Homo sapiens) CpG-island No: 21865
taggcgcgttttatcgggcgggggcgcggttcgggagcggagcggtcggtagggggtttttcgcgtcggttttcgcgggaggaagcgttggtagttgttcggacgggttaaaggaggaaaagggaaaattattgggtttcggggcgggaaggattgcgtgattgggaggaaggtattttagattgtcgagtagggtcgttcgcgtcgggattttattttcggggtagtgcgggttattcgggatttgggaattcgggttattttttatcgtcgttagggtttttttcgtcggtgtcgtaggttggagcgggcgtcgcggtcgggggcggtgcgtttaggggcgcgaagggcgggtcggggcggggcgtcgttcgttcggtttcgggaggcggtgtgggcgggcgttggcgcgtttcgggagtgagtcgcggggcgcgtagtttttttgatgtgttattagtacgtggagttaggtcgggtcgcggcgagtaagtcgatttttttaattttcgaggggtttcgtcgtttcgtttttttttcggtttcgtcgggttcgtttttttagcggagggggcggcggcggtttttaggtttcgggtaggtcgagcgagttacggttttcggttaggagttcgaggggttttcggaacgttcgggcgcgggtttcggttagcggttatggttttcgtgtttaggtagcggtgcgggttcggttttgcgggagggtgcggtttgttgcgagaggtcggttacggtttttgtttcgcgtttcgcgtttttcgttcgtcgagttgagcgtaggtaatcgaggtagagcggagttgggtttcgtaggcgcggcgtgggagcgtggcgaagtttttcggcgtataatttttgcgttttattcgggagtggggttgcggtggggaggttttggttttcgtattttttttttttttagcgttgtttttcggtttgag

SEQ ID NO: 21866 - DNA, 962 bp, Artificial Sequence
  chemically treated genomic DNA (Homo sapiens) CpG-island No: 21866
ctcaaaccgaaaaacaacgctaaaaaaaaaaaaaatacgaaaaccaaaacctccccaccgcaaccccactcccgaataaaacgcaaaaattatacgccgaaaaacttcgccacgctcccacgccgcgcctacgaaacccaactccgctctacctcgattacctacgctcaactcgacgaacgaaaaacgcgaaacgcgaaacaaaaaccgtaaccgacctctcgcaacaaaccgcaccctcccgcaaaaccgaacccgcaccgctacctaaacacgaaaaccataaccgctaaccgaaacccgcgcccgaacgttccgaaaacccctcgaactcctaaccgaaaaccgtaactcgctcgacctacccgaaacctaaaaaccgccgccgccccctccgctaaaaaaacgaacccgacgaaaccgaaaaaaaaacgaaacgacgaaacccctcgaaaattaaaaaaatcgacttactcgccgcgacccgacctaactccacgtactaataacacatcaaaaaaactacgcgccccgcgactcactcccgaaacgcgccaacgcccgcccacaccgcctcccgaaaccgaacgaacgacgccccgccccgacccgcccttcgcgcccctaaacgcaccgcccccgaccgcgacgcccgctccaacctacgacaccgacgaaaaaaaccctaacgacgataaaaaataacccgaattcccaaatcccgaataacccgcactaccccgaaaataaaatcccgacgcgaacgaccctactcgacaatctaaaataccttcctcccaatcacgcaatccttcccgccccgaaacccaataattttcccttttcctcctttaacccgtccgaacaactaccaacgcttcctcccgcgaaaaccgacgcgaaaaaccccctaccgaccgctccgctcccgaaccgcgcccccgcccgataaaacgcgccta

SEQ ID NO: 21867 - DNA, 962 bp, Artificial Sequence
  chemically treated genomic DNA (Homo sapiens) CpG-island No: 21867
tttaggtcgagggatagcgttgggggagggggaggtgcggggattaaagtttttttatcgtagttttattttcgagtggggcgtaagagttatgcgtcgagaaatttcgttacgtttttacgtcgcgtttgcgaggtttagtttcgttttgtttcggttatttgcgtttagttcggcgggcgaggggcgcggggcgcggggtaggagtcgtggtcgatttttcgtagtaggtcgtattttttcgtaaggtcgagttcgtatcgttgtttgggtacgggggttatagtcgttagtcggggttcgcgttcgaacgtttcgggagtttttcgaatttttggtcgggggtcgtggttcgttcgatttgttcgggatttgggggtcgtcgtcgtttttttcgttaggagagcgagttcgacgaagtcgggagaggagcggggcggcgagatttttcgaaagttgggggggtcggtttgttcgtcgcggttcgatttggttttacgtgttggtgatatattaggaaggttgcgcgtttcgcggtttattttcggaacgcgttagcgttcgtttatatcgtttttcggagtcgagcggacggcgtttcgtttcggttcgtttttcgcgtttttaggcgtatcgttttcggtcgcgacgttcgttttagtttgcggtatcggcgggagagattttgacggcggtggggggtggttcgggtttttaggtttcgggtggttcgtattgtttcggggatggggtttcgacgcgggcggttttattcgatagtttggagtgttttttttttagttacgtagtttttttcgtttcggagtttagtaatttttttttttttttttttgattcgttcgagtagttgttagcgttttttttcgcggagatcggcgcggggagttttttgtcggtcgtttcgttttcgggtcgcgttttcgttcggtggagcgcgtttg

SEQ ID NO: 21868 - DNA, 962 bp, Artificial Sequence
  chemically treated genomic DNA (Homo sapiens) CpG-island No: 21868
caaacgcgctccaccgaacgaaaacgcgacccgaaaacgaaacgaccgacaaaaaactccccgcgccgatctccgcgaaaaaaaacgctaacaactactcgaacgaatcaaaaaaaaaaaaaaaaaaattactaaactccgaaacgaaaaaaactacgtaactaaaaaaaaaacactccaaactatcgaataaaaccgcccgcgtcgaaaccccatccccgaaacaatacgaaccacccgaaacctaaaaacccgaaccaccccccaccgccgtcaaaatctctcccgccgataccgcaaactaaaacgaacgtcgcgaccgaaaacgatacgcctaaaaacgcgaaaaacgaaccgaaacgaaacgccgtccgctcgactccgaaaaacgatataaacgaacgctaacgcgttccgaaaataaaccgcgaaacgcgcaaccttcctaatatatcaccaacacgtaaaaccaaatcgaaccgcgacgaacaaaccgacccccccaactttcgaaaaatctcgccgccccgctcctctcccgacttcgtcgaactcgctctcctaacgaaaaaaacgacgacgacccccaaatcccgaacaaatcgaacgaaccacgacccccgaccaaaaattcgaaaaactcccgaaacgttcgaacgcgaaccccgactaacgactataacccccgtacccaaacaacgatacgaactcgaccttacgaaaaaatacgacctactacgaaaaatcgaccacgactcctaccccgcgccccgcgcccctcgcccgccgaactaaacgcaaataaccgaaacaaaacgaaactaaacctcgcaaacgcgacgtaaaaacgtaacgaaatttctcgacgcataactcttacgccccactcgaaaataaaactacgataaaaaaactttaatccccgcacctccccctcccccaacgctatccctcgacctaaa

SEQ ID NO: 21869 - DNA, 604 bp, Artificial Sequence
  chemically treated genomic DNA (Homo sapiens) CpG-island No: 21869
tcgtcgagcgtcgtgtaatttttggagggttgggtttggagttcgcgattcgaggtcgggcggggcggtggattttttcggggaacgtcgtttgagggatatttagagtttcggcggagcggagcgcggtgtatagagtcggcgatcggatttagtttcgggaagttcgtcggggacgtatttcgaatttcgaggatgggagttgagggttgggtttttgcgggcgagatgagggtgtcggattaattggtttataaagttttagttttcggttttcgggattagcgtttttttttcggttttcgttttaggtcggttttttttcgggttggcgtgcgtttcggttaggttgttttttaggtttacgttggagaaggagtggtgaggtgcgttcgtttcggttgcgtgcggtgattcgggaaattttcgtatttcgttggagaaatagcgacgttttcggaagtgtgagtcggttattgtttggggttcgtattttttgggtagacgtggatcgcgtttcggcgatttgggttgagtggatagacgggattcggtttatttatgggttaagttttgttatttatcgaggtttgttttgttgtgt

SEQ ID NO: 21870 - DNA, 604 bp, Artificial Sequence
  chemically treated genomic DNA (Homo sapiens) CpG-island No: 21870
acacaacaaaacaaacctcgataaataacaaaacttaacccataaataaaccgaatcccgtctatccactcaacccaaatcgccgaaacgcgatccacgtctacccaaaaaatacgaaccccaaacaataaccgactcacacttccgaaaacgtcgctatttctccaacgaaatacgaaaatttcccgaatcaccgcacgcaaccgaaacgaacgcacctcaccactccttctccaacgtaaacctaaaaaacaacctaaccgaaacgcacgccaacccgaaaaaaaaccgacctaaaacgaaaaccgaaaaaaaaacgctaatcccgaaaaccgaaaactaaaactttataaaccaattaatccgacaccctcatctcgcccgcaaaaacccaaccctcaactcccatcctcgaaattcgaaatacgtccccgacgaacttcccgaaactaaatccgatcgccgactctatacaccgcgctccgctccgccgaaactctaaatatccctcaaacgacgttccccgaaaaaatccaccgccccgcccgacctcgaatcgcgaactccaaacccaaccctccaaaaattacacgacgctcgacga

SEQ ID NO: 21871 - DNA, 604 bp, Artificial Sequence
  chemically treated genomic DNA (Homo sapiens) CpG-island No: 21871
gtatagtagggtaggtttcggtaagtggtagggtttggtttatgggtaagtcgggtttcgtttgtttatttaatttaggtcgtcggggcgcggtttacgtttgtttaaagggtacggattttaagtagtgatcgatttatattttcgagagcgtcgttatttttttagcgaagtgcggggatttttcgaattatcgtacgtagtcggggcgagcgtattttattattttttttttagcgtggatttgagaggtagtttggtcggagcgtacgttagttcgggaggaagtcggtttggggcgaggatcggggagaagacgttggtttcgggggtcgagaattgggattttgtaggttagttgattcgatatttttatttcgttcgtaaagatttagtttttagtttttattttcggagttcggggtgcgttttcgacgggtttttcggggttgggttcggtcgtcggttttgtgtatcgcgtttcgtttcgtcgaagttttgggtgttttttaggcggcgtttttcgggaaagtttatcgtttcgttcgatttcgggtcgcgggttttaaatttagttttttaagggttatacgacgttcggcgg

SEQ ID NO: 21872 - DNA, 604 bp, Artificial Sequence
  chemically treated genomic DNA (Homo sapiens) CpG-island No: 21872
ccgccgaacgtcgtataacccttaaaaaactaaatttaaaacccgcgacccgaaatcgaacgaaacgataaactttcccgaaaaacgccgcctaaaaaacacccaaaacttcgacgaaacgaaacgcgatacacaaaaccgacgaccgaacccaaccccgaaaaacccgtcgaaaacgcaccccgaactccgaaaataaaaactaaaaactaaatctttacgaacgaaataaaaatatcgaatcaactaacctacaaaatcccaattctcgacccccgaaaccaacgtcttctccccgatcctcgccccaaaccgacttcctcccgaactaacgtacgctccgaccaaactacctctcaaatccacgctaaaaaaaaaataataaaatacgctcgccccgactacgtacgataattcgaaaaatccccgcacttcgctaaaaaaataacgacgctctcgaaaatataaatcgatcactacttaaaatccgtaccctttaaacaaacgtaaaccgcgccccgacgacctaaattaaataaacaaacgaaacccgacttacccataaaccaaaccctaccacttaccgaaacctaccctactatac

SEQ ID NO: 21873 - DNA, 504 bp, Artificial Sequence
  chemically treated genomic DNA (Homo sapiens) CpG-island No: 21873
atatgcgcggatcgaatgaatttcggtatcgcgttgtttgcggtttagtttttggtttttgttgtcgcgcgtggggcggtaggggttggggggtggggtcggggtcgggttgagcgcgttgggcgggaggcgtcgtaggtgggcgcggttaggtgagtttcgggggcgtcgttcgttttgttcgggattttggtcggcgttggttgttggcgttttttcgttttcgttgtcgttagtggttgttgtcgtttcgtggagtttaaggagatcgcggttagagcgtttatcgtttaagatggtggtttttgtgttttcgtgagtgcgagcggacggggcgggggcgttaggtcgggttggacgttttttttcggagcgggcgggacgggcgggcggaggtttagtgtttttgcgggatttatcgagggttttgttatcgcgcgttttttagaggaagttttttagtttttttcgttttagttttcgggaggatgcgtgagaagaggt

SEQ ID NO: 21874 - DNA, 504 bp, Artificial Sequence
  chemically treated genomic DNA (Homo sapiens) CpG-island No: 21874
acctcttctcacgcatcctcccgaaaactaaaacgaaaaaaactaaaaaacttcctctaaaaaacgcgcgataacaaaaccctcgataaatcccgcaaaaacactaaacctccgcccgcccgtcccgcccgctccgaaaaaaaacgtccaacccgacctaacgcccccgccccgtccgctcgcactcacgaaaacacaaaaaccaccatcttaaacgataaacgctctaaccgcgatctccttaaactccacgaaacgacaacaaccactaacgacaacgaaaacgaaaaaacgccaacaaccaacgccgaccaaaatcccgaacaaaacgaacgacgcccccgaaactcacctaaccgcgcccacctacgacgcctcccgcccaacgcgctcaacccgaccccgaccccaccccccaacccctaccgccccacgcgcgacaacaaaaaccaaaaactaaaccgcaaacaacgcgataccgaaattcattcgatccgcgcatat

SEQ ID NO: 21875 - DNA, 504 bp, Artificial Sequence
  chemically treated genomic DNA (Homo sapiens) CpG-island No: 21875
atttttttttacgtattttttcgggggttgggacggggagggttgaggaattttttttggggggcgcgcggtgatagagttttcggtgggtttcgtagaggtattgagttttcgttcgttcgtttcgttcgtttcgggagggggcgtttagttcggtttggcgttttcgtttcgttcgttcgtatttacggagatataggagttattattttgggcggtggacgttttggtcgcggtttttttgggttttacggagcgatagtagttattagcggtaacgggggcgaagaggcgttagtagttagcgtcggttagggtttcgggtagggcgggcggcgttttcggggtttatttggtcgcgtttatttgcggcgtttttcgtttagcgcgtttagttcggtttcggttttattttttagtttttgtcgttttacgcgcggtagtaggagttagaggttagatcgtaggtagcgcggtgtcggggtttattcggttcgcgtatgt

SEQ ID NO: 21876 - DNA, 504 bp, Artificial Sequence
  chemically treated genomic DNA (Homo sapiens) CpG-island No: 21876
acatacgcgaaccgaataaaccccgacaccgcgctacctacgatctaacctctaactcctactaccgcgcgtaaaacgacaaaaactaaaaaataaaaccgaaaccgaactaaacgcgctaaacgaaaaacgccgcaaataaacgcgaccaaataaaccccgaaaacgccgcccgccctacccgaaaccctaaccgacgctaactactaacgcctcttcgcccccgttaccgctaataactactatcgctccgtaaaacccaaaaaaaccgcgaccaaaacgtccaccgcccaaaataataactcctatatctccgtaaatacgaacgaacgaaacgaaaacgccaaaccgaactaaacgccccctcccgaaacgaacgaaacgaacgaacgaaaactcaatacctctacgaaacccaccgaaaactctatcaccgcgcgccccccaaaaaaaattcctcaaccctccccgtcccaacccccgaaaaaatacgtaaaaaaaaat

SEQ ID NO: 21877 - DNA, 559 bp, Artificial Sequence
  chemically treated genomic DNA (Homo sapiens) CpG-island No: 21877
atcgcggcgtggagttgttcggttatttcgaggttgcggttcggggtttggagtggtttcggggattttttttggattttatgcggaagggtttataggatttttatttcgggttttcgttggacgtcgtggtcgttttcgtagcgattttcgattttcgacgttattcgtaggcgtcggaggagttgggtacgtatggcgagggggcgttgcgggtgttgttgcgcggttttgtttttgtcgtggtgcgttagcgggcgttgggcgatttcgcgttgtttaagcgcgtagtattcggttttgggcggttcggttcgcgggttttgtgtatttagttggcgtgcgcgtattcggagttgtacgagttttttttcgatttcgtcgttttagtcgttttggttttggcgttgttcgcgggcgttggtttgttggataaggtcggtcgtagtcgggagttgcggtggtgggggtagagtggggtcggggaaggtcgggggggttatatggtgaagatcgtagtggatgggttttcgttgtacgagtttgatttcgggttggt

SEQ ID NO: 21878 - DNA, 559 bp, Artificial Sequence
  chemically treated genomic DNA (Homo sapiens) CpG-island No: 21878
accaacccgaaatcaaactcgtacaacgaaaacccatccactacgatcttcaccatataacccccccgaccttccccgaccccactctacccccaccaccgcaactcccgactacgaccgaccttatccaacaaaccaacgcccgcgaacaacgccaaaaccaaaacgactaaaacgacgaaatcgaaaaaaaactcgtacaactccgaatacgcgcacgccaactaaatacacaaaacccgcgaaccgaaccgcccaaaaccgaatactacgcgcttaaacaacgcgaaatcgcccaacgcccgctaacgcaccacgacaaaaacaaaaccgcgcaacaacacccgcaacgccccctcgccatacgtacccaactcctccgacgcctacgaataacgtcgaaaatcgaaaatcgctacgaaaacgaccacgacgtccaacgaaaacccgaaataaaaatcctataaacccttccgcataaaatccaaaaaaaatccccgaaaccactccaaaccccgaaccgcaacctcgaaataaccgaacaactccacgccgcgat

SEQ ID NO: 21879 - DNA, 559 bp, Artificial Sequence
  chemically treated genomic DNA (Homo sapiens) CpG-island No: 21879
gttaattcgaagttaaattcgtgtagcgggggtttatttattgcgatttttattatgtggttttttcggtttttttcggttttattttgtttttattatcgtagttttcggttgcggtcgattttgtttagtaggttagcgttcgcgggtagcgttaaagttaaggcggttagggcggcgaagtcggggaagagttcgtgtagtttcgagtgcgcgtacgttagttgggtgtatagggttcgcgggtcgagtcgtttaaggtcgaatattacgcgtttaaatagcgcgaagtcgtttagcgttcgttggcgtattacggtaggagtaaagtcgcgtagtagtattcgtagcgttttttcgttatgcgtgtttagttttttcggcgtttgcgggtagcgtcgggggtcgaagatcgttgcgaaggcggttacggcgtttagcgaaggttcggggtaggagttttgtaggttttttcgtatggagtttaggaaggattttcggagttattttaagtttcggatcgtagtttcggagtaatcgagtagttttacgtcgcggt

SEQ ID NO: 21880 - DNA, 559 bp, Artificial Sequence
  chemically treated genomic DNA (Homo sapiens) CpG-island No: 21880
accgcgacgtaaaactactcgattactccgaaactacgatccgaaacttaaaataactccgaaaatccttcctaaactccatacgaaaaaacctacaaaactcctaccccgaaccttcgctaaacgccgtaaccgccttcgcaacgatcttcgacccccgacgctacccgcaaacgccgaaaaaactaaacacgcataacgaaaaaacgctacgaatactactacgcgactttactcctaccgtaatacgccaacgaacgctaaacgacttcgcgctatttaaacgcgtaatattcgaccttaaacgactcgacccgcgaaccctatacacccaactaacgtacgcgcactcgaaactacacgaactcttccccgacttcgccgccctaaccgccttaactttaacgctacccgcgaacgctaacctactaaacaaaatcgaccgcaaccgaaaactacgataataaaaacaaaataaaaccgaaaaaaaccgaaaaaaccacataataaaaatcgcaataaataaacccccgctacacgaatttaacttcgaattaac

SEQ ID NO: 21881 - DNA, 635 bp, Artificial Sequence
  chemically treated genomic DNA (Homo sapiens) CpG-island No: 21881
cggggcgtgcgtgttcggcggtggcggggggtttgggcgtgcgttttttggttgtggaagggtcgttgggattggcgattttttgcggcgaggagggtagttggggcggattatttttggcggtgagggagtcgtcggggcgggcgttattagttatgtagggggttgtgggggcgggcgtttcgggtggtgacggggatggtttttgggttgggcgttttttcgcggtaaggaggtagtttggtcgtgcgttttcggaggtgagaggtttttcggggcgaatatttttagtggaggaaggggtttttcgggcggcgagagattggggggcggtagagggagtcgttagggcggtggagtgtcggggttagcgtatttcgttgacgtcggtgtagtgcgagtcgttgttcgtgaagttcgcggggtaggggtcgtagcgcgcgtcgtttttcgtttggatgtaggttacgtcggggaagtagaagtcgggcgcgtagtggagtaggggtcgtacgttgggtaggtcggtgcgtattgattgttgtatttttgcgggggggaggggggagaagcggcggggttgatcggtggttcgttcgggggtagagtttattatggttacgtttcggggttgg

SEQ ID NO: 21882 - DNA, 635 bp, Artificial Sequence
  chemically treated genomic DNA (Homo sapiens) CpG-island No: 21882
ccaaccccgaaacgtaaccataataaactctacccccgaacgaaccaccgatcaaccccgccgcttctcccccctcccccccgcaaaaatacaacaatcaatacgcaccgacctacccaacgtacgacccctactccactacgcgcccgacttctacttccccgacgtaacctacatccaaacgaaaaacgacgcgcgctacgacccctaccccgcgaacttcacgaacaacgactcgcactacaccgacgtcaacgaaatacgctaaccccgacactccaccgccctaacgactccctctaccgccccccaatctctcgccgcccgaaaaaccccttcctccactaaaaatattcgccccgaaaaacctctcacctccgaaaacgcacgaccaaactacctccttaccgcgaaaaaacgcccaacccaaaaaccatccccgtcaccacccgaaacgcccgcccccacaaccccctacataactaataacgcccgccccgacgactccctcaccgccaaaaataatccgccccaactaccctcctcgccgcaaaaaatcgccaatcccaacgacccttccacaaccaaaaaacgcacgcccaaaccccccgccaccgccgaacacgcacgccccg

SEQ ID NO: 21883 - DNA, 635 bp, Artificial Sequence
  chemically treated genomic DNA (Homo sapiens) CpG-island No: 21883
ttagtttcggggcgtggttatgataggttttgttttcgggcgagttatcgattagtttcgtcgttttttttttttttttttcgtagggatgtagtagttagtacgtatcggtttatttagcgtgcggtttttgttttattgcgcgttcggtttttgttttttcggcgtggtttgtatttagacggagagcggcgcgcgttgcggtttttgtttcgcgggttttacgggtaacggttcgtattgtatcgacgttaacgaggtgcgttagtttcgatattttatcgttttgacgattttttttatcgttttttaatttttcgtcgttcgggagatttttttttttattgggagtgttcgtttcgaagagttttttattttcgggggcgtacggttagattatttttttatcgcggggggacgtttaatttaaggattattttcgttattattcgggacgttcgtttttataattttttatatagttagtgacgttcgtttcgacgatttttttatcgttaggggtggttcgttttagttatttttttcgtcgtaggggatcgttagttttaacgatttttttatagttagggaacgtacgtttagatttttcgttatcgtcgggtacgtacgtttcg

SEQ ID NO: 21884 - DNA, 635 bp, Artificial Sequence
  chemically treated genomic DNA (Homo sapiens) CpG-island No: 21884
cgaaacgtacgtacccgacgataacgaaaaatctaaacgtacgttccctaactataaaaaaatcgttaaaactaacgatcccctacgacgaaaaaaataactaaaacgaaccacccctaacgataaaaaaatcgtcgaaacgaacgtcactaactatataaaaaattataaaaacgaacgtcccgaataataacgaaaataatccttaaattaaacgtccccccgcgataaaaaaataatctaaccgtacgcccccgaaaataaaaaactcttcgaaacgaacactcccaataaaaaaaaaaatctcccgaacgacgaaaaattaaaaaacgataaaaaaaatcgtcaaaacgataaaatatcgaaactaacgcacctcgttaacgtcgatacaatacgaaccgttacccgtaaaacccgcgaaacaaaaaccgcaacgcgcgccgctctccgtctaaatacaaaccacgccgaaaaaacaaaaaccgaacgcgcaataaaacaaaaaccgcacgctaaataaaccgatacgtactaactactacatccctacgaaaaaaaaaaaaaaaaaacgacgaaactaatcgataactcgcccgaaaacaaaacctatcataaccacgccccgaaactaa

SEQ ID NO: 21885 - DNA, 690 bp, Artificial Sequence
  chemically treated genomic DNA (Homo sapiens) CpG-island No: 21885
gtcgtgtgtttcgtaggtgagggcgtttcgagggttgcgtcgggggcgtttttttttgtttttcggtcgtttaggtggcgttcgcgtttttttttttcgcggttgttttcggggcgttcgttttttgttttggtaggggggaaggagtggggcgtcgggtatttacgggtttttgattcggttcgcggcgtttcgaggacgtagagtagtagtagtaggggtagtaacggcggcggtcgtcgcgcggattgggcggcggggtttcggcggtcggcgggtatggggtcggcgttgtcgggggcgcgcggcgggttgcggttcggcggcggtggcgtagggcgcgggacgtaggtcgggcgcgggagggcgcgggttaggtcgttcgtacgtcgttgggcgcggacgcggaggtcggagtaagtttgagtagtcgaattgataaggcgttaatgcgtcgttggtttcgttcggtttcgttttcggttcggttcggtttcgggggggcggcgggtttcgtatcggttttttcgtcgttcgttcgttcgcgggtatcgcgcgtttcgttcgtttcgttttcgttttatcgagaatcgcgcgcgttttatttcgcggtttaaagttttttaatttaatttttatcggtttaggatttttttttttaattttgttagttttaggttttttattttt

SEQ ID NO: 21886 - DNA, 690 bp, Artificial Sequence
  chemically treated genomic DNA (Homo sapiens) CpG-island No: 21886
aaaaataaaaaacctaaaactaacaaaattaaaaaaaaaaatcctaaaccgataaaaattaaattaaaaaactttaaaccgcgaaataaaacgcgcgcgattctcgataaaacgaaaacgaaacgaacgaaacgcgcgatacccgcgaacgaacgaacgacgaaaaaaccgatacgaaacccgccgcccccccgaaaccgaaccgaaccgaaaacgaaaccgaacgaaaccaacgacgcattaacgccttatcaattcgactactcaaacttactccgacctccgcgtccgcgcccaacgacgtacgaacgacctaacccgcgccctcccgcgcccgacctacgtcccgcgccctacgccaccgccgccgaaccgcaacccgccgcgcgcccccgacaacgccgaccccatacccgccgaccgccgaaaccccgccgcccaatccgcgcgacgaccgccgccgttactacccctactactactactctacgtcctcgaaacgccgcgaaccgaatcaaaaacccgtaaatacccgacgccccactccttcccccctaccaaaacaaaaaacgaacgccccgaaaacaaccgcgaaaaaaaaaaacgcgaacgccacctaaacgaccgaaaaacaaaaaaaaacgcccccgacgcaaccctcgaaacgccctcacctacgaaacacacgac

SEQ ID NO: 21887 - DNA, 690 bp, Artificial Sequence
  chemically treated genomic DNA (Homo sapiens) CpG-island No: 21887
gggggtgggaagtttggagttggtagggttggagagggaggttttgggtcggtaggggttgagttagggggttttgggtcgcgggatagggcgcgcgcggttttcggtggggcggaggcgggacgggcggggcgcgcggtgttcgcgggcgggcgggcggcggggaggtcggtgcggggttcgtcgttttttcggggtcgggtcgggtcgggggcggggtcgggcggggttagcggcgtattagcgttttgttaattcggttgtttagatttgtttcggttttcgcgttcgcgtttagcgacgtgcgggcggtttggttcgcgttttttcgcgttcggtttgcgtttcgcgttttgcgttatcgtcgtcgagtcgtagttcgtcgcgcgttttcggtagcgtcggttttatgttcgtcggtcgtcggggtttcgtcgtttaattcgcgcggcggtcgtcgtcgttgttgtttttgttgttgttgttttgcgttttcggggcgtcgcgagtcggattaggagttcgtgagtattcggcgttttatttttttttttttgttagagtagagggcgggcgtttcgggggtagtcgcggggggagggggcgcgggcgttatttggacggtcggggaataaaggaaggcgttttcggcgtagttttcggggcgtttttatttgcggggtatacggt

SEQ ID NO: 21888 - DNA, 690 bp, Artificial Sequence
  chemically treated genomic DNA (Homo sapiens) CpG-island No: 21888
accgtataccccgcaaataaaaacgccccgaaaactacgccgaaaacgccttcctttattccccgaccgtccaaataacgcccgcgccccctccccccgcgactacccccgaaacgcccgccctctactctaacaaaaaaaaaaaaataaaacgccgaatactcacgaactcctaatccgactcgcgacgccccgaaaacgcaaaacaacaacaacaaaaacaacaacgacgacgaccgccgcgcgaattaaacgacgaaaccccgacgaccgacgaacataaaaccgacgctaccgaaaacgcgcgacgaactacgactcgacgacgataacgcaaaacgcgaaacgcaaaccgaacgcgaaaaaacgcgaaccaaaccgcccgcacgtcgctaaacgcgaacgcgaaaaccgaaacaaatctaaacaaccgaattaacaaaacgctaatacgccgctaaccccgcccgaccccgcccccgacccgacccgaccccgaaaaaacgacgaaccccgcaccgacctccccgccgcccgcccgcccgcgaacaccgcgcgccccgcccgtcccgcctccgccccaccgaaaaccgcgcgcgccctatcccgcgacccaaaaccccctaactcaacccctaccgacccaaaacctccctctccaaccctaccaactccaaacttcccaccccc

SEQ ID NO: 21889 - DNA, 516 bp, Artificial Sequence
  chemically treated genomic DNA (Homo sapiens) CpG-island No: 21889
ggggtcgcgatgtatttgtttcgttcgattcgtacgtttcgggtgtcgtagcgtagttatttcgttcgtttttcgtattttttatttttcgttttttaggttgtttcgttcgggtgacgttagcgtttcggttttcgtcgtagtcgttgtatttttcgtgttcggtttgagttggagtttttcgcgtttttcgcgtttcgttcggttatggttgcggtggcgttgatgttatcgtcgttgttgttgttgttgttgttggcgtcgtcgttcgtcgttttcgcgtcgttcgttcgcgattttttcgttttttagttcggggatacgtagaattgttagttgcggtgtcgcgatcgcgatttcggttcgtagttttcgtaggtgaggcgcgtgcggtgttaggtgttagcgggggacgcgggattttttcgaaggaggaggcgttgggatgggttttttttggatgatagtaggagattttggtgggggtgttcgtggggaggtgggggtcgggaatgg

SEQ ID NO: 21890 - DNA, 516 bp, Artificial Sequence
  chemically treated genomic DNA (Homo sapiens) CpG-island No: 21890
ccattcccgacccccacctccccacgaacacccccaccaaaatctcctactatcatccaaaaaaaacccatcccaacgcctcctccttcgaaaaaatcccgcgtcccccgctaacacctaacaccgcacgcgcctcacctacgaaaactacgaaccgaaatcgcgatcgcgacaccgcaactaacaattctacgtatccccgaactaaaaaacgaaaaaatcgcgaacgaacgacgcgaaaacgacgaacgacgacgccaacaacaacaacaacaacaacgacgataacatcaacgccaccgcaaccataaccgaacgaaacgcgaaaaacgcgaaaaactccaactcaaaccgaacacgaaaaatacaacgactacgacgaaaaccgaaacgctaacgtcacccgaacgaaacaacctaaaaaacgaaaaataaaaaatacgaaaaacgaacgaaataactacgctacgacacccgaaacgtacgaatcgaacgaaacaaatacatcgcgacccc

SEQ ID NO: 21891 - DNA, 516 bp, Artificial Sequence
  chemically treated genomic DNA (Homo sapiens) CpG-island No: 21891
ttattttcgatttttatttttttacggatatttttattaaagttttttgttgttatttaagagaagtttattttaacgttttttttttcggagagatttcgcgtttttcgttggtatttggtatcgtacgcgttttatttgcgagggttgcgggtcgaggtcgcggtcgcggtatcgtagttggtagttttgcgtgttttcgagttggggggcgaagggatcgcgggcggacggcgcggaggcggcgggcggcgacgttaatagtagtagtagtagtagcggcggtggtattagcgttatcgtagttatggtcgggcggaacgcggggggcgcgggggattttagtttaggtcgggtacggaggatgtagcggttgcggcggggatcggggcgttgacgttattcgagcgaggtagtttgggaagcggggggtgggagatgcggagagcgggcggggtagttgcgttgcggtattcgaggcgtgcgggtcgggcggggtaggtgtatcgcggtttt

SEQ ID NO: 21892 - DNA, 516 bp, Artificial Sequence
  chemically treated genomic DNA (Homo sapiens) CpG-island No: 21892
aaaaccgcgatacacctaccccgcccgacccgcacgcctcgaataccgcaacgcaactaccccgcccgctctccgcatctcccaccccccgcttcccaaactacctcgctcgaataacgtcaacgccccgatccccgccgcaaccgctacatcctccgtacccgacctaaactaaaatcccccgcgccccccgcgttccgcccgaccataactacgataacgctaataccaccgccgctactactactactactattaacgtcgccgcccgccgcctccgcgccgtccgcccgcgatcccttcgccccccaactcgaaaacacgcaaaactaccaactacgataccgcgaccgcgacctcgacccgcaaccctcgcaaataaaacgcgtacgataccaaataccaacgaaaaacgcgaaatctctccgaaaaaaaaaacgttaaaataaacttctcttaaataacaacaaaaaactttaataaaaatatccgtaaaaaaataaaaatcgaaaataa

SEQ ID NO: 21893 - DNA, 534 bp, Artificial Sequence
  chemically treated genomic DNA (Homo sapiens) CpG-island No: 21893
atttcggggatcgtcgtcgttgtagttatcggttcgtttacgttcgttttttgtagtcgttattgtcgttttatatttttttcgttcgtcgggggttttgtttcgtgaggttagcgattaacggtcgtcgcgtattcgttttttaatagttaatcgtcggcggggtcgcgatattttatatatcgttgagttggaaagggacgcgttatttaagtttcgcggcgttcgtatttttattagtttttgcgtaggttacgtttttttcgacgtcgtaggcggagaagtcggaggtaggagattataaagcgtaggagtagatgttttcgtcgtttcgttcgttttaggtttcgtttatttgttggtttgcgtttagaaagtcgggaggagtttagtgatttttagtatttttttttatagtggatcgtttttcgtttttcgcgcgttgagttcgcgtaagggtttttgggagttgtagtttgttttttagaattcgttttttttttttttagttttttttagaatttatggttttgt

SEQ ID NO: 21894 - DNA, 534 bp, Artificial Sequence
  chemically treated genomic DNA (Homo sapiens) CpG-island No: 21894
acaaaaccataaattctaaaaaaaactaaaaaaaaaaaaaacgaattctaaaaaacaaactacaactcccaaaaacccttacgcgaactcaacgcgcgaaaaacgaaaaacgatccactataaaaaaaaatactaaaaatcactaaactcctcccgactttctaaacgcaaaccaacaaataaacgaaacctaaaacgaacgaaacgacgaaaacatctactcctacgctttataatctcctacctccgacttctccgcctacgacgtcgaaaaaaacgtaacctacgcaaaaactaataaaaatacgaacgccgcgaaacttaaataacgcgtccctttccaactcaacgatatataaaatatcgcgaccccgccgacgattaactattaaaaaacgaatacgcgacgaccgttaatcgctaacctcacgaaacaaaacccccgacgaacgaaaaaaatataaaacgacaataacgactacaaaaaacgaacgtaaacgaaccgataactacaacgacgacgatccccgaaat

SEQ ID NO: 21895 - DNA, 534 bp, Artificial Sequence
  chemically treated genomic DNA (Homo sapiens) CpG-island No: 21895
ataaaattatggattttaggagggattgggaaagagaaaaacgaattttggaaggtaaattataatttttaaaggtttttgcgcggatttagcgcgcgagggacgaagggcggtttattgtaaggggaaatgttgaggattattgggtttttttcggttttttgaacgtaagttagtaagtgggcgggatttggggcgggcggagcggcgagagtatttgtttttgcgttttgtggttttttgttttcggttttttcgtttgcgacgtcgaagggggcgtggtttgcgtagaggttggtgggggtgcgggcgtcgcgggatttgggtgacgcgtttttttttagtttagcggtgtgtgaggtgtcgcggtttcgtcggcgattggttgttgagaggcgagtacgcggcggtcgttggtcgttggttttacggagtaaggttttcggcgggcggggaggatatggggcggtagtggcggttgtaggaggcgggcgtggacgagtcggtggttgtagcggcggcggttttcggagt

SEQ ID NO: 21896 - DNA, 534 bp, Artificial Sequence
  chemically treated genomic DNA (Homo sapiens) CpG-island No: 21896
actccgaaaaccgccgccgctacaaccaccgactcgtccacgcccgcctcctacaaccgccactaccgccccatatcctccccgcccgccgaaaaccttactccgtaaaaccaacgaccaacgaccgccgcgtactcgcctctcaacaaccaatcgccgacgaaaccgcgacacctcacacaccgctaaactaaaaaaaaacgcgtcacccaaatcccgcgacgcccgcacccccaccaacctctacgcaaaccacgcccccttcgacgtcgcaaacgaaaaaaccgaaaacaaaaaaccacaaaacgcaaaaacaaatactctcgccgctccgcccgccccaaatcccgcccacttactaacttacgttcaaaaaaccgaaaaaaacccaataatcctcaacatttccccttacaataaaccgcccttcgtccctcgcgcgctaaatccgcgcaaaaacctttaaaaattataatttaccttccaaaattcgtttttctctttcccaatccctcctaaaatccataattttat

SEQ ID NO: 21897 - DNA, 889 bp, Artificial Sequence
  chemically treated genomic DNA (Homo sapiens) CpG-island No: 21897
attttcgcggtttttttttttgttgtttgtaggaaaatgtcgcggtcgtaatggcggcggatgtggagggggacgtgtacgtattggtggagtattttttcgagtatatcggtaaggacgggcgtcgcgtggttatttcgtttaatgagcgttatcggtcgttgcggcgtagtatagagtattgagtattggtggtacgtgcggcgtaagttcggcggtcgttttttttatttgttcgcgtagtacgtgcgcgagttgtttgcgttgggtaattttgtcgttgacgcgtcgttaggtttttttatcgggattcgtagtttttgagtcgttcgtttacgattatcggttcgtgagcgcggttgtggtagcggtttttaacggttttttagcggagtttcgaggcggggttagttttttgtgcggttttgcgtagcgcggcgtcgcgagttagcgtagtagtttggcgttcggtttgttcgtttgtttgtatttgcggtttacggcgttcgtgcggttcgcgtagtttttggacgatttgacgcgcgtcgtcgtttcgtttttcgtcggtaatttcggaagtagcggtagttttaaggtttgtagcgtagcgggtttttgggtgtgtttgttgtttttgtcgcgtagcgatttagagaacgtttaagaggttatttaggaggtacgcggttcgtcgcggtaggagatcgtgaagtaggtacgatttcgggcgcggaggcggggaggttcgttgaggatagcgttcgtagggagtttgggttcgaggagatttatttcgtttagcgtcgggtatgacgtttatttttgtcggaagatttcggatgagttttttttttttagtcgcgaaatagtgtaggtttttattttttat

SEQ ID NO: 21898 - DNA, 889 bp, Artificial Sequence
  chemically treated genomic DNA (Homo sapiens) CpG-island No: 21898
ataaaaaataaaaacctacactatttcgcgactaaaaaaaaaaaactcatccgaaatcttccgacaaaaataaacgtcatacccgacgctaaacgaaataaatctcctcgaacccaaactccctacgaacgctatcctcaacgaacctccccgcctccgcgcccgaaatcgtacctacttcacgatctcctaccgcgacgaaccgcgtacctcctaaataacctcttaaacgttctctaaatcgctacgcgacaaaaacaacaaacacacccaaaaacccgctacgctacaaaccttaaaactaccgctacttccgaaattaccgacgaaaaacgaaacgacgacgcgcgtcaaatcgtccaaaaactacgcgaaccgcacgaacgccgtaaaccgcaaatacaaacaaacgaacaaaccgaacgccaaactactacgctaactcgcgacgccgcgctacgcaaaaccgcacaaaaaactaaccccgcctcgaaactccgctaaaaaaccgttaaaaaccgctaccacaaccgcgctcacgaaccgataatcgtaaacgaacgactcaaaaactacgaatcccgataaaaaaacctaacgacgcgtcaacgacaaaattacccaacgcaaacaactcgcgcacgtactacgcgaacaaataaaaaaaacgaccgccgaacttacgccgcacgtaccaccaatactcaatactctatactacgccgcaacgaccgataacgctcattaaacgaaataaccacgcgacgcccgtccttaccgatatactcgaaaaaatactccaccaatacgtacacgtccccctccacatccgccgccattacgaccgcgacattttcctacaaacaacaaaaaaaaaaaccgcgaaaat

SEQ ID NO: 21899 - DNA, 889 bp, Artificial Sequence
  chemically treated genomic DNA (Homo sapiens) CpG-island No: 21899
atgagggatgggggtttgtattgtttcgcggttggggagagggagtttattcgaagtttttcgatagaggtgggcgttatgttcgacgttgagcggagtgggttttttcgagtttaggttttttgcgggcgttgtttttagcgagttttttcgttttcgcgttcggggtcgtatttgttttacgattttttatcgcggcgggtcgcgtattttttggatggttttttagacgttttttgagtcgttgcgcgataggggtagtaggtatatttaggagttcgttacgttgtaggttttgaagttgtcgttgttttcgaggttgtcggcgggaggcgagacgacggcgcgcgttaggtcgtttagggattgcgcgggtcgtacgggcgtcgtgggtcgtaggtataggtaggcgggtaggtcgggcgttaggttgttgcgttggttcgcggcgtcgcgttgcgtagggtcgtatagggagttggtttcgtttcggggtttcgttggggggtcgttgggggtcgttgttatagtcgcgtttacgaatcggtagtcgtaggcgagcggtttaggggttgcgggtttcgatggggggatttggcggcgcgttagcggtagggttgtttagcgtaggtagttcgcgtacgtattgcgcgggtaggtagaaggggcggtcgtcgggtttgcgtcgtacgtgttattaatgtttagtgttttgtgttgcgtcgtagcggtcggtagcgtttattgggcgggatggttacgcggcgttcgtttttgtcggtgtattcgaaggggtgttttattagtacgtatacgtttttttttatattcgtcgttattgcggtcgcggtatttttttgtaggtaataaggaagagggtcgcggaagt

SEQ ID NO: 21900 - DNA, 889 bp, Artificial Sequence
  chemically treated genomic DNA (Homo sapiens) CpG-island No: 21900
acttccgcgaccctcttccttattacctacaaaaaaataccgcgaccgcaataacgacgaatataaaaaaaaacgtatacgtactaataaaacaccccttcgaatacaccgacaaaaacgaacgccgcgtaaccatcccgcccaataaacgctaccgaccgctacgacgcaacacaaaacactaaacattaataacacgtacgacgcaaacccgacgaccgccccttctacctacccgcgcaatacgtacgcgaactacctacgctaaacaaccctaccgctaacgcgccgccaaatccccccatcgaaacccgcaacccctaaaccgctcgcctacgactaccgattcgtaaacgcgactataacaacgacccccaacgaccccccaacgaaaccccgaaacgaaaccaactccctatacgaccctacgcaacgcgacgccgcgaaccaacgcaacaacctaacgcccgacctacccgcctacctatacctacgacccacgacgcccgtacgacccgcgcaatccctaaacgacctaacgcgcgccgtcgtctcgcctcccgccgacaacctcgaaaacaacgacaacttcaaaacctacaacgtaacgaactcctaaatatacctactacccctatcgcgcaacgactcaaaaaacgtctaaaaaaccatccaaaaaatacgcgacccgccgcgataaaaaatcgtaaaacaaatacgaccccgaacgcgaaaacgaaaaaactcgctaaaaacaacgcccgcaaaaaacctaaactcgaaaaaacccactccgctcaacgtcgaacataacgcccacctctatcgaaaaacttcgaataaactccctctccccaaccgcgaaacaatacaaacccccatccctcat

SEQ ID NO: 21901 - DNA, 545 bp, Artificial Sequence
  chemically treated genomic DNA (Homo sapiens) CpG-island No: 21901
cgcgggtagcgcgtagtttttacgcggtttcgggtagagttcggcgcgcgggttcggggcggcgtagttttcgttcggttggtagttttcggcgttcgcgggcggcgggaaggattcgttcgcgtcggggaagtcggtcgtttggggtcgcggcgggtaggcgtaggttttaaggaagcggttcggcggggcgggtattaaggcgtttttcgggtagggagattttaggttgtcgttttcgcgacgttcgttcgcgttttgcgcgttcggtttcgggtagaagtagcggtgttgcgggtcggcgttaggcgttcggttttcgtcgtttttcggtatcggttcggtgttcgttagtatgttttcgtaattcggttttacgatgtttattcggggcgggttggtattttttcgtagtcgtcgaggattcgttttttcgcgcgcgagagggtcgcgtgggttgggatgggtagggagtagggggcgggggattcgagggtcgggtgggggattttatcggagttcgggttttgacgtttggtttttat

SEQ ID NO: 21902 - DNA, 545 bp, Artificial Sequence
  chemically treated genomic DNA (Homo sapiens) CpG-island No: 21902
ataaaaaccaaacgtcaaaacccgaactccgataaaatcccccacccgaccctcgaatcccccgccccctactccctacccatcccaacccacgcgaccctctcgcgcgcgaaaaaacgaatcctcgacgactacgaaaaaataccaacccgccccgaataaacatcgtaaaaccgaattacgaaaacatactaacgaacaccgaaccgataccgaaaaacgacgaaaaccgaacgcctaacgccgacccgcaacaccgctacttctacccgaaaccgaacgcgcaaaacgcgaacgaacgtcgcgaaaacgacaacctaaaatctccctacccgaaaaacgccttaatacccgccccgccgaaccgcttccttaaaacctacgcctacccgccgcgaccccaaacgaccgacttccccgacgcgaacgaatccttcccgccgcccgcgaacgccgaaaactaccaaccgaacgaaaactacgccgccccgaacccgcgcgccgaactctacccgaaaccgcgtaaaaactacgcgctacccgcg

SEQ ID NO: 21903 - DNA, 545 bp, Artificial Sequence
  chemically treated genomic DNA (Homo sapiens) CpG-island No: 21903
gtagaagttaggcgttagagttcgggtttcggtggggttttttattcggttttcgggtttttcgttttttgttttttgtttattttagtttacgcgattttttcgcgcgcggaggggcgggttttcgacggttacgggaaggtgttagttcgtttcggatgggtatcgtggagtcgggttgcggagatatgttgacgggtatcgagtcgatgtcggggagcgacgagggtcgggcgtttggcgtcgattcgtagtatcgttatttttattcggagtcgggcgcgtaggacgcggacgagcgtcgcgggggcggtagtttggggtttttttattcggggggcgttttggtgttcgtttcgtcgagtcgtttttttggagtttacgtttattcgtcgcgattttaggcggtcggttttttcggcgcgggcgagtttttttcgtcgttcgcggacgtcgagggttattagtcgggcgagggttacgtcgtttcggattcgcgcgtcgggttttattcggggtcgcgtgaggattacgcgttattcgcg

SEQ ID NO: 21904 - DNA, 545 bp, Artificial Sequence
  chemically treated genomic DNA (Homo sapiens) CpG-island No: 21904
cgcgaataacgcgtaatcctcacgcgaccccgaataaaacccgacgcgcgaatccgaaacgacgtaaccctcgcccgactaataaccctcgacgtccgcgaacgacgaaaaaaactcgcccgcgccgaaaaaaccgaccgcctaaaatcgcgacgaataaacgtaaactccaaaaaaacgactcgacgaaacgaacaccaaaacgccccccgaataaaaaaaccccaaactaccgcccccgcgacgctcgtccgcgtcctacgcgcccgactccgaataaaaataacgatactacgaatcgacgccaaacgcccgaccctcgtcgctccccgacatcgactcgatacccgtcaacatatctccgcaacccgactccacgatacccatccgaaacgaactaacaccttcccgtaaccgtcgaaaacccgcccctccgcgcgcgaaaaaatcgcgtaaactaaaataaacaaaaaacaaaaaacgaaaaacccgaaaaccgaataaaaaaccccaccgaaacccgaactctaacgcctaacttctac

SEQ ID NO: 21905 - DNA, 532 bp, Artificial Sequence
  chemically treated genomic DNA (Homo sapiens) CpG-island No: 21905
ggagacgtagtatttatcgaagtcgaatttttaagtacggtcgtcgttatcggattgtgagcggagcggggtcgggagcggcgggcgattcggggcgggaatttaggtacggttgttattagcgttagcgatttatcggttgatgcgtagcggggcgattttcgttttgtgtcggaggtagcgtttttaatttaggcggcgtgggtcgaggtagagaattattaaaattattatttcggagcggtgtcggaagtttcgttttatcgtatgtaataaacggagataggttcgtttttgaacgttgattggtttcgcgtttttgtagtttggcgttcggtattatgggtaatgtagtttttagaagtttagggtttcggtgttttttttgagatttattcggaataagggttaagcggttcgcggagggcgttaggaaaaggcgcgatattaagagcgagatagggatttgttgttttttaaaggggtcgttggtcgattttcgtagttttatatttattgaagggagtgtttg

SEQ ID NO: 21906 - DNA, 532 bp, Artificial Sequence
  chemically treated genomic DNA (Homo sapiens) CpG-island No: 21906
caaacactcccttcaataaatataaaactacgaaaatcgaccaacgacccctttaaaaaacaacaaatccctatctcgctcttaatatcgcgccttttcctaacgccctccgcgaaccgcttaacccttattccgaataaatctcaaaaaaaacaccgaaaccctaaacttctaaaaactacattacccataataccgaacgccaaactacaaaaacgcgaaaccaatcaacgttcaaaaacgaacctatctccgtttattacatacgataaaacgaaacttccgacaccgctccgaaataataattttaataattctctacctcgacccacgccgcctaaattaaaaacgctacctccgacacaaaacgaaaatcgccccgctacgcatcaaccgataaatcgctaacgctaataacaaccgtacctaaattcccgccccgaatcgcccgccgctcccgaccccgctccgctcacaatccgataacgacgaccgtacttaaaaattcgacttcgataaatactacgtctcc

SEQ ID NO: 21907 - DNA, 532 bp, Artificial Sequence
  chemically treated genomic DNA (Homo sapiens) CpG-island No: 21907
tagatattttttttagtgggtatgggattgcggaaatcggttagcggtttttttaaggagtagtaagtttttgtttcgtttttggtgtcgcgtttttttttagcgtttttcgcgggtcgtttagtttttgtttcgggtgaattttagggagggtatcggaattttgggtttttgagaattatattatttataatgtcgagcgttaagttgtaaagacgcggagttaattaacgtttaggaacggatttgttttcgtttgttgtatacggtaaggcgggattttcggtatcgtttcgagatggtaattttggtggttttttatttcggtttacgtcgtttgagttagaaacgttgttttcggtatagagcgggggtcgtttcgttgcgtattagtcggtgggtcgttggcgttggtggtagtcgtgtttgggttttcgtttcgggtcgttcgtcgttttcggtttcgtttcgtttataattcgatggcggcggtcgtgtttagggattcgatttcggtgagtgttgcgttttt

SEQ ID NO: 21908 - DNA, 532 bp, Artificial Sequence
  chemically treated genomic DNA (Homo sapiens) CpG-island No: 21908
aaaaacgcaacactcaccgaaatcgaatccctaaacacgaccgccgccatcgaattataaacgaaacgaaaccgaaaacgacgaacgacccgaaacgaaaacccaaacacgactaccaccaacgccaacgacccaccgactaatacgcaacgaaacgacccccgctctataccgaaaacaacgtttctaactcaaacgacgtaaaccgaaataaaaaaccaccaaaattaccatctcgaaacgataccgaaaatcccgccttaccgtatacaacaaacgaaaacaaatccgttcctaaacgttaattaactccgcgtctttacaacttaacgctcgacattataaataatataattctcaaaaacccaaaattccgataccctccctaaaattcacccgaaacaaaaactaaacgacccgcgaaaaacgctaaaaaaaaacgcgacaccaaaaacgaaacaaaaacttactactccttaaaaaaaccgctaaccgatttccgcaatcccatacccactaaaaaaaatatcta

SEQ ID NO: 21909 - DNA, 504 bp, Artificial Sequence
  chemically treated genomic DNA (Homo sapiens) CpG-island No: 21909
gaattttcggcgttttttttgtggcgggtattttggtttgtgttagttttattcgcgggtgtcggatttggatttaggtgttgatagcgagaaggcgcgaggagagtcgtttttttagttgtatagtcggggtttgacggtcgtcggcggtggtgatagttttgtttttgttttcgttcggatcgtttatcgttttcggttcgtttcgtttagagttcgatggcggcggtattgagggtttcgatttaggtgagcgttgcgttttttcggttttttttgttttttttattcgaaattgagggacgcgtgaagggttttttgtagttcggatcgtattgttcggtatagtgaggcgttggtgttggatttcgtttttggtagtgtggtagggagcgggagagcgatacggttagggggttgcgcgggtaatagtttggagttgcgtttgagtcgggaggttggggagatttaggtcggttttacgcgtgtaggtagtagagggtg

SEQ ID NO: 21910 - DNA, 504 bp, Artificial Sequence
  chemically treated genomic DNA (Homo sapiens) CpG-island No: 21910
caccctctactacctacacgcgtaaaaccgacctaaatctccccaacctcccgactcaaacgcaactccaaactattacccgcgcaaccccctaaccgtatcgctctcccgctccctaccacactaccaaaaacgaaatccaacaccaacgcctcactataccgaacaatacgatccgaactacaaaaaacccttcacgcgtccctcaatttcgaataaaaaaaacaaaaaaaaccgaaaaaacgcaacgctcacctaaatcgaaaccctcaataccgccgccatcgaactctaaacgaaacgaaccgaaaacgataaacgatccgaacgaaaacaaaaacaaaactatcaccaccgccgacgaccgtcaaaccccgactatacaactaaaaaaacgactctcctcgcgccttctcgctatcaacacctaaatccaaatccgacacccgcgaataaaactaacacaaaccaaaatacccgccacaaaaaaaacgccgaaaattc

SEQ ID NO: 21911 - DNA, 504 bp, Artificial Sequence
  chemically treated genomic DNA (Homo sapiens) CpG-island No: 21911
tattttttgttatttgtacgcgtgaggtcggtttgggtttttttagtttttcggtttaggcgtagttttaagttgttgttcgcgtagttttttgatcgtgtcgttttttcgttttttgttatattattagaaacgagatttagtattagcgttttattgtgtcggatagtgcggttcgggttgtagaaaattttttacgcgttttttagtttcgggtggggagggtagaggaggtcgggaggacgtagcgtttatttgggtcggggtttttagtgtcgtcgttatcggattttgggcggagcgggtcgggagcggtggacgattcgggcggagataagagtaaagttgttattatcgtcggcgatcgttaggtttcggttgtgtagttgagaaaacgatttttttcgcgttttttcgttgttagtatttaggtttagattcggtattcgcggatggaattgatataagttaaagtgttcgttatagggaggacgtcggaagttt

SEQ ID NO: 21912 - DNA, 504 bp, Artificial Sequence
  chemically treated genomic DNA (Homo sapiens) CpG-island No: 21912
aaacttccgacgtcctccctataacgaacactttaacttatatcaattccatccgcgaataccgaatctaaacctaaatactaacaacgaaaaaacgcgaaaaaaatcgttttctcaactacacaaccgaaacctaacgatcgccgacgataataacaactttactcttatctccgcccgaatcgtccaccgctcccgacccgctccgcccaaaatccgataacgacgacactaaaaaccccgacccaaataaacgctacgtcctcccgacctcctctaccctccccacccgaaactaaaaaacgcgtaaaaaattttctacaacccgaaccgcactatccgacacaataaaacgctaatactaaatctcgtttctaataatataacaaaaaacgaaaaaacgacacgatcaaaaaactacgcgaacaacaacttaaaactacgcctaaaccgaaaaactaaaaaaacccaaaccgacctcacgcgtacaaataacaaaaaata

SEQ ID NO: 21913 - DNA, 658 bp, Artificial Sequence
  chemically treated genomic DNA (Homo sapiens) CpG-island No: 21913
tgaggtttcgttatagcgtttttttttttttaatcggaggttcggcgtttcgtttttttaatttacggtttttttcgattttagtttattcggattttttagcgttttattttatcgtatcgttttcggggtcgcgttcgggtcgtcgttagtcgttttcgttttttatacgcgttcggagtttcgagtttttattcggtcgcgttttatcgtttcgggtttttcgagatcgtatacgtcgttcgttagtttttagggtttaggatgattacgtcgaatcgtttttcgtttttcggttttttttattcgagtacgcggttcggcgcgttttttatttttattttagatatatataggtatacgtatttaacgttattttacggtcgggatagattcgggagttttaattcggacgcggtttttatttgtttttttattcgtttatatcgcgttttttataatttcgtcgttttttcgtttttattcggggttttggttttttttcgtttttagtttttcgggttttttatcgggtttttcggttttgtttttagtttttttcggtcgtcgttttttttttcgttttcgtatttattatttagttattaggttatggattttttaattttggttttttttttttaattagttatttttt

SEQ ID NO: 21914 - DNA, 658 bp, Artificial Sequence
  chemically treated genomic DNA (Homo sapiens) CpG-island No: 21914
aaaaaataactaattaaaaaaaaaaaaccaaaattaaaaaatccataacctaataactaaataataaatacgaaaacgaaaaaaaaaacgacgaccgaaaaaaactaaaaacaaaaccgaaaaacccgataaaaaacccgaaaaactaaaaacgaaaaaaaaccaaaaccccgaataaaaacgaaaaaacgacgaaattataaaaaacgcgatataaacgaataaaaaaacaaataaaaaccgcgtccgaattaaaactcccgaatctatcccgaccgtaaaataacgttaaatacgtatacctatatatatctaaaataaaaataaaaaacgcgccgaaccgcgtactcgaataaaaaaaaccgaaaaacgaaaaacgattcgacgtaatcatcctaaaccctaaaaactaacgaacgacgtatacgatctcgaaaaacccgaaacgataaaacgcgaccgaataaaaactcgaaactccgaacgcgtataaaaaacgaaaacgactaacgacgacccgaacgcgaccccgaaaacgatacgataaaataaaacgctaaaaaatccgaataaactaaaatcgaaaaaaaccgtaaattaaaaaaacgaaacgccgaacctccgattaaaaaaaaaaaaacgctataacgaaacctca

SEQ ID NO: 21915 - DNA, 658 bp, Artificial Sequence
  chemically treated genomic DNA (Homo sapiens) CpG-island No: 21915
agagagtggttggttggggggaaggggttagagttgaggggtttatagtttagtaattgggtggtgagtacgggggcggaggggggggcggcggtcggagagggttaggaatagggtcggggggttcggtggggagttcgaaaagttggagacggggaggggttaaagtttcggatgggggcggagggacggcgaaattgtggggagcgcggtatgggcgggtgggggggtaggtgggggtcgcgttcgggttagagttttcgggtttgtttcggtcgtgaagtagcgttggatgcgtgtgtttgtgtgtgtttggggtgggggtgaggggcgcgtcgggtcgcgtgttcgagtagaaggggtcggagggcggggagcggttcggcgtggttattttggattttgggggttggcgggcggcgtgtgcggtttcggagggttcgaggcggtggagcgcggtcgggtaggaattcggggtttcgggcgcgtgtgaaggacgggggcggttggcggcggttcggacgcggtttcgggagcggtacggtggggtggggcgttgagggattcgagtagattggagtcgagagagatcgtgagttgggggggcggggcgtcgggttttcggttgggggaaggggagcgttatagcgaggtttta

SEQ ID NO: 21916 - DNA, 658 bp, Artificial Sequence
  chemically treated genomic DNA (Homo sapiens) CpG-island No: 21916
taaaacctcgctataacgctccccttcccccaaccgaaaacccgacgccccgcccccccaactcacgatctctctcgactccaatctactcgaatccctcaacgccccaccccaccgtaccgctcccgaaaccgcgtccgaaccgccgccaaccgcccccgtccttcacacgcgcccgaaaccccgaattcctacccgaccgcgctccaccgcctcgaaccctccgaaaccgcacacgccgcccgccaacccccaaaatccaaaataaccacgccgaaccgctccccgccctccgaccccttctactcgaacacgcgacccgacgcgcccctcacccccaccccaaacacacacaaacacacgcatccaacgctacttcacgaccgaaacaaacccgaaaactctaacccgaacgcgacccccacctacccccccacccgcccataccgcgctccccacaatttcgccgtccctccgcccccatccgaaactttaacccctccccgtctccaacttttcgaactccccaccgaaccccccgaccctattcctaaccctctccgaccgccgcccccccctccgcccccgtactcaccacccaattactaaactataaacccctcaactctaaccccttccccccaaccaaccactctct

SEQ ID NO: 21917 - DNA, 701 bp, Artificial Sequence
  chemically treated genomic DNA (Homo sapiens) CpG-island No: 21917
ttcgaattttttcgttgggtttcggggttcgatttttaagtttgttaattgatttttcgttcgtttttcgtcggtttagcgttttgtatcggtcgagagtttattttcgggattgggtttcgttatggtttttagtatcgttttttttttttttttcggttcggcgttttttttttcggagtcggggatttcggtgtcgtttttagtgttcgatgtttttattgtttcgttttatagaagtgttcgttttagttcggttgagattcgagttcgttagtcgttgtcgttatttttttttattattgtttttcgtattttcggatcgggtttttttttttcgcgtcgtcggtcgtttgttttttttttttttttttttttttttttttttttttttttttttttttttttttttttttttttcgtcggcgtcgaggcgtagtgtattaagggttttgtagttcgttcgggaatagcggaaaagggatcgtatgaattttcggaattttgatttttagaaagttataggttggcgtaggcgtattaagtcgtttttttttttcggggagcggcggggagattaggagtcggaggggagagcggaagtgcgcgcgtaggtttttgggagatgtaggttgggcgggattaagaaagaagaggaagaagggattagaattttcggttattatattgtttcgttttgt

SEQ ID NO: 21918 - DNA, 701 bp, Artificial Sequence
  chemically treated genomic DNA (Homo sapiens) CpG-island No: 21918
acaaaacgaaacaatataataaccgaaaattctaatcccttcttcctcttctttcttaatcccgcccaacctacatctcccaaaaacctacgcgcgcacttccgctctcccctccgactcctaatctccccgccgctccccgaaaaaaaaaaacgacttaatacgcctacgccaacctataactttctaaaaatcaaaattccgaaaattcatacgatcccttttccgctattcccgaacgaactacaaaacccttaatacactacgcctcgacgccgacgaaaaaaaaaaaaaaaaaaaaaaaaaaaaaaaaaaaaaaaaaaaaaaaaaaaaaaaaaaaaaaaacaaacgaccgacgacgcgaaaaaaaaaaacccgatccgaaaatacgaaaaacaataataaaaaaaaataacgacaacgactaacgaactcgaatctcaaccgaactaaaacgaacacttctataaaacgaaacaataaaaacatcgaacactaaaaacgacaccgaaatccccgactccgaaaaaaaaaacgccgaaccgaaaaaaaaaaaaaaaacgatactaaaaaccataacgaaacccaatcccgaaaataaactctcgaccgatacaaaacgctaaaccgacgaaaaacgaacgaaaaatcaattaacaaacttaaaaatcgaaccccgaaacccaacgaaaaaattcgaa

SEQ ID NO: 21919 - DNA, 701 bp, Artificial Sequence
  chemically treated genomic DNA (Homo sapiens) CpG-island No: 21919
gtagaacgaggtagtatggtggtcgagagttttaattttttttttttttttttttttggtttcgtttagtttatattttttaggggtttgcgcgcgtattttcgttttttttttcggtttttggttttttcgtcgtttttcgggggaggggagcggtttggtgcgtttgcgttagtttgtggttttttgggaattaaagtttcggaggtttatgcggtttttttttcgttgttttcggacggattataaaatttttggtgtattgcgtttcggcgtcggcggggggaggagggagagaagaggagggagggaggagagaggaggaggaggaggaggaggagggagtaggcggtcggcggcgcggggggagggggttcggttcgggagtgcgggaggtagtggtagagggaggtggcggtagcggttagcggattcgagttttaatcgggttgaggcggatatttttgtggagcgaagtagtgggagtatcgagtattagaggcggtatcgggattttcggtttcggggaggggggcgtcggatcgggaggaggggagggggcgatgttggaagttatggcggagtttagtttcgaaggtgagttttcgatcggtgtagagcgttgagtcggcggggggcgggcgaggaattaattggtaaatttggaggtcgagtttcggagtttagcgggggagttcggg

SEQ ID NO: 21920 - DNA, 701 bp, Artificial Sequence
  chemically treated genomic DNA (Homo sapiens) CpG-island No: 21920
cccgaactcccccgctaaactccgaaactcgacctccaaatttaccaattaattcctcgcccgccccccgccgactcaacgctctacaccgatcgaaaactcaccttcgaaactaaactccgccataacttccaacatcgccccctcccctcctcccgatccgacgcccccctccccgaaaccgaaaatcccgataccgcctctaatactcgatactcccactacttcgctccacaaaaatatccgcctcaacccgattaaaactcgaatccgctaaccgctaccgccacctccctctaccactacctcccgcactcccgaaccgaaccccctccccccgcgccgccgaccgcctactccctcctcctcctcctcctcctcctctctcctccctccctcctcttctctccctcctccccccgccgacgccgaaacgcaatacaccaaaaattttataatccgtccgaaaacaacgaaaaaaaaaccgcataaacctccgaaactttaattcccaaaaaaccacaaactaacgcaaacgcaccaaaccgctcccctcccccgaaaaacgacgaaaaaaccaaaaaccgaaaaaaaaaacgaaaatacgcgcgcaaacccctaaaaaatataaactaaacgaaaccaaaaaaaaaaaaaaaaaaaaaattaaaactctcgaccaccatactacctcgttctac

SEQ ID NO: 21921 - DNA, 514 bp, Artificial Sequence
  chemically treated genomic DNA (Homo sapiens) CpG-island No: 21921
gttcgtacgattgtgcgttagggttcggggaggggcgtttttcgcgtgagcgtttttttgggaatattgaatataattattttttattttagattatgttaggttttaatggtgggaggacgttcgagtgttcggttcgttttatttcgaggaggaaggatattgggttatgacgttattagagggcgttagagtagggatcggacgcgagttggagatgttggattcgttgttggttttgggcggtttggtgttgtttcggggtgagagttagaggtacggtggcggggcggggggtgcggttcgggtttggttgaggggacggaagtgggtaggaagggttaggggttataggttaggtgtggaaatcgcgacgggttcgcgaaggcggtaattttagcgtttttatattttttattcgtttttcgttttgtagatttcgtggagtgggaggggcgtagttttttgaaggcgtttgttaagaaatttgtattgtggtgagtattttatagtg

SEQ ID NO: 21922 - DNA, 514 bp, Artificial Sequence
  chemically treated genomic DNA (Homo sapiens) CpG-island No: 21922
cactataaaatactcaccacaatacaaatttcttaacaaacgccttcaaaaaactacgcccctcccactccacgaaatctacaaaacgaaaaacgaataaaaaatataaaaacgctaaaattaccgccttcgcgaacccgtcgcgatttccacacctaacctataacccctaacccttcctacccacttccgtcccctcaaccaaacccgaaccgcaccccccgccccgccaccgtacctctaactctcaccccgaaacaacaccaaaccgcccaaaaccaacaacgaatccaacatctccaactcgcgtccgatccctactctaacgccctctaataacgtcataacccaatatccttcctcctcgaaataaaacgaaccgaacactcgaacgtcctcccaccattaaaacctaacataatctaaaataaaaaataattatattcaatattcccaaaaaaacgctcacgcgaaaaacgcccctccccgaaccctaacgcacaatcgtacgaac

SEQ ID NO: 21923 - DNA, 514 bp, Artificial Sequence
  chemically treated genomic DNA (Homo sapiens) CpG-island No: 21923
tattgtgggatatttattatagtgtagattttttgataagcgtttttaagagattgcgttttttttattttacggaatttgtagagcgagggacggataaagggtatgagagcgttgggattatcgttttcgcgaattcgtcgcgatttttatatttagtttgtgatttttggttttttttgtttattttcgtttttttagttaggttcgaatcgtatttttcgtttcgttatcgtgtttttggtttttatttcgaagtagtattaggtcgtttaaggttaatagcgagtttaatatttttaattcgcgttcggtttttgttttggcgttttttgatggcgttatgatttagtgtttttttttttcggggtgaaacgggtcgagtattcgggcgtttttttattattaagatttaatatagtttggaatgagaggtgattatgtttaatatttttaggggggcgtttacgcggagggcgttttttttcgagttttggcgtatagtcgtacggat

SEQ ID NO: 21924 - DNA, 514 bp, Artificial Sequence
  chemically treated genomic DNA (Homo sapiens) CpG-island No: 21924
atccgtacgactatacgccaaaactcgaaaaaaaacgccctccgcgtaaacgcccccctaaaaatattaaacataatcacctctcattccaaactatattaaatcttaataataaaaaaacgcccgaatactcgacccgtttcaccccgaaaaaaaaaaacactaaatcataacgccatcaaaaaacgccaaaacaaaaaccgaacgcgaattaaaaatattaaactcgctattaaccttaaacgacctaatactacttcgaaataaaaaccaaaaacacgataacgaaacgaaaaatacgattcgaacctaactaaaaaaacgaaaataaacaaaaaaaaccaaaaatcacaaactaaatataaaaatcgcgacgaattcgcgaaaacgataatcccaacgctctcataccctttatccgtccctcgctctacaaattccgtaaaataaaaaaaacgcaatctcttaaaaacgcttatcaaaaaatctacactataataaatatcccacaata

SEQ ID NO: 21925 - DNA, 579 bp, Artificial Sequence
  chemically treated genomic DNA (Homo sapiens) CpG-island No: 21925
gtaggcggttttagttttcgtgtcgtcggtcgcgtttattaatcgttggattttttttgttcggcgtcgtgttttgtcgagggttaggggcgtttaggtgtttaagatttgggttaagcgggtaggttttcgtttttttcgatagcgcggtttttttgttttcgtttcgtttttttcgtttaaggattcgttcggggcgtcggggtttcggtgaaattgttttggatagggggaagggtgaaagggtgtagcgaagagaagtcgagacggtggttcgaagtttcgcgcggcgtatatgttagtcggcgtttttgttttgagttcgttatcgaggttatcgggtttgtggtttcggttaatcggtcgataagattagaggtagtaggcggcggtttattttgattagtcgtatcgtttttcggttttcggcgcgtttcgtgtttcgcgtttcggggtcgtttttgtttgagaaaaggacgggagatgacggaggttatggtttgttcgggaatggaggaggggatggtttcggtttaagtatcgttgtttcgagtcggggacgaggttgggttgggggag

SEQ ID NO: 21926 - DNA, 579 bp, Artificial Sequence
  chemically treated genomic DNA (Homo sapiens) CpG-island No: 21926
ctcccccaacccaacctcgtccccgactcgaaacaacgatacttaaaccgaaaccatcccctcctccattcccgaacaaaccataacctccgtcatctcccgtccttttctcaaacaaaaacgaccccgaaacgcgaaacacgaaacgcgccgaaaaccgaaaaacgatacgactaatcaaaataaaccgccgcctactacctctaatcttatcgaccgattaaccgaaaccacaaacccgataacctcgataacgaactcaaaacaaaaacgccgactaacatatacgccgcgcgaaacttcgaaccaccgtctcgacttctcttcgctacaccctttcacccttccccctatccaaaacaatttcaccgaaaccccgacgccccgaacgaatccttaaacgaaaaaaacgaaacgaaaacaaaaaaaccgcgctatcgaaaaaaacgaaaacctacccgcttaacccaaatcttaaacacctaaacgcccctaaccctcgacaaaacacgacgccgaacaaaaaaaatccaacgattaataaacgcgaccgacgacacgaaaactaaaaccgcctac

SEQ ID NO: 21927 - DNA, 579 bp, Artificial Sequence
  chemically treated genomic DNA (Homo sapiens) CpG-island No: 21927
tttttttaatttagtttcgttttcggttcggagtagcggtgtttaggtcggggttatttttttttttattttcgggtaggttatggttttcgttatttttcgttttttttttagatagaaacggtttcggggcgcggggtacggggcgcgtcgagggtcgaagggcggtgcggttggttagagtgggtcgtcgtttgttgtttttaattttatcggtcgattagtcgaagttataaattcggtggtttcgatagcgggtttagagtagggacgtcggttggtatgtgcgtcgcgcggggtttcggattatcgtttcggttttttttcgttgtatttttttatttttttttttatttagggtagttttatcgaaatttcggcgtttcgggcggatttttgagcggagagggcggggcgggagtaggaaggtcgcgttgtcgggaggggcggggatttgttcgtttggtttaggttttggatatttgggcgtttttggttttcggtagaatacggcgtcggatagaagaggtttagcggttagtgggcgcggtcggcggtacgaaggttggagtcgtttgt

SEQ ID NO: 21928 - DNA, 579 bp, Artificial Sequence
  chemically treated genomic DNA (Homo sapiens) CpG-island No: 21928
acaaacgactccaaccttcgtaccgccgaccgcgcccactaaccgctaaacctcttctatccgacgccgtattctaccgaaaaccaaaaacgcccaaatatccaaaacctaaaccaaacgaacaaatccccgcccctcccgacaacgcgaccttcctactcccgccccgccctctccgctcaaaaatccgcccgaaacgccgaaatttcgataaaactaccctaaataaaaaaaaaaataaaaaaatacaacgaaaaaaaaccgaaacgataatccgaaaccccgcgcgacgcacataccaaccgacgtccctactctaaacccgctatcgaaaccaccgaatttataacttcgactaatcgaccgataaaattaaaaacaacaaacgacgacccactctaaccaaccgcaccgcccttcgaccctcgacgcgccccgtaccccgcgccccgaaaccgtttctatctaaaaaaaaaacgaaaaataacgaaaaccataacctacccgaaaataaaaaaaaaaataaccccgacctaaacaccgctactccgaaccgaaaacgaaactaaattaaaaaaa

SEQ ID NO: 21929 - DNA, 939 bp, Artificial Sequence
  chemically treated genomic DNA (Homo sapiens) CpG-island No: 21929
agagtcgttttgtgcgcgtttgttttttatttagtatcggtttgttcgtttgatttcgggtcgggggggcgggggttttcgagatcgtcgtcgtcggattgttaggggtgcgggagttcggcgtcgagggggttttagtagcggggttcgaggcggtttcgttttcgtcgttcgtttcgtcgtttttttgcggtttttttgcgggtatcggtattattatcgttattatttttgtcgtcgtcgcgggtatcgtcgtcgcggggatcgttgtagttttcgttgtcgtttttatttcgtttatttcgtcgggtttagtatcggttatagtcgttatcgtttcggttttttttttcggttcgcgaatttatcgttttgttcggttttcgcgtttcgagtttcgtttatacgtcggtagcgggttcggagtcgaggttaatggtagttcgttgtcgtcgttcgcgtagatttcgtttttcgattacgggttaattttagtttagtagtattttcggatcgtacgtcgatttcgtttttcggatttcgtatcgcggtttcggttttcgttagtcgtttagtaagtatatttgggtttcgttttttggtcgttacgtgacggttttcggtttaatttattggtcggcggttttttttttttttttttttcgtttttttttatcggtcgcgggaaattaaacgggtcggtcgcgttttaatcgttatttggtttttgcgggaagggcggggtcggggtcgtagtgttaaggttgtttttaacgatttgagcgaggggcgggaatttgtagtttcggttttggtagtgagtagtatcgttcgtttttattttcgagatcgattttgttcgtatgttgttaggtgtagacgtttttcggttattatcgtttttggtattttttttttataggacggttttgtatattt

SEQ ID NO: 21930 - DNA, 939 bp, Artificial Sequence
  chemically treated genomic DNA (Homo sapiens) CpG-island No: 21930
aaatatacaaaaccgtcctataaaaaaaaaataccaaaaacgataataaccgaaaaacgtctacacctaacaacatacgaacaaaatcgatctcgaaaataaaaacgaacgatactactcactaccaaaaccgaaactacaaattcccgcccctcgctcaaatcgttaaaaacaaccttaacactacgaccccgaccccgcccttcccgcaaaaaccaaataacgattaaaacgcgaccgacccgtttaatttcccgcgaccgataaaaaaaaacgaaaaaaaaaaaaaaaaaaaaccgccgaccaataaattaaaccgaaaaccgtcacgtaacgaccaaaaaacgaaacccaaatatacttactaaacgactaacgaaaaccgaaaccgcgatacgaaatccgaaaaacgaaatcgacgtacgatccgaaaatactactaaactaaaattaacccgtaatcgaaaaacgaaatctacgcgaacgacgacaacgaactaccattaacctcgactccgaacccgctaccgacgtataaacgaaactcgaaacgcgaaaaccgaacaaaacgataaattcgcgaaccgaaaaaaaaaaccgaaacgataacgactataaccgatactaaacccgacgaaataaacgaaataaaaacgacaacgaaaactacaacgatccccgcgacgacgatacccgcgacgacgacaaaaataataacgataataataccgatacccgcaaaaaaaccgcaaaaaaacgacgaaacgaacgacgaaaacgaaaccgcctcgaaccccgctactaaaaccccctcgacgccgaactcccgcacccctaacaatccgacgacgacgatctcgaaaacccccgcccccccgacccgaaatcaaacgaacaaaccgatactaaataaaaaacaaacgcgcacaaaacgactct

SEQ ID NO: 21931 - DNA, 939 bp, Artificial Sequence
  chemically treated genomic DNA (Homo sapiens) CpG-island No: 21931
gggtgtgtagggtcgttttgtggggagagggtgttaagggcggtggtggtcggaaggcgtttgtatttggtagtatacgggtaaggtcggtttcgagggtggaggcgagcggtgttatttattgttagaatcgaggttgtagattttcgtttttcgtttaggtcgttaggggtaattttggtattgcggtttcggtttcgtttttttcgtagaggttaggtggcggttggggcgcgatcggttcgtttgatttttcgcggtcggtggaaaggggcggaggggggaggggaaaggggtcgtcggttaatgggttgggtcgggggtcgttacgtggcggttagggggcggggtttaggtgtatttattgggcggttggcgggggtcggggtcgcggtgcgaagttcgggaggcggggtcggcgtgcggttcgggggtgttgttgggttgggattggttcgtggtcgggaggcggggtttgcgcgagcggcggtagcgggttgttattggtttcggtttcgggttcgttgtcggcgtgtgggcgaggttcggggcgcgaggatcgagtagggcggtgggttcgcgagtcggggggaggggtcggggcggtggcggttgtggtcggtattggattcggcgggatgagcgaggtggaggcggtagcgggggttatagcggttttcgcggcgacggtgttcgcgacggcggtaggggtggtagcggtggtggtatcggtgttcgtaggggagtcgtagaaaggcggcggggcgggcggcgggggcggagtcgtttcgggtttcgttgttgggattttttcggcgtcgggttttcgtatttttggtaattcggcgacggcggtttcgggaattttcgttttttcggttcggagttaggcggataagtcggtgttgggtgaggggtaggcgcgtatagggcggtttt

SEQ ID NO: 21932 - DNA, 939 bp, Artificial Sequence
  chemically treated genomic DNA (Homo sapiens) CpG-island No: 21932
aaaaccgccctatacgcgcctacccctcacccaacaccgacttatccgcctaactccgaaccgaaaaaacgaaaattcccgaaaccgccgtcgccgaattaccaaaaatacgaaaacccgacgccgaaaaaatcccaacaacgaaacccgaaacgactccgcccccgccgcccgccccgccgcctttctacgactcccctacgaacaccgataccaccaccgctaccacccctaccgccgtcgcgaacaccgtcgccgcgaaaaccgctataacccccgctaccgcctccacctcgctcatcccgccgaatccaataccgaccacaaccgccaccgccccgacccctccccccgactcgcgaacccaccgccctactcgatcctcgcgccccgaacctcgcccacacgccgacaacgaacccgaaaccgaaaccaataacaacccgctaccgccgctcgcgcaaaccccgcctcccgaccacgaaccaatcccaacccaacaacacccccgaaccgcacgccgaccccgcctcccgaacttcgcaccgcgaccccgacccccgccaaccgcccaataaatacacctaaaccccgccccctaaccgccacgtaacgacccccgacccaacccattaaccgacgacccctttcccctcccccctccgcccctttccaccgaccgcgaaaaatcaaacgaaccgatcgcgccccaaccgccacctaacctctacgaaaaaaacgaaaccgaaaccgcaataccaaaattacccctaacgacctaaacgaaaaacgaaaatctacaacctcgattctaacaataaataacaccgctcgcctccaccctcgaaaccgaccttacccgtatactaccaaatacaaacgccttccgaccaccaccgcccttaacaccctctccccacaaaacgaccctacacaccc

SEQ ID NO: 21933 - DNA, 744 bp, Artificial Sequence
  chemically treated genomic DNA (Homo sapiens) CpG-island No: 21933
gttcgcgtattgtttcgagcgtagttgggatcgtagagtcgtcgggcgttcgcggtattttcggtgtgtttttgttttcggggtcgggttgggtcgggtgggtcgtgtgtttttttttcgttaagtgcgcgtgtttttttttttttcgggtatagggtacgattagtcgcgtcggttatttggcggggttcgagttcgcgtcgtcgtcgtcgtcgtcgtcgcgggagtcgttcgcgtttagtttgggtagcgttttttatttgttcgacgcgtcgttcgtcgtcgtcgtcgtcgcgttttattattttagttttacgttgttcgcgtcgtcgcgcgggggtttttcgttggtcgcgttttagggcggttcgtttattaagttgtagcgcggcggttcggttttcgagggcgttatttacgtcgcgtcgcgcggtttttcgtttaagtagtcgtttagtcgtttggttaagttttatagtattagttcgtttattaatatcgtcgtgttttcggtcggtttgttttcgattcgcgtgatttcgttttttatcgtgtagtttattatttttttttcgtttatttattagttgagttttattatcggtacgtacgttattttgtcgtttattaagcgtttggtttacgcgttcgagtagtatagtaagtattcgtaggagttgtatgttacggttattttttagaggtcgggtagtttggtaggtaaaggttcgttgttatttggcg

SEQ ID NO: 21934 - DNA, 744 bp, Artificial Sequence
  chemically treated genomic DNA (Homo sapiens) CpG-island No: 21934
cgccaaataacaacgaacctttacctaccaaactacccgacctctaaaaaataaccgtaacatacaactcctacgaatacttactatactactcgaacgcgtaaaccaaacgcttaataaacgacaaaataacgtacgtaccgataataaaactcaactaataaataaacgaaaaaaaaataataaactacacgataaaaaacgaaatcacgcgaatcgaaaacaaaccgaccgaaaacacgacgatattaataaacgaactaatactataaaacttaaccaaacgactaaacgactacttaaacgaaaaaccgcgcgacgcgacgtaaataacgccctcgaaaaccgaaccgccgcgctacaacttaataaacgaaccgccctaaaacgcgaccaacgaaaaacccccgcgcgacgacgcgaacaacgtaaaactaaaataataaaacgcgacgacgacgacgacgaacgacgcgtcgaacaaataaaaaacgctacccaaactaaacgcgaacgactcccgcgacgacgacgacgacgacgacgcgaactcgaaccccgccaaataaccgacgcgactaatcgtaccctatacccgaaaaaaaaaaaaacacgcgcacttaacgaaaaaaaaacacacgacccacccgacccaacccgaccccgaaaacaaaaacacaccgaaaataccgcgaacgcccgacgactctacgatcccaactacgctcgaaacaatacgcgaac

SEQ ID NO: 21935 - DNA, 744 bp, Artificial Sequence
  chemically treated genomic DNA (Homo sapiens) CpG-island No: 21935
cgttaggtggtagcgagtttttatttgttaggttgttcggtttttggagggtggtcgtggtatatagtttttgcgagtgtttgttgtattgttcggacgcgtggattaggcgtttggtgggcgatagggtggcgtacgtgtcgatggtggagtttagttggtggatgggcgaggaggagatggtggattgtacggtggggggcgaggttacgcggatcggggataggtcggtcgaggatacgacgatgttgatgggcgagttggtgttgtaggatttggttaggcggttgggcgattgtttgggcgaggagtcgcgcggcgcggcgtaggtggcgttttcgggggtcgagtcgtcgcgttgtagtttggtgggcgaatcgttttggggcgcggttagcggggagttttcgcgcggcggcgcgggtagcgtggagttggagtagtagagcgcggcggcggcggcggcgggcggcgcgtcgggtaggtggaaggcgttgtttaggttgggcgcgaacggttttcgcggcggcggcggcggcggcggcgcgggttcgggtttcgttaggtggtcggcgcggttggtcgtgttttgtgttcgggagaggagagaatacgcgtatttagcgagggagaagtatacggtttattcggtttagttcggtttcgagagtagaggtatatcggggatgtcgcgggcgttcggcggttttgcgattttagttgcgttcggggtagtacgcgaat

SEQ ID NO: 21936 - DNA, 744 bp, Artificial Sequence
  chemically treated genomic DNA (Homo sapiens) CpG-island No: 21936
attcgcgtactaccccgaacgcaactaaaatcgcaaaaccgccgaacgcccgcgacatccccgatatacctctactctcgaaaccgaactaaaccgaataaaccgtatacttctccctcgctaaatacgcgtattctctcctctcccgaacacaaaacacgaccaaccgcgccgaccacctaacgaaacccgaacccgcgccgccgccgccgccgccgccgcgaaaaccgttcgcgcccaacctaaacaacgccttccacctacccgacgcgccgcccgccgccgccgccgccgcgctctactactccaactccacgctacccgcgccgccgcgcgaaaactccccgctaaccgcgccccaaaacgattcgcccaccaaactacaacgcgacgactcgacccccgaaaacgccacctacgccgcgccgcgcgactcctcgcccaaacaatcgcccaaccgcctaaccaaatcctacaacaccaactcgcccatcaacatcgtcgtatcctcgaccgacctatccccgatccgcgtaacctcgccccccaccgtacaatccaccatctcctcctcgcccatccaccaactaaactccaccatcgacacgtacgccaccctatcgcccaccaaacgcctaatccacgcgtccgaacaatacaacaaacactcgcaaaaactatataccacgaccaccctccaaaaaccgaacaacctaacaaataaaaactcgctaccacctaacg

SEQ ID NO: 21937 - DNA, 583 bp, Artificial Sequence
  chemically treated genomic DNA (Homo sapiens) CpG-island No: 21937
atttgtttcggtcggtcgaagcgtcgcgggcgtttttttatttacggcgggtttgtttagtttttcgtttagttcgggttcgggtttcgtcgaggtaggtgtgcgtggcggattagttttcgggtattcggttggtttagttttatttcgaacgttatcgggttaggttacgcgtagattcgagttcggggttttcgtttttggttgtcggttcgcgttcgtcgcgcgtttcgcgtttattgcgcgttcggtttcggtttcgtttttcggagggtttcgttttcgtttttttgtcgatgtcgttgaggaaaatgaaagcggtcgtggttaggattggcgtagttgtcgttttaggcgaggggcgtagaatgtagcggtcgttagtttggagcgcgggttttggggtcgtaattcgcgtcgggcgaggtaagtatagttttttcgcggtcgtttcgcgggtttttttttgcggattcggcgggttcgacgttaggcgtttgattcgggtagggttaggggttttgtcgtgggggcggggagggtttgagaagcggtatttttgggtttcgtggttttgagtttt

SEQ ID NO: 21938 - DNA, 583 bp, Artificial Sequence
  chemically treated genomic DNA (Homo sapiens) CpG-island No: 21938
aaaactcaaaaccacgaaacccaaaaataccgcttctcaaaccctccccgcccccacgacaaaacccctaaccctacccgaatcaaacgcctaacgtcgaacccgccgaatccgcaaaaaaaaacccgcgaaacgaccgcgaaaaaactatacttacctcgcccgacgcgaattacgaccccaaaacccgcgctccaaactaacgaccgctacattctacgcccctcgcctaaaacgacaactacgccaatcctaaccacgaccgctttcattttcctcaacgacatcgacaaaaaaacgaaaacgaaaccctccgaaaaacgaaaccgaaaccgaacgcgcaataaacgcgaaacgcgcgacgaacgcgaaccgacaaccaaaaacgaaaaccccgaactcgaatctacgcgtaacctaacccgataacgttcgaaataaaactaaaccaaccgaatacccgaaaactaatccgccacgcacacctacctcgacgaaacccgaacccgaactaaacgaaaaactaaacaaacccgccgtaaataaaaaaacgcccgcgacgcttcgaccgaccgaaacaaat

SEQ ID NO: 21939 - DNA, 583 bp, Artificial Sequence
  chemically treated genomic DNA (Homo sapiens) CpG-island No: 21939
gaggtttaaagttacgaaatttaagggtgtcgttttttaggtttttttcgtttttacggtagaatttttgattttgttcgggttaaacgtttggcgtcgggttcgtcgggttcgtaaggaggagttcgcgaggcggtcgcgaaggggttgtgtttatttcgttcggcgcgggttgcggttttagggttcgcgttttaggttggcggtcgttgtattttgcgtttttcgtttgaaacggtagttgcgttagttttggttacgatcgtttttattttttttaacgatatcggtaggaaagcgaaagcgaaatttttcgggaggcgggatcggggtcgagcgcgtagtgaacgcggggcgcgcggcgggcgcgggtcggtagttagaggcgggggtttcgggttcgggtttgcgcgtggtttggttcggtggcgttcggggtggagttgggttagtcgagtgttcgagagttagttcgttacgtatatttgtttcggcgggattcgggttcgggttgggcgggaggttgggtaggttcgtcgtaagtggaaaggcgttcgcggcgtttcggtcgatcgggataggt

SEQ ID NO: 21940 - DNA, 583 bp, Artificial Sequence
  chemically treated genomic DNA (Homo sapiens) CpG-island No: 21940
acctatcccgatcgaccgaaacgccgcgaacgcctttccacttacgacgaacctacccaacctcccgcccaacccgaacccgaatcccgccgaaacaaatatacgtaacgaactaactctcgaacactcgactaacccaactccaccccgaacgccaccgaaccaaaccacgcgcaaacccgaacccgaaacccccgcctctaactaccgacccgcgcccgccgcgcgccccgcgttcactacgcgctcgaccccgatcccgcctcccgaaaaatttcgctttcgctttcctaccgatatcgttaaaaaaaataaaaacgatcgtaaccaaaactaacgcaactaccgtttcaaacgaaaaacgcaaaatacaacgaccgccaacctaaaacgcgaaccctaaaaccgcaacccgcgccgaacgaaataaacacaaccccttcgcgaccgcctcgcgaactcctccttacgaacccgacgaacccgacgccaaacgtttaacccgaacaaaatcaaaaattctaccgtaaaaacgaaaaaaacctaaaaaacgacacccttaaatttcgtaactttaaacctc

SEQ ID NO: 21941 - DNA, 541 bp, Artificial Sequence
  chemically treated genomic DNA (Homo sapiens) CpG-island No: 21941
acggtcgggtcgggcggcggagttgtaagggatagaggcgcggtaggcgcgcggagttagcggagttagttgagttcgagtttagttcgcgttcgcgtcgttatgtttttggttttttgcggtagcgagaattattcggtcgtttatcgggtggattagggggtttttaataacggttgttttgtggacgcgtttaacgtggtgtcgtacgtttttttattttttattattttttttattttttttattggtgagtgcgcgtagcgagtcgcggaggaggggacgggagagtagggagggaggaggaggcgttgcgcgtcgtatcgttcggcgttttttttcggttcgcgatcgtcgttcgtttcgttttcggggttttttgttttgtgttttgttcgtcggttttcgtattcgtatattagtttatttttttattttttcggtgttttcgatttcgcgttaaatatagcggacgtttgtgatttatgggattattaagttttgtttttgtagggttaagagttgggatggggaaaaggga

SEQ ID NO: 21942 - DNA, 541 bp, Artificial Sequence
  chemically treated genomic DNA (Homo sapiens) CpG-island No: 21942
tcccttttccccatcccaactcttaaccctacaaaaacaaaacttaataatcccataaatcacaaacgtccgctatatttaacgcgaaatcgaaaacaccgaaaaaataaaaaaataaactaatatacgaatacgaaaaccgacgaacaaaacacaaaacaaaaaaccccgaaaacgaaacgaacgacgatcgcgaaccgaaaaaaaacgccgaacgatacgacgcgcaacgcctcctcctccctccctactctcccgtcccctcctccgcgactcgctacgcgcactcaccaataaaaaaaataaaaaaaataataaaaaataaaaaaacgtacgacaccacgttaaacgcgtccacaaaacaaccgttattaaaaaccccctaatccacccgataaacgaccgaataattctcgctaccgcaaaaaaccaaaaacataacgacgcgaacgcgaactaaactcgaactcaactaactccgctaactccgcgcgcctaccgcgcctctatcccttacaactccgccgcccgacccgaccgt

SEQ ID NO: 21943 - DNA, 541 bp, Artificial Sequence
  chemically treated genomic DNA (Homo sapiens) CpG-island No: 21943
ttttttttttttattttagtttttggttttgtagaagtaaaatttggtgattttatgggttataaacgttcgttgtgtttggcgcgggatcgggggtatcgggggagtgaagggatgagttggtgtgcgagtgcggggatcggcgggtaggatatagggtaggggatttcgggaacgaggcggacggcggtcgcgggtcggaaggggacgtcgagcggtgcggcgcgtagcgtttttttttttttttttgttttttcgttttttttttcgcggttcgttgcgcgtatttattaatgaagaggatggggaaggtgatgaagagtaggaagacgtgcggtattacgttgagcgcgtttataaagtagtcgttgttgaggattttttggtttattcggtaggcggtcgagtggttttcgttgtcgtagaaggttaggggtatggcggcgcgggcgcgggttgggttcgggtttagttggtttcgttggtttcgcgcgtttgtcgcgtttttgttttttgtagtttcgtcgttcggttcggtcgt

SEQ ID NO: 21944 - DNA, 541 bp, Artificial Sequence
  chemically treated genomic DNA (Homo sapiens) CpG-island No: 21944
acgaccgaaccgaacgacgaaactacaaaaaacaaaaacgcgacaaacgcgcgaaaccaacgaaaccaactaaacccgaacccaacccgcgcccgcgccgccatacccctaaccttctacgacaacgaaaaccactcgaccgcctaccgaataaaccaaaaaatcctcaacaacgactactttataaacgcgctcaacgtaataccgcacgtcttcctactcttcatcaccttccccatcctcttcattaataaatacgcgcaacgaaccgcgaaaaaaaaaacgaaaaaacaaaaaaaaaaaaaaaaacgctacgcgccgcaccgctcgacgtccccttccgacccgcgaccgccgtccgcctcgttcccgaaatcccctaccctatatcctacccgccgatccccgcactcgcacaccaactcatcccttcactcccccgatacccccgatcccgcgccaaacacaacgaacgtttataacccataaaatcaccaaattttacttctacaaaaccaaaaactaaaataaaaaaaaaaaa

SEQ ID NO: 21945 - DNA, 609 bp, Artificial Sequence
  chemically treated genomic DNA (Homo sapiens) CpG-island No: 21945
tgagtttcgggaggggaggtggagggcgggggcggggaggggcgcgggaggggcgggggtttgtttcggtttcgttttttgcgtttcggtgtaggtcgggttttttttggcggttttcggtttcgttttttttttcgtgcgtttttttttcgtcgttttagatttttgtttagtttaggtcggttttcgcggatttacggacggatagatagacgggaggacggttagtcgcgagcgttcgggcggcgggagggggcggggaggcgacggtcgtggcgtgaggagtaggagtaggtgtagcggcggcggcgggcggggtcgggattcggcgcggagcgggagtcgcggcgcgggcgggcggtagggatcgggaggtcgcgattcggagttagtttcgtcgggtcgcgcgtaggttcggggagtcgcggttgagtcgggtggggtggtgattttagagaacgtaggattttaaggagatagagaggacgagagttggagggggattcggaaagcggcgggggcgtttcgggaggggtggagtaggatatagggggcgtatttggaggagagacggggcgggggtggttaggatttgagttggagtttggg

SEQ ID NO: 21946 - DNA, 609 bp, Artificial Sequence
  chemically treated genomic DNA (Homo sapiens) CpG-island No: 21946
cccaaactccaactcaaatcctaaccacccccgccccgtctctcctccaaatacgccccctatatcctactccacccctcccgaaacgcccccgccgctttccgaatccccctccaactctcgtcctctctatctccttaaaatcctacgttctctaaaatcaccaccccacccgactcaaccgcgactccccgaacctacgcgcgacccgacgaaactaactccgaatcgcgacctcccgatccctaccgcccgcccgcgccgcgactcccgctccgcgccgaatcccgaccccgcccgccgccgccgctacacctactcctactcctcacgccacgaccgtcgcctccccgccccctcccgccgcccgaacgctcgcgactaaccgtcctcccgtctatctatccgtccgtaaatccgcgaaaaccgacctaaactaaacaaaaatctaaaacgacgaaaaaaaaacgcacgaaaaaaaaaacgaaaccgaaaaccgccaaaaaaaacccgacctacaccgaaacgcaaaaaacgaaaccgaaacaaacccccgcccctcccgcgcccctccccgcccccgccctccacctcccctcccgaaactca

SEQ ID NO: 21947 - DNA, 609 bp, Artificial Sequence
  chemically treated genomic DNA (Homo sapiens) CpG-island No: 21947
tttaggttttagtttaggttttggttattttcgtttcgttttttttttaggtgcgttttttatgttttattttatttttttcggagcgttttcgtcgtttttcggatttttttttagttttcgttttttttgtttttttgggattttgcgttttttggagttattattttattcggtttaatcgcggtttttcggatttgcgcgcgattcggcggggttgatttcgagtcgcggtttttcggtttttgtcgttcgttcgcgtcgcggttttcgtttcgcgtcgggtttcggtttcgttcgtcgtcgtcgttgtatttgtttttgttttttacgttacggtcgtcgttttttcgttttttttcgtcgttcgggcgttcgcggttggtcgttttttcgtttgtttgttcgttcgtgggttcgcggagatcgatttgggttaggtaggggtttaggacggcgggaggggggcgtacgaggagaggaacggggtcggggatcgttagggggagttcgatttgtatcggagcgtagggggcggggtcggagtaagttttcgtttttttcgcgttttttttcgttttcgttttttattttttttttcgggattta

SEQ ID NO: 21948 - DNA, 609 bp, Artificial Sequence
  chemically treated genomic DNA (Homo sapiens) CpG-island No: 21948
taaatcccgaaaaaaaaaataaaaaacgaaaacgaaaaaaaacgcgaaaaaaacgaaaacttactccgaccccgccccctacgctccgatacaaatcgaactccccctaacgatccccgaccccgttcctctcctcgtacgcccccctcccgccgtcctaaacccctacctaacccaaatcgatctccgcgaacccacgaacgaacaaacaaacgaaaaaacgaccaaccgcgaacgcccgaacgacgaaaaaaaacgaaaaaacgacgaccgtaacgtaaaaaacaaaaacaaatacaacgacgacgacgaacgaaaccgaaacccgacgcgaaacgaaaaccgcgacgcgaacgaacgacaaaaaccgaaaaaccgcgactcgaaatcaaccccgccgaatcgcgcgcaaatccgaaaaaccgcgattaaaccgaataaaataataactccaaaaaacgcaaaatcccaaaaaaacaaaaaaaacgaaaactaaaaaaaaatccgaaaaacgacgaaaacgctccgaaaaaaataaaataaaacataaaaaacgcacctaaaaaaaaaacgaaacgaaaataaccaaaacctaaactaaaacctaaa

SEQ ID NO: 21949 - DNA, 1033 bp, Artificial Sequence
  chemically treated genomic DNA (Homo sapiens) CpG-island No: 21949
ttcgtttcgggttagcggtagtcgtattcgtttattattatgtttttatattgtcgtagtattacgttgtcgttgttgttaaagaagagtacggagatgggcgataggcgcgcgggtacgtagtagggtaggtcggcggttttcggggcggtcgcgtgtatgagcgcgcgtagtatagcgtggttgagcgtcggcggtttttcggatttcgatagcgcgacgggtagcgcgtattgattttggtagtagttggttaggaagtcgcgcggcgcgatgatttagcggtgttagtttatttcgcggaagtttacgtatagtcgtcgcgcgcgataagcgttttcggggtcgtcgtttaatacgggttcggcgtcgcgtcgcggtcgggttagggggtggtataggcgcgggtcgagggttattagtagtagcgaggtttcggttaggcgcgcgtaggcggtaggggttcgggggcgtagcgttagcgttaggcggaggttgcgcggttatgaggcgttgcgagtttaagcggcgtttagtagtttcgcgcgtattggcggttttagggcgggtattaattggcggagtagtatcggttcggggttcgcgttcgcgttttggttcgtttgcgttacgtttagtttttagtcgtttttcggggttgtcgtcgtcgtcgtcgcgaaacgtagttttaggcgggttcggttcgggcgtttagcgggttttatagtcgataggtcgaagacgattgtttatttagggtaatgtttcgcggtcgaggtaggtttcgaggttcgggtgggcgtatttggggaggtaggaataggaattcggttcgcgttgcgttttcggtttgtttatggggtttcggttagggatagggaggaaggtgaacgttggggttcggggcgtatcgtttgtgggaagggtgtgaagcggcggggtgggttgatggagtgggggtagggtatgagttttaaggaaggcgttttgcggggtgcggcggggggggtgggttgttttcggcggggggtat

SEQ ID NO: 21950 - DNA, 1033 bp, Artificial Sequence
  chemically treated genomic DNA (Homo sapiens) CpG-island No: 21950
ataccccccgccgaaaacaacccaccccccccgccgcaccccgcaaaacgccttccttaaaactcataccctacccccactccatcaacccaccccgccgcttcacacccttcccacaaacgatacgccccgaaccccaacgttcaccttcctccctatccctaaccgaaaccccataaacaaaccgaaaacgcaacgcgaaccgaattcctattcctacctccccaaatacgcccacccgaacctcgaaacctacctcgaccgcgaaacattaccctaaataaacaatcgtcttcgacctatcgactataaaacccgctaaacgcccgaaccgaacccgcctaaaactacgtttcgcgacgacgacgacgacaaccccgaaaaacgactaaaaactaaacgtaacgcaaacgaaccaaaacgcgaacgcgaaccccgaaccgatactactccgccaattaatacccgccctaaaaccgccaatacgcgcgaaactactaaacgccgcttaaactcgcaacgcctcataaccgcgcaacctccgcctaacgctaacgctacgcccccgaacccctaccgcctacgcgcgcctaaccgaaacctcgctactactaataaccctcgacccgcgcctataccaccccctaacccgaccgcgacgcgacgccgaacccgtattaaacgacgaccccgaaaacgcttatcgcgcgcgacgactatacgtaaacttccgcgaaataaactaacaccgctaaatcatcgcgccgcgcgacttcctaaccaactactaccaaaatcaatacgcgctacccgtcgcgctatcgaaatccgaaaaaccgccgacgctcaaccacgctatactacgcgcgctcatacacgcgaccgccccgaaaaccgccgacctaccctactacgtacccgcgcgcctatcgcccatctccgtactcttctttaacaacaacgacaacgtaatactacgacaatataaaaacataataataaacgaatacgactaccgctaacccgaaacgaa

SEQ ID NO: 21951 - DNA, 1033 bp, Artificial Sequence
  chemically treated genomic DNA (Homo sapiens) CpG-island No: 21951
atgtttttcgtcgagggtagtttatttttttcgtcgtatttcgtagggcgttttttttggaatttatgttttgtttttattttattagtttatttcgtcgttttatattttttttatagacggtgcgtttcgagttttagcgtttatttttttttttgtttttaatcgagattttatgggtaggtcggggacgtagcgcgagtcgagtttttgtttttatttttttaggtgcgtttattcgggtttcggagtttgtttcggtcgcggggtattgttttgagtggatagtcgttttcgatttgtcggttgtggaattcgttgagcgttcgagtcgggttcgtttggagttgcgtttcgcggcggcggcggcggtagtttcggagggcggttgggagttgagcgtggcgtaagcgggttagggcgcgggcgcggatttcgggtcggtgttgtttcgttagttggtgttcgttttggggtcgttagtgcgcgcggagttgttgggcgtcgtttgggttcgtaacgttttatggtcgcgtagttttcgtttggcgttggcgttacgttttcgggtttttgtcgtttgcgcgcgtttggtcgaggtttcgttgttgttggtgattttcgattcgcgtttgtgttattttttggttcggtcgcggcgcgacgtcgaattcgtgttgggcggcggtttcgggggcgtttgtcgcgcgcggcggttgtacgtgagttttcgcgaggtgggttggtatcgttgggttatcgcgtcgcgcggttttttggttaattattgttagggttagtgcgcgttgttcgtcgcgttgtcggggttcggggggtcgtcggcgtttaattacgttgtgttgcgcgcgtttatgtacgcggtcgtttcgggagtcgtcgatttgttttgttgcgtgttcgcgcgtttgtcgtttattttcgtgtttttttttgataatagcgataacgtggtgttgcggtagtatgaggatatggtggtggacgagtgcggttgtcgttaattcggggcggg

SEQ ID NO: 21952 - DNA, 1033 bp, Artificial Sequence
  chemically treated genomic DNA (Homo sapiens) CpG-island No: 21952
cccgccccgaattaacgacaaccgcactcgtccaccaccatatcctcatactaccgcaacaccacgttatcgctattatcaaaaaaaaacacgaaaataaacgacaaacgcgcgaacacgcaacaaaacaaatcgacgactcccgaaacgaccgcgtacataaacgcgcgcaacacaacgtaattaaacgccgacgaccccccgaaccccgacaacgcgacgaacaacgcgcactaaccctaacaataattaaccaaaaaaccgcgcgacgcgataacccaacgataccaacccacctcgcgaaaactcacgtacaaccgccgcgcgcgacaaacgcccccgaaaccgccgcccaacacgaattcgacgtcgcgccgcgaccgaaccaaaaaataacacaaacgcgaatcgaaaatcaccaacaacaacgaaacctcgaccaaacgcgcgcaaacgacaaaaacccgaaaacgtaacgccaacgccaaacgaaaactacgcgaccataaaacgttacgaacccaaacgacgcccaacaactccgcgcgcactaacgaccccaaaacgaacaccaactaacgaaacaacaccgacccgaaatccgcgcccgcgccctaacccgcttacgccacgctcaactcccaaccgccctccgaaactaccgccgccgccgccgcgaaacgcaactccaaacgaacccgactcgaacgctcaacgaattccacaaccgacaaatcgaaaacgactatccactcaaaacaataccccgcgaccgaaacaaactccgaaacccgaataaacgcacctaaaaaaataaaaacaaaaactcgactcgcgctacgtccccgacctacccataaaatctcgattaaaaacaaaaaaaaaaataaacgctaaaactcgaaacgcaccgtctataaaaaaaatataaaacgacgaaataaactaataaaataaaaacaaaacataaattccaaaaaaaacgccctacgaaatacgacgaaaaaaataaactaccctcgacgaaaaacat

SEQ ID NO: 21953 - DNA, 581 bp, Artificial Sequence
  chemically treated genomic DNA (Homo sapiens) CpG-island No: 21953
gattgcgggattcgtagattgagtttttaagcgtttcgtttcgtcgcgttttttttcgcgggttttatcgcggattcgtttttgcgcgtttcgggttaggagtttttagttgtaggattaggtacgtgcgattttacgtgagtttttcggtcggagcgtagatgggaagtgcgtatgcgtttatcgtttggaaagtaggttagatttttttttttacgtgatttgttttttttagttattttcggcgttttttcgtcggggcgtagtcgggatgcgttcggtagttaacgtgacggggttgggcgcgggcggtttcgcgagcgtttagcgttcgcgaggatttgtcggttttttttatattcgagcgtttcgtttagaagtcgggcgggtaaaagggagcgtttcgggaagtatttgggagtcgggttggaaatgaatggggttcggaagcgagtttaaatcgttgatatttggtatcgggttgcgtttatttttatgttttttaaggtagttttgtttgtaagaagggaacgcgtatcgttttttagtagattatatcgatcgtttgtacgtttgtattt

SEQ ID NO: 21954 - DNA, 581 bp, Artificial Sequence
  chemically treated genomic DNA (Homo sapiens) CpG-island No: 21954
aaatacaaacgtacaaacgatcgatataatctactaaaaaacgatacgcgttcccttcttacaaacaaaactaccttaaaaaacataaaaataaacgcaacccgataccaaatatcaacgatttaaactcgcttccgaaccccattcatttccaacccgactcccaaatacttcccgaaacgctcccttttacccgcccgacttctaaacgaaacgctcgaatataaaaaaaaccgacaaatcctcgcgaacgctaaacgctcgcgaaaccgcccgcgcccaaccccgtcacgttaactaccgaacgcatcccgactacgccccgacgaaaaaacgccgaaaataactaaaaaaaacaaatcacgtaaaaaaaaaaatctaacctactttccaaacgataaacgcatacgcacttcccatctacgctccgaccgaaaaactcacgtaaaatcgcacgtacctaatcctacaactaaaaactcctaacccgaaacgcgcaaaaacgaatccgcgataaaacccgcgaaaaaaaacgcgacgaaacgaaacgcttaaaaactcaatctacgaatcccgcaatc

SEQ ID NO: 21955 - DNA, 581 bp, Artificial Sequence
  chemically treated genomic DNA (Homo sapiens) CpG-island No: 21955
gaatgtaaacgtgtaaacgatcggtgtgatttattgaaaggcgatgcgcgttttttttttgtaggtagaattgttttaggaagtatgaaagtggacgtagttcggtgttaggtgttagcgatttgagttcgttttcgggttttatttatttttagttcggtttttagatatttttcgaggcgtttttttttgttcgttcgatttttgagcggagcgttcgggtgtgaggagaatcggtaaattttcgcgggcgttgggcgttcgcggagtcgttcgcgtttagtttcgttacgttggttgtcgagcgtatttcggttgcgtttcggcggggaggcgtcgagggtagttaaggggagtaggttacgtgagaggaggagtttgatttattttttaggcggtaggcgtatgcgtattttttatttgcgtttcggtcgggaggtttacgtggaatcgtacgtgtttggttttgtagttaggggtttttggttcggggcgcgtaggggcgggttcgcggtgggattcgcggagaggggcgcggcggggcggagcgtttggagatttagtttgcgggtttcgtaatt

SEQ ID NO: 21956 - DNA, 581 bp, Artificial Sequence
  chemically treated genomic DNA (Homo sapiens) CpG-island No: 21956
aattacgaaacccgcaaactaaatctccaaacgctccgccccgccgcgcccctctccgcgaatcccaccgcgaacccgcccctacgcgccccgaaccaaaaacccctaactacaaaaccaaacacgtacgattccacgtaaacctcccgaccgaaacgcaaataaaaaatacgcatacgcctaccgcctaaaaaataaatcaaactcctcctctcacgtaacctactccccttaactaccctcgacgcctccccgccgaaacgcaaccgaaatacgctcgacaaccaacgtaacgaaactaaacgcgaacgactccgcgaacgcccaacgcccgcgaaaatttaccgattctcctcacacccgaacgctccgctcaaaaatcgaacgaacaaaaaaaaacgcctcgaaaaatatctaaaaaccgaactaaaaataaataaaacccgaaaacgaactcaaatcgctaacacctaacaccgaactacgtccactttcatacttcctaaaacaattctacctacaaaaaaaaaacgcgcatcgcctttcaataaatcacaccgatcgtttacacgtttacattc

SEQ ID NO: 21957 - DNA, 730 bp, Artificial Sequence
  chemically treated genomic DNA (Homo sapiens) CpG-island No: 21957
gtcgggtcgatttcgggggtatttcgttttttgttttttttttttataaatttacgagttttcggagatgtttaggtagaggtggtcgaggagaggtcgcgggataagtacgcggagcgttatcgtttcgtatttgtcgaggagatttcgaggtgcgaggagggatttcggggcggcgttttttttgttttgtcgcggcggcggttcgggttttgcggggttgggggggtcggggggcggcgggagagcggagggcgggttttgggtttacgtgttcgttgtttagtttttaattcggtttcgtcgtttcgtcgggatggtcgcggtcggagcgcgttgagtttcggcgtcgtttttgtcgtttttattttttcgcgattttcgttcggtttcgcgttttcgtttcggtttcgtagttggcgtttttttattttcgtttttgttttcgtttttttcgcgtcgttggtagtcgtagttttcggatcgggaggaatgagcgagttatgaggttgttgcggcgttgggcgttcgcggttttgttgttgtcgttgttttttacgttcggtgagtgattttcgttcggtttcggcgttttttttttgttttcgtttcgggatgtgcggcgtttgttgttgtagttatttttttttgtagtgttcggggtgatagtcggttcggagcgcgggagggtaggggagcgggagaggagggaaggtgcgtttatttattt

SEQ ID NO: 21958 - DNA, 730 bp, Artificial Sequence
  chemically treated genomic DNA (Homo sapiens) CpG-island No: 21958
aaataaataaacgcaccttccctcctctcccgctcccctaccctcccgcgctccgaaccgactatcaccccgaacactacaaaaaaaaataactacaacaacaaacgccgcacatcccgaaacgaaaacaaaaaaaaaacgccgaaaccgaacgaaaatcactcaccgaacgtaaaaaacaacgacaacaacaaaaccgcgaacgcccaacgccgcaacaacctcataactcgctcattcctcccgatccgaaaactacgactaccaacgacgcgaaaaaaacgaaaacaaaaacgaaaataaaaaaacgccaactacgaaaccgaaacgaaaacgcgaaaccgaacgaaaatcgcgaaaaaataaaaacgacaaaaacgacgccgaaactcaacgcgctccgaccgcgaccatcccgacgaaacgacgaaaccgaattaaaaactaaacaacgaacacgtaaacccaaaacccgccctccgctctcccgccgccccccgacccccccaaccccgcaaaacccgaaccgccgccgcgacaaaacaaaaaaaacgccgccccgaaatccctcctcgcacctcgaaatctcctcgacaaatacgaaacgataacgctccgcgtacttatcccgcgacctctcctcgaccacctctacctaaacatctccgaaaactcgtaaatttataaaaaaaaaaaacaaaaaacgaaatacccccgaaatcgacccgac

SEQ ID NO: 21959 - DNA, 730 bp, Artificial Sequence
  chemically treated genomic DNA (Homo sapiens) CpG-island No: 21959
aggtgggtggacgtatttttttttttttttcgtttttttattttttcgcgtttcggatcggttgttatttcgagtattgtaggaaaaggtggttgtagtagtaagcgtcgtatatttcggggcgggggtagggagggggcgtcggggtcgggcgggggttatttatcgggcgtggggagtagcgatagtagtagagtcgcgaacgtttagcgtcgtagtagttttatggttcgtttatttttttcggttcgggggttgcggttgttagcggcgcggggagggcgggagtagggacgggggtggggaggcgttagttgcggagtcggggcgggggcgcggggtcgggcgggggtcgcggagaggtgggggcggtagggacggcgtcggggtttagcgcgtttcggtcgcggttatttcggcggggcggcggggtcgggttaagagttgagtagcgagtacgtgagtttagggttcgtttttcgttttttcgtcgtttttcggtttttttagtttcgtagggttcgggtcgtcgtcgcggtaggataaaagaggcgtcgtttcggggttttttttcgtatttcgaagttttttcggtaggtgcggggcggtggcgtttcgcgtatttatttcgcggttttttttcggttatttttgtttgagtattttcgaggattcgtagatttgtaggggagggaagtaggggacggggtattttcggggtcgattcggt

SEQ ID NO: 21960 - DNA, 730 bp, Artificial Sequence
  chemically treated genomic DNA (Homo sapiens) CpG-island No: 21960
accgaatcgaccccgaaaataccccgtcccctacttccctcccctacaaatctacgaatcctcgaaaatactcaaacaaaaataaccgaaaaaaaaccgcgaaataaatacgcgaaacgccaccgccccgcacctaccgaaaaaacttcgaaatacgaaaaaaaaccccgaaacgacgcctcttttatcctaccgcgacgacgacccgaaccctacgaaactaaaaaaaccgaaaaacgacgaaaaaacgaaaaacgaaccctaaactcacgtactcgctactcaactcttaacccgaccccgccgccccgccgaaataaccgcgaccgaaacgcgctaaaccccgacgccgtccctaccgcccccacctctccgcgacccccgcccgaccccgcgcccccgccccgactccgcaactaacgcctccccacccccgtccctactcccgccctccccgcgccgctaacaaccgcaacccccgaaccgaaaaaaataaacgaaccataaaactactacgacgctaaacgttcgcgactctactactatcgctactccccacgcccgataaataacccccgcccgaccccgacgccccctccctacccccgccccgaaatatacgacgcttactactacaaccaccttttcctacaatactcgaaataacaaccgatccgaaacgcgaaaaaataaaaaaacgaaaaaaaaaaaaaaatacgtccacccacct

SEQ ID NO: 21961 - DNA, 1292 bp, Artificial Sequence
  chemically treated genomic DNA (Homo sapiens) CpG-island No: 21961
ttagttttcgaacgaatttttttttaattttcgggaggtaggagttttagcggggagatgcgggaagttttagacgagttcgtacgtcgtcggagacgtagggatcgaggtcggggagataaagagtagttcgcgaagagttcgggcggcgaggggcggttcggtttcgttttgcgtttttaatcgttcgggtagttgtcggtatcgtcggggcgtcgtcgagtgcgcgtcgtttttgttcgggtttttcgatcgtcgttcgatattttcgcggtttaggatattttcgagtcgtttttttttcgatttgggagtcgcgcgtttggggataaagagggagggtgcgtcggggatagtggtaggacgcgggtcggcgacgttttttcggattcggcgggaatttttcggcggcgtttttttttttttttcgttttggtcgcgttttttttcggattttcggaggtttttttcggttttttttcgggttttttaagagttttttcgtttttttttgggatttcgtttttggttcgtttttttttagtcggttttgcggtcgttttttattcggcggcgggttttttcggagtcgtttttttcgtcgggtttcggttcgtttcgtcggtcgcggttttatgtgtttcgcgtcgttatcgtttttattttcgttttttttttatttttttcgtcgttgtcgttttcgttttagtttttagtcgaggtagaagtcgttttcgtcgttgtcgtcgtcgtcgtcgtttttcgttttcgtcgtcgcgattcgcgggaaggcgtttgcgtattgcgcgttgcggtgggggcgggggcgtttcgtcgcggttcgggagcggggggcgcgcggtacgtggcgttcgagtgggaggggggcgttttagaacgcgcgggaagcgacgcgagcgttaatttttcgcggtcgagttttcgtcgttttttcggatagttcgggacgcggcggaggcgcggcgcgcgtgggagttattcgcgtggagtttggatttcgggtgggcgtagatttcgtttcggatagtttatttttttaagttgattttcgggcgagagtttttcgttagtcgcgttttagtttgagcgggtcgttaacggcgtcgtgggttttcgttttatttgggtattttgggttggtttagcgggtttagagttgttttttgcgcgtttcgtcgaggttttggtttattgtagtacgggatgttaatgtttttttttaggttttgttttataatttttcgaggatttggcgggttttgcgtggattt

SEQ ID NO: 21962 - DNA, 1292 bp, Artificial Sequence
  chemically treated genomic DNA (Homo sapiens) CpG-island No: 21962
aaatccacgcaaaacccgccaaatcctcgaaaaattataaaacaaaacctaaaaaaaaacattaacatcccgtactacaataaaccaaaacctcgacgaaacgcgcaaaaaacaactctaaacccgctaaaccaacccaaaatacccaaataaaacgaaaacccacgacgccgttaacgacccgctcaaactaaaacgcgactaacgaaaaactctcgcccgaaaatcaacttaaaaaaataaactatccgaaacgaaatctacgcccacccgaaatccaaactccacgcgaataactcccacgcgcgccgcgcctccgccgcgtcccgaactatccgaaaaaacgacgaaaactcgaccgcgaaaaattaacgctcgcgtcgcttcccgcgcgttctaaaacgcccccctcccactcgaacgccacgtaccgcgcgccccccgctcccgaaccgcgacgaaacgcccccgcccccaccgcaacgcgcaatacgcaaacgccttcccgcgaatcgcgacgacgaaaacgaaaaacgacgacgacgacgacaacgacgaaaacgacttctacctcgactaaaaactaaaacgaaaacgacaacgacgaaaaaaataaaaaaaaaacgaaaataaaaacgataacgacgcgaaacacataaaaccgcgaccgacgaaacgaaccgaaacccgacgaaaaaaacgactccgaaaaaacccgccgccgaataaaaaacgaccgcaaaaccgactaaaaaaaaacgaaccaaaaacgaaatcccaaaaaaaaacgaaaaaactcttaaaaaacccgaaaaaaaaccgaaaaaaacctccgaaaatccgaaaaaaaacgcgaccaaaacgaaaaaaaaaaaaaaacgccgccgaaaaattcccgccgaatccgaaaaaacgtcgccgacccgcgtcctaccactatccccgacgcaccctccctctttatccccaaacgcgcgactcccaaatcgaaaaaaaaacgactcgaaaatatcctaaaccgcgaaaatatcgaacgacgatcgaaaaacccgaacaaaaacgacgcgcactcgacgacgccccgacgataccgacaactacccgaacgattaaaaacgcaaaacgaaaccgaaccgcccctcgccgcccgaactcttcgcgaactactctttatctccccgacctcgatccctacgtctccgacgacgtacgaactcgtctaaaacttcccgcatctccccgctaaaactcctacctcccgaaaattaaaaaaaaattcgttcgaaaactaa

SEQ ID NO: 21963 - DNA, 1292 bp, Artificial Sequence
  chemically treated genomic DNA (Homo sapiens) CpG-island No: 21963
agatttacgtagggttcgttagattttcgaggaattgtagagtagaatttgggaggagatattagtatttcgtgttataatggattaaggtttcggcggagcgcgtagaagataattttgggttcgttaaattaatttaggatatttaggtaaggcgagaatttacggcgtcgttagcggttcgtttaaattgaggcgcggttggcgggggattttcgttcgaaaattagtttggaagaatgaattgttcggagcgaagtttgcgtttattcggggtttagattttacgcgggtgatttttacgcgcgtcgcgttttcgtcgcgtttcggattattcgagagagcggcgaggattcgatcgcggaaagttggcgttcgcgtcgtttttcgcgcgttttggggcgttttttttttattcgagcgttacgtgtcgcgcgtttttcgttttcgggtcgcggcgggacgttttcgtttttatcgtagcgcgtagtgcgtaggcgttttttcgcgggtcgcggcggcgggagcgggaggcggcggcggcggcggtagcggcgggagcggtttttgtttcggttggagattgaggcgaaggcggtagcggcggaggaggtggaggagaggcgagggtgaaggcgatggcgacgcggggtatatgaggtcgcgatcggcgggacgggtcgaggttcggcggaggaggcggtttcgggggaattcgtcgtcgggtgaggggcggtcgtagggtcggttgaggagaagcgggttaggggcggggttttagggggaggcgggagaatttttggggagttcggggaggggtcgaggagaattttcggaggttcggggaggagcgcggttagagcgggagaaggaggggggcgtcgtcgaggggttttcgtcgagttcggaggggcgtcgtcggttcgcgttttgttattgttttcggcgtattttttttttttgtttttaggcgcgcggtttttaaatcgggagggaaacggttcgggggtgttttgggtcgcggaggtgtcgggcgacggtcggggagttcggatagaagcggcgcgtattcggcggcgtttcggcggtgtcgataattattcgggcggttaggggcgtagggcggagtcgggtcgtttttcgtcgttcgggtttttcgcgggttgttttttgttttttcgatttcgatttttgcgttttcggcggcgtgcgggttcgtttgaggtttttcgtattttttcgttggaatttttgtttttcgggggttagaggagggttcgttcgagggttgg

SEQ ID NO: 21964 - DNA, 1292 bp, Artificial Sequence
  chemically treated genomic DNA (Homo sapiens) CpG-island No: 21964
ccaaccctcgaacgaaccctcctctaacccccgaaaaacaaaaattccaacgaaaaaatacgaaaaacctcaaacgaacccgcacgccgccgaaaacgcaaaaatcgaaatcgaaaaaacaaaaaacaacccgcgaaaaacccgaacgacgaaaaacgacccgactccgccctacgcccctaaccgcccgaataattatcgacaccgccgaaacgccgccgaatacgcgccgcttctatccgaactccccgaccgtcgcccgacacctccgcgacccaaaacacccccgaaccgtttccctcccgatttaaaaaccgcgcgcctaaaaacaaaaaaaaaaaatacgccgaaaacaataacaaaacgcgaaccgacgacgcccctccgaactcgacgaaaacccctcgacgacgcccccctccttctcccgctctaaccgcgctcctccccgaacctccgaaaattctcctcgacccctccccgaactccccaaaaattctcccgcctccccctaaaaccccgcccctaacccgcttctcctcaaccgaccctacgaccgcccctcacccgacgacgaattcccccgaaaccgcctcctccgccgaacctcgacccgtcccgccgatcgcgacctcatataccccgcgtcgccatcgccttcaccctcgcctctcctccacctcctccgccgctaccgccttcgcctcaatctccaaccgaaacaaaaaccgctcccgccgctaccgccgccgccgccgcctcccgctcccgccgccgcgacccgcgaaaaaacgcctacgcactacgcgctacgataaaaacgaaaacgtcccgccgcgacccgaaaacgaaaaacgcgcgacacgtaacgctcgaataaaaaaaaaacgccccaaaacgcgcgaaaaacgacgcgaacgccaactttccgcgatcgaatcctcgccgctctctcgaataatccgaaacgcgacgaaaacgcgacgcgcgtaaaaatcacccgcgtaaaatctaaaccccgaataaacgcaaacttcgctccgaacaattcattcttccaaactaattttcgaacgaaaatcccccgccaaccgcgcctcaatttaaacgaaccgctaacgacgccgtaaattctcgccttacctaaatatcctaaattaatttaacgaacccaaaattatcttctacgcgctccgccgaaaccttaatccattataacacgaaatactaatatctcctcccaaattctactctacaattcctcgaaaatctaacgaaccctacgtaaatct

SEQ ID NO: 21965 - DNA, 1047 bp, Artificial Sequence
  chemically treated genomic DNA (Homo sapiens) CpG-island No: 21965
tttcgtcgtttcggtttcgggtaggcgacgagagcgtttttttttagtcgtcgtcgtcgtcgtcgtcgtcgtttcgggtttaacggtcggttttttttcgtttttcggtttcggtcgtcgtcgtcgtttttttttttggttcgttcgttttttttttttgtcggttgcgttttcggttcggttttttttcgtttcgggtttcgtacggcgtttatatttcgggcggggaaggcgtttcgttttcgttttcggaggtcggtcgtcgtcgtcgtttcggttttatttacgtcgcgttcgggtcgcgtcgtttcgttcgcgtcgtcgcgtttacgttttttgtcgtatttttcgttttttgtcgtcgtcgttgtttcgcgggtcggcgggcggcgagggggtttcgggggtcgggcgtacgggtttcgggcgcggaggaggttttttgttgtttttgtttttcgttcgttttttaaattttttagtttcgggtcgttcgtatttcgtcgtttaggcggggggattaggaggttaatttcggtcggcggcgtgcgttttttttttttcgtcgttcgcggttatttgggagttgtcggttttcgtattaaggacgtcgcggtcgttcggtcggagcgcggttcggcgtagatttcgggcgagtaggcgggtcgtgcgtttggtagcgttcgggtcggtttcggtttcgtcgttttgtagcgcgtttttttcgtcgttttcgttttttcgcgttcgcgtaatggtacgggtttgcgttgtcggaattgtggagtcgttgttttggaaatcgagttcggtttggtttcgtggtttttgatttttaattttgtgggcgttacgggggagcggtagttgttagtagagcgtttttttattcggtttttttttattcggtagttcgttattgagtcgttttttttttgggttacgttttagtttcgttttttttttttttttgttgttgaagtttgcgtagtttttttttatagtttatttttgtaattcgttatttttattttatatttttttttt

SEQ ID NO: 21966 - DNA, 1047 bp, Artificial Sequence
  chemically treated genomic DNA (Homo sapiens) CpG-island No: 21966
aaaaaaaaaatataaaataaaaataacgaattacaaaaataaactataaaaaaaaactacgcaaacttcaacaacaaaaaaaaaaaaaaaacgaaactaaaacgtaacccaaaaaaaaaacgactcaataacgaactaccgaataaaaaaaaaccgaataaaaaaacgctctactaacaactaccgctcccccgtaacgcccacaaaattaaaaatcaaaaaccacgaaaccaaaccgaactcgatttccaaaacaacgactccacaattccgacaacgcaaacccgtaccattacgcgaacgcgaaaaaacgaaaacgacgaaaaaaacgcgctacaaaacgacgaaaccgaaaccgacccgaacgctaccaaacgcacgacccgcctactcgcccgaaatctacgccgaaccgcgctccgaccgaacgaccgcgacgtccttaatacgaaaaccgacaactcccaaataaccgcgaacgacgaaaaaaaaaaaacgcacgccgccgaccgaaattaacctcctaatccccccgcctaaacgacgaaatacgaacgacccgaaactaaaaaatttaaaaaacgaacgaaaaacaaaaacaacaaaaaacctcctccgcgcccgaaacccgtacgcccgacccccgaaaccccctcgccgcccgccgacccgcgaaacaacgacgacgacaaaaaacgaaaaatacgacaaaaaacgtaaacgcgacgacgcgaacgaaacgacgcgacccgaacgcgacgtaaataaaaccgaaacgacgacgacgaccgacctccgaaaacgaaaacgaaacgccttccccgcccgaaatataaacgccgtacgaaacccgaaacgaaaaaaaaccgaaccgaaaacgcaaccgacaaaaaaaaaaaacgaacgaaccaaaaaaaaaaacgacgacgacgaccgaaaccgaaaaacgaaaaaaaaccgaccgttaaacccgaaacgacgacgacgacgacgacgacgactaaaaaaaaacgctctcgtcgcctacccgaaaccgaaacgacgaaa

SEQ ID NO: 21967 - DNA, 1047 bp, Artificial Sequence
  chemically treated genomic DNA (Homo sapiens) CpG-island No: 21967
gggagaggggtgtgaaataagggtaacgaattgtaggggtaaattgtgggaaggggttgcgtagattttaatagtaaagaaaaagaaggaacggggttggggcgtggtttagagagggaacggtttaataacgggttatcgggtgaaaagaagtcgggtggggaggcgttttgttgatagttgtcgttttttcgtggcgtttatagggttaaaaattaggggttacgggattaggtcgaattcggtttttagggtaacggttttatagtttcggtagcgtaggttcgtattattgcgcgggcgcgggggagcgggagcggcggaggggacgcgttgtagggcggcggagtcggggtcggttcgggcgttattaaacgtacggttcgtttgttcgttcggggtttgcgtcgagtcgcgtttcggtcggacggtcgcggcgtttttggtgcgggggtcggtagtttttaagtggtcgcggacggcgggggagaaggaacgtacgtcgtcggtcgggattggttttttggttttttcgtttgggcggcggagtgcgggcggttcggggttgggaggtttgaaaagcgggcgagagataaaggtagtaggaagtttttttcgcgttcggagttcgtgcgttcggttttcggggttttttcgtcgttcgtcggttcgcggagtagcggcggcggtaggaggcggaggatgcggtagggggcgtgggcgcggcggcgcgggcggagcggcgcggttcgggcgcggcgtgggtagagtcgaggcggcggcggcggtcggttttcgggagcgagagcgaggcgtttttttcgttcgggatgtgagcgtcgtgcggagttcggggcgggggagggtcgggtcggaggcgtagtcggtaggaaggaaggacggacggattaggaggaggagcggcggcggcggtcggagtcggaaggcggggaggggtcggtcgttgggttcgaggcggcggcggcggcggcggcggcggttggggagaagcgttttcgtcgtttgttcgaggtcggagcggcgggg

SEQ ID NO: 21968 - DNA, 1047 bp, Artificial Sequence
  chemically treated genomic DNA (Homo sapiens) CpG-island No: 21968
ccccgccgctccgacctcgaacaaacgacgaaaacgcttctccccaaccgccgccgccgccgccgccgccgcctcgaacccaacgaccgacccctccccgccttccgactccgaccgccgccgccgctcctcctcctaatccgtccgtccttccttcctaccgactacgcctccgacccgaccctcccccgccccgaactccgcacgacgctcacatcccgaacgaaaaaaacgcctcgctctcgctcccgaaaaccgaccgccgccgccgcctcgactctacccacgccgcgcccgaaccgcgccgctccgcccgcgccgccgcgcccacgccccctaccgcatcctccgcctcctaccgccgccgctactccgcgaaccgacgaacgacgaaaaaaccccgaaaaccgaacgcacgaactccgaacgcgaaaaaaacttcctactacctttatctctcgcccgcttttcaaacctcccaaccccgaaccgcccgcactccgccgcccaaacgaaaaaaccaaaaaaccaatcccgaccgacgacgtacgttccttctcccccgccgtccgcgaccacttaaaaactaccgacccccgcaccaaaaacgccgcgaccgtccgaccgaaacgcgactcgacgcaaaccccgaacgaacaaacgaaccgtacgtttaataacgcccgaaccgaccccgactccgccgccctacaacgcgtcccctccgccgctcccgctcccccgcgcccgcgcaataatacgaacctacgctaccgaaactataaaaccgttaccctaaaaaccgaattcgacctaatcccgtaacccctaatttttaaccctataaacgccacgaaaaaacgacaactatcaacaaaacgcctccccacccgacttcttttcacccgataacccgttattaaaccgttccctctctaaaccacgccccaaccccgttccttctttttctttactattaaaatctacgcaaccccttcccacaatttacccctacaattcgttacccttatttcacacccctctccc

SEQ ID NO: 21969 - DNA, 860 bp, Artificial Sequence
  chemically treated genomic DNA (Homo sapiens) CpG-island No: 21969
tttttcgtcgcgaaaggcgaggcgaggggaatagcgggcgtcggattttttcgatagcggtcgtaaggagggcggttttaggtttttatacggtcgatttttaggttaaggcgcgtcgggcggtaggttagagttaggaattaagttgcgggtcgggtcgagagcgcgttttttcgttcgcgttagggatattcgttttttagtttttattttttttcgattttaagttttttttttgcgtttaggaaacggcgtttatattttagagatttttattcggagttcgtcgtcgttttatcgcgtgtttcggattttttgggagttatcgttgaggggaggggggaggaggggggaacggaggagggagggggttaagttcggtgtagtcgtcgtcgttgtcgtcgtcgcgatgtcgtttttggaatcgcgttttcgtcgtcgcgatagcgatcgtcgtcgtcgcgttttttcgtttttacgatcgtacgtcgtcgtgacgcgtatcgtacgaggcggttcgagttaataagattatacgtcgtgcgtagtcgcgttgttttaaatcggaagtcgtttttttgatcgttttaaaatttgggtgtatcgtgggagttgtggttcggttaggaatttagcgaaaattatattgggtgttgagggtcggaggagcgtgcgttttttaggcgtttatataatttttcggagtttttttttttatcgaaaaaggaagtaatttggagttgaggaggagggggtcgtttcggttcgcggatgtttttcgtagtttttatggatattggttatatattttgggtaagagttagaatttgaggatttaggttggatcgtgtgtttttgtt

SEQ ID NO: 21970 - DNA, 860 bp, Artificial Sequence
  chemically treated genomic DNA (Homo sapiens) CpG-island No: 21970
aacaaaaacacacgatccaacctaaatcctcaaattctaactcttacccaaaatatataaccaatatccataaaaactacgaaaaacatccgcgaaccgaaacgaccccctcctcctcaactccaaattacttcctttttcgataaaaaaaaaaactccgaaaaattatataaacgcctaaaaaacgcacgctcctccgaccctcaacacccaatataattttcgctaaattcctaaccgaaccacaactcccacgatacacccaaattttaaaacgatcaaaaaaacgacttccgatttaaaacaacgcgactacgcacgacgtataatcttattaactcgaaccgcctcgtacgatacgcgtcacgacgacgtacgatcgtaaaaacgaaaaaacgcgacgacgacgatcgctatcgcgacgacgaaaacgcgattccaaaaacgacatcgcgacgacgacaacgacgacgactacaccgaacttaaccccctccctcctccgttcccccctcctcccccctcccctcaacgataactcccaaaaaatccgaaacacgcgataaaacgacgacgaactccgaataaaaatctctaaaatataaacgccgtttcctaaacgcaaaaaaaaaacttaaaatcgaaaaaaaataaaaactaaaaaacgaatatccctaacgcgaacgaaaaaacgcgctctcgacccgacccgcaacttaattcctaactctaacctaccgcccgacgcgccttaacctaaaaatcgaccgtataaaaacctaaaaccgccctccttacgaccgctatcgaaaaaatccgacgcccgctattcccctcgcctcgcctttcgcgacgaaaaa

SEQ ID NO: 21971 - DNA, 860 bp, Artificial Sequence
  chemically treated genomic DNA (Homo sapiens) CpG-island No: 21971
ggtagagatatacgatttagtttaaatttttaaattttggtttttgtttaaagtgtgtagttagtatttatagagattgcgaaaagtattcgcgagtcggggcggtttttttttttttagttttaaattgttttttttttcggtgggagaaaaaatttcgaggagttgtgtgagcgtttaaggagcgtacgttttttcggtttttaatatttagtatagttttcgttaagtttttggtcgaattatagtttttacgatgtatttaggttttagagcggttagaggggcggttttcggtttaggatagcgcggttgcgtacggcgtgtggttttattggttcgaatcgtttcgtgcgatgcgcgttacggcgacgtgcggtcgtgggggcggggagacgcggcggcggcggtcgttgtcgcggcggcgagagcgcgattttagaagcggtatcgcggcggcggtagcggcggcggttatatcgggtttggttttttttttttttcgtttttttttttttttttttttttttagcggtggtttttaagaagttcgagatacgcggtgaggcggcgacgggtttcgggtgagggtttttggagtgtgggcgtcgttttttgggcgtagagggagagtttggggtcggggggaggtgagagttgaggggcgaatgtttttggcgcgggcgggagagcgcgttttcggttcggttcgtaatttgatttttaattttgatttgtcgttcggcgcgttttggtttgagggtcggtcgtgtggggatttggagtcgttttttttgcgatcgttgtcggaggagttcggcgttcgttgtttttttcgtttcgtttttcgcggcggaggg

SEQ ID NO: 21972 - DNA, 860 bp, Artificial Sequence
  chemically treated genomic DNA (Homo sapiens) CpG-island No: 21972
ccctccgccgcgaaaaacgaaacgaaaaaaacaacgaacgccgaactcctccgacaacgatcgcaaaaaaaacgactccaaatccccacacgaccgaccctcaaaccaaaacgcgccgaacgacaaatcaaaattaaaaatcaaattacgaaccgaaccgaaaacgcgctctcccgcccgcgccaaaaacattcgcccctcaactctcacctccccccgaccccaaactctccctctacgcccaaaaaacgacgcccacactccaaaaaccctcacccgaaacccgtcgccgcctcaccgcgtatctcgaacttcttaaaaaccaccgctaaaaaaaaaaaaaaaaaaaaaaaaacgaaaaaaaaaaaaaaccaaacccgatataaccgccgccgctaccgccgccgcgataccgcttctaaaatcgcgctctcgccgccgcgacaacgaccgccgccgccgcgtctccccgcccccacgaccgcacgtcgccgtaacgcgcatcgcacgaaacgattcgaaccaataaaaccacacgccgtacgcaaccgcgctatcctaaaccgaaaaccgcccctctaaccgctctaaaacctaaatacatcgtaaaaactataattcgaccaaaaacttaacgaaaactatactaaatattaaaaaccgaaaaaacgtacgctccttaaacgctcacacaactcctcgaaattttttctcccaccgaaaaaaaaaacaatttaaaactaaaaaaaaaaaaaccgccccgactcgcgaatacttttcgcaatctctataaatactaactacacactttaaacaaaaaccaaaatttaaaaatttaaactaaatcgtatatctctacc

SEQ ID NO: 21973 - DNA, 540 bp, Artificial Sequence
  chemically treated genomic DNA (Homo sapiens) CpG-island No: 21973
tgcgtagggaggtcgcgattcggcgtcggcgcgaattttcgcgatgtgattcgtgagggaattttttaagaagtagcgtatttcgcgcgtaaaggcggtttttcgaattgtaggaataaacgttttttgttggggggaagacggagatttttatatcgcgggagattaatttgtgagtaatagaagtattacgttataaagagtatgacgagtttttttaggtttgggaaagtacgggtaaatgttcgcggttttgcgcgttagcggggagtagtagagattttcggcgtcggttgttcgtagggttagagcgtcgaatcgggataatcggaggttttagtttatttcggattgtaaatgttaatacgggtttttcggtcggttgatttagaatttaggtcgtcgggacgtgtggtttttgttttttagacgttcggattcgcgtcgggaagggtttcgttttttttggttttcgttttttttttttttttttgcgttcggttattgtaaatgtatttagtttagtagtattagtttagg

SEQ ID NO: 21974 - DNA, 540 bp, Artificial Sequence
  chemically treated genomic DNA (Homo sapiens) CpG-island No: 21974
cctaaactaatactactaaactaaatacatttacaataaccgaacgcaaaaaaaaaaaaaaaaaacgaaaaccaaaaaaaacgaaacccttcccgacgcgaatccgaacgtctaaaaaacaaaaaccacacgtcccgacgacctaaattctaaatcaaccgaccgaaaaacccgtattaacatttacaatccgaaataaactaaaacctccgattatcccgattcgacgctctaaccctacgaacaaccgacgccgaaaatctctactactccccgctaacgcgcaaaaccgcgaacatttacccgtactttcccaaacctaaaaaaactcgtcatactctttataacgtaatacttctattactcacaaattaatctcccgcgatataaaaatctccgtcttccccccaacaaaaaacgtttattcctacaattcgaaaaaccgcctttacgcgcgaaatacgctacttcttaaaaaattccctcacgaatcacatcgcgaaaattcgcgccgacgccgaatcgcgacctccctacgca

SEQ ID NO: 21975 - DNA, 540 bp, Artificial Sequence
  chemically treated genomic DNA (Homo sapiens) CpG-island No: 21975
tttgggttagtgttattggattgaatgtatttgtaataatcggacgtagaaaaaaaaaaaaaaagcggggattaggggaggcgaaatttttttcggcgcgagttcgagcgtttgagaagtagaagttatacgtttcggcgatttaagttttggattagtcggtcggaggattcgtgttagtatttataattcgaggtgagttgaagttttcggttgtttcggttcgacgttttagttttgcgagtagtcgacgtcggaagtttttattgtttttcgttggcgcgtaggatcgcgggtatttattcgtgtttttttaagtttggaagaattcgttatgttttttgtagcgtggtgtttttgttgtttataggttagtttttcgcggtataagagttttcgttttttttttagtaagaagcgtttgtttttgtaattcggggggtcgtttttgcgcgcggggtgcgttgttttttggagagtttttttacgggttatatcgcggaggttcgcgtcggcgtcgggtcgcggtttttttgcgta

SEQ ID NO: 21976 - DNA, 540 bp, Artificial Sequence
  chemically treated genomic DNA (Homo sapiens) CpG-island No: 21976
tacgcaaaaaaaccgcgacccgacgccgacgcgaacctccgcgatataacccgtaaaaaaactctccaaaaaacaacgcaccccgcgcgcaaaaacgaccccccgaattacaaaaacaaacgcttcttactaaaaaaaaaacgaaaactcttataccgcgaaaaactaacctataaacaacaaaaacaccacgctacaaaaaacataacgaattcttccaaacttaaaaaaacacgaataaatacccgcgatcctacgcgccaacgaaaaacaataaaaacttccgacgtcgactactcgcaaaactaaaacgtcgaaccgaaacaaccgaaaacttcaactcacctcgaattataaatactaacacgaatcctccgaccgactaatccaaaacttaaatcgccgaaacgtataacttctacttctcaaacgctcgaactcgcgccgaaaaaaatttcgcctcccctaatccccgctttttttttttttttctacgtccgattattacaaatacattcaatccaataacactaacccaaa

SEQ ID NO: 21977 - DNA, 570 bp, Artificial Sequence
  chemically treated genomic DNA (Homo sapiens) CpG-island No: 21977
tattagcgcgcgggtttcgcgtttcgtttagttcgggattcgcggtcggcgggggaggggcggggcggagcggcgatcgttattcgcggttagttatcgcgtttcgaagcgtattgggtaggtttttattatagcggagagggaggtaggggggaggtggcgttcgattcgacgcggggtaggaaggcggaggtagcggcgtaggcggcggcgatagtcgcgggggatttcggcgggagtttataacgcgttgggttgtatgggcgtcgttatagtggggacgtagcggcgggcggagcgcgcggtcgcgattcggtcgggcgtttgcgattaatgggttcgcggaagtcgggcggagcgagggtttggttaatgcggagttgcgttgtttcgagtagtttaatagacgtaggagtcgcggatttgtcgtttcgtttatttcgtttattacgagagtagtgttgcggcgagtgcggggcgagaggttcgcgttggtggagtattttagtttgtaggtttagcgtgggtgtttttttcgggtatatcgagttgtttagaggaatttttttt

SEQ ID NO: 21978 - DNA, 570 bp, Artificial Sequence
  chemically treated genomic DNA (Homo sapiens) CpG-island No: 21978
aaaaaaaattcctctaaacaactcgatatacccgaaaaaaacacccacgctaaacctacaaactaaaatactccaccaacgcgaacctctcgccccgcactcgccgcaacactactctcgtaataaacgaaataaacgaaacgacaaatccgcgactcctacgtctattaaactactcgaaacaacgcaactccgcattaaccaaaccctcgctccgcccgacttccgcgaacccattaatcgcaaacgcccgaccgaatcgcgaccgcgcgctccgcccgccgctacgtccccactataacgacgcccatacaacccaacgcgttataaactcccgccgaaatcccccgcgactatcgccgccgcctacgccgctacctccgccttcctaccccgcgtcgaatcgaacgccacctcccccctacctccctctccgctataataaaaacctacccaatacgcttcgaaacgcgataactaaccgcgaataacgatcgccgctccgccccgcccctcccccgccgaccgcgaatcccgaactaaacgaaacgcgaaacccgcgcgctaata

SEQ ID NO: 21979 - DNA, 570 bp, Artificial Sequence
  chemically treated genomic DNA (Homo sapiens) CpG-island No: 21979
gaagagggtttttttagatagttcgatgtgttcgggagagatatttacgttgaatttgtaagttggggtgttttattagcgcgaatttttcgtttcgtattcgtcgtagtattgttttcgtggtaggcggggtgggcgggacggtaaattcgcggtttttgcgtttattgggttgttcggggtagcgtagtttcgtattggttaggttttcgtttcgttcggttttcgcgagtttattggtcgtaggcgttcgatcgggtcgcggtcgcgcgtttcgttcgtcgttgcgtttttattatggcggcgtttatgtagtttagcgcgttgtgggttttcgtcggggtttttcgcggttgtcgtcgtcgtttacgtcgttgttttcgtttttttgtttcgcgtcgggtcgggcgttattttttttttgttttttttttcgttgtggtaagggtttgtttagtgcgtttcggggcgcgatggttgatcgcgaataacggtcgtcgtttcgtttcgtttttttttcgtcggtcgcgggtttcgggttgggcggggcgcggagttcgcgcgttagtg

SEQ ID NO: 21980 - DNA, 570 bp, Artificial Sequence
  chemically treated genomic DNA (Homo sapiens) CpG-island No: 21980
cactaacgcgcgaactccgcgccccgcccaacccgaaacccgcgaccgacgaaaaaaaaacgaaacgaaacgacgaccgttattcgcgatcaaccatcgcgccccgaaacgcactaaacaaacccttaccacaacgaaaaaaaaaacaaaaaaaaaataacgcccgacccgacgcgaaacaaaaaaacgaaaacaacgacgtaaacgacgacgacaaccgcgaaaaaccccgacgaaaacccacaacgcgctaaactacataaacgccgccataataaaaacgcaacgacgaacgaaacgcgcgaccgcgacccgatcgaacgcctacgaccaataaactcgcgaaaaccgaacgaaacgaaaacctaaccaatacgaaactacgctaccccgaacaacccaataaacgcaaaaaccgcgaatttaccgtcccgcccaccccgcctaccacgaaaacaatactacgacgaatacgaaacgaaaaattcgcgctaataaaacaccccaacttacaaattcaacgtaaatatctctcccgaacacatcgaactatctaaaaaaaccctcttc

SEQ ID NO: 21981 - DNA, 1216 bp, Artificial Sequence
  chemically treated genomic DNA (Homo sapiens) CpG-island No: 21981
gttcgaacgttgaacgtttttaatatattgttttttagatacgtttaagcgggtatttcgggtcgtttattttggatcgcggtcggttacgtataagtagcgtcgtaggttgtttggagtcgggtcgtgttttgatttttttttttttagttttatatgcggcggatttcggggaagttagggttaggcgaagcgtagcgggttttttgggttgtagcgaggagacgtaagttttttcgtaaagtcgcggggaggaggtgttgagaatgtttgttcggcgttttaattcggagttaagggtatcgggttcgggtcgaggggtcgcgttcgtttggtttcgtcggggtcgttcggggttttgaatttaagaacggcgtttgtaggatttcggagtcgggcgcgagttgcgggttcggttcgagcgtttttgcgtggcgtttcgcgtgttaatcgggttatttcggtttttatcgtagatttcggttacgagtttcggcgttttagttttttttcgagttttggttttggtcggggtagttttgtcgagttttggtttagcggtttttttttcgcgggtaaatttggttttttcggcgcgggtagtaaggataagtaagcgttcgcgtcgggttttgtagtaagatgcggggtcgcgggcgttaggattttagtggggtgtagcgggatcggttggtggcggcgttagcgatatggtatttttttcgcgttcgttgggagttgcgttcgcgtatttgagacggtcggggtcgaggggaagattaggtggtcggatttgggcgggagggagggagtatttcgtggcggcggcggcgatttcgtttcgcgtttttcggttggtttttcgggttgtcggcgggtttcgggttcgttggaggttgttgaggttttagttttttgagtcgtcgttgttcgttgttgtgttatcgtcgtcgcggttgttttatttttgtcgtcgggatcggagttcgtgacgttattttttgggtttcgtttgtttaatcgtcgttatttgtgcgcgtcgttcgttcgttagtcggttagattcgcgcggcggttacggtaggtgcgcggagtaggcgggcgcgtacgcggggcgcgatgatttcggagcgttggggttatttagggttcggagggaggagggttagcgtagcgtttttgtttttggttagcgtggagttcggtaagtgatagt

SEQ ID NO: 21982 - DNA, 1216 bp, Artificial Sequence
  chemically treated genomic DNA (Homo sapiens) CpG-island No: 21982
actatcacttaccgaactccacgctaaccaaaaacaaaaacgctacgctaaccctcctccctccgaaccctaaataaccccaacgctccgaaatcatcgcgccccgcgtacgcgcccgcctactccgcgcacctaccgtaaccgccgcgcgaatctaaccgactaacgaacgaacgacgcgcacaaataacgacgattaaacaaacgaaacccaaaaaataacgtcacgaactccgatcccgacgacaaaaataaaacaaccgcgacgacgataacacaacaacgaacaacgacgactcaaaaaactaaaacctcaacaacctccaacgaacccgaaacccgccgacaacccgaaaaaccaaccgaaaaacgcgaaacgaaatcgccgccgccgccacgaaatactccctccctcccgcccaaatccgaccacctaatcttcccctcgaccccgaccgtctcaaatacgcgaacgcaactcccaacgaacgcgaaaaaaataccatatcgctaacgccgccaccaaccgatcccgctacaccccactaaaatcctaacgcccgcgaccccgcatcttactacaaaacccgacgcgaacgcttacttatccttactacccgcgccgaaaaaaccaaatttacccgcgaaaaaaaaaccgctaaaccaaaactcgacaaaactaccccgaccaaaaccaaaactcgaaaaaaaactaaaacgccgaaactcgtaaccgaaatctacgataaaaaccgaaataacccgattaacacgcgaaacgccacgcaaaaacgctcgaaccgaacccgcaactcgcgcccgactccgaaatcctacaaacgccgttcttaaattcaaaaccccgaacgaccccgacgaaaccaaacgaacgcgacccctcgacccgaacccgatacccttaactccgaattaaaacgccgaacaaacattctcaacacctcctccccgcgactttacgaaaaaacttacgtctcctcgctacaacccaaaaaacccgctacgcttcgcctaaccctaacttccccgaaatccgccgcatataaaactaaaaaaaaaaaaatcaaaacacgacccgactccaaacaacctacgacgctacttatacgtaaccgaccgcgatccaaaataaacgacccgaaatacccgcttaaacgtatctaaaaaacaatatattaaaaacgttcaacgttcgaac

SEQ ID NO: 21983 - DNA, 1216 bp, Artificial Sequence
  chemically treated genomic DNA (Homo sapiens) CpG-island No: 21983
gttgttatttgtcgagttttacgttagttagaggtaggagcgttacgttggttttttttttttcgggttttagatggttttagcgtttcggagttatcgcgtttcgcgtgcgcgttcgtttgtttcgcgtatttgtcgtggtcgtcgcgcgggtttgatcggttggcgggcgggcggcgcgtataggtggcggcgattgggtaggcggggtttagagggtgacgttacgggtttcggtttcggcggtagaaatagggtagtcgcggcggcggtggtatagtagcgggtagcggcggtttagggagttggagttttaatagtttttagcgagttcgggattcgtcgatagttcgagaaattagtcgaaggacgcggggcggggtcgtcgtcgtcgttacggggtgttttttttttttcgtttaagttcggttatttggtttttttttcggtttcggtcgttttaggtacgcgggcgtagtttttagcgggcgcggggagggtgttatgtcgttggcgtcgttattagtcggtttcgttgtattttattggggttttggcgttcgcggtttcgtattttgttgtagggttcggcgcgggcgtttgtttgtttttattgttcgcgtcgggaaagttaagtttgttcgcggggaagggatcgttgggttagggttcggtagggttatttcggttaaggttaggattcgaggagaggttgggacgtcgaggttcgtggtcggggtttacggtggggatcggagtgattcggttggtacgcggggcgttacgtagaagcgttcgggtcgagttcgtagttcgcgttcggtttcgaaattttgtaggcgtcgtttttgggtttaggatttcgagcggtttcggcggagttaggcgagcgcggtttttcggttcgggttcggtgtttttggtttcgggttggggcgtcgggtaggtatttttagtatttttttttcgcggttttgcggggaaatttgcgttttttcgttgtagtttaaagggttcgttgcgtttcgtttggttttggttttttcggggttcgtcgtatgtgaggttggggaggaaggaattagggtacgattcgattttaggtagtttgcggcgttgtttgtgcgtagtcggtcgcggtttagagtgagcggttcggggtattcgtttgaacgtgtttagggagtagtgtgttgggggcgtttagcgttcgggt

SEQ ID NO: 21984 - DNA, 1216 bp, Artificial Sequence
  chemically treated genomic DNA (Homo sapiens) CpG-island No: 21984
acccgaacgctaaacgcccccaacacactactccctaaacacgttcaaacgaataccccgaaccgctcactctaaaccgcgaccgactacgcacaaacaacgccgcaaactacctaaaatcgaatcgtaccctaattccttcctccccaacctcacatacgacgaaccccgaaaaaaccaaaaccaaacgaaacgcaacgaaccctttaaactacaacgaaaaaacgcaaatttccccgcaaaaccgcgaaaaaaaaatactaaaaatacctacccgacgccccaacccgaaaccaaaaacaccgaacccgaaccgaaaaaccgcgctcgcctaactccgccgaaaccgctcgaaatcctaaacccaaaaacgacgcctacaaaatttcgaaaccgaacgcgaactacgaactcgacccgaacgcttctacgtaacgccccgcgtaccaaccgaatcactccgatccccaccgtaaaccccgaccacgaacctcgacgtcccaacctctcctcgaatcctaaccttaaccgaaataaccctaccgaaccctaacccaacgatcccttccccgcgaacaaacttaactttcccgacgcgaacaataaaaacaaacaaacgcccgcgccgaaccctacaacaaaatacgaaaccgcgaacgccaaaaccccaataaaatacaacgaaaccgactaataacgacgccaacgacataacaccctccccgcgcccgctaaaaactacgcccgcgtacctaaaacgaccgaaaccgaaaaaaaaaccaaataaccgaacttaaacgaaaaaaaaaaaacaccccgtaacgacgacgacgaccccgccccgcgtccttcgactaatttctcgaactatcgacgaatcccgaactcgctaaaaactattaaaactccaactccctaaaccgccgctacccgctactataccaccgccgccgcgactaccctatttctaccgccgaaaccgaaacccgtaacgtcaccctctaaaccccgcctacccaatcgccgccacctatacgcgccgcccgcccgccaaccgatcaaacccgcgcgacgaccacgacaaatacgcgaaacaaacgaacgcgcacgcgaaacgcgataactccgaaacgctaaaaccatctaaaacccgaaaaaaaaaaaaccaacgtaacgctcctacctctaactaacgtaaaactcgacaaataacaac

SEQ ID NO: 21985 - DNA, 727 bp, Artificial Sequence
  chemically treated genomic DNA (Homo sapiens) CpG-island No: 21985
ggcgttcggaacggtagtttggggggcgtttcgttcggagttgtggttagggttggcgggtcgtgtgcggcgcgggatttagagtttaggagtagtagtttcggcgcggcggcgtaggagtcggcgtacgagtataggaatatatagagttagacgtagagtatggcgaagagtagcgcgagttttttttttatcggcggcgggggcggcggcggttgcggtaggagtcggtcggggatatcgaggtaagatttgtcgttatttaggcgttgttttatgcgttgttcgcgggcgcggttagggatatggtttagtatatggcgtgggtttcgtcgggtagtgagcgtagagagggtttttcggtacgttggacgttcgggtggttcggtttattgttttcgtgtgttcgcggtcgtcgttgttgttgttgtttttttttaggtggcggcggtagttgtagcggcggcggtttttgatatgttgttcggtaggagttgtaattggaacggaaagtcgggacggcggtaattgttgggcgagggtttgttttcggggcgcgacgacgcgttcggggttaggaggacgttgtattttcgcgttttggttattttagattgtgcgtatcgtcgtacgtcggggttgtttttttgtagttttaagaattgagtttcgagtagtttcggtattttttcgtagaggttgtagaggcgaattgcgtaggaagaga

SEQ ID NO: 21986 - DNA, 727 bp, Artificial Sequence
  chemically treated genomic DNA (Homo sapiens) CpG-island No: 21986
tctcttcctacgcaattcgcctctacaacctctacgaaaaaataccgaaactactcgaaactcaattcttaaaactacaaaaaaacaaccccgacgtacgacgatacgcacaatctaaaataaccaaaacgcgaaaatacaacgtcctcctaaccccgaacgcgtcgtcgcgccccgaaaacaaaccctcgcccaacaattaccgccgtcccgactttccgttccaattacaactcctaccgaacaacatatcaaaaaccgccgccgctacaactaccgccgccacctaaaaaaaaacaacaacaacaacgacgaccgcgaacacacgaaaacaataaaccgaaccacccgaacgtccaacgtaccgaaaaaccctctctacgctcactacccgacgaaacccacgccatatactaaaccatatccctaaccgcgcccgcgaacaacgcataaaacaacgcctaaataacgacaaatcttacctcgatatccccgaccgactcctaccgcaaccgccgccgcccccgccgccgataaaaaaaaaactcgcgctactcttcgccatactctacgtctaactctatatattcctatactcgtacgccgactcctacgccgccgcgccgaaactactactcctaaactctaaatcccgcgccgcacacgacccgccaaccctaaccacaactccgaacgaaacgccccccaaactaccgttccgaacgcc

SEQ ID NO: 21987 - DNA, 727 bp, Artificial Sequence
  chemically treated genomic DNA (Homo sapiens) CpG-island No: 21987
tttttttttgcgtagttcgtttttgtagtttttgcggggaagtgtcggggttgttcgaggtttagtttttaggattgtaaggaggtagtttcggcgtgcggcggtgcgtatagtttagagtggttagggcgcgagagtgtaacgtttttttggtttcgagcgcgtcgtcgcgtttcgggagtagattttcgtttagtagttatcgtcgtttcgatttttcgttttagttgtagtttttgtcgggtaatatgttaagagtcgtcgtcgttatagttgtcgtcgttatttggggaagagtagtagtagtagcggcggtcgcgggtatacgggggtaataaatcgagttattcgggcgtttagcgtgtcggggaattttttttgcgtttattgttcggcgggatttacgttatgtgttgagttatgtttttggtcgcgttcgcgggtagcgtatggggtagcgtttgagtggcggtagattttgtttcgatgttttcggtcggtttttatcgtagtcgtcgtcgttttcgtcgtcggtgaggaggaagttcgcgttgtttttcgttatgttttgcgtttggttttatatgtttttgtattcgtgcgtcggtttttgcgtcgtcgcgtcggggttgttgtttttgggttttgggtttcgcgtcgtatacgattcgttagttttggttatagtttcggacgggacgttttttaggttgtcgtttcgggcgtt

SEQ ID NO: 21988 - DNA, 727 bp, Artificial Sequence
  chemically treated genomic DNA (Homo sapiens) CpG-island No: 21988
aacgcccgaaacgacaacctaaaaaacgtcccgtccgaaactataaccaaaactaacgaatcgtatacgacgcgaaacccaaaacccaaaaacaacaaccccgacgcgacgacgcaaaaaccgacgcacgaatacaaaaacatataaaaccaaacgcaaaacataacgaaaaacaacgcgaacttcctcctcaccgacgacgaaaacgacgacgactacgataaaaaccgaccgaaaacatcgaaacaaaatctaccgccactcaaacgctaccccatacgctacccgcgaacgcgaccaaaaacataactcaacacataacgtaaatcccgccgaacaataaacgcaaaaaaaattccccgacacgctaaacgcccgaataactcgatttattacccccgtatacccgcgaccgccgctactactactactcttccccaaataacgacgacaactataacgacgacgactcttaacatattacccgacaaaaactacaactaaaacgaaaaatcgaaacgacgataactactaaacgaaaatctactcccgaaacgcgacgacgcgctcgaaaccaaaaaaacgttacactctcgcgccctaaccactctaaactatacgcaccgccgcacgccgaaactacctccttacaatcctaaaaactaaacctcgaacaaccccgacacttccccgcaaaaactacaaaaacgaactacgcaaaaaaaaa

SEQ ID NO: 21989 - DNA, 644 bp, Artificial Sequence
  chemically treated genomic DNA (Homo sapiens) CpG-island No: 21989
gtggcgcgtattcggttcgttcgtatcgattggcgtcgtatttttggcgggaggaagtggcgttcgtgttgcgtttggtatagtagtcgtttaggttcggggtcgtggtcgtttagtatttttaattttacgataaaaggaatttgtacgtttcgttttaggaagcgttaaaaaggtttttcgggttttagggtttagagtagttttatgggttcgagtttcgcgaagttgtcgtttagcgcgggtgcgcgttttaggtttagttcgtcgcgggcgtcggcgtagtagcgcgcgtgggttcggaagagcgcgtttttttcgtcgcgtagggacgcgcgtagcgtaattcgttgtttcggggttaggtcgcgtacggtaatgcgtatcggttcgttttagtagtagcggtttgggggttttaggattagcgttgttgatattttggagtcggagcggggaatttaaaggtcgaggttcgagattcgtttaagatcgtggtaagcgcgtcgaatgttcggacggcgttcggcgttttttggtgtcggaagttgtcggtggttgagtagttttagaaagtttttgggattttagatcggttaattcggcgtttcggattcgtttgaggtaaaagtagttaggttttt

SEQ ID NO: 21990 - DNA, 644 bp, Artificial Sequence
  chemically treated genomic DNA (Homo sapiens) CpG-island No: 21990
aaaaacctaactacttttacctcaaacgaatccgaaacgccgaattaaccgatctaaaatcccaaaaactttctaaaactactcaaccaccgacaacttccgacaccaaaaaacgccgaacgccgtccgaacattcgacgcgcttaccacgatcttaaacgaatctcgaacctcgacctttaaattccccgctccgactccaaaatatcaacaacgctaatcctaaaacccccaaaccgctactactaaaacgaaccgatacgcattaccgtacgcgacctaaccccgaaacaacgaattacgctacgcgcgtccctacgcgacgaaaaaaacgcgctcttccgaacccacgcgcgctactacgccgacgcccgcgacgaactaaacctaaaacgcgcacccgcgctaaacgacaacttcgcgaaactcgaacccataaaactactctaaaccctaaaacccgaaaaacctttttaacgcttcctaaaacgaaacgtacaaattccttttatcgtaaaattaaaaatactaaacgaccacgaccccgaacctaaacgactactataccaaacgcaacacgaacgccacttcctcccgccaaaaatacgacgccaatcgatacgaacgaaccgaatacgcgccac

SEQ ID NO: 21991 - DNA, 644 bp, Artificial Sequence
  chemically treated genomic DNA (Homo sapiens) CpG-island No: 21991
aggagtttggttatttttgttttagacgagttcggagcgtcgggttaatcggtttgaagttttaggggttttttgggattgtttagttatcggtagttttcggtattaggggacgtcggacgtcgttcggatattcggcgcgtttgttacgattttggacgggtttcgggtttcgatttttgaatttttcgtttcggttttaagatgttagtaacgttgattttggagtttttaggtcgttgttgttggaacgagtcggtgcgtattgtcgtgcgcggtttggtttcggagtagcgggttacgttgcgcgcgtttttgcgcgacgagaagggcgcgttttttcgggtttacgcgcgttattgcgtcgacgttcgcggcgagttggatttggagcgcgtattcgcgttgggcggtagtttcgcgggattcgagtttatggggttgttttgggttttggaattcgagaagtttttttggcgttttttgaagcgggacgtatagattttttttgtcgtggagttggaggtgttggacggttacgatttcgagtttggacggttgttgtgttaggcgtagtacgagcgttattttttttcgttaggggtgcggcgttagtcggtgcgagcgggtcgggtgcgcgttat

SEQ ID NO: 21992 - DNA, 644 bp, Artificial Sequence
  chemically treated genomic DNA (Homo sapiens) CpG-island No: 21992
ataacgcgcacccgacccgctcgcaccgactaacgccgcacccctaacgaaaaaaaataacgctcgtactacgcctaacacaacaaccgtccaaactcgaaatcgtaaccgtccaacacctccaactccacgacaaaaaaaatctatacgtcccgcttcaaaaaacgccaaaaaaacttctcgaattccaaaacccaaaacaaccccataaactcgaatcccgcgaaactaccgcccaacgcgaatacgcgctccaaatccaactcgccgcgaacgtcgacgcaataacgcgcgtaaacccgaaaaaacgcgcccttctcgtcgcgcaaaaacgcgcgcaacgtaacccgctactccgaaaccaaaccgcgcacgacaatacgcaccgactcgttccaacaacaacgacctaaaaactccaaaatcaacgttactaacatcttaaaaccgaaacgaaaaattcaaaaatcgaaacccgaaacccgtccaaaatcgtaacaaacgcgccgaatatccgaacgacgtccgacgtcccctaataccgaaaactaccgataactaaacaatcccaaaaaacccctaaaacttcaaaccgattaacccgacgctccgaactcgtctaaaacaaaaataaccaaactcct

SEQ ID NO: 21993 - DNA, 670 bp, Artificial Sequence
  chemically treated genomic DNA (Homo sapiens) CpG-island No: 21993
ttattttttagcgttcggtaaagtcgttagcgttcgtttattgatttcgcggagttgggtcgtttttgttttatttagattgggatggtagcgacgttgattttggagttcgcgcgcgttgttgttgggacgagtcgttgcgtatcgtagtgcgcgtttggtttcggagtagttagttacgttgcgtacgtttttgcgcgacgaagagggcgcgttttttcgggtttacgcgcgttatcgtgtcgacgttcgcgacgagttggatttggagcgcgcgttcgcgttgggaggtagtttcgcgcggttttagttatggggttgttgtgggcgttggagttcgagaaagttttggtgcggttggtgaagcgcgacgtgcggacgtttttcgtcgtggagttggaagtgttggacggttacgatatcgagttcgggcggttgttgtgtttggcgtagaataagcgcgatttttttcggtcgggggtgcggcgcgagtcggtgcgcgcgggttcggtgcgcgtcgcgttttttttgtcgtcggatgagtagtttgtttagaatttggtcgagttttgcgatttttatcggttttttttttgttttgggaatcgcgtgattgtggaatatttttgaatttgttttttcgttttagagtttgttatggattttgagt

SEQ ID NO: 21994 - DNA, 670 bp, Artificial Sequence
  chemically treated genomic DNA (Homo sapiens) CpG-island No: 21994
actcaaaatccataacaaactctaaaacgaaaaaacaaattcaaaaatattccacaatcacgcgattcccaaaacaaaaaaaaaaccgataaaaatcgcaaaactcgaccaaattctaaacaaactactcatccgacgacaaaaaaaacgcgacgcgcaccgaacccgcgcgcaccgactcgcgccgcacccccgaccgaaaaaaatcgcgcttattctacgccaaacacaacaaccgcccgaactcgatatcgtaaccgtccaacacttccaactccacgacgaaaaacgtccgcacgtcgcgcttcaccaaccgcaccaaaactttctcgaactccaacgcccacaacaaccccataactaaaaccgcgcgaaactacctcccaacgcgaacgcgcgctccaaatccaactcgtcgcgaacgtcgacacgataacgcgcgtaaacccgaaaaaacgcgccctcttcgtcgcgcaaaaacgtacgcaacgtaactaactactccgaaaccaaacgcgcactacgatacgcaacgactcgtcccaacaacaacgcgcgcgaactccaaaatcaacgtcgctaccatcccaatctaaataaaacaaaaacgacccaactccgcgaaatcaataaacgaacgctaacgactttaccgaacgctaaaaaataa

SEQ ID NO: 21995 - DNA, 670 bp, Artificial Sequence
  chemically treated genomic DNA (Homo sapiens) CpG-island No: 21995
atttagaatttatgatagattttggagcgaaggaataagtttagggatgttttataattacgcgatttttaggataggaaaggggtcggtgggggtcgtagagttcgattaaattttgggtagattatttattcggcggtaggaagagcgcggcgcgtatcgggttcgcgcgtatcggttcgcgtcgtattttcggtcggagaaagtcgcgtttgttttgcgttaggtatagtagtcgttcgggttcggtgtcgtggtcgtttagtatttttagttttacggcgaagggcgttcgtacgtcgcgttttattagtcgtattaaggttttttcgggttttaacgtttatagtagttttatggttggagtcgcgcgaagttgttttttagcgcgggcgcgcgttttaggtttagttcgtcgcgggcgtcggtacggtagcgcgcgtgggttcggaagagcgcgtttttttcgtcgcgtagggacgtgcgtagcgtgattggttgtttcggggttaggcgcgtattgcgatgcgtagcggttcgttttagtagtagcgcgcgcgggttttaggattagcgtcgttgttattttaatttgggtagaataggggcgatttagtttcgcggagttagtgggcgggcgttggcggttttgtcgagcgttggaaagtag

SEQ ID NO: 21996 - DNA, 670 bp, Artificial Sequence
  chemically treated genomic DNA (Homo sapiens) CpG-island No: 21996
ctactttccaacgctcgacaaaaccgccaacgcccgcccactaactccgcgaaactaaatcgcccctattctacccaaattaaaataacaacgacgctaatcctaaaacccgcgcgcgctactactaaaacgaaccgctacgcatcgcaatacgcgcctaaccccgaaacaaccaatcacgctacgcacgtccctacgcgacgaaaaaaacgcgctcttccgaacccacgcgcgctaccgtaccgacgcccgcgacgaactaaacctaaaacgcgcgcccgcgctaaaaaacaacttcgcgcgactccaaccataaaactactataaacgttaaaacccgaaaaaaccttaatacgactaataaaacgcgacgtacgaacgcccttcgccgtaaaactaaaaatactaaacgaccacgacaccgaacccgaacgactactatacctaacgcaaaacaaacgcgactttctccgaccgaaaatacgacgcgaaccgatacgcgcgaacccgatacgcgccgcgctcttcctaccgccgaataaataatctacccaaaatttaatcgaactctacgacccccaccgacccctttcctatcctaaaaatcgcgtaattataaaacatccctaaacttattccttcgctccaaaatctatcataaattctaaat

SEQ ID NO: 21997 - DNA, 545 bp, Artificial Sequence
  chemically treated genomic DNA (Homo sapiens) CpG-island No: 21997
gttgggacgaatcggtgcgaatcgtcgtgcgcggtttagtttcggagtagtcggttacgttgcgcgcgtttttgcgcgacgagaagggcgcgtttttttaggtttacgcgcgttatcgcgtcgatatttttggcgagttggatttggagcgcgcgttcgcgttgggcggtagtttcgcgcgggtttgagtttatggggttgttttgggttttggagttcgagaaatttttggtgcggttggtgaagcgcgacgtgcgaacgtttttggtcgtggagttggaggtgttggatggttacgatttcgatttcgggcggttgttgtgttagacgcggtacgagcgttattttttttcgttcggggtgcggcgcgagtcggtgcgcgtgggtcgggtgcgaggtacgttttttttgtcgttaggtgatttattttcgttaattgtttcgtgttcgttcgttttttattttgtgtgtttttttcgttttacgtttttcgtttatgtgtatgttttttcgtcgcgttttcgggttatattgtttaggtaggt

SEQ ID NO: 21998 - DNA, 545 bp, Artificial Sequence
  chemically treated genomic DNA (Homo sapiens) CpG-island No: 21998
acctacctaaacaatataacccgaaaacgcgacgaaaaaacatacacataaacgaaaaacgtaaaacgaaaaaaacacacaaaataaaaaacgaacgaacacgaaacaattaacgaaaataaatcacctaacgacaaaaaaaacgtacctcgcacccgacccacgcgcaccgactcgcgccgcaccccgaacgaaaaaaaataacgctcgtaccgcgtctaacacaacaaccgcccgaaatcgaaatcgtaaccatccaacacctccaactccacgaccaaaaacgttcgcacgtcgcgcttcaccaaccgcaccaaaaatttctcgaactccaaaacccaaaacaaccccataaactcaaacccgcgcgaaactaccgcccaacgcgaacgcgcgctccaaatccaactcgccaaaaatatcgacgcgataacgcgcgtaaacctaaaaaaacgcgcccttctcgtcgcgcaaaaacgcgcgcaacgtaaccgactactccgaaactaaaccgcgcacgacgattcgcaccgattcgtcccaac

SEQ ID NO: 21999 - DNA, 545 bp, Artificial Sequence
  chemically treated genomic DNA (Homo sapiens) CpG-island No: 21999
atttgtttgggtaatatagttcgggggcgcggcgggggggtatatatataagcgaaaagcgtggggcgggggagatatataaagtgaaaggcgaacgaatacggaataattagcggaggtgagttatttggcggtaggaagagcgtgtttcgtattcggtttacgcgtatcggttcgcgtcgtatttcgggcgggaggaagtagcgttcgtgtcgcgtttggtatagtagtcgttcggggtcggggtcgtggttatttagtatttttagttttacggttaagggcgttcgtacgtcgcgttttattagtcgtattaaaggtttttcgggttttaaggtttagagtagttttatgggtttaagttcgcgcgaagttgtcgtttagcgcgggcgcgcgttttaggtttagttcgttaagagtgtcggcgcggtagcgcgcgtgggtttggaaaagcgcgtttttttcgtcgcgtagggacgcgcgtagcgtgatcggttgtttcggggttaggtcgcgtacggcgattcgtatcggttcgttttagt

SEQ ID NO: 22000 - DNA, 545 bp, Artificial Sequence
  chemically treated genomic DNA (Homo sapiens) CpG-island No: 22000
actaaaacgaaccgatacgaatcgccgtacgcgacctaaccccgaaacaaccgatcacgctacgcgcgtccctacgcgacgaaaaaaacgcgcttttccaaacccacgcgcgctaccgcgccgacactcttaacgaactaaacctaaaacgcgcgcccgcgctaaacgacaacttcgcgcgaacttaaacccataaaactactctaaaccttaaaacccgaaaaacctttaatacgactaataaaacgcgacgtacgaacgcccttaaccgtaaaactaaaaatactaaataaccacgaccccgaccccgaacgactactataccaaacgcgacacgaacgctacttcctcccgcccgaaatacgacgcgaaccgatacgcgtaaaccgaatacgaaacacgctcttcctaccgccaaataactcacctccgctaattattccgtattcgttcgcctttcactttatatatctcccccgccccacgcttttcgcttatatatatacccccccgccgcgcccccgaactatattacccaaacaaat

SEQ ID NO: 22001 - DNA, 539 bp, Artificial Sequence
  chemically treated genomic DNA (Homo sapiens) CpG-island No: 22001
gtattcggttcgcgcgtatcggttcgcgtcgtatttcgggcgggaggaagtagcgttcgtgtcgtattcggtatagtagtcgttcggggtcggggtcgtggttatttagtatttttagttttacggttaagggcgttcgtacgtcgcgttttattagtcgtattaagggtttttcgggttttaaggtttagagtagttttatgcgtttaagttcgcgaagttgtcgtttagcgcggggcgcgttttaggtttagttcgttaagggtgtcggcgcggtagcgcgcgggggtttggaaaagcgcgtttttttcgtcgcgtagggacgcgcgtagcgtgatcggttgtttcggggttaggtcgcgtacggcgattcgtatcggttcgttttagtagtagcggttcgcgggttttaggattagcgtcgtcgttattcgagtaggaatttaaataattcggttaaattgttttagttgtggagatttttgtaattttgtttaattttttttttcgggttgtcgtcgtaggttaaacgtttatta

SEQ ID NO: 22002 - DNA, 539 bp, Artificial Sequence
  chemically treated genomic DNA (Homo sapiens) CpG-island No: 22002
taataaacgtttaacctacgacgacaacccgaaaaaaaaaattaaacaaaattacaaaaatctccacaactaaaacaatttaaccgaattatttaaattcctactcgaataacgacgacgctaatcctaaaacccgcgaaccgctactactaaaacgaaccgatacgaatcgccgtacgcgacctaaccccgaaacaaccgatcacgctacgcgcgtccctacgcgacgaaaaaaacgcgcttttccaaacccccgcgcgctaccgcgccgacacccttaacgaactaaacctaaaacgcgccccgcgctaaacgacaacttcgcgaacttaaacgcataaaactactctaaaccttaaaacccgaaaaacccttaatacgactaataaaacgcgacgtacgaacgcccttaaccgtaaaactaaaaatactaaataaccacgaccccgaccccgaacgactactataccgaatacgacacgaacgctacttcctcccgcccgaaatacgacgcgaaccgatacgcgcgaaccgaatac

SEQ ID NO: 22003 - DNA, 539 bp, Artificial Sequence
  chemically treated genomic DNA (Homo sapiens) CpG-island No: 22003
tagtgggcgtttagtttgcgacggtagttcgagaggaagagttgggtagagttgtaggggtttttatagttgaggtagtttggtcggattatttgggtttttgttcggatggcggcgacgttgattttggagttcgcgggtcgttgttgttgggacgaatcggtgcgaatcgtcgtgcgcggtttagtttcggagtagtcggttacgttgcgcgcgtttttgcgcgacgagaagggcgcgtttttttaggttttcgcgcgttatcgcgtcgatatttttggcgagttggatttggagcgcgtttcgcgttgggcggtagtttcgcgggtttggacgtatggggttgttttgggttttggagttcgagaaatttttggtgcggttggtgaagcgcgacgtgcgaacgtttttggtcgtggagttggaggtgttggatggttacgatttcgatttcgggcggttgttgtgtcgggtgcggtacgagcgttattttttttcgttcggggtgcggcgcgagtcggtgcgcgcgggtcgggtgt

SEQ ID NO: 22004 - DNA, 539 bp, Artificial Sequence
  chemically treated genomic DNA (Homo sapiens) CpG-island No: 22004
acacccgacccgcgcgcaccgactcgcgccgcaccccgaacgaaaaaaaataacgctcgtaccgcacccgacacaacaaccgcccgaaatcgaaatcgtaaccatccaacacctccaactccacgaccaaaaacgttcgcacgtcgcgcttcaccaaccgcaccaaaaatttctcgaactccaaaacccaaaacaaccccatacgtccaaacccgcgaaactaccgcccaacgcgaaacgcgctccaaatccaactcgccaaaaatatcgacgcgataacgcgcgaaaacctaaaaaaacgcgcccttctcgtcgcgcaaaaacgcgcgcaacgtaaccgactactccgaaactaaaccgcgcacgacgattcgcaccgattcgtcccaacaacaacgacccgcgaactccaaaatcaacgtcgccgccatccgaacaaaaacccaaataatccgaccaaactacctcaactataaaaacccctacaactctacccaactcttcctctcgaactaccgtcgcaaactaaacgcccacta

SEQ ID NO: 22005 - DNA, 1579 bp, Artificial Sequence
  chemically treated genomic DNA (Homo sapiens) CpG-island No: 22005
gaggttcgaagtggcgggaacgggtttttcgcggcggttttaaggcgagggaggttgtaaaatttggtagagaattcggcgcgtcgggtcggggatgtttcgggtgtcgggggtaggggtcgtaggttcgtaggtagaagtttttttacgcgagcgggggtttcggtcgcggaaggggcgttttcggggtcgtcggtagcggcgagcgggcgggagggagtttttcgggtttttttcgcgtttcgggttggcggggcgatggcgacgacggtttttcggttttttcgtttcggacgtcgatggcggtgcgtttcggtttttttttaatagtttttttttcgcggtcgtcggagtcggtgaggtcgagagggcggggagtcgcgtagggaaggcgagagggcggaggttgcgtggtgtaggcggcggcggcgggaggaggagggtcgggcgggtaggggaggaggaggaggcgggcgtcgtgtcgtacgtagttttaggcggggtagtttcggtagttgagggacgtagttagattttggcgggacggggttttcgtcggggtttaggtttagggattaggcggaggcgtcgcgggagtttttggggtattatagagatgcgggtgagtgtcggtagtcgtcggggtcgagaggaggtggcggcggcggcggcggcgtaggttcggtttcgagtcgcggtgtcgtagtgattcgggtcgcgacggtcgaaattaggcgtttggcgaggtttgagtcgtcgaaacgcggtcgggtagaatggcggtcgggtcgggggattcgtgggcggaggacgtcgaaggtggtagaggagcgagcggggtcgggttttgagttatttcggacgggtcggggcggttaggtttggattacgtattgggaaaaagtacgatttatcgcgtttggaggcggcggtttggtggcgtcggttttttttttcgtcgcgatcgggttgggttttcggagggtgggtcgacgtgtggttcggggcggttcgggcgttcgcgtttcgtttggtgaggcgattttcgcgggacgtcgggattcgtgtttttgttttttcgcgtttacgttttttttcggcgttgtttttcggtcgacgcgtgtttttttgtgagttttgggtttaagcgtaggagtagtcgcggagtcgggttttttcgtttttcggttttttgttcgcggttttcgggtttttcgtttgtattgttgcgaacgtgtagggcgttattattgggtaatagtcgtttttttgtttcgtttttttgggagagcgggtcggggtatgcgcgtagggatgttagttcggcggtcgaatcggatagagtttttcggcgttcgtttatcgttcgttagtcgggtcgggttttgcgttgcggtttcggcgcgttttcggttttaacgggagcgcgcgttttgattttgagggtagtcgtgcgttcgttaggtcgttgggatttggggtttttagattcgggggtcgtcgttttttttttttttaagatttgaaagattttcgtttttgttattcgtgtagtattgtgtagcgtagatataagata

SEQ ID NO: 22006 - DNA, 1579 bp, Artificial Sequence
  chemically treated genomic DNA (Homo sapiens) CpG-island No: 22006
tatcttatatctacgctacacaatactacacgaataacaaaaacgaaaatctttcaaatcttaaaaaaaaaaaaaacgacgacccccgaatctaaaaaccccaaatcccaacgacctaacgaacgcacgactaccctcaaaatcaaaacgcgcgctcccgttaaaaccgaaaacgcgccgaaaccgcaacgcaaaacccgacccgactaacgaacgataaacgaacgccgaaaaactctatccgattcgaccgccgaactaacatccctacgcgcataccccgacccgctctcccaaaaaaacgaaacaaaaaaacgactattacccaataataacgccctacacgttcgcaacaatacaaacgaaaaacccgaaaaccgcgaacaaaaaaccgaaaaacgaaaaaacccgactccgcgactactcctacgcttaaacccaaaactcacaaaaaaacacgcgtcgaccgaaaaacaacgccgaaaaaaaacgtaaacgcgaaaaaacaaaaacacgaatcccgacgtcccgcgaaaatcgcctcaccaaacgaaacgcgaacgcccgaaccgccccgaaccacacgtcgacccaccctccgaaaacccaacccgatcgcgacgaaaaaaaaaaccgacgccaccaaaccgccgcctccaaacgcgataaatcgtactttttcccaatacgtaatccaaacctaaccgccccgacccgtccgaaataactcaaaacccgaccccgctcgctcctctaccaccttcgacgtcctccgcccacgaatcccccgacccgaccgccattctacccgaccgcgtttcgacgactcaaacctcgccaaacgcctaatttcgaccgtcgcgacccgaatcactacgacaccgcgactcgaaaccgaacctacgccgccgccgccgccgccacctcctctcgaccccgacgactaccgacactcacccgcatctctataataccccaaaaactcccgcgacgcctccgcctaatccctaaacctaaaccccgacgaaaaccccgtcccgccaaaatctaactacgtccctcaactaccgaaactaccccgcctaaaactacgtacgacacgacgcccgcctcctcctcctcccctacccgcccgaccctcctcctcccgccgccgccgcctacaccacgcaacctccgccctctcgccttccctacgcgactccccgccctctcgacctcaccgactccgacgaccgcgaaaaaaaaactattaaaaaaaaaccgaaacgcaccgccatcgacgtccgaaacgaaaaaaccgaaaaaccgtcgtcgccatcgccccgccaacccgaaacgcgaaaaaaacccgaaaaactccctcccgcccgctcgccgctaccgacgaccccgaaaacgccccttccgcgaccgaaacccccgctcgcgtaaaaaaacttctacctacgaacctacgacccctacccccgacacccgaaacatccccgacccgacgcgccgaattctctaccaaattttacaacctccctcgccttaaaaccgccgcgaaaaacccgttcccgccacttcgaacctc

SEQ ID NO: 22007 - DNA, 1579 bp, Artificial Sequence
  chemically treated genomic DNA (Homo sapiens) CpG-island No: 22007
tattttatgtttgcgttatataatattgtacgggtggtagaaacgggggttttttagattttaagggaaaaaaaagcgacgattttcgagtttggggattttaagttttagcggtttggcgggcgtacggttatttttagggttagggcgcgcgttttcgttgggatcgggggcgcgtcgaggtcgtagcgtagggttcggttcgattagcgagcgataggcgggcgtcggggggttttgttcggttcggtcgtcgggttagtatttttgcgcgtatgtttcggttcgtttttttaggagaacggggtaaaagggcgattgttatttaataatagcgttttgtacgttcgtaataatgtaggcggggaattcgagagtcgcgggtagggaatcggaaagcgagagagttcggtttcgcggttgtttttgcgtttgagtttagagtttataggggaatacgcgtcggtcggaaagtagcgtcgggaagaagcgtgggcgcgagggggtaagggtacgggtttcggcgtttcgcggaggtcgttttattaggcgaggcgcggacgttcgagtcgtttcgggttatacgtcggtttatttttcgagaatttagttcggtcgcggcggggaaaggggtcggcgttattaggtcgtcgtttttaggcgcgatgaatcgtgtttttttttagtgcgtagtttaggtttggtcgtttcggttcgttcggggtgatttagggttcggtttcgttcgtttttttgttattttcggcgtttttcgtttacgagtttttcggttcggtcgttattttgttcggtcgcgtttcggcggtttaggtttcgttaggcgtttggtttcggtcgtcgcggttcgagttattgcgatatcgcggttcggggtcgggtttgcgtcgtcgtcgtcgtcgttattttttttcggtttcggcggttgtcgatatttattcgtatttttgtggtgttttaaaggttttcgcgacgttttcgtttggtttttgggtttgggtttcggcgaaagtttcgtttcgttaaggtttagttgcgttttttagttatcggggttgtttcgtttggagttgcgtgcgatacggcgttcgtttttttttttttttttgttcgttcggttttttttttttcgtcgtcgtcgtttgtattacgtaattttcgttttttcgttttttttgcgcggtttttcgttttttcggttttatcggtttcggcgatcgcgggggagaagttgttgggggagggtcggaacgtatcgttatcggcgttcggggcgggggagtcgggaaatcgtcgtcgttatcgtttcgttagttcgaggcgcgggaggggttcggaaagttttttttcgttcgttcgtcgttgtcggcggtttcgggggcgtttttttcgcggtcgaggttttcgttcgcgtggggaagtttttatttgcgagtttgcggtttttgttttcggtattcgagatattttcgattcggcgcgtcggattttttgttaggttttatagtttttttcgttttgggatcgtcgcggaggattcgttttcgttatttcggatttt

SEQ ID NO: 22008 - DNA, 1579 bp, Artificial Sequence
  chemically treated genomic DNA (Homo sapiens) CpG-island No: 22008
aaaatccgaaataacgaaaacgaatcctccgcgacgatcccaaaacgaaaaaaactataaaacctaacaaaaaatccgacgcgccgaatcgaaaatatctcgaataccgaaaacaaaaaccgcaaactcgcaaataaaaacttccccacgcgaacgaaaacctcgaccgcgaaaaaaacgcccccgaaaccgccgacaacgacgaacgaacgaaaaaaaactttccgaacccctcccgcgcctcgaactaacgaaacgataacgacgacgatttcccgactcccccgccccgaacgccgataacgatacgttccgaccctcccccaacaacttctcccccgcgatcgccgaaaccgataaaaccgaaaaaacgaaaaaccgcgcaaaaaaaacgaaaaaacgaaaattacgtaatacaaacgacgacgacgaaaaaaaaaaaaccgaacgaacaaaaaaaaaaaaaaaaacgaacgccgtatcgcacgcaactccaaacgaaacaaccccgataactaaaaaacgcaactaaaccttaacgaaacgaaactttcgccgaaacccaaacccaaaaaccaaacgaaaacgtcgcgaaaacctttaaaacaccacaaaaatacgaataaatatcgacaaccgccgaaaccgaaaaaaaataacgacgacgacgacgacgcaaacccgaccccgaaccgcgatatcgcaataactcgaaccgcgacgaccgaaaccaaacgcctaacgaaacctaaaccgccgaaacgcgaccgaacaaaataacgaccgaaccgaaaaactcgtaaacgaaaaacgccgaaaataacaaaaaaacgaacgaaaccgaaccctaaatcaccccgaacgaaccgaaacgaccaaacctaaactacgcactaaaaaaaaacacgattcatcgcgcctaaaaacgacgacctaataacgccgacccctttccccgccgcgaccgaactaaattctcgaaaaataaaccgacgtataacccgaaacgactcgaacgtccgcgcctcgcctaataaaacgacctccgcgaaacgccgaaacccgtacccttaccccctcgcgcccacgcttcttcccgacgctactttccgaccgacgcgtattcccctataaactctaaactcaaacgcaaaaacaaccgcgaaaccgaactctctcgctttccgattccctacccgcgactctcgaattccccgcctacattattacgaacgtacaaaacgctattattaaataacaatcgcccttttaccccgttctcctaaaaaaacgaaccgaaacatacgcgcaaaaatactaacccgacgaccgaaccgaacaaaaccccccgacgcccgcctatcgctcgctaatcgaaccgaaccctacgctacgacctcgacgcgcccccgatcccaacgaaaacgcgcgccctaaccctaaaaataaccgtacgcccgccaaaccgctaaaacttaaaatccccaaactcgaaaatcgtcgcttttttttcccttaaaatctaaaaaacccccgtttctaccacccgtacaatattatataacgcaaacataaaata

SEQ ID NO: 22009 - DNA, 1068 bp, Artificial Sequence
  chemically treated genomic DNA (Homo sapiens) CpG-island No: 22009
tcgtacgcgttttttagtcgcggtcgttcgtttgtcgcggttatttcggtttttgtttttgttttttagtgatcggattaaggcgttgagcgaggttttgtttgcggggcggttatgcggcggtgataggagcgcgatcgatacgtacgggtttttcgttttttttcgtttttcgttcgttcgttagttttttttagtcgaggttgtttcgcggcggtcgtagttcgcgcgcggtttatattcgttttttttcggtattttcggtttcggagttgtttggaggcggtcgtattcgggtgagtttttttcgttttattttcgcgtttttcgttttcgtttcgggggttattgcgagcgggggtttttattagagattttgtttcgtcggggtttgtagggataggggtttgggagtcgcggttcgtcgcgcgcggtgtggggttttggggggcgttcgtgtcgtttttttttatttttatttttatcgtttcgtcgggtttcgagtttcgtcggttttggtagtggtcgaaacgaggcgatgggggtggggcggtacggacgcggtcgcgggggacgatagtggtacgcgcgcgttttagtgcgcgtgggggaggggcgcgcgcgtcgatcggcgtgcggtgggggggcgtttcgcgcgtgcgatttcgcgcgcgagcgagcgagcggttttgcgggttgcgtatgtttcgtcgcgttgattggtcggttaggcggtgcgggggcgcgcgcggtgttaggttcgagtcgtcgtggggtcgcgttcgtttggtgtatttggggtttttgcgtcggggtagtagacgcgcgggattggttaatcggcgcgggggcggggtcgcgcgttgtttggtaattgcggcgggcgggggagcgggagcgttgtttttcgtttcgtttcgtttttaggtggagttcgtagtgggttttgtttcgggtcggttcggcgcgtttgtttcgcggggtttgttttttgggggaaataaatataatgatcggaaggaaaattttagttttaggttatgaaaattaagtcgtttgggtttagtt

SEQ ID NO: 22010 - DNA, 1068 bp, Artificial Sequence
  chemically treated genomic DNA (Homo sapiens) CpG-island No: 22010
aactaaacccaaacgacttaattttcataacctaaaactaaaattttccttccgatcattatatttatttcccccaaaaaacaaaccccgcgaaacaaacgcgccgaaccgacccgaaacaaaacccactacgaactccacctaaaaacgaaacgaaacgaaaaacaacgctcccgctcccccgcccgccgcaattaccaaacaacgcgcgaccccgcccccgcgccgattaaccaatcccgcgcgtctactaccccgacgcaaaaaccccaaatacaccaaacgaacgcgaccccacgacgactcgaacctaacaccgcgcgcgcccccgcaccgcctaaccgaccaatcaacgcgacgaaacatacgcaacccgcaaaaccgctcgctcgctcgcgcgcgaaatcgcacgcgcgaaacgcccccccaccgcacgccgatcgacgcgcgcgcccctcccccacgcgcactaaaacgcgcgcgtaccactatcgtcccccgcgaccgcgtccgtaccgccccacccccatcgcctcgtttcgaccactaccaaaaccgacgaaactcgaaacccgacgaaacgataaaaataaaaataaaaaaaaacgacacgaacgccccccaaaaccccacaccgcgcgcgacgaaccgcgactcccaaacccctatccctacaaaccccgacgaaacaaaatctctaataaaaacccccgctcgcaataacccccgaaacgaaaacgaaaaacgcgaaaataaaacgaaaaaaactcacccgaatacgaccgcctccaaacaactccgaaaccgaaaataccgaaaaaaaacgaatataaaccgcgcgcgaactacgaccgccgcgaaacaacctcgactaaaaaaaactaacgaacgaacgaaaaacgaaaaaaaacgaaaaacccgtacgtatcgatcgcgctcctatcaccgccgcataaccgccccgcaaacaaaacctcgctcaacgccttaatccgatcactaaaaaacaaaaacaaaaaccgaaataaccgcgacaaacgaacgaccgcgactaaaaaacgcgtacga

SEQ ID NO: 22011 - DNA, 1068 bp, Artificial Sequence
  chemically treated genomic DNA (Homo sapiens) CpG-island No: 22011
ggttgaatttagacggtttaatttttatggtttaaagttgaagtttttttttcggttattgtgtttattttttttaaagaataggtttcgcggggtaggcgcgtcgggtcggttcgggataaagtttattgcggattttatttgggagcggggcggggcgggggatagcgttttcgttttttcgttcgtcgtagttattaggtaacgcgcggtttcgttttcgcgtcggttggttaatttcgcgcgtttgttgtttcggcgtaggagttttagatatattaggcgagcgcgattttacgacggttcgggtttggtatcgcgcgcgttttcgtatcgtttagtcggttaattagcgcggcggggtatgcgtagttcgtagggtcgttcgttcgttcgcgcgcgggatcgtacgcgcgaggcgtttttttatcgtacgtcggtcggcgcgcgcgttttttttttacgcgtattgaggcgcgcgcgtgttattgtcgtttttcgcgatcgcgttcgtgtcgttttatttttatcgtttcgtttcggttattgttaaggtcggcggggttcgagattcggcgaggcggtgggggtgggggtagggggaggcggtacgggcgttttttaaggttttatatcgcgcgcggcgggtcgcggtttttaggtttttgtttttgtaggtttcggcggggtaaagtttttaataaaggttttcgttcgtaatggttttcgaggcgggggcggggggcgcggggatgaggcgagagggatttattcgagtgcggtcgtttttaggtagtttcggggtcgggggtgtcgaggggaggcgagtgtgggtcgcgcgcgggttgcggtcgtcgcggagtagtttcggttgaggggagttggcgagcggacgggaggcgagagggggcgaggggttcgtgcgtgtcggtcgcgtttttgttatcgtcgtatggtcgtttcgtaggtagggtttcgtttagcgttttgattcgattattgggggatagaggtagaggtcggggtgatcgcggtaggcgggcggtcgcggttggagagcgcgtgcgg

SEQ ID NO: 22012 - DNA, 1068 bp, Artificial Sequence
  chemically treated genomic DNA (Homo sapiens) CpG-island No: 22012
ccgcacgcgctctccaaccgcgaccgcccgcctaccgcgatcaccccgacctctacctctatcccccaataatcgaatcaaaacgctaaacgaaaccctacctacgaaacgaccatacgacgataacaaaaacgcgaccgacacgcacgaacccctcgccccctctcgcctcccgtccgctcgccaactcccctcaaccgaaactactccgcgacgaccgcaacccgcgcgcgacccacactcgcctcccctcgacacccccgaccccgaaactacctaaaaacgaccgcactcgaataaatccctctcgcctcatccccgcgccccccgcccccgcctcgaaaaccattacgaacgaaaacctttattaaaaactttaccccgccgaaacctacaaaaacaaaaacctaaaaaccgcgacccgccgcgcgcgatataaaaccttaaaaaacgcccgtaccgcctccccctacccccacccccaccgcctcgccgaatctcgaaccccgccgaccttaacaataaccgaaacgaaacgataaaaataaaacgacacgaacgcgatcgcgaaaaacgacaataacacgcgcgcgcctcaatacgcgtaaaaaaaaaacgcgcgcgccgaccgacgtacgataaaaaaacgcctcgcgcgtacgatcccgcgcgcgaacgaacgaacgaccctacgaactacgcataccccgccgcgctaattaaccgactaaacgatacgaaaacgcgcgcgataccaaacccgaaccgtcgtaaaatcgcgctcgcctaatatatctaaaactcctacgccgaaacaacaaacgcgcgaaattaaccaaccgacgcgaaaacgaaaccgcgcgttacctaataactacgacgaacgaaaaaacgaaaacgctatcccccgccccgccccgctcccaaataaaatccgcaataaactttatcccgaaccgacccgacgcgcctaccccgcgaaacctattctttaaaaaaaataaacacaataaccgaaaaaaaaacttcaactttaaaccataaaaattaaaccgtctaaattcaacc

SEQ ID NO: 22013 - DNA, 558 bp, Artificial Sequence
  chemically treated genomic DNA (Homo sapiens) CpG-island No: 22013
  misc_feature (102)..(102): n is either a, c, g or t
  misc_feature (105)..(105): n is either a, c, g or t
  misc_feature (214)..(214): n is either a, c, g or t
  misc_feature (287)..(288): n is either a, c, g or t
  misc_feature (293)..(293): n is either a, c, g or t
  misc_feature (302)..(302): n is either a, c, g or t
  misc_feature (308)..(308): n is either a, c, g or t
cgtttttacgttttttagataatagttttagtttttttaggtttttttcgggtatcggtttcgtggtcgtttttttacgaagaggagttattttcggttttnaanggatcggatcgagggtagtggcgagcgtattatttgatcgggtattattcggattttataattgtttttgttttttttcgcggaattggaatttaatagtcgtagagtntttttggaattatgtgttgttgtcgttttcgtcgtcgtcgtcgttgttttcgtcgtcgttcgcgcgtcgtttnngcgtnatttatagnttgagnatggtgataggatttagtaatacgaaattcggcgtttagagttgttttgtcgtcgtcgttatagatattatagttatcgttttgttttcgatagtgtatatagtttcggttatttcgtatatttttcgacgttttaagttttcgaggttttcgcggattatttagttaattataaagttgtagtttttttcgttttcgttttgatgtatagttttttgattggcgggttgcgtgtttttatgtgatcgga

SEQ ID NO: 22014 - DNA, 558 bp, Artificial Sequence
  chemically treated genomic DNA (Homo sapiens) CpG-island No: 22014
  misc_feature (251)..(251): n is either a, c, g or t
  misc_feature (257)..(257): n is either a, c, g or t
  misc_feature (266)..(266): n is either a, c, g or t
  misc_feature (271)..(272): n is either a, c, g or t
  misc_feature (345)..(345): n is either a, c, g or t
  misc_feature (454)..(454): n is either a, c, g or t
  misc_feature (457)..(457): n is either a, c, g or t
tccgatcacataaaaacacgcaacccgccaatcaaaaaactatacatcaaaacgaaaacgaaaaaaactacaactttataattaactaaataatccgcgaaaacctcgaaaacttaaaacgtcgaaaaatatacgaaataaccgaaactatatacactatcgaaaacaaaacgataactataatatctataacgacgacgacaaaacaactctaaacgccgaatttcgtattactaaatcctatcaccatnctcaanctataaatnacgcnnaaacgacgcgcgaacgacgacgaaaacaacgacgacgacgacgaaaacgacaacaacacataattccaaaaanactctacgactattaaattccaattccgcgaaaaaaaacaaaaacaattataaaatccgaataatacccgatcaaataatacgctcgccactaccctcgatccgatccnttnaaaaccgaaaataactcctcttcgtaaaaaaacgaccacgaaaccgatacccgaaaaaaacctaaaaaaactaaaactattatctaaaaaacgtaaaaacg

SEQ ID NO: 22015 - DNA, 558 bp, Artificial Sequence
  chemically treated genomic DNA (Homo sapiens) CpG-island No: 22015
  misc_feature (251)..(251): n is either a, c, g or t
  misc_feature (257)..(257): n is either a, c, g or t
  misc_feature (266)..(266): n is either a, c, g or t
  misc_feature (271)..(272): n is either a, c, g or t
  misc_feature (345)..(345): n is either a, c, g or t
  misc_feature (454)..(454): n is either a, c, g or t
  misc_feature (457)..(457): n is either a, c, g or t
ttcggttatatggggatacgtagttcgttaattaggaggttgtatattagggcgggggcgggaggagttgtagttttgtgattggttgaatggttcgcggaggtttcgggggtttggggcgtcggggagtgtgcgaggtggtcggggttgtgtgtattatcggagataaagcggtggttgtggtgtttgtgacggcggcggtagagtagttttaaacgtcgaatttcgtgttgttgaattttgttattatntttaanttatgggtngcgtnngggcggcgcgcgggcggcggcggaggtagcggcggcggcggcggaggcggtagtagtatatggttttaagagngttttgcggttgttgggttttaatttcgcggggagggataaaggtagttgtgagattcgggtagtgttcggttaggtggtgcgttcgttattgttttcgattcggtttnttngaagtcgggagtagttttttttcgtggggaggcggttacgggatcgatgttcgggaagggtttggggaggttgaggttgttgtttgagggacgtgggggcg

SEQ ID NO: 22016 - DNA, 558 bp, Artificial Sequence
  chemically treated genomic DNA (Homo sapiens) CpG-island No: 22016
  misc_feature (102)..(102): n is either a, c, g or t
  misc_feature (105)..(105): n is either a, c, g or t
  misc_feature (214)..(214): n is either a, c, g or t
  misc_feature (287)..(288): n is either a, c, g or t
  misc_feature (293)..(293): n is either a, c, g or t
  misc_feature (302)..(302): n is either a, c, g or t
  misc_feature (308)..(308): n is either a, c, g or t
cgcccccacgtccctcaaacaacaacctcaacctccccaaacccttcccgaacatcgatcccgtaaccgcctccccacgaaaaaaaactactcccgacttcnaanaaaccgaatcgaaaacaataacgaacgcaccacctaaccgaacactacccgaatctcacaactacctttatccctccccgcgaaattaaaacccaacaaccgcaaaacnctcttaaaaccatatactactaccgcctccgccgccgccgccgctacctccgccgccgcccgcgcgccgcccnnacgcnacccataanttaaanataataacaaaattcaacaacacgaaattcgacgtttaaaactactctaccgccgccgtcacaaacaccacaaccaccgctttatctccgataatacacacaaccccgaccacctcgcacactccccgacgccccaaacccccgaaacctccgcgaaccattcaaccaatcacaaaactacaactcctcccgcccccgccctaatatacaacctcctaattaacgaactacgtatccccatataaccgaa

SEQ ID NO: 22017 - DNA, 600 bp, Artificial Sequence
  chemically treated genomic DNA (Homo sapiens) CpG-island No: 22017
  misc_feature (55)..(55): n is either a, c, g or t
  misc_feature (88)..(88): n is either a, c, g or t
  misc_feature (98)..(98): n is either a, c, g or t
  misc_feature (102)..(102): n is either a, c, g or t
  misc_feature (119)..(119): n is either a, c, g or t
  misc_feature (122)..(122): n is either a, c, g or t
  misc_feature (137)..(137): n is either a, c, g or t
  misc_feature (199)..(199): n is either a, c, g or t
  misc_feature (219)..(219): n is either a, c, g or t
  misc_feature (225)..(225): n is either a, c, g or t
  misc_feature (297)..(297): n is either a, c, g or t
  misc_feature (304)..(305): n is either a, c, g or t
  misc_feature (314)..(315): n is either a, c, g or t
  misc_feature (324)..(328): n is either a, c, g or t
  misc_feature (351)..(352): n is either a, c, g or t
  misc_feature (360)..(362): n is either a, c, g or t
  misc_feature (367)..(367): n is either a, c, g or t
  misc_feature (374)..(374): n is either a, c, g or t
  misc_feature (453)..(453): n is either a, c, g or t
  misc_feature (488)..(488): n is either a, c, g or t
  misc_feature (492)..(492): n is either a, c, g or t
  misc_feature (533)..(533): n is either a, c, g or t
  misc_feature (555)..(555): n is either a, c, g or t
  misc_feature (566)..(566): n is either a, c, g or t
cggtttcgtttttgttacgtgatagcgtgcgtttttttttttgtttttttgattntttttcgttatttaaagaaatagtatcgggggncgggtcgagncgancgtagtcgggacgtaangtntgcggtgcggatcgngaggagttattttgtttcgtcgtcggggagttaggtttttaaatcgaagaagttttggcgtngttttttttttttttcgggntttggntagggcgaaggaacgggcgtgcggtcgatcgagcgatcggttggcggtttttttttttgttttggtatttangtttttnnggggcgtannggcggtcgnnnnntcgcgcgcgcgttcggtggtcgnnttgcgttnnngcgtncgcgttnttttttttcgtacgtagaattcgggcggcggtttatgcgtttgcgattcgacgaggagtcgttcgggtggtcggcggtngcgggtagtttttcgttcgtttcgggggaggcggncgtngtagcggtcgcgggatttggagcggtcggggaggcgggggntgtcggggtcggtttggaggtnttggcgttatntttcggggtttgtaaggatttagttgggggggta

SEQ ID NO: 22018 - DNA, 600 bp, Artificial Sequence
  chemically treated genomic DNA (Homo sapiens) CpG-island No: 22018
  misc_feature (35)..(35): n is either a, c, g or t
  misc_feature (46)..(46): n is either a, c, g or t
  misc_feature (68)..(68): n is either a, c, g or t
  misc_feature (109)..(109): n is either a, c, g or t
  misc_feature (113)..(113): n is either a, c, g or t
  misc_feature (148)..(148): n is either a, c, g or t
  misc_feature (227)..(227): n is either a, c, g or t
  misc_feature (234)..(234): n is either a, c, g or t
  misc_feature (239)..(241): n is either a, c, g or t
  misc_feature (249)..(250): n is either a, c, g or t
  misc_feature (273)..(277): n is either a, c, g or t
  misc_feature (286)..(287): n is either a, c, g or t
  misc_feature (296)..(297): n is either a, c, g or t
  misc_feature (304)..(304): n is either a, c, g or t
  misc_feature (376)..(376): n is either a, c, g or t
  misc_feature (382)..(382): n is either a, c, g or t
  misc_feature (402)..(402): n is either a, c, g or t
  misc_feature (464)..(464): n is either a, c, g or t
  misc_feature (479)..(479): n is either a, c, g or t
  misc_feature (482)..(482): n is either a, c, g or t
  misc_feature (499)..(499): n is either a, c, g or t
  misc_feature (503)..(503): n is either a, c, g or t
  misc_feature (513)..(513): n is either a, c, g or t
  misc_feature (546)..(546): n is either a, c, g or t
tacccccccaactaaatccttacaaaccccgaaanataacgccaanacctccaaaccgaccccgacancccccgcctccccgaccgctccaaatcccgcgaccgctacnacgnccgcctcccccgaaacgaacgaaaaactacccgcnaccgccgaccacccgaacgactcctcgtcgaatcgcaaacgcataaaccgccgcccgaattctacgtacgaaaaaaaanaacgcgnacgcnnnaacgcaanncgaccaccgaacgcgcgcgcgannnnncgaccgccnntacgccccnnaaaaacntaaataccaaaacaaaaaaaaaaaccgccaaccgatcgctcgatcgaccgcacgcccgttccttcgccctanccaaancccgaaaaaaaaaaaaaacnacgccaaaacttcttcgatttaaaaacctaactccccgacgacgaaacaaaataactcctcncgatccgcaccgcanacnttacgtcccgactacgntcgnctcgacccgncccccgatactatttctttaaataacgaaaaanaatcaaaaaaacaaaaaaaaaaacgcacgctatcacgtaacaaaaacgaaaccg

SEQ ID NO: 22019 - DNA, 600 bp, Artificial Sequence
  chemically treated genomic DNA (Homo sapiens) CpG-island No: 22019
  misc_feature (35)..(35): n is either a, c, g or t
  misc_feature (46)..(46): n is either a, c, g or t
  misc_feature (68)..(68): n is either a, c, g or t
  misc_feature (109)..(109): n is either a, c, g or t
  misc_feature (113)..(113): n is either a, c, g or t
  misc_feature (148)..(148): n is either a, c, g or t
  misc_feature (227)..(227): n is either a, c, g or t
  misc_feature (234)..(234): n is either a, c, g or t
  misc_feature (239)..(241): n is either a, c, g or t
  misc_feature (249)..(250): n is either a, c, g or t
  misc_feature (273)..(277): n is either a, c, g or t
  misc_feature (286)..(287): n is either a, c, g or t
  misc_feature (296)..(297): n is either a, c, g or t
  misc_feature (304)..(304): n is either a, c, g or t
  misc_feature (376)..(376): n is either a, c, g or t
  misc_feature (382)..(382): n is either a, c, g or t
  misc_feature (402)..(402): n is either a, c, g or t
  misc_feature (464)..(464): n is either a, c, g or t
  misc_feature (479)..(479): n is either a, c, g or t
  misc_feature (482)..(482): n is either a, c, g or t
  misc_feature (499)..(499): n is either a, c, g or t
  misc_feature (503)..(503): n is either a, c, g or t
  misc_feature (513)..(513): n is either a, c, g or t
  misc_feature (546)..(546): n is either a, c, g or t
tgtttttttaattgggtttttgtaggtttcgaagngtggcgttagngtttttaagtcggtttcggtanttttcgttttttcggtcgttttaaatttcgcggtcgttgtngcgntcgtttttttcggagcgggcggagagttgttcgtngtcgtcgattattcggacgatttttcgtcgaatcgtaaacgtataggtcgtcgttcgagttttgcgtacgagaagaaangacgcgngcgtnnnagcgtaanncggttatcgggcgcgcgcgcggnnnnncggtcgttnntgcgttttnnaagagtntggatgttagagtaggagaaagagtcgttaatcgatcgttcgatcgatcgtacgttcgttttttcgttttanttaganttcgggagggggggagggtngcgttagggttttttcgatttaggggtttgatttttcggcgacgagataagatggttttttncggttcgtatcgtangtnttacgtttcggttgcgntcgnttcggttcgnttttcggtattgtttttttaaatggcggagagnggttaggaaagtaggaagagaggcgtacgttgttacgtgataggggcgggatcg

SEQ ID NO: 22020 - DNA, 600 bp, Artificial Sequence
  chemically treated genomic DNA (Homo sapiens) CpG-island No: 22020
  misc_feature (55)..(55): n is either a, c, g or t
  misc_feature (88)..(88): n is either a, c, g or t
  misc_feature (98)..(98): n is either a, c, g or t
  misc_feature (102)..(102): n is either a, c, g or t
  misc_feature (119)..(119): n is either a, c, g or t
  misc_feature (122)..(122): n is either a, c, g or t
  misc_feature (137)..(137): n is either a, c, g or t
  misc_feature (199)..(199): n is either a, c, g or t
  misc_feature (219)..(219): n is either a, c, g or t
  misc_feature (225)..(225): n is either a, c, g or t
  misc_feature (297)..(297): n is either a, c, g or t
  misc_feature (304)..(305): n is either a, c, g or t
  misc_feature (314)..(315): n is either a, c, g or t
  misc_feature (324)..(328): n is either a, c, g or t
  misc_feature (351)..(352): n is either a, c, g or t
  misc_feature (360)..(362): n is either a, c, g or t
  misc_feature (367)..(367): n is either a, c, g or t
  misc_feature (374)..(374): n is either a, c, g or t
  misc_feature (453)..(453): n is either a, c, g or t
  misc_feature (488)..(488): n is either a, c, g or t
  misc_feature (492)..(492): n is either a, c, g or t
  misc_feature (533)..(533): n is either a, c, g or t
  misc_feature (555)..(555): n is either a, c, g or t
  misc_feature (566)..(566): n is either a, c, g or t
cgatcccgcccctatcacgtaacaacgtacgcctctcttcctactttcctaaccnctctccgccatttaaaaaaacaataccgaaaancgaaccgaancgancgcaaccgaaacgtaanacntacgatacgaaccgnaaaaaaccatcttatctcgtcgccgaaaaatcaaacccctaaatcgaaaaaaccctaacgcnaccctccccccctcccgaantctaantaaaacgaaaaaacgaacgtacgatcgatcgaacgatcgattaacgactctttctcctactctaacatccanactcttnnaaaacgcannaacgaccgnnnnnccgcgcgcgcgcccgataaccgnnttacgctnnnacgcncgcgtcntttcttctcgtacgcaaaactcgaacgacgacctatacgtttacgattcgacgaaaaatcgtccgaataatcgacgacnacgaacaactctccgcccgctccgaaaaaaacgancgcnacaacgaccgcgaaatttaaaacgaccgaaaaaacgaaaantaccgaaaccgacttaaaaacnctaacgccacncttcgaaacctacaaaaacccaattaaaaaaaca

SEQ ID NO: 22021 - DNA, 548 bp, Artificial Sequence
  chemically treated genomic DNA (Homo sapiens) CpG-island No: 22021
ttagtcgacgattttgtttttgtagtaggcgatttcgaagcgttttttggcgcgttttattcgtattacggttatattggttaggcggatttggttggtgggggtgaagatcgatatcgcggttgtttaaagatttagaagtcggtaaattagggttgattcgcgtcgtttagtttgaaggttattagcgtttcgcggtaacgatcgagcggcgcgcggtattgatttaattataagtgcgcggcgtcgcgatttattagttttaggtagtcgttatagcgtgtttggtaggtttatttattgcgtaggcgttaggtggagtagaagtcgggaggggagaagtgagcgatgacgtttgcgtattgtggtttttatcgttatttttttacgtttaaaaagggaggtgtttttttttggcgttttattttcgttaatgagttgagagttttgataggatgttcgcggatgtttagtgatcgggttgaaatatagcgttggtattatttcgtttcgcggaatttaagggttagatttattttataatagaa

SEQ ID NO: 22022 - DNA, 548 bp, Artificial Sequence
  chemically treated genomic DNA (Homo sapiens) CpG-island No: 22022
ttctattataaaataaatctaacccttaaattccgcgaaacgaaataataccaacgctatatttcaacccgatcactaaacatccgcgaacatcctatcaaaactctcaactcattaacgaaaataaaacgccaaaaaaaaacacctccctttttaaacgtaaaaaaataacgataaaaaccacaatacgcaaacgtcatcgctcacttctcccctcccgacttctactccacctaacgcctacgcaataaataaacctaccaaacacgctataacgactacctaaaactaataaatcgcgacgccgcgcacttataattaaatcaataccgcgcgccgctcgatcgttaccgcgaaacgctaataaccttcaaactaaacgacgcgaatcaaccctaatttaccgacttctaaatctttaaacaaccgcgatatcgatcttcacccccaccaaccaaatccgcctaaccaatataaccgtaatacgaataaaacgcgccaaaaaacgcttcgaaatcgcctactacaaaaacaaaatcgtcgactaa

SEQ ID NO: 22023 - DNA, 548 bp, Artificial Sequence
  chemically treated genomic DNA (Homo sapiens) CpG-island No: 22023
ttttattataaagtgggtttggtttttgaatttcgcggaacgaggtggtgttaacgttgtgttttaattcggttattaaatattcgcgagtattttgttagagtttttagtttattggcgaaagtaaaacgttaaggaaaagtatttttttttttgggcgtggaaagatggcggtaaaagttataatgcgtaggcgttatcgtttattttttttttttcggtttttgttttatttgacgtttgcgtagtaagtaagtttgttagatacgttgtggcggttgtttgaagttagtgagtcgcggcgtcgcgtatttgtggttgggttagtgtcgcgcgtcgttcggtcgttatcgcgaggcgttggtggtttttaggttggacggcgcgggttagttttggtttgtcggtttttgggtttttgaatagtcgcgatgtcgatttttatttttattaattagattcgtttaattaatgtggtcgtggtacggatgaagcgcgttaggaagcgtttcgaaatcgtttgttatagaaataaggtcgtcggttgg

SEQ ID NO: 22024 - DNA, 548 bp, Artificial Sequence
  chemically treated genomic DNA (Homo sapiens) CpG-island No: 22024
ccaaccgacgaccttatttctataacaaacgatttcgaaacgcttcctaacgcgcttcatccgtaccacgaccacattaattaaacgaatctaattaataaaaataaaaatcgacatcgcgactattcaaaaacccaaaaaccgacaaaccaaaactaacccgcgccgtccaacctaaaaaccaccaacgcctcgcgataacgaccgaacgacgcgcgacactaacccaaccacaaatacgcgacgccgcgactcactaacttcaaacaaccgccacaacgtatctaacaaacttacttactacgcaaacgtcaaataaaacaaaaaccgaaaaaaaaaaaataaacgataacgcctacgcattataacttttaccgccatctttccacgcccaaaaaaaaaaatacttttccttaacgttttactttcgccaataaactaaaaactctaacaaaatactcgcgaatatttaataaccgaattaaaacacaacgttaacaccacctcgttccgcgaaattcaaaaaccaaacccactttataataaaa

SEQ ID NO: 22025 - DNA, 545 bp, Artificial Sequence
  chemically treated genomic DNA (Homo sapiens) CpG-island No: 22025
aatagagttcgttatttgttttgggaacggcggtgggtgttttaggaggcggattttcggtgtatttttgcgcgtgtgtatttttttttgcgtgcgtgttcgcgcgtgcgtgttcgtatatgcgttattttcgtattgttttcgttttttgcgtttttttaggttatcgtttgttttagtttttaggttttggtttttagtggatgagaattatcgagtttgcggggttggacgttgatcgttcgggttagtatttaggcgggcgggagttgtgcggtttagggttcgcgcgggtcgggtagaggttcgagcggattttcgagcgtgaatttcggagttagcgttgggttagaggggttaggcgggaggtggtggcggaggcgaaggggcgacgggatttgggtttggttcgtgtgtgttttcggcggtttgcgtcggtcgtcgttgtacggtgagttttagggaggcggatttgggtttcgagaaggatattcgtttggatttgtttcgtagttcggttcgggtttcgggagtagaatagtttt

SEQ ID NO: 22026 - DNA, 545 bp, Artificial Sequence
  chemically treated genomic DNA (Homo sapiens) CpG-island No: 22026
aaaactattctactcccgaaacccgaaccgaactacgaaacaaatccaaacgaatatccttctcgaaacccaaatccgcctccctaaaactcaccgtacaacgacgaccgacgcaaaccgccgaaaacacacacgaaccaaacccaaatcccgtcgccccttcgcctccgccaccacctcccgcctaacccctctaacccaacgctaactccgaaattcacgctcgaaaatccgctcgaacctctacccgacccgcgcgaaccctaaaccgcacaactcccgcccgcctaaatactaacccgaacgatcaacgtccaaccccgcaaactcgataattctcatccactaaaaaccaaaacctaaaaactaaaacaaacgataacctaaaaaaacgcaaaaaacgaaaacaatacgaaaataacgcatatacgaacacgcacgcgcgaacacgcacgcaaaaaaaaatacacacgcgcaaaaatacaccgaaaatccgcctcctaaaacacccaccgccgttcccaaaacaaataacgaactctatt

SEQ ID NO: 22027 - DNA, 545 bp, Artificial Sequence
  chemically treated genomic DNA (Homo sapiens) CpG-island No: 22027
aaggttgttttgttttcgaggttcgggtcgggttacggggtaaatttaggcgggtgtttttttcggggtttagattcgtttttttggggtttatcgtatagcgacggtcggcgtaggtcgtcgaggatatatacgggttaggtttaggtttcgtcgttttttcgttttcgttattatttttcgtttggtttttttggtttagcgttggtttcggggtttacgttcgggggttcgttcgagtttttattcggttcgcgcgaattttgggtcgtatagttttcgttcgtttaggtgttggttcgggcggttagcgtttagtttcgtagattcggtgatttttatttattagaggttaaagtttgggaattagagtaagcggtgatttgaagaggcgtaggaagcgagggtagtgcggaggtggcgtatgtgcgagtacgtacgcgcgaatacgtacgtagggagaggtgtatacgcgtaggagtgtatcggaagttcgttttttgggatatttatcgtcgtttttaggataagtaacggattttatt

SEQ ID NO: 22028 - DNA, 545 bp, Artificial Sequence
  chemically treated genomic DNA (Homo sapiens) CpG-island No: 22028
aataaaatccgttacttatcctaaaaacgacgataaatatcccaaaaaacgaacttccgatacactcctacgcgtatacacctctccctacgtacgtattcgcgcgtacgtactcgcacatacgccacctccgcactaccctcgcttcctacgcctcttcaaatcaccgcttactctaattcccaaactttaacctctaataaataaaaatcaccgaatctacgaaactaaacgctaaccgcccgaaccaacacctaaacgaacgaaaactatacgacccaaaattcgcgcgaaccgaataaaaactcgaacgaacccccgaacgtaaaccccgaaaccaacgctaaaccaaaaaaaccaaacgaaaaataataacgaaaacgaaaaaacgacgaaacctaaacctaacccgtatatatcctcgacgacctacgccgaccgtcgctatacgataaaccccaaaaaaacgaatctaaaccccgaaaaaaacacccgcctaaatttaccccgtaacccgacccgaacctcgaaaacaaaacaacctt

SEQ ID NO: 22029 - DNA, 556 bp, Artificial Sequence
  chemically treated genomic DNA (Homo sapiens) CpG-island No: 22029
tcggcgcggcgattttagtcgcgtcgcgtttgcgtgggtttagcgttttatgggagttgtagtttcgttatgaggtcgcgcgtcgcgttttttttagagtaggtaattttaggcggcggagtcggaatagtttggaggcgagaagttgggaaggaaagtagagggagtcgaagcgggacgtatagagtcgtagttgtaggtagacggagtggacgtttaggtagagtggagagacgttttgggtttgagagttgatttatgttattgtttcgatttcggaggcgtggaggggtcgcgggttaggcggattttttcgtggttgtaaggtgcgggttagttttacgtgtatttttgatttttgcgagtttcgttggttgcgtttgtataatgggtcgaacggtaagagtaataatattttttcggcgttttcgcgcggattttatttatgcgaaatgtcgtttttttttgacgttcggagtaggcgggtaggtgcggggtatttgcgttggtggggtcgttagttagttggttggtttcggggcgttagttgggtttt

SEQ ID NO: 22030 - DNA, 556 bp, Artificial Sequence
  chemically treated genomic DNA (Homo sapiens) CpG-island No: 22030
aaaacccaactaacgccccgaaaccaaccaactaactaacgaccccaccaacgcaaataccccgcacctacccgcctactccgaacgtcaaaaaaaaacgacatttcgcataaataaaatccgcgcgaaaacgccgaaaaaatattattactcttaccgttcgacccattatacaaacgcaaccaacgaaactcgcaaaaatcaaaaatacacgtaaaactaacccgcaccttacaaccacgaaaaaatccgcctaacccgcgacccctccacgcctccgaaatcgaaacaataacataaatcaactctcaaacccaaaacgtctctccactctacctaaacgtccactccgtctacctacaactacgactctatacgtcccgcttcgactccctctactttccttcccaacttctcgcctccaaactattccgactccgccgcctaaaattacctactctaaaaaaaacgcgacgcgcgacctcataacgaaactacaactcccataaaacgctaaacccacgcaaacgcgacgcgactaaaatcgccgcgccga

SEQ ID NO: 22031 - DNA, 556 bp, Artificial Sequence
  chemically treated genomic DNA (Homo sapiens) CpG-island No: 22031
ggagtttagttggcgtttcggagttagttagttggttagcggttttattagcgtaagtgtttcgtatttgttcgtttgtttcgagcgttaagagaaggcggtatttcgtatgggtaaaattcgcgcggggacgtcgggagaatgttgttgtttttgtcgttcggtttattgtatagacgtagttagcgaggttcgtagaggttagggatgtacgtaggattggttcgtattttgtagttacggaaagattcgtttggttcgcggtttttttacgttttcgaggtcgagatagtgatataagttaatttttaagtttagggcgtttttttattttgtttagacgtttatttcgtttgtttgtagttacggttttgtgcgtttcgtttcgattttttttgtttttttttttagtttttcgtttttagattgtttcggtttcgtcgtttgaaattatttgttttgggggaggcgcggcgcgcggttttatgacggaattataatttttatgaggcgttgggtttacgtaggcgcggcgcggttgaagtcgtcgcgtcgg

SEQ ID NO: 22032 - DNA, 556 bp, Artificial Sequence
  chemically treated genomic DNA (Homo sapiens) CpG-island No: 22032
ccgacgcgacgacttcaaccgcgccgcgcctacgtaaacccaacgcctcataaaaattataattccgtcataaaaccgcgcgccgcgcctcccccaaaacaaataatttcaaacgacgaaaccgaaacaatctaaaaacgaaaaactaaaaaaaaaaacaaaaaaaatcgaaacgaaacgcacaaaaccgtaactacaaacaaacgaaataaacgtctaaacaaaataaaaaaacgccctaaacttaaaaattaacttatatcactatctcgacctcgaaaacgtaaaaaaaccgcgaaccaaacgaatctttccgtaactacaaaatacgaaccaatcctacgtacatccctaacctctacgaacctcgctaactacgtctatacaataaaccgaacgacaaaaacaacaacattctcccgacgtccccgcgcgaattttacccatacgaaataccgccttctcttaacgctcgaaacaaacgaacaaatacgaaacacttacgctaataaaaccgctaaccaactaactaactccgaaacgccaactaaactcc

SEQ ID NO: 22033 - DNA, 937 bp, Artificial Sequence
  chemically treated genomic DNA (Homo sapiens) CpG-island No: 22033
ttgcggagttattcggtttatgaacgagtcgtttcgcgtttttcgtttttagaaagaggtttttaagaggcgagttttgcgttatttatttattttgatcgcgagtcgggaggaaatcgtatttgttcggttcgggggcggaggcgtttattatttttttggttttttcgaagcgtcgtaggggtgtttggtgcgtttttagtaatttttagcgcgggtttttagattttggttagtttagtttcgtttatacgcgtaagtggttggttcgtggagtttgttaatcggtgttagtcgttgtgcgattggtcggtgggataaaagcgcggaagggttttttttcgtggtgtgtagtcggtttggcgtgattttcgtttgatttaggtgagatatttgcgttcgggagagcgggtcgggtttcgttatttttttagggcggttgtggggtttgcgcggtttcgcgtttttggtttaggaggattcgtcgttcgatttttagattagtcgattttcggtttttcgtttttgcgttcgtcgtttttcgcgtatcgtcgagttcgcgtttttttcgtgtttaaatcgcggcggggttgcggtcgttggttttgggtttcgcgtttttagcgttttcggggtgttttttagtgtagtttgttcggtgggcgtcgaggtttcgcgtttcgggtcgtttcgggattttgcgttttttttatcgtagtcggttttgcggggcgagttttaggagaattagttcggatttcgttagttttttgtattgggcgtgtgggtttttgcgggtttagtcggcgtcgcggggtcgggggcgcgcgtcgtcggcgttcgtggttatagtaaagatttggatttgagttttaatttttttattaattttttttttttagagtacggtaggggtttgcgttgtcgttttgaggtt

SEQ ID NO: 22034 - DNA, 937 bp, Artificial Sequence
  chemically treated genomic DNA (Homo sapiens) CpG-island No: 22034
aacctcaaaacgacaacgcaaacccctaccgtactctaaaaaaaaaaaattaataaaaaaattaaaactcaaatccaaatctttactataaccacgaacgccgacgacgcgcgcccccgaccccgcgacgccgactaaacccgcaaaaacccacacgcccaatacaaaaaactaacgaaatccgaactaattctcctaaaactcgccccgcaaaaccgactacgataaaaaaaacgcaaaatcccgaaacgacccgaaacgcgaaacctcgacgcccaccgaacaaactacactaaaaaacaccccgaaaacgctaaaaacgcgaaacccaaaaccaacgaccgcaaccccgccgcgatttaaacacgaaaaaaacgcgaactcgacgatacgcgaaaaacgacgaacgcaaaaacgaaaaaccgaaaatcgactaatctaaaaatcgaacgacgaatcctcctaaaccaaaaacgcgaaaccgcgcaaaccccacaaccgccctaaaaaaataacgaaacccgacccgctctcccgaacgcaaatatctcacctaaatcaaacgaaaatcacgccaaaccgactacacaccacgaaaaaaaacccttccgcgcttttatcccaccgaccaatcgcacaacgactaacaccgattaacaaactccacgaaccaaccacttacgcgtataaacgaaactaaactaaccaaaatctaaaaacccgcgctaaaaattactaaaaacgcaccaaacacccctacgacgcttcgaaaaaaccaaaaaaataataaacgcctccgcccccgaaccgaacaaatacgatttcctcccgactcgcgatcaaaataaataaataacgcaaaactcgcctcttaaaaacctctttctaaaaacgaaaaacgcgaaacgactcgttcataaaccgaataactccgcaa

SEQ ID NO: 22035 - DNA, 937 bp, Artificial Sequence
  chemically treated genomic DNA (Homo sapiens) CpG-island No: 22035
ggttttaagacggtagcgtaggtttttgtcgtattttgggaaagaaaaattagtgaaaaaattaaggtttaagtttaggtttttgttgtaattacgagcgtcggcggcgcgcgttttcgatttcgcggcgtcggttgagttcgtagggatttatacgtttagtgtaggaggttggcgggattcgggttggtttttttggagttcgtttcgtagggtcggttgcggtgaagagagcgtagggtttcgaggcgattcgaggcgcggggtttcggcgtttatcgggtaggttatattgaagggtatttcgaagacgttgggggcgcggggtttagggttaacggtcgtaatttcgtcgcgatttgggtacggagaggacgcgggttcggcggtgcgcgaagggcgacgggcgtaggggcgggagatcgagagtcggttggtttaagagtcgggcggcggatttttttgggttaggggcgcggagtcgcgtaggttttatagtcgttttggggagatggcggagttcggttcgttttttcgagcgtaggtattttatttggattaggcgagggttacgttaagtcggttatatattacggaaaggagttttttcgcgtttttattttatcgattaatcgtatagcgattagtatcgattgataagttttacggattagttatttgcgcgtatgggcgggattaagttagttagagtttagaagttcgcgttaagggttgttagggacgtattaaatatttttacggcgtttcggaggagttaaaggaataatgggcgttttcgttttcgggtcgggtagatgcggttttttttcgattcgcgattaaaatgggtgagtagcgtagagttcgttttttggaggtttttttttgaaggcggaggacgcggggcggttcgtttatgggtcgggtggtttcgtag

SEQ ID NO: 22036 - DNA, 937 bp, Artificial Sequence
  chemically treated genomic DNA (Homo sapiens) CpG-island No: 22036
ctacgaaaccacccgacccataaacgaaccgccccgcgtcctccgccttcaaaaaaaaacctccaaaaaacgaactctacgctactcacccattttaatcgcgaatcgaaaaaaaaccgcatctacccgacccgaaaacgaaaacgcccattattcctttaactcctccgaaacgccgtaaaaatatttaatacgtccctaacaacccttaacgcgaacttctaaactctaactaacttaatcccgcccatacgcgcaaataactaatccgtaaaacttatcaatcgatactaatcgctatacgattaatcgataaaataaaaacgcgaaaaaactcctttccgtaatatataaccgacttaacgtaaccctcgcctaatccaaataaaatacctacgctcgaaaaaacgaaccgaactccgccatctccccaaaacgactataaaacctacgcgactccgcgcccctaacccaaaaaaatccgccgcccgactcttaaaccaaccgactctcgatctcccgcccctacgcccgtcgcccttcgcgcaccgccgaacccgcgtcctctccgtacccaaatcgcgacgaaattacgaccgttaaccctaaaccccgcgcccccaacgtcttcgaaatacccttcaatataacctacccgataaacgccgaaaccccgcgcctcgaatcgcctcgaaaccctacgctctcttcaccgcaaccgaccctacgaaacgaactccaaaaaaaccaacccgaatcccgccaacctcctacactaaacgtataaatccctacgaactcaaccgacgccgcgaaatcgaaaacgcgcgccgccgacgctcgtaattacaacaaaaacctaaacttaaaccttaattttttcactaatttttctttcccaaaatacgacaaaaacctacgctaccgtcttaaaacc

SEQ ID NO: 22037 - DNA, 529 bp, Artificial Sequence
  chemically treated genomic DNA (Homo sapiens) CpG-island No: 22037
gttttgcgaaacgggatacggtagtgtaacgggaataatcggatatcgaggttttcgaaggttgaggtcgcggtagaggcggcggtacggtgacgggcgcgatttcggtttttcggttttttaaggggcggtttcgggatatttgagtttcgcggggtcgtgaacgtttagtatagtttcgggtcggaattacgatttattatatcgcgttggcgttgggaacggcgtcggtgacggatcgggggtcggaagtgaaggacgggggaggatcgttgttttcggcgtcgtaattgttgttatttttttcgcgttatggttgcgttcggtcgttaggtaagttcgagttgggcgcgcgggttttttcgggtcgtaggcgggcgggtagcgacgtagaggaatcgcggtcgtcgagtgttttacggttaggtcgtggagttttttcggaggttcgtgtacgttgatttggttttggtattttggattcgtggttttgtttaattattgtgggatatagagttgatattttttt

SEQ ID NO: 22038 - DNA, 529 bp, Artificial Sequence
  chemically treated genomic DNA (Homo sapiens) CpG-island No: 22038
aaaaaaatatcaactctatatcccacaataattaaacaaaaccacgaatccaaaataccaaaaccaaatcaacgtacacgaacctccgaaaaaactccacgacctaaccgtaaaacactcgacgaccgcgattcctctacgtcgctacccgcccgcctacgacccgaaaaaacccgcgcgcccaactcgaacttacctaacgaccgaacgcaaccataacgcgaaaaaaataacaacaattacgacgccgaaaacaacgatcctcccccgtccttcacttccgacccccgatccgtcaccgacgccgttcccaacgccaacgcgatataataaatcgtaattccgacccgaaactatactaaacgttcacgaccccgcgaaactcaaatatcccgaaaccgccccttaaaaaaccgaaaaaccgaaatcgcgcccgtcaccgtaccgccgcctctaccgcgacctcaaccttcgaaaacctcgatatccgattattcccgttacactaccgtatcccgtttcgcaaaac

SEQ ID NO: 22039 - DNA, 529 bp, Artificial Sequence
  chemically treated genomic DNA (Homo sapiens) CpG-island No: 22039
aaaaaaatgttaattttatattttataataattgagtagagttacgggtttaggatgttaaaattaggttagcgtgtacggattttcgggagggttttacgatttggtcgtgaaatattcggcggtcgcggtttttttgcgtcgttgttcgttcgtttgcgattcggagaagttcgcgcgtttagttcgagtttatttgacggtcgaacgtagttatagcgcggagaagatggtagtagttacggcgtcggaagtagcggttttttttcgttttttattttcggttttcggttcgttatcgacgtcgtttttagcgttagcgcggtgtggtggatcgtgatttcggttcggagttgtgttgagcgtttacggtttcgcggggtttaggtgtttcggggtcgttttttagaaagtcggaaggtcggagtcgcgttcgttatcgtgtcgtcgtttttgtcgcggttttagttttcgggggtttcggtgttcggttgttttcgttgtattgtcgtgtttcgtttcgtagagt

SEQ ID NO: 22040 - DNA, 529 bp, Artificial Sequence
  chemically treated genomic DNA (Homo sapiens) CpG-island No: 22040
actctacgaaacgaaacacgacaatacaacgaaaacaaccgaacaccgaaacccccgaaaactaaaaccgcgacaaaaacgacgacacgataacgaacgcgactccgaccttccgactttctaaaaaacgaccccgaaacacctaaaccccgcgaaaccgtaaacgctcaacacaactccgaaccgaaatcacgatccaccacaccgcgctaacgctaaaaacgacgtcgataacgaaccgaaaaccgaaaataaaaaacgaaaaaaaaccgctacttccgacgccgtaactactaccatcttctccgcgctataactacgttcgaccgtcaaataaactcgaactaaacgcgcgaacttctccgaatcgcaaacgaacgaacaacgacgcaaaaaaaccgcgaccgccgaatatttcacgaccaaatcgtaaaaccctcccgaaaatccgtacacgctaacctaattttaacatcctaaacccgtaactctactcaattattataaaatataaaattaacattttttt

SEQ ID NO: 22041 - DNA, 1218 bp, Artificial Sequence
  chemically treated genomic DNA (Homo sapiens) CpG-island No: 22041
gcgcgtacgtcgggttttagcggcgcgtgtagttagtcgtcgggattttcgttttgtagtggttcgggttttacgtttacgttggcgacgtttacggtttttagtttcgcggttagggttgggttgtttagtacgtaggttttgggcgcgggggcgtcggttaggcgttggcgtaggtagagcgcggtgtagtaggtcgtgtcgaagatttttaggttggcgtcgggtttcgcggggtcgtcgaagtttaggcgtcgtagtttttcggcgtaggtagcgcgggttttgttgttgttgttggtgatgaagtttaggcgtttgtcgcgggttcgtagcgttcgtagggtttcgggcgcgttaggtacggcggttttttcgcgttatagtacgtcgtcgtagtcgaatagtagcgtgtttacgtcggttagtagcgtttgtgttcgttcggcgtttagtcgtacgtagcgggcgtcgtcgttatcggttttcgtcgtcgttatcgtcgttcgtcggtcgtcgtcgttcgtcggtcgtttttcgtagtcgttcgtcgcggcgtttttttcgttttcggcgcgtttattggtttagcgtttcgcgttcgtcgtttattggtttgtattttcgttaattcgttttcgtttttcgcgggttgcgggagtttagcgttaatcggtgaggttcggcgcggggagaggggcgattattggttatcggttttgggacgtttcggtgattggttggtagggttttaatcggtattcggagtgaagcgttcgttgcggaaatgcggtagaggggagagtagcgtaggcgtaaggtcgttgttttcgggttgtcgcgggtcgtttatttattggaagcgagtggttagtttaggtgacgaggttttttacggagtgattcgggttaggtcggttgtttattggtcggtttttttcgcgggtatgggcggggttttcgtaggagcgtcgcgggagggggtcggggtattttcgtcggtcgtgttcgtgtttttgtgtcgtggacgcgttcgggatacggggttattacgtgggtcgtttatcggttagtttcgcgagttagttcggggtttttttttcggtaggcgtgagtacgcgttttagttttttgtaaaaacgcgttttcggttttttggaggtaatacgaattagttattattaggttgggggattagggtttaaggatattgtttag

SEQ ID NO: 22042 - DNA, 1218 bp, Artificial Sequence
  chemically treated genomic DNA (Homo sapiens) CpG-island No: 22042
ctaaacaatatccttaaaccctaatcccccaacctaataataactaattcgtattacctccaaaaaaccgaaaacgcgtttttacaaaaaactaaaacgcgtactcacgcctaccgaaaaaaaaaccccgaactaactcgcgaaactaaccgataaacgacccacgtaataaccccgtatcccgaacgcgtccacgacacaaaaacacgaacacgaccgacgaaaataccccgaccccctcccgcgacgctcctacgaaaaccccgcccatacccgcgaaaaaaaccgaccaataaacaaccgacctaacccgaatcactccgtaaaaaacctcgtcacctaaactaaccactcgcttccaataaataaacgacccgcgacaacccgaaaacaacgaccttacgcctacgctactctcccctctaccgcatttccgcaacgaacgcttcactccgaataccgattaaaaccctaccaaccaatcaccgaaacgtcccaaaaccgataaccaataatcgcccctctccccgcgccgaacctcaccgattaacgctaaactcccgcaacccgcgaaaaacgaaaacgaattaacgaaaatacaaaccaataaacgacgaacgcgaaacgctaaaccaataaacgcgccgaaaacgaaaaaaacgccgcgacgaacgactacgaaaaacgaccgacgaacgacgacgaccgacgaacgacgataacgacgacgaaaaccgataacgacgacgcccgctacgtacgactaaacgccgaacgaacacaaacgctactaaccgacgtaaacacgctactattcgactacgacgacgtactataacgcgaaaaaaccgccgtacctaacgcgcccgaaaccctacgaacgctacgaacccgcgacaaacgcctaaacttcatcaccaacaacaacaacaaaacccgcgctacctacgccgaaaaactacgacgcctaaacttcgacgaccccgcgaaacccgacgccaacctaaaaatcttcgacacgacctactacaccgcgctctacctacgccaacgcctaaccgacgcccccgcgcccaaaacctacgtactaaacaacccaaccctaaccgcgaaactaaaaaccgtaaacgtcgccaacgtaaacgtaaaacccgaaccactacaaaacgaaaatcccgacgactaactacacgcgccgctaaaacccgacgtacgcgc

SEQ ID NO: 22043 - DNA, 1218 bp, Artificial Sequence
  chemically treated genomic DNA (Homo sapiens) CpG-island No: 22043
ttagatagtgtttttagattttaattttttagtttggtaatggttggttcgtgttatttttaaggaatcgggaacgcgtttttgtaaaggattgaggcgcgtatttacgtttgtcggggaaggagtttcgggttggttcgcgggattggtcggtaagcgatttacgtggtggtttcgtgtttcgagcgcgtttacggtatagaggtacgggtacggtcgacgaaggtgtttcggttttttttcgcggcgtttttgcgagagtttcgtttatgttcgcgggagagatcggttaatggatagtcggtttggttcgggttatttcgtgaagggtttcgttatttaggttgattattcgtttttaatgggtgagcggttcgcggtagttcgggaatagcggttttgcgtttgcgttgtttttttttttgtcgtattttcgtagcgagcgttttatttcgaatgtcggttggagttttgttagttaattatcggggcgttttaaggtcggtagttaatgatcgttttttttttcgcgtcgggttttatcgattggcgttgagttttcgtagttcgcgggaggcgggggcggattggcgaaggtgtaggttaatgggcggcgggcgcgaggcgttgggttaatgagcgcgtcgggggcggggagggcgtcgcggcgggcggttgcgaggagcggtcggcgggcggcggcggtcggcgggcggcgatggcggcggcggaggtcggtggcgacgacgttcgttgcgtgcggttgagcgtcgagcgggtataggcgttgttggtcgacgtggatacgttgttgttcgattgcgacggcgtgttgtggcgcggggagatcgtcgtgtttggcgcgttcgaggttttgcgggcgttgcgagttcgcggtaagcgtttgggttttattattaataatagtagtaagattcgcgttgtttacgtcgagaagttgcggcgtttgggtttcggcggtttcgcggggttcggcgttagtttggaggttttcggtacggtttattgtatcgcgttttatttgcgttagcgtttggtcggcgttttcgcgtttaaggtttacgtgttgggtagtttagttttggtcgcggagttggaggtcgtgggcgtcgttagcgtgggcgtggggttcgagttattgtagggcgagggtttcggcgattggttgtacgcgtcgttggagttcgacgtgcgcgt

SEQ ID NO: 22044 - DNA, 1218 bp, Artificial Sequence
  chemically treated genomic DNA (Homo sapiens) CpG-island No: 22044
acgcgcacgtcgaactccaacgacgcgtacaaccaatcgccgaaaccctcgccctacaataactcgaaccccacgcccacgctaacgacgcccacgacctccaactccgcgaccaaaactaaactacccaacacgtaaaccttaaacgcgaaaacgccgaccaaacgctaacgcaaataaaacgcgatacaataaaccgtaccgaaaacctccaaactaacgccgaaccccgcgaaaccgccgaaacccaaacgccgcaacttctcgacgtaaacaacgcgaatcttactactattattaataataaaacccaaacgcttaccgcgaactcgcaacgcccgcaaaacctcgaacgcgccaaacacgacgatctccccgcgccacaacacgccgtcgcaatcgaacaacaacgtatccacgtcgaccaacaacgcctatacccgctcgacgctcaaccgcacgcaacgaacgtcgtcgccaccgacctccgccgccgccatcgccgcccgccgaccgccgccgcccgccgaccgctcctcgcaaccgcccgccgcgacgccctccccgcccccgacgcgctcattaacccaacgcctcgcgcccgccgcccattaacctacaccttcgccaatccgcccccgcctcccgcgaactacgaaaactcaacgccaatcgataaaacccgacgcgaaaaaaaaaacgatcattaactaccgaccttaaaacgccccgataattaactaacaaaactccaaccgacattcgaaataaaacgctcgctacgaaaatacgacaaaaaaaaaaacaacgcaaacgcaaaaccgctattcccgaactaccgcgaaccgctcacccattaaaaacgaataatcaacctaaataacgaaacccttcacgaaataacccgaaccaaaccgactatccattaaccgatctctcccgcgaacataaacgaaactctcgcaaaaacgccgcgaaaaaaaaccgaaacaccttcgtcgaccgtacccgtacctctataccgtaaacgcgctcgaaacacgaaaccaccacgtaaatcgcttaccgaccaatcccgcgaaccaacccgaaactccttccccgacaaacgtaaatacgcgcctcaatcctttacaaaaacgcgttcccgattccttaaaaataacacgaaccaaccattaccaaactaaaaaattaaaatctaaaaacactatctaa

SEQ ID NO: 22045 - DNA, 747 bp, Artificial Sequence
  chemically treated genomic DNA (Homo sapiens) CpG-island No: 22045
ggaagcgttggggcgcggttgtttagtagtcgttagttcgttcgtttttcgcgttttttggtttttaaattcgagtgtagtttcgaatataggtttttttgtcgtttcgttttttggttggtaatttgttttatcgtaattacgttttttttatagtttcgttttattttcgtttttagcgcgttcggtttcgtttttgttttttaaggttatatcgttatttaggttcggtttttcgtttgttcgttaattcgtttcggttttgtttcgttttttttttgtcgtttttttacgttggtttcggcgcggttcgttgttatgacgatatggtcgtaaattcgttatttttttgcggcgcgttgcgatatggagggcgcgatggtagtgcgggtgacggtcgtttatacggtagaagtttaggtcgaagtcgggcgggaagcgggcgagggtgtagttgcggcggtggcggcggttttggtttttagcggttttttcggtttttcggcgttttttagcgaggaaggtaatcgggtcgattcggagggtgcggtcggggtgcgggtagtttatttcgggttggtagaggttcggatggttcgagttgcgggttcgatcgatttttttagatttagatatttcgcggatttcgcgggatttttatagttttttacgaaatttttaggtttgttgcgatttttacgggttttttttgcggggcgtttgttattttttttttttggtgtgcgt

SEQ ID NO: 22046 - DNA, 747 bp, Artificial Sequence
  chemically treated genomic DNA (Homo sapiens) CpG-island No: 22046
acgcacaccaaaaaaaaaaaataacaaacgccccgcaaaaaaaacccgtaaaaatcgcaacaaacctaaaaatttcgtaaaaaactataaaaatcccgcgaaatccgcgaaatatctaaatctaaaaaaatcgatcgaacccgcaactcgaaccatccgaacctctaccaacccgaaataaactacccgcaccccgaccgcaccctccgaatcgacccgattaccttcctcgctaaaaaacgccgaaaaaccgaaaaaaccgctaaaaaccaaaaccgccgccaccgccgcaactacaccctcgcccgcttcccgcccgacttcgacctaaacttctaccgtataaacgaccgtcacccgcactaccatcgcgccctccatatcgcaacgcgccgcaaaaaaataacgaatttacgaccatatcgtcataacaacgaaccgcgccgaaaccaacgtaaaaaaacgacaaaaaaaaaacgaaacaaaaccgaaacgaattaacgaacaaacgaaaaaccgaacctaaataacgatataaccttaaaaaacaaaaacgaaaccgaacgcgctaaaaacgaaaataaaacgaaactataaaaaaaacgtaattacgataaaacaaattaccaaccaaaaaacgaaacgacaaaaaaacctatattcgaaactacactcgaatttaaaaaccaaaaaacgcgaaaaacgaacgaactaacgactactaaacaaccgcgccccaacgcttcc

SEQ ID NO: 22047 - DNA, 747 bp, Artificial Sequence
  chemically treated genomic DNA (Homo sapiens) CpG-island No: 22047
acgtatattagagaggggggatgataggcgtttcgtaggagaggttcgtgagggtcgtagtaaatttgggggtttcgtggagggttgtgagggtttcgcgagattcgcgaggtgtttgggtttgggagggtcggtcgagttcgtagttcgggttattcgggtttttgttagttcgggatgaattgttcgtatttcggtcgtatttttcgggtcggttcggttatttttttcgttgaagggcgtcgggaggtcgaggaagtcgttgggggttaaggtcgtcgttatcgtcgtaattgtattttcgttcgtttttcgttcggtttcggtttgggtttttgtcgtatgagcggtcgttattcgtattgttatcgcgttttttatgtcgtaacgcgtcgtaggaagatggcggatttacgattatgtcgttataataacgggtcgcgtcgaggttagcgtgagggaacggtaagaggagggcggggtagaatcggagcggattgacggataggcggggagtcgggtttggatagcggtgtggttttaaagggtagaggcggggtcgggcgcgttgagagcgaagatggggcgggattgtggggagggcgtggttacggtggagtagattgttagttagggggcggggcggtagaaggatttatgttcgaggttgtattcggatttgagagttagagaacgcgaggggcgagcggattggcggttgttaggtagtcgcgttttagcgttttt

SEQ ID NO: 22048 - DNA, 747 bp, Artificial Sequence
  chemically treated genomic DNA (Homo sapiens) CpG-island No: 22048
aaaaacgctaaaacgcgactacctaacaaccgccaatccgctcgcccctcgcgttctctaactctcaaatccgaatacaacctcgaacataaatccttctaccgccccgccccctaactaacaatctactccaccgtaaccacgccctccccacaatcccgccccatcttcgctctcaacgcgcccgaccccgcctctaccctttaaaaccacaccgctatccaaacccgactccccgcctatccgtcaatccgctccgattctaccccgccctcctcttaccgttccctcacgctaacctcgacgcgacccgttattataacgacataatcgtaaatccgccatcttcctacgacgcgttacgacataaaaaacgcgataacaatacgaataacgaccgctcatacgacaaaaacccaaaccgaaaccgaacgaaaaacgaacgaaaatacaattacgacgataacgacgaccttaacccccaacgacttcctcgacctcccgacgcccttcaacgaaaaaaataaccgaaccgacccgaaaaatacgaccgaaatacgaacaattcatcccgaactaacaaaaacccgaataacccgaactacgaactcgaccgaccctcccaaacccaaacacctcgcgaatctcgcgaaaccctcacaaccctccacgaaacccccaaatttactacgaccctcacgaacctctcctacgaaacgcctatcatcccccctctctaatatacgt

SEQ ID NO: 22049 - DNA, 774 bp, Artificial Sequence
  chemically treated genomic DNA (Homo sapiens) CpG-island No: 22049
gggcgcgcggggtcgtaggtcgggggtttagcgggttttttttattttttaggaaagacgcggtgtcggtcgtggatatttatttgtatttagatttcgaggacgtttttagtcgcgagtttttcgtggttaagttttcggttttcggtatcggtgagcgggtttcgttttttttttttcgtcgagttttgacgtttttattttttttcgtagtagtatagaatttggtgttgatttcgttgtacgcggcgtcgtattaagtcgtggcggagatcgacgcgttttacgacgtgtatttggacgtgatcgataagtggggtatcgacgtaagtttatttttcggtttcggggtttttgtaggcgcgtttcgggggtttggtttatgagggcgggatttcgacggtttttgcggcggtttagatacggtttcgcggcgttcgtaggatatgttgtttttgggcgattttaacgtcgattgtagttatgtgcgggcgtaggattgggtcgttattcgtttgaggagtagtgaggtttttaagtggtttatttttgatagcgtcgatattacggtgggtaatttagattgcgtttacgatcgtattgtggtttgtggcgttcgtttgcgtcggagtttgaagttttagtcggttatcgtgtacgatttttaggaggaattcggtttggattagatttaggcgagtgggtcgtggggcggtgttggttttgggtttttatcgttcgggcgtacgtaggtagtagggagggtttagcgtt

SEQ ID NO: 22050 - DNA, 774 bp, Artificial Sequence
  chemically treated genomic DNA (Homo sapiens) CpG-island No: 22050
aacgctaaaccctccctactacctacgtacgcccgaacgataaaaacccaaaaccaacaccgccccacgacccactcgcctaaatctaatccaaaccgaattcctcctaaaaatcgtacacgataaccgactaaaacttcaaactccgacgcaaacgaacgccacaaaccacaatacgatcgtaaacgcaatctaaattacccaccgtaatatcgacgctatcaaaaataaaccacttaaaaacctcactactcctcaaacgaataacgacccaatcctacgcccgcacataactacaatcgacgttaaaatcgcccaaaaacaacatatcctacgaacgccgcgaaaccgtatctaaaccgccgcaaaaaccgtcgaaatcccgccctcataaaccaaacccccgaaacgcgcctacaaaaaccccgaaaccgaaaaataaacttacgtcgataccccacttatcgatcacgtccaaatacacgtcgtaaaacgcgtcgatctccgccacgacttaatacgacgccgcgtacaacgaaatcaacaccaaattctatactactacgaaaaaaaataaaaacgtcaaaactcgacgaaaaaaaaaaaacgaaacccgctcaccgataccgaaaaccgaaaacttaaccacgaaaaactcgcgactaaaaacgtcctcgaaatctaaatacaaataaatatccacgaccgacaccgcgtctttcctaaaaaataaaaaaaacccgctaaacccccgacctacgaccccgcgcgccc

SEQ ID NO: 22051 - DNA, 774 bp, Artificial Sequence
  chemically treated genomic DNA (Homo sapiens) CpG-island No: 22051
ggcgttggattttttttgttgtttgcgtgcgttcgggcggtggggatttaagattagtatcgttttacggtttattcgtttgagtttggtttaggtcgaattttttttggaagtcgtgtacggtggtcgattggggttttaggtttcggcgtaggcgggcgttataggttataatgcggtcgtaggcgtagtttgagttgtttatcgtggtgtcggcgttgttagggatgagttatttgaagattttattgttttttagacggatggcggtttagttttgcgttcgtatatagttgtagtcggcgttgaagtcgtttaggaatagtatgttttgcgggcgtcgcggagtcgtgtttgagtcgtcgtaggagtcgtcgaggtttcgtttttatgaattagattttcggggcgcgtttgtagggatttcgggatcgaggggtgggtttacgtcggtgttttatttgtcgattacgtttaggtatacgtcgtagagcgcgtcgattttcgttacggtttgatgcggcgtcgcgtgtagcgggattagtattaggttttgtgttgttgcgggaaggggtgggggcgttagagttcggcgggaggggaggggcggggttcgtttatcggtgtcgggggtcgagaatttgattacgaagggttcgcggttgaagacgttttcggggtttgggtataggtaggtgtttacgatcgatatcgcgttttttttaggagatggggaggattcgttgagttttcgatttgcggtttcgcgcgttt

SEQ ID NO: 22052 - DNA, 774 bp, Artificial Sequence
  chemically treated genomic DNA (Homo sapiens) CpG-island No: 22052
aaacgcgcgaaaccgcaaatcgaaaactcaacgaatcctccccatctcctaaaaaaaacgcgatatcgatcgtaaacacctacctatacccaaaccccgaaaacgtcttcaaccgcgaacccttcgtaatcaaattctcgacccccgacaccgataaacgaaccccgcccctcccctcccgccgaactctaacgcccccaccccttcccgcaacaacacaaaacctaatactaatcccgctacacgcgacgccgcatcaaaccgtaacgaaaatcgacgcgctctacgacgtatacctaaacgtaatcgacaaataaaacaccgacgtaaacccacccctcgatcccgaaatccctacaaacgcgccccgaaaatctaattcataaaaacgaaacctcgacgactcctacgacgactcaaacacgactccgcgacgcccgcaaaacatactattcctaaacgacttcaacgccgactacaactatatacgaacgcaaaactaaaccgccatccgtctaaaaaacaataaaatcttcaaataactcatccctaacaacgccgacaccacgataaacaactcaaactacgcctacgaccgcattataacctataacgcccgcctacgccgaaacctaaaaccccaatcgaccaccgtacacgacttccaaaaaaaattcgacctaaaccaaactcaaacgaataaaccgtaaaacgatactaatcttaaatccccaccgcccgaacgcacgcaaacaacaaaaaaaatccaacgcc

SEQ ID NO: 22053 - DNA, 1005 bp, Artificial Sequence
  chemically treated genomic DNA (Homo sapiens) CpG-island No: 22053
cgttcgcgtcgcgtttagacgcgtttattttgaggtataggttagtgtgcggggagggttcgggcggcgcgggagggttcggttaggcggcgtttattttagtatggtatttagttggtcggttaggtcgtcgaatatgttgtcgatgtcgtttaggatgttgttagtgttttttttcgtcgtcgagtcgttgcggggcgcggggtaaggggcgtgagtgggcggggcgggtttggttacgtttatttcgattaggatacgtttacgtttcgtattttcgtcggttttcgtttatcgtacgacgatttcggcggagtttcgtttacggtacgtttatttttgtcgagtttcgtttatttttgtcgagtttcgtttatttttgtcgagtttcgtttatttttgtcgagtttcgtttttcgttcgttaggtttcgtttcgtatttatcgcgggttttgcgcgtttttttgtcggatttttttttttatcgtttgtagcgtcgcggttaggtacgcgtttgttttttttagtttttgtcgggcgttgttttttggcgaggcgttttcgggcggggcggggggcgcggcggcggcggcggcggcggcggcggcggttcgcgggggtttggcgggtacgtgtagcgcgggcgcgtcgggggacgggggtttggcggggttggcgtttagcgagggcggcgtatcgggcggtttggcgagggcggcgggcggttgtcgcgcgggcgagggtgcgggtgaagggtcggcgttgttcgaaggtagtttcgcgatcgttttgacgggtttgggcgttgtgggcggcggcggcggtttgggagatacgggcggtggcgtgtcgtgggcgcgttttatttttgcggggaggattacgttggtatcgagcgggtacgagtttcgtcgtcgcgttttttgttttagtttttcgcggttttttttttagcggatcgggaaagattttgtttattttgtttttagttttggatggatgag

SEQ ID NO: 22054 - DNA, 1005 bp, Artificial Sequence
  chemically treated genomic DNA (Homo sapiens) CpG-island No: 22054
ctcatccatccaaaactaaaaacaaaataaacaaaatctttcccgatccgctaaaaaaaaaaccgcgaaaaactaaaacaaaaaacgcgacgacgaaactcgtacccgctcgataccaacgtaatcctccccgcaaaaataaaacgcgcccacgacacgccaccgcccgtatctcccaaaccgccgccgccgcccacaacgcccaaacccgtcaaaacgatcgcgaaactaccttcgaacaacgccgacccttcacccgcaccctcgcccgcgcgacaaccgcccgccgccctcgccaaaccgcccgatacgccgccctcgctaaacgccaaccccgccaaacccccgtcccccgacgcgcccgcgctacacgtacccgccaaacccccgcgaaccgccgccgccgccgccgccgccgccgccgcgccccccgccccgcccgaaaacgcctcgccaaaaaacaacgcccgacaaaaactaaaaaaaacaaacgcgtacctaaccgcgacgctacaaacgataaaaaaaaaaatccgacaaaaaaacgcgcaaaacccgcgataaatacgaaacgaaacctaacgaacgaaaaacgaaactcgacaaaaataaacgaaactcgacaaaaataaacgaaactcgacaaaaataaacgaaactcgacaaaaataaacgtaccgtaaacgaaactccgccgaaatcgtcgtacgataaacgaaaaccgacgaaaatacgaaacgtaaacgtatcctaatcgaaataaacgtaaccaaacccgccccgcccactcacgccccttaccccgcgccccgcaacgactcgacgacgaaaaaaaacactaacaacatcctaaacgacatcgacaacatattcgacgacctaaccgaccaactaaataccatactaaaataaacgccgcctaaccgaaccctcccgcgccgcccgaaccctccccgcacactaacctatacctcaaaataaacgcgtctaaacgcgacgcgaacg

SEQ ID NO: 22055 - DNA, 1005 bp, Artificial Sequence
  chemically treated genomic DNA (Homo sapiens) CpG-island No: 22055
tttatttatttagggttgggggtaaggtgagtagggtttttttcggttcgttggggaggaagtcgcgggaggttggggtagggggcgcggcggcggaattcgtgttcgttcggtgttagcgtggtttttttcgtagaggtgaagcgcgtttacggtacgttatcgttcgtgttttttaagtcgtcgtcgtcgtttatagcgtttaagttcgttaaggcggtcgcggggttgttttcgggtagcgtcggttttttattcgtattttcgttcgcgcgatagtcgttcgtcgttttcgttaagtcgttcggtacgtcgttttcgttgggcgttagtttcgttaagttttcgtttttcggcgcgttcgcgttgtacgtgttcgttaagttttcgcgagtcgtcgtcgtcgtcgtcgtcgtcgtcgtcgcgtttttcgtttcgttcgaaggcgtttcgttaggggatagcgttcggtagaaattggaggagataagcgcgtgtttggtcgcggcgttgtaggcggtggaggagaagattcggtaggaggacgcgtagggttcgcggtaggtgcggggcggggtttggcgggcggagggcggggttcggtagagatgggcggggttcggtagagatgggcggggttcggtagagatgggcggggttcggtagagatgggcgtgtcgtgagcggggtttcgtcgaggtcgtcgtgcggtaggcggaagtcgacggagatgcgggacgtgggcgtgttttggtcggggtgggcgtggttagattcgtttcgtttatttacgttttttgtttcgcgtttcgtagcgattcggcggcggaaaagagtattggtagtattttggacgatatcggtagtatgttcgacgatttggtcgattagttggatgttatgttggagtgaacgtcgtttggtcgggttttttcgcgtcgttcgggtttttttcgtatattgatttatattttaggatgggcgcgtttgggcgcggcgcgagcg

SEQ ID NO: 22056 - DNA, 1005 bp, Artificial Sequence
  chemically treated genomic DNA (Homo sapiens) CpG-island No: 22056
cgctcgcgccgcgcccaaacgcgcccatcctaaaatataaatcaatatacgaaaaaaacccgaacgacgcgaaaaaacccgaccaaacgacgttcactccaacataacatccaactaatcgaccaaatcgtcgaacatactaccgatatcgtccaaaatactaccaatactcttttccgccgccgaatcgctacgaaacgcgaaacaaaaaacgtaaataaacgaaacgaatctaaccacgcccaccccgaccaaaacacgcccacgtcccgcatctccgtcgacttccgcctaccgcacgacgacctcgacgaaaccccgctcacgacacgcccatctctaccgaaccccgcccatctctaccgaaccccgcccatctctaccgaaccccgcccatctctaccgaaccccgccctccgcccgccaaaccccgccccgcacctaccgcgaaccctacgcgtcctcctaccgaatcttctcctccaccgcctacaacgccgcgaccaaacacgcgcttatctcctccaatttctaccgaacgctatcccctaacgaaacgccttcgaacgaaacgaaaaacgcgacgacgacgacgacgacgacgacgacgactcgcgaaaacttaacgaacacgtacaacgcgaacgcgccgaaaaacgaaaacttaacgaaactaacgcccaacgaaaacgacgtaccgaacgacttaacgaaaacgacgaacgactatcgcgcgaacgaaaatacgaataaaaaaccgacgctacccgaaaacaaccccgcgaccgccttaacgaacttaaacgctataaacgacgacgacgacttaaaaaacacgaacgataacgtaccgtaaacgcgcttcacctctacgaaaaaaaccacgctaacaccgaacgaacacgaattccgccgccgcgccccctaccccaacctcccgcgacttcctccccaacgaaccgaaaaaaaccctactcaccttacccccaaccctaaataaataaa

SEQ ID NO: 22057 - DNA, 524 bp, Artificial Sequence
  chemically treated genomic DNA (Homo sapiens) CpG-island No: 22057
tcgttcggcgtcgggtggggggtttcgcgtcggggaggggttttcggggtttttattcgcgtttcgcgttttcggtatttattggttttttcgggtcgcggtttttgtagtagtttttgcgcggtttttacgtttttcgtttttatcgtttgtattagtttttgttttttttttatggcgcggtcggggtcgtagcgacgcggttgcgttcgtgagttcggcgcggtttagaggcggcggcggtttcgcggtatcggtcgtttttttcgtcgtttttttcgtcgttttttcgtcgttcgtcgttttttcgtttttttcgggtttcggtttgggttcgggttttcggcgcggagggggcggggagcgcgttacgggcgggggggggttcgggggcggaggaggaggaagaataaaaaaattttagcgtatatttaaattaacgcgatacgtaagaacgaatcgatatttagagaaacggggagtaataattgaagagggattaatagcgtagtaaatattttata

SEQ ID NO: 22058 - DNA, 524 bp, Artificial Sequence
  chemically treated genomic DNA (Homo sapiens) CpG-island No: 22058
tataaaatatttactacgctattaatccctcttcaattattactccccgtttctctaaatatcgattcgttcttacgtatcgcgttaatttaaatatacgctaaaatttttttattcttcctcctcctccgcccccgaacccccccccgcccgtaacgcgctccccgccccctccgcgccgaaaacccgaacccaaaccgaaacccgaaaaaaacgaaaaaacgacgaacgacgaaaaaacgacgaaaaaaacgacgaaaaaaacgaccgataccgcgaaaccgccgccgcctctaaaccgcgccgaactcacgaacgcaaccgcgtcgctacgaccccgaccgcgccataaaaaaaaaacaaaaactaatacaaacgataaaaacgaaaaacgtaaaaaccgcgcaaaaactactacaaaaaccgcgacccgaaaaaaccaataaataccgaaaacgcgaaacgcgaataaaaaccccgaaaacccctccccgacgcgaaaccccccacccgacgccgaacga

SEQ ID NO: 22059 - DNA, 524 bp, Artificial Sequence
  chemically treated genomic DNA (Homo sapiens) CpG-island No: 22059
tgtgaagtatttgttacgttgttggtttttttttagttattgtttttcgtttttttgagtgtcggttcgtttttgcgtgtcgcgttagtttgggtgtgcgttggggtttttttgtttttttttttttttcgttttcgggttttttttcgttcgtgacgcgtttttcgtttttttcgcgtcgggagttcgagtttaagtcggagttcgaggagggcgaaggggcggcgggcggcgaggaggcggcgggggaggcggcgggggaggcggtcggtgtcgcggggtcgtcgtcgtttttgagtcgcgtcgagtttacgagcgtagtcgcgtcgttgcggtttcggtcgcgttatggggaaggagtaggagttggtgtaggcggtgaaggcggaggacgtagggatcgcgtagaggttgttgtagaggtcgcggttcgggaaggttagtgagtgtcgggggcgcggggcgcgggtgggagtttcgggggttttttttcggcgcggagttttttattcggcgtcgggcgg

SEQ ID NO: 22060 - DNA, 524 bp, Artificial Sequence
  chemically treated genomic DNA (Homo sapiens) CpG-island No: 22060
ccgcccgacgccgaataaaaaactccgcgccgaaaaaaaacccccgaaactcccacccgcgccccgcgcccccgacactcactaaccttcccgaaccgcgacctctacaacaacctctacgcgatccctacgtcctccgccttcaccgcctacaccaactcctactccttccccataacgcgaccgaaaccgcaacgacgcgactacgctcgtaaactcgacgcgactcaaaaacgacgacgaccccgcgacaccgaccgcctcccccgccgcctcccccgccgcctcctcgccgcccgccgccccttcgccctcctcgaactccgacttaaactcgaactcccgacgcgaaaaaaacgaaaaacgcgtcacgaacgaaaaaaaacccgaaaacgaaaaaaaaaaaaaaacaaaaaaaccccaacgcacacccaaactaacgcgacacgcaaaaacgaaccgacactcaaaaaaacgaaaaacaataactaaaaaaaaaccaacaacgtaacaaatacttcaca

SEQ ID NO: 22061 - DNA, 1536 bp, Artificial Sequence
  chemically treated genomic DNA (Homo sapiens) CpG-island No: 22061
atcgtaattttaaaattggcgcggtttttttagatcgtagatttcgggttttgggtcgtaggcggggtcggatacgtgatcgtcggggttttcgggcgtgaggtcggtagatattttaggttggacggtttttattttttcggatacgtttgtaggggttacgaatgtaaatttttttcgagacgtttttgagttttcgatttttagattttaattcggttcgaacggttttttagttcgaaatacggttggattataatcggtcgatgtttcggtttatttttttagtttttttggttcgtcgtacggaatttttaggggttgcgtcggcgggcgagtcgagggtgagaagttgggcgaggttttagaagtgaaggggtagtttcggtttagattgtgtatatacgatttttgaaaagtaaacgttcgcggggttgggcgattttgggtgggacgcgttcgggttagtttcgtaggcgggtgtgtacgtttcggttaagttgaggtgtagagaggcgattcgggcgtcgcgttttcgtttttcgttttcgaggatagtgacgcgcgtggggaggacggcgcggtcgtagagcgtcgtttagagtcgcgtatacgcgatttgttaggagttcgcgggtagataatcggcggggaaggacgagagggggcgtagacgagggagggaaagatgggtttgtttgatagcgcgcggcggtcgagagtttttaggatatttttgcgttcggagcgtttcgttttcggggtatttggagggcgcgtcgtattttgtatttgtattttaggttttttatcgtttcgatttcgtcgttttcgggttttcggtagggggttttcggcgtagttgttttcgatttattagtttttcggttattatcggggtgcgggatgcggagttcgcgcgtcgtcgtcggttttcggttgtgtttcgcggttcggttcgtagcgtcgcgttttcgtagtttttttacgtgttagtttaggcgggtggaatatagagatattaaatattgaagacgcgcggcgacgtgttcgtagcgcgacgtaggtttcgtttttcgtttttgtgttcgcgcgttttcgagttcgtttcgtttatttgcgcgtgcgcgtcgtcggtcgttttcggtagtgttttcgtcgcgttttttttagttgcgttagagggggcgcggtttatagcgttgggttaatatttcgtcgtcgttcggagtcgggttttgttcgcgttttcgcgagagagtcgttattttttcggtgttcgggagaggggtcgggcgggacggtatagtaatcggaggaattttgattttttgtttcgtaagtttagtatcggttttgtcgttttgtttcgaagggttaattaggttattttttgtttcgggacggagagcgttttggaaaaggcggaggggtcggtgaggagtagggtttttttcgtttcggggttttgagtttttttgtgatcgttatttttttgtagcgtataattgggttggttattaataattgttcgat

SEQ ID NO: 22062 - DNA, 1536 bp, Artificial Sequence
  chemically treated genomic DNA (Homo sapiens) CpG-island No: 22062
atcgaacaattattaataaccaacccaattatacgctacaaaaaaataacgatcacaaaaaaactcaaaaccccgaaacgaaaaaaaccctactcctcaccgacccctccgccttttccaaaacgctctccgtcccgaaacaaaaaataacctaattaacccttcgaaacaaaacgacaaaaccgatactaaacttacgaaacaaaaaatcaaaattcctccgattactataccgtcccgcccgacccctctcccgaacaccgaaaaaataacgactctctcgcgaaaacgcgaacaaaacccgactccgaacgacgacgaaatattaacccaacgctataaaccgcgccccctctaacgcaactaaaaaaaacgcgacgaaaacactaccgaaaacgaccgacgacgcgcacgcgcaaataaacgaaacgaactcgaaaacgcgcgaacacaaaaacgaaaaacgaaacctacgtcgcgctacgaacacgtcgccgcgcgtcttcaatatttaatatctctatattccacccgcctaaactaacacgtaaaaaaactacgaaaacgcgacgctacgaaccgaaccgcgaaacacaaccgaaaaccgacgacgacgcgcgaactccgcatcccgcaccccgataataaccgaaaaactaataaatcgaaaacaactacgccgaaaaccccctaccgaaaacccgaaaacgacgaaatcgaaacgataaaaaacctaaaatacaaatacaaaatacgacgcgccctccaaataccccgaaaacgaaacgctccgaacgcaaaaatatcctaaaaactctcgaccgccgcgcgctatcaaacaaacccatctttccctccctcgtctacgccccctctcgtccttccccgccgattatctacccgcgaactcctaacaaatcgcgtatacgcgactctaaacgacgctctacgaccgcgccgtcctccccacgcgcgtcactatcctcgaaaacgaaaaacgaaaacgcgacgcccgaatcgcctctctacacctcaacttaaccgaaacgtacacacccgcctacgaaactaacccgaacgcgtcccacccaaaatcgcccaaccccgcgaacgtttacttttcaaaaatcgtatatacacaatctaaaccgaaactaccccttcacttctaaaacctcgcccaacttctcaccctcgactcgcccgccgacgcaacccctaaaaattccgtacgacgaaccaaaaaaactaaaaaaataaaccgaaacatcgaccgattataatccaaccgtatttcgaactaaaaaaccgttcgaaccgaattaaaatctaaaaatcgaaaactcaaaaacgtctcgaaaaaaatttacattcgtaacccctacaaacgtatccgaaaaaataaaaaccgtccaacctaaaatatctaccgacctcacgcccgaaaaccccgacgatcacgtatccgaccccgcctacgacccaaaacccgaaatctacgatctaaaaaaaccgcgccaattttaaaattacgat

SEQ ID NO: 22063 - DNA, 1536 bp, Artificial Sequence
  chemically treated genomic DNA (Homo sapiens) CpG-island No: 22063
atcgagtaattattaatggttaatttaattatacgttataaggaaatgacggttatagggaagtttaaagtttcgaagcgagggaagttttgttttttatcggttttttcgttttttttagggcgtttttcgtttcgaggtaggagatggtttggttgatttttcgagataaggcggtaaaatcggtgttgggtttgcggggtagggaattaaggttttttcggttgttgtatcgtttcgttcggtttttttttcgggtatcggagagatgacggttttttcgcgagagcgcgagtaagattcggtttcgggcggcggcgggatgttagtttagcgttgtagatcgcgttttttttggcgtagttgggagaggcgcggcggaggtattgtcgggagcggtcggcggcgcgtacgcgtaggtgagcggggcgggttcgggagcgcgcgggtataagggcgaggggcggggtttgcgtcgcgttgcgggtacgtcgtcgcgcgtttttagtatttaatgtttttgtgttttattcgtttgggttagtacgtgggggagttgcggaagcgcggcgttgcgggtcgggtcgcggggtatagtcgggggtcggcggcggcgcgcggatttcgtatttcgtatttcgatggtagtcgaggagttggtaggtcgggggtagttgcgtcggggattttttgtcggagattcgaaggcggcggggtcggggcgatggggagtttgaggtgtaggtgtagggtgcgacgcgttttttaggtatttcgggggcgggacgtttcggacgtagaggtgttttgggggttttcggtcgtcgcgcgttgttaggtaggtttatttttttttttttcgtttgcgttttttttcgttttttttcgtcggttgtttgttcgcgggtttttgatagatcgcgtgtgcgcggttttgggcggcgttttgcggtcgcgtcgttttttttacgcgcgttattgttttcgggggcggggggcgagggcgcgacgttcgggtcgtttttttgtattttaatttaatcggagcgtgtatattcgtttgcgaggttgattcgagcgcgttttatttaaggtcgtttagtttcgcgggcgtttattttttaaaggtcgtgtgtatatagtttgagtcggagttgtttttttatttttggagtttcgtttaattttttattttcggttcgttcgtcggcgtagtttttgggagtttcgtgcggcgagttaggggaattgggaagatgggtcgggatatcggtcggttgtgatttaatcgtgtttcgggttgagggatcgttcgaatcgaattggggtttggaggtcggaggtttaggggcgtttcggggggaatttgtattcgtagtttttgtaggcgtgttcggaggggtggaggtcgtttagtttggggtgtttgtcgattttacgttcgggggtttcgacggttacgtgttcggtttcgtttgcggtttagggttcggggtttgcgatttggagggatcgcgttagttttggggttacgat

SEQ ID NO: 22064 - DNA, 1536 bp, Artificial Sequence
  chemically treated genomic DNA (Homo sapiens) CpG-island No: 22064
atcgtaaccccaaaactaacgcgatccctccaaatcgcaaaccccgaaccctaaaccgcaaacgaaaccgaacacgtaaccgtcgaaacccccgaacgtaaaatcgacaaacaccccaaactaaacgacctccacccctccgaacacgcctacaaaaactacgaatacaaattccccccgaaacgcccctaaacctccgacctccaaaccccaattcgattcgaacgatccctcaacccgaaacacgattaaatcacaaccgaccgatatcccgacccatcttcccaattcccctaactcgccgcacgaaactcccaaaaactacgccgacgaacgaaccgaaaataaaaaattaaacgaaactccaaaaataaaaaaacaactccgactcaaactatatacacacgacctttaaaaaataaacgcccgcgaaactaaacgaccttaaataaaacgcgctcgaatcaacctcgcaaacgaatatacacgctccgattaaattaaaatacaaaaaaacgacccgaacgtcgcgccctcgccccccgcccccgaaaacaataacgcgcgtaaaaaaaacgacgcgaccgcaaaacgccgcccaaaaccgcgcacacgcgatctatcaaaaacccgcgaacaaacaaccgacgaaaaaaaacgaaaaaaaacgcaaacgaaaaaaaaaaaaataaacctacctaacaacgcgcgacgaccgaaaacccccaaaacacctctacgtccgaaacgtcccgcccccgaaatacctaaaaaacgcgtcgcaccctacacctacacctcaaactccccatcgccccgaccccgccgccttcgaatctccgacaaaaaatccccgacgcaactacccccgacctaccaactcctcgactaccatcgaaatacgaaatacgaaatccgcgcgccgccgccgacccccgactataccccgcgacccgacccgcaacgccgcgcttccgcaactcccccacgtactaacccaaacgaataaaacacaaaaacattaaatactaaaaacgcgcgacgacgtacccgcaacgcgacgcaaaccccgcccctcgcccttatacccgcgcgctcccgaacccgccccgctcacctacgcgtacgcgccgccgaccgctcccgacaatacctccgccgcgcctctcccaactacgccaaaaaaaacgcgatctacaacgctaaactaacatcccgccgccgcccgaaaccgaatcttactcgcgctctcgcgaaaaaaccgtcatctctccgatacccgaaaaaaaaaccgaacgaaacgatacaacaaccgaaaaaaccttaattccctaccccgcaaacccaacaccgattttaccgccttatctcgaaaaatcaaccaaaccatctcctacctcgaaacgaaaaacgccctaaaaaaaacgaaaaaaccgataaaaaacaaaacttccctcgcttcgaaactttaaacttccctataaccgtcatttccttataacgtataattaaattaaccattaataattactcgat

SEQ ID NO: 22065 - DNA, 610 bp, Artificial Sequence
  chemically treated genomic DNA (Homo sapiens) CpG-island No: 22065
cgtagtcgttgttatagcggtttacgaagggcgggtagtcgttgagtaggatatataagatgacgtttaggttttataggtcgtagcgtttgtcgtagatgttagttttttcgttgaaggtttttattattttcggggttatgtatttcgtcgagtcgtattgcgggcgggggaggggcgcgttagtcggggttttttagtattacgtgggaatcgagttcgggtaattgcgggttatttgcgttagtcggttcggatttcgtttcgtcgggttcgattaattagcggttgtcgggaacgcgttttcgtttaattagtaggtgtagagttcgtttttttttcgtcgcggtttcgttttattcggttaaatatcgacgcgttggggcgtttgttcgaggtttcgtcgcgatatttcgtttaattaattagcggttgttgttaggcggaagttcgagtttcgcggtttggagttgttggatggtttaggtttcgcgaggttatgtaatcgtagagtaggcggtcgagtttttagtttttttcgcgggtttttatcggagtgagtagtttcggggtggagataggggagtagttttcgttgagtttgatgtcg

SEQ ID NO: 22066 - DNA, 610 bp, Artificial Sequence
  chemically treated genomic DNA (Homo sapiens) CpG-island No: 22066
cgacatcaaactcaacgaaaactactcccctatctccaccccgaaactactcactccgataaaaacccgcgaaaaaaactaaaaactcgaccgcctactctacgattacataacctcgcgaaacctaaaccatccaacaactccaaaccgcgaaactcgaacttccgcctaacaacaaccgctaattaattaaacgaaatatcgcgacgaaacctcgaacaaacgccccaacgcgtcgatatttaaccgaataaaacgaaaccgcgacgaaaaaaaaacgaactctacacctactaattaaacgaaaacgcgttcccgacaaccgctaattaatcgaacccgacgaaacgaaatccgaaccgactaacgcaaataacccgcaattacccgaactcgattcccacgtaatactaaaaaaccccgactaacgcgcccctcccccgcccgcaatacgactcgacgaaatacataaccccgaaaataataaaaaccttcaacgaaaaaactaacatctacgacaaacgctacgacctataaaacctaaacgtcatcttatatatcctactcaacgactacccgcccttcgtaaaccgctataacaacgactacg

SEQ ID NO: 22067 - DNA, 610 bp, Artificial Sequence
  chemically treated genomic DNA (Homo sapiens) CpG-island No: 22067
cggtattaaatttaacggggattgtttttttatttttatttcggagttgtttatttcggtgagggttcgcggggagggttgggggttcggtcgtttgttttgcggttgtataatttcgcggagtttgggttatttagtagttttaggtcgcggagttcgggttttcgtttagtaatagtcgttgattggttgggcggggtgtcgcggcggggtttcgagtaggcgttttaacgcgtcggtgtttggtcgggtggggcggggtcgcggcgggggaggggcgagttttgtatttgttgattgggcgggggcgcgttttcggtagtcgttgattggtcgggttcggcggggcggggttcgagtcggttggcgtaggtgattcgtagttattcgggttcggtttttacgtaatgttgggaaatttcggttgacgcgtttttttttcgttcgtagtgcggttcggcggagtatatggtttcggaggtagtggaggtttttagcgaggaggttagtatttacgataagcgttgcgatttgtggagtttgggcgttattttgtatattttatttagcggttattcgtttttcgtgggtcgttgtggtagcgattgcg

SEQ ID NO: 22068 - DNA, 610 bp, Artificial Sequence
  chemically treated genomic DNA (Homo sapiens) CpG-island No: 22068
cgcaatcgctaccacaacgacccacgaaaaacgaataaccgctaaataaaatatacaaaataacgcccaaactccacaaatcgcaacgcttatcgtaaatactaacctcctcgctaaaaacctccactacctccgaaaccatatactccgccgaaccgcactacgaacgaaaaaaaaacgcgtcaaccgaaatttcccaacattacgtaaaaaccgaacccgaataactacgaatcacctacgccaaccgactcgaaccccgccccgccgaacccgaccaatcaacgactaccgaaaacgcgcccccgcccaatcaacaaatacaaaactcgcccctcccccgccgcgaccccgccccacccgaccaaacaccgacgcgttaaaacgcctactcgaaaccccgccgcgacaccccgcccaaccaatcaacgactattactaaacgaaaacccgaactccgcgacctaaaactactaaataacccaaactccgcgaaattatacaaccgcaaaacaaacgaccgaacccccaaccctccccgcgaaccctcaccgaaataaacaactccgaaataaaaataaaaaaacaatccccgttaaatttaataccg

SEQ ID NO: 22069 - DNA, 930 bp, Artificial Sequence
  chemically treated genomic DNA (Homo sapiens) CpG-island No: 22069
cggtcggttcgggtagtttcgggtgtagggcgggggttaggtacgagtttcgggagtcgattttaggggcgggtttcgcgttttttacgtcggttatttcggtggtttagttcggagcgtttttaaatcgatttcgggttttattttgaacgaacggtggaaattttgaagttcggttggttttttttgtattattttttgttcgggtttcgttagcgggggaggggatcgagggttcggggggaggttcgagggcgggcggtcgggcggggggcggtcgaggaggggattttgcgggcgggagtagataaagggagggcggtgagcggagttcggtttgttaggagcgcggatcgggcgggggcggcgagggtttcgcggggttcgtttttcgttatcgggtcggtgttttcggggtcgttttggggttcgtatttatcggggtcgggtttgggtcggggtcgtagtgtcgtcgtcgttttacgtcgcgtagttcggatttcgtttcgcggatcgcgcggggaatagcgtcgtcgtcgtcgttagcgcggatttttttatttgggttatcgtcgttgagaggagtcgggcgcgtcgtcgtcgtcgttatttttataggttcggatttgttttggtttcgttttcgacgtaggtttcgttcggttttattttttgcgtacgacgtgggcggagttagaagagggcgtttttcgggaatttagtgcggttgcgcgtttcggcggtggggcgtgttcgaaacggttagcgtacgtttgcgtagtgcggcgtacgggggtttcggtgcggaatttaggtagcgattttgcggcgcgttcggagttggtttgtttttgtcgtttgaggttcgcggggttcgtgggatttgcgaggttttgggtcgtgttttatcgtttggttttatatagggta

SEQ ID NO: 22070 - DNA, 930 bp, Artificial Sequence
  chemically treated genomic DNA (Homo sapiens) CpG-island No: 22070
taccctatataaaaccaaacgataaaacacgacccaaaacctcgcaaatcccacgaaccccgcgaacctcaaacgacaaaaacaaaccaactccgaacgcgccgcaaaatcgctacctaaattccgcaccgaaacccccgtacgccgcactacgcaaacgtacgctaaccgtttcgaacacgccccaccgccgaaacgcgcaaccgcactaaattcccgaaaaacgccctcttctaactccgcccacgtcgtacgcaaaaaataaaaccgaacgaaacctacgtcgaaaacgaaaccaaaacaaatccgaacctataaaaataacgacgacgacgacgcgcccgactcctctcaacgacgataacccaaataaaaaaatccgcgctaacgacgacgacgacgctattccccgcgcgatccgcgaaacgaaatccgaactacgcgacgtaaaacgacgacgacactacgaccccgacccaaacccgaccccgataaatacgaaccccaaaacgaccccgaaaacaccgacccgataacgaaaaacgaaccccgcgaaaccctcgccgcccccgcccgatccgcgctcctaacaaaccgaactccgctcaccgccctccctttatctactcccgcccgcaaaatcccctcctcgaccgccccccgcccgaccgcccgccctcgaacctccccccgaaccctcgatcccctcccccgctaacgaaacccgaacaaaaaataatacaaaaaaaaccaaccgaacttcaaaatttccaccgttcgttcaaaataaaacccgaaatcgatttaaaaacgctccgaactaaaccaccgaaataaccgacgtaaaaaacgcgaaacccgcccctaaaatcgactcccgaaactcgtacctaacccccgccctacacccgaaactacccgaaccgaccg

SEQ ID NO: 22071 - DNA, 930 bp, Artificial Sequence
  chemically treated genomic DNA (Homo sapiens) CpG-island No: 22071
tgttttgtgtggggttaggcggtaggatacggtttagggtttcgtaggttttacgggtttcgcgagttttaggcggtaaaaataggttagtttcgggcgcgtcgtagggtcgttgtttaggtttcgtatcgagattttcgtgcgtcgtattgcgtaggcgtgcgttagtcgtttcggatacgttttatcgtcggagcgcgtagtcgtattgggttttcggagagcgtttttttttggtttcgtttacgtcgtgcgtagggggtgaggtcgggcggagtttgcgtcgggggcggggttagagtaggttcgggtttataaaggtggcggcggcggcgacgcgttcggttttttttagcggcggtggtttaggtagaggggttcgcgttggcggcggcggcggcgttgtttttcgcgcggttcgcggagcggggttcgggttgcgcgacgtggggcggcggcggtattgcggtttcggtttaagttcgatttcggtgagtgcgaattttagggcggtttcgaggatatcgattcggtagcgggaaacgggtttcgcggagttttcgtcgttttcgttcggttcgcgtttttggtaggtcgggtttcgtttatcgttttttttttgtttgttttcgttcgtagggtttttttttcggtcgtttttcgttcggtcgttcgttttcgggttttttttcgggttttcggttttttttttcgttggcggggttcggatagaagatggtgtagaagaaattagtcgaattttagggtttttatcgttcgtttaaggtgaggttcggggtcggtttgggggcgtttcgggttggattatcggaatggtcggcgtggggggcgcggggttcgtttttaagatcggttttcggggttcgtgtttggttttcgttttatattcggggttgttcgggtcggtcg

SEQ ID NO: 22072 - DNA, 930 bp, Artificial Sequence
  chemically treated genomic DNA (Homo sapiens) CpG-island No: 22072
cgaccgacccgaacaaccccgaatataaaacgaaaaccaaacacgaaccccgaaaaccgatcttaaaaacgaaccccgcgccccccacgccgaccattccgataatccaacccgaaacgcccccaaaccgaccccgaacctcaccttaaacgaacgataaaaaccctaaaattcgactaatttcttctacaccatcttctatccgaaccccgccaacgaaaaaaaaaaccgaaaacccgaaaaaaaacccgaaaacgaacgaccgaacgaaaaacgaccgaaaaaaaaaccctacgaacgaaaacaaacaaaaaaaaaacgataaacgaaacccgacctaccaaaaacgcgaaccgaacgaaaacgacgaaaactccgcgaaacccgtttcccgctaccgaatcgatatcctcgaaaccgccctaaaattcgcactcaccgaaatcgaacttaaaccgaaaccgcaataccgccgccgccccacgtcgcgcaacccgaaccccgctccgcgaaccgcgcgaaaaacaacgccgccgccgccgccaacgcgaacccctctacctaaaccaccgccgctaaaaaaaaccgaacgcgtcgccgccgccgccacctttataaacccgaacctactctaaccccgcccccgacgcaaactccgcccgacctcaccccctacgcacgacgtaaacgaaaccaaaaaaaaacgctctccgaaaacccaatacgactacgcgctccgacgataaaacgtatccgaaacgactaacgcacgcctacgcaatacgacgcacgaaaatctcgatacgaaacctaaacaacgaccctacgacgcgcccgaaactaacctatttttaccgcctaaaactcgcgaaacccgtaaaacctacgaaaccctaaaccgtatcctaccgcctaaccccacacaaaaca

SEQ ID NO: 22073 - DNA, 732 bp, Artificial Sequence
  chemically treated genomic DNA (Homo sapiens) CpG-island No: 22073
agtttcgcgtcggttgacgttcggtcggtgtagagaaggtttagttcggggttcggtttatttatggagcgtcgtgaggacgttcggttagaggaggtttcgttgagtcgggggcggggtaggtgaacggaatttggtagtgtttttcgaagaatagggtcgataacgcgatttatcgggttcgaaagaaggttaggtttagttatcgttcgtcgcgggtaggtttaaatcgtagcggtgaggttagtcggtacgtaattcggtagttacgattttttttagtttagtgggcggttatttacggtgttcggtgttaaggagacggtcggcgggaggttgacgagagtcgggaggcgttagcgaaggaagagaaaaatcgaagacgaagttattatagcgtcgtagcgcggcgcggcgtttgttttataggagagggcgtaggcgtcgaggatttcggggcgcgcggcgttatatcgcggttgggttggtcgtcgagatcgtttgacggtaggtcgagaacggttgggcgggtttaggtcgggaggcggtaaggagttgtcgggggcggttggtcgggggatcggggggtcggaagagttttcgtttttttttagttttgaaagcgtcgcgttgtttcgttaattgggtgtcggatttcgattggtttagaaaggttttttaggtagcggtgttttaagtcgagtgaaagattttagttaaaaagtttggaaa

SEQ ID NO: 22074 - DNA, 732 bp, Artificial Sequence
  chemically treated genomic DNA (Homo sapiens) CpG-island No: 22074
tttccaaactttttaactaaaatctttcactcgacttaaaacaccgctacctaaaaaacctttctaaaccaatcgaaatccgacacccaattaacgaaacaacgcgacgctttcaaaactaaaaaaaaacgaaaactcttccgaccccccgatcccccgaccaaccgcccccgacaactccttaccgcctcccgacctaaacccgcccaaccgttctcgacctaccgtcaaacgatctcgacgaccaacccaaccgcgatataacgccgcgcgccccgaaatcctcgacgcctacgccctctcctataaaacaaacgccgcgccgcgctacgacgctataataacttcgtcttcgatttttctcttccttcgctaacgcctcccgactctcgtcaacctcccgccgaccgtctccttaacaccgaacaccgtaaataaccgcccactaaactaaaaaaaatcgtaactaccgaattacgtaccgactaacctcaccgctacgatttaaacctacccgcgacgaacgataactaaacctaaccttctttcgaacccgataaatcgcgttatcgaccctattcttcgaaaaacactaccaaattccgttcacctaccccgcccccgactcaacgaaacctcctctaaccgaacgtcctcacgacgctccataaataaaccgaaccccgaactaaaccttctctacaccgaccgaacgtcaaccgacgcgaaact

SEQ ID NO: 22075 - DNA, 732 bp, Artificial Sequence
  chemically treated genomic DNA (Homo sapiens) CpG-island No: 22075
tttttaggttttttaattggggttttttattcggtttagggtatcgttgtttgaaagatttttttaggttagtcggggttcggtatttagttgacgagatagcgcggcgtttttagagttggggagaggcgaaaattttttcggtttttcgatttttcggttagtcgttttcggtagttttttgtcgtttttcggtttgggttcgtttagtcgttttcggtttgtcgttaggcgatttcggcggttagtttagtcgcgatgtgacgtcgcgcgtttcggggttttcggcgtttgcgtttttttttataaagtagacgtcgcgtcgcgttgcgacgttgtagtggtttcgttttcggttttttttttttttcgttaacgtttttcggttttcgttagtttttcgtcggtcgtttttttaatatcgaatatcgtgagtagtcgtttattgaattggaaagggtcgtggttatcggattgcgtgtcggttggttttatcgttgcggtttgggtttgttcgcggcgggcggtgattgggtttggttttttttcgggttcggtggatcgcgttgtcgattttgtttttcgggagatattattaggtttcgtttatttgtttcgttttcgatttagcgaggttttttttggtcgggcgtttttacggcgttttataagtgagtcgaatttcgggttgggttttttttgtatcggtcgagcgttagtcggcgcggagtt

SEQ ID NO: 22076 - DNA, 732 bp, Artificial Sequence
  chemically treated genomic DNA (Homo sapiens) CpG-island No: 22076
aactccgcgccgactaacgctcgaccgatacaaaaaaaacccaacccgaaattcgactcacttataaaacgccgtaaaaacgcccgaccaaaaaaaacctcgctaaatcgaaaacgaaacaaataaacgaaacctaataatatctcccgaaaaacaaaatcgacaacgcgatccaccgaacccgaaaaaaaaccaaacccaatcaccgcccgccgcgaacaaacccaaaccgcaacgataaaaccaaccgacacgcaatccgataaccacgaccctttccaattcaataaacgactactcacgatattcgatattaaaaaaacgaccgacgaaaaactaacgaaaaccgaaaaacgttaacgaaaaaaaaaaaaaaccgaaaacgaaaccactacaacgtcgcaacgcgacgcgacgtctactttataaaaaaaaacgcaaacgccgaaaaccccgaaacgcgcgacgtcacatcgcgactaaactaaccgccgaaatcgcctaacgacaaaccgaaaacgactaaacgaacccaaaccgaaaaacgacaaaaaactaccgaaaacgactaaccgaaaaatcgaaaaaccgaaaaaattttcgcctctccccaactctaaaaacgccgcgctatctcgtcaactaaataccgaaccccgactaacctaaaaaaatctttcaaacaacgataccctaaaccgaataaaaaaccccaattaaaaaacctaaaaa

SEQ ID NO: 22077 - DNA, 513 bp, Artificial Sequence
  chemically treated genomic DNA (Homo sapiens) CpG-island No: 22077
gtttttttttattaattttaattttttaatattttttttatttatttttaaatattttttattcgttttgttaattttcgtttttttttttttgtcggatttcgttttttgatttttgtttcgtttcgtagttttttagttttcggagttttattttgttttttagttttgtttcgttttagcgtttatttatttattttttaattttttttatttttattttcgggtcgtttagtttaattttttatttagtttgttttttttattttcgtagtttttttttttattaagtttcgttttttattaagtttcgtttatttttttaagtttttcgttttggtttcgttttatattttttattatttttcggttttttttcgagtttcgtttttacgttggtttcgtttagcgggggagttcgtttttattttttgttttttttgggtttaggcgatgtcgtcgttattagttacgcggagtagttttagttcgtcgtggttattaagggtttta

SEQ ID NO: 22078 - DNA, 513 bp, Artificial Sequence
  chemically treated genomic DNA (Homo sapiens) CpG-island No: 22078
taaaacccttaataaccacgacgaactaaaactactccgcgtaactaataacgacgacatcgcctaaacccaaaaaaaacaaaaaataaaaacgaactcccccgctaaacgaaaccaacgtaaaaacgaaactcgaaaaaaaaccgaaaaataataaaaaatataaaacgaaaccaaaacgaaaaacttaaaaaaataaacgaaacttaataaaaaacgaaacttaataaaaaaaaaaactacgaaaataaaaaaaacaaactaaataaaaaattaaactaaacgacccgaaaataaaaataaaaaaaattaaaaaataaataaataaacgctaaaacgaaacaaaactaaaaaacaaaataaaactccgaaaactaaaaaactacgaaacgaaacaaaaatcaaaaaacgaaatccgacaaaaaaaaaaaaacgaaaattaacaaaacgaataaaaaatatttaaaaataaataaaaaaaatattaaaaaattaaaattaataaaaaaaaac

SEQ ID NO: 22079 - DNA, 513 bp, Artificial Sequence
  chemically treated genomic DNA (Homo sapiens) CpG-island No: 22079
tggggtttttggtggttacgacgggttggggttgtttcgcgtggttggtgacggcggtatcgtttggatttagggagaataggaggtgagggcggattttttcgttgggcggggttaacgtgggggcggggttcggggaggggtcggagagtggtaggggatgtggggcggagttaaaacgaaagatttggggaagtgggcgaggtttaatgaggggcggggtttagtgagggaggagattgcgggaatgggaggggtaaattgagtgaagggttgggttgagcgattcgggaatgaaaatgggaggggttgaggagtgggtgggtgggcgttggaacgaggtaagattaagaggtagagtgaggtttcgagagttgggaggttgcgaagcggggtagggattaaggggcggggttcggtagagagaaggaggcggggattggtagagcgggtgggagatgtttggggatgggtaggggaggtgttgagaggttggagttgataggagggggt

SEQ ID NO: 22080 - DNA, 513 bp, Artificial Sequence
  chemically treated genomic DNA (Homo sapiens) CpG-island No: 22080
accccctcctatcaactccaacctctcaacacctcccctacccatccccaaacatctcccacccgctctaccaatccccgcctccttctctctaccgaaccccgccccttaatccctaccccgcttcgcaacctcccaactctcgaaacctcactctacctcttaatcttacctcgttccaacgcccacccacccactcctcaacccctcccattttcattcccgaatcgctcaacccaacccttcactcaatttacccctcccattcccgcaatctcctccctcactaaaccccgcccctcattaaacctcgcccacttccccaaatctttcgttttaactccgccccacatcccctaccactctccgacccctccccgaaccccgcccccacgttaaccccgcccaacgaaaaaatccgccctcacctcctattctccctaaatccaaacgataccgccgtcaccaaccacgcgaaacaaccccaacccgtcgtaaccaccaaaaacccca

SEQ ID NO: 22081 - DNA, 533 bp, Artificial Sequence
  chemically treated genomic DNA (Homo sapiens) CpG-island No: 22081
ttaatgcgttcgatttttattatttattttttagttttttatcgtcgaagatttgtgtttgatttttttggcgttttttttatttttttttttcggagtatttttttacgttttttgatacgattattttttttttttattattatatcgtttttttatttttttttttttttttgattgtcgcgcgtgttatatatttttgttcgtatcgtatttttttttttttattttattcgattttttttttgtatttagtcgattttttttatttttttttttttatttttttcgttttttttttttaattttatcgtttttttatattttttttttttttatatttttatatttatttcgttttttattaattttttttttttttttttattttttcgtatttttttttttttttagtttattgtttttttttattatattttttacgtcgattttatttttttttattacgttattcgttttttttatatgtttttttttatatgtttttatatttttttattttattttatatt

SEQ ID NO: 22082 - DNA, 533 bp, Artificial Sequence
  chemically treated genomic DNA (Homo sapiens) CpG-island No: 22082
aatataaaataaaataaaaaaatataaaaacatataaaaaaaaacatataaaaaaaacgaataacgtaataaaaaaaaataaaatcgacgtaaaaaatataataaaaaaaaacaataaactaaaaaaaaaaaaaaatacgaaaaaataaaaaaaaaaaaaaaaaattaataaaaaacgaaataaatataaaaatataaaaaaaaaaaaaatataaaaaaacgataaaattaaaaaaaaaaaacgaaaaaaataaaaaaaaaaaaataaaaaaaatcgactaaatacaaaaaaaaaatcgaataaaataaaaaaaaaaaaatacgatacgaacaaaaatatataacacgcgcgacaatcaaaaaaaaaaaaaaaaataaaaaaacgatataataataaaaaaaaaaaataatcgtatcaaaaaacgtaaaaaaatactccgaaaaaaaaaaataaaaaaaacgccaaaaaaatcaaacacaaatcttcgacgataaaaaactaaaaaataaataataaaaatcgaacgcattaa

SEQ ID NO: 22083 - DNA, 533 bp, Artificial Sequence
  chemically treated genomic DNA (Homo sapiens) CpG-island No: 22083
ggtgtgaagtgaggtgaggaagtgtagaagtatataaagaagaatatgtgggagaagcgggtagcgtgataagagggagtggagtcgacgtggagggtgtgatgagagagggtagtagattaggagaggggaggagtgcggaggggtaggaggaaaggaggaaggttaatgggggacgaggtaaatgtagaagtgtagaggaaagaaaggtgtaggagggcggtggggttgagaggaagagacgagaggagtggagggagggagataaaggaaatcggttaggtgtaagaggaagatcgggtgaggtgaaggggagagagtgcggtgcgaatagaagtatatggtacgcgcggtagttagagggggaaaagagaatgagaggacggtgtggtggtaggaggagggggtggtcgtgttaagaagcgtagagaaatgtttcgagggaggagggtggagagagcgttagaagggttagatataggttttcggcggtgaagagttagagggtagatggtgagggtcggacgtattag

SEQ ID NO: 22084 - DNA, 533 bp, Artificial Sequence
  chemically treated genomic DNA (Homo sapiens) CpG-island No: 22084
ctaatacgtccgaccctcaccatctaccctctaactcttcaccgccgaaaacctatatctaacccttctaacgctctctccaccctcctccctcgaaacatttctctacgcttcttaacacgaccaccccctcctcctaccaccacaccgtcctctcattctcttttccccctctaactaccgcgcgtaccatatacttctattcgcaccgcactctctccccttcacctcacccgatcttcctcttacacctaaccgatttcctttatctccctccctccactcctctcgtctcttcctctcaaccccaccgccctcctacacctttctttcctctacacttctacatttacctcgtcccccattaaccttcctcctttcctcctacccctccgcactcctcccctctcctaatctactaccctctctcatcacaccctccacgtcgactccactccctcttatcacgctacccgcttctcccacatattcttctttatatacttctacacttcctcacctcacttcacacc

SEQ ID NO: 22085 - DNA, 840 bp, Artificial Sequence
  chemically treated genomic DNA (Homo sapiens) CpG-island No: 22085
acggggttatcggagggagatttaaggaaggatcgatgcggggcggtaataggcgggtttcgcggttatttgaaggagggtgacgtggcggtgaagggcgcgcgaagggtcgggcggggcggagtttggacgagtggtagggacggaggaggtgcggcggaatgaagagtgttggcggggtcgggtgagagtgacggagcggcgattgagtgagggtggggaggggagtggcggcggggaagtgtgcggtaggtgtggagagggggtggatgcgtcgcgagaggtgggcgacgtgggagggaggtggtggtgggggtgcgtgcgggcgggtcgaggggggtgggtcgaggagggggatcggcgtgtgtcgcgtgggagtggcgcgggagtgcgggagaggcggggtcggtggtcgttcgggttgtgtgcggggcgcgtgtcgtgtaggagtggtggtcgcgaggggcgcgtggcgggggggagtgggcgtggggggggggggtgcgggggtgtgggggggggggcggtgggggtgggggggggtggagagggggggggggggggggggggatgggggtggcgggggggggggggcggggagggggggggggtgggcgggggtggtgggggacggttggggggtgggggggggcggggggggggggggggggggatgggggggaggtggggagggggggggaggggtgaggtgggcgggggagggggggggtggggggggaggggtgggtgggtggtggggcggggggtggggggaggggggggtggcgggtggggggggggtgggggggtgcggggggggggggttaggaagagtataat

SEQ ID NO: 22086 - DNA, 840 bp, Artificial Sequence
  chemically treated genomic DNA (Homo sapiens) CpG-island No: 22086
attatactcttcctaaccccccccccccgcacccccccaccccccccccacccgccacccccccctccccccaccccccgccccaccacccacccacccctccccccccaccccccccctcccccgcccacctcacccctccccccccctccccacctcccccccatccccccccccccccccccccgcccccccccaccccccaaccgtcccccaccacccccgcccaccccccccccctccccgcccccccccccccgccacccccatccccccccccccccccccccctctccacccccccccacccccaccgcccccccccccacacccccgcaccccccccccccacgcccactcccccccgccacgcgcccctcgcgaccaccactcctacacgacacgcgccccgcacacaacccgaacgaccaccgaccccgcctctcccgcactcccgcgccactcccacgcgacacacgccgatccccctcctcgacccacccccctcgacccgcccgcacgcacccccaccaccacctccctcccacgtcgcccacctctcgcgacgcatccaccccctctccacacctaccgcacacttccccgccgccactcccctccccaccctcactcaatcgccgctccgtcactctcacccgaccccgccaacactcttcattccgccgcacctcctccgtccctaccactcgtccaaactccgccccgcccgacccttcgcgcgcccttcaccgccacgtcaccctccttcaaataaccgcgaaacccgcctattaccgccccgcatcgatccttccttaaatctccctccgataaccccgt

SEQ ID NO: 22087 - DNA, 840 bp, Artificial Sequence
  chemically treated genomic DNA (Homo sapiens) CpG-island No: 22087
gttatgttttttttggtttttttttttcgtatttttttattttttttttattcgttatttttttttttttttatttttcgttttattatttatttatttttttttttttattttttttttttttcgtttattttatttttttttttttttttttattttttttttattttttttttttttttttttcgtttttttttattttttaatcgttttttattattttcgtttatttttttttttttttcgttttttttttttcgttatttttatttttttttttttttttttttttttttatttttttttatttttatcgtttttttttttatattttcgtattttttttttttacgtttattttttttcgttacgcgtttttcgcgattattatttttgtacggtacgcgtttcgtatataattcgggcgattatcggtttcgtttttttcgtattttcgcgttatttttacgcggtatacgtcggttttttttttcggtttatttttttcgattcgttcgtacgtatttttattattattttttttttacgtcgtttatttttcgcggcgtatttattttttttttatatttgtcgtatattttttcgtcgttatttttttttttatttttatttagtcgtcgtttcgttatttttattcggtttcgttaatattttttatttcgtcgtatttttttcgtttttattattcgtttaagtttcgtttcgttcgatttttcgcgcgttttttatcgttacgttatttttttttaaatggtcgcggggttcgtttattgtcgtttcgtatcgatttttttttaagttttttttcgataatttcgt

SEQ ID NO: 22088 - DNA, 840 bp, Artificial Sequence
  chemically treated genomic DNA (Homo sapiens) CpG-island No: 22088
acgaaattatcgaaaaaaaacttaaaaaaaaatcgatacgaaacgacaataaacgaaccccgcgaccatttaaaaaaaaataacgtaacgataaaaaacgcgcgaaaaatcgaacgaaacgaaacttaaacgaataataaaaacgaaaaaaatacgacgaaataaaaaatattaacgaaaccgaataaaaataacgaaacgacgactaaataaaaataaaaaaaaaaataacgacgaaaaaatatacgacaaatataaaaaaaaaataaatacgccgcgaaaaataaacgacgtaaaaaaaaaataataataaaaatacgtacgaacgaatcgaaaaaaataaaccgaaaaaaaaaaccgacgtataccgcgtaaaaataacgcgaaaatacgaaaaaaacgaaaccgataatcgcccgaattatatacgaaacgcgtaccgtacaaaaataataatcgcgaaaaacgcgtaacgaaaaaaaataaacgtaaaaaaaaaaaatacgaaaatataaaaaaaaaaacgataaaaataaaaaaaaataaaaaaaaaaaaaaaaaaaaaaaaaaataaaaataacgaaaaaaaaaaaacgaaaaaaaaaaaaaaataaacgaaaataataaaaaacgattaaaaaataaaaaaaaacgaaaaaaaaaaaaaaaaaaaataaaaaaaaaataaaaaaaaaaaaaaaaaaataaaataaacgaaaaaaaaaaaaaataaaaaaaaaaaaataaataaataataaaacgaaaaataaaaaaaaaaaaaaataacgaataaaaaaaaaataaaaaaatacgaaaaaaaaaaaccaaaaaaaacataac

SEQ ID NO: 22089 - DNA, 559 bp, Artificial Sequence
  chemically treated genomic DNA (Homo sapiens) CpG-island No: 22089
gcgtttcgatttaggtacgtcgttattttattcgcgtatataattcggcggtagaaaagcgtttggcggcgattatcgtttaggatagttagcgtgcgaatgtttatgaagtgcgtgttgaagtttagcgtgcgcgttttaaattgttagcgtgggtcgattattacgattggttttttttcgtaaattacggaaattcgtattttgcgtttggattttaaaaagggtaatttcgacgttaataattatcgtacgggtattgcggaatatattaagtaggttattgttgagtaggaacgtttgggattggatgtgttggtatatggcgaggtcgagcgtaatgatatggtggaatattttggcgagtatttcgacggatttgtttttacgtaaaacggtttggtatagagttacggttttcgttgcgtgaagtatcgattgttattggtgatattagtcgttcggtatcgattatcgtggaatgggttaaatattttttaaatttgttattataattcgtgtaaagggtattttaatcgggtcggggaataaattttgt

SEQ ID NO: 22090 - DNA, 559 bp, Artificial Sequence
  chemically treated genomic DNA (Homo sapiens) CpG-island No: 22090
acaaaatttattccccgacccgattaaaataccctttacacgaattataataacaaatttaaaaaatatttaacccattccacgataatcgataccgaacgactaatatcaccaataacaatcgatacttcacgcaacgaaaaccgtaactctataccaaaccgttttacgtaaaaacaaatccgtcgaaatactcgccaaaatattccaccatatcattacgctcgacctcgccatataccaacacatccaatcccaaacgttcctactcaacaataacctacttaatatattccgcaatacccgtacgataattattaacgtcgaaattaccctttttaaaatccaaacgcaaaatacgaatttccgtaatttacgaaaaaaaaccaatcgtaataatcgacccacgctaacaatttaaaacgcgcacgctaaacttcaacacgcacttcataaacattcgcacgctaactatcctaaacgataatcgccgccaaacgcttttctaccgccgaattatatacgcgaataaaataacgacgtacctaaatcgaaacgc

SEQ ID NO: 22091 - DNA, 559 bp, Artificial Sequence
  chemically treated genomic DNA (Homo sapiens) CpG-island No: 22091
ataaaatttgtttttcggttcggttaagatattttttatacgggttgtggtgataggtttggggaatatttggtttattttacggtaatcggtgtcgggcggttaatgttattaatgataatcggtgttttacgtagcgggaatcgtagttttgtattaaatcgttttgcgtaaagataaattcgtcgaggtgttcgttaaagtattttattatgttattacgttcggtttcgttatgtattagtatatttagttttaaacgtttttgtttaataatggtttgtttgatatgtttcgtaatgttcgtgcggtagttgttggcgtcgagattgttttttttgaaatttagacgtagggtacgaattttcgtggtttgcgggaaggaattaatcgtggtggtcggtttacgttggtagtttaaaacgcgtacgttgggttttagtacgtattttatagatattcgtacgttggttgttttgggcggtgatcgtcgttagacgtttttttatcgtcggattatgtacgcgggtagagtgacgacgtgtttgaatcggggcgt

SEQ ID NO: 22092 - DNA, 559 bp, Artificial Sequence
  chemically treated genomic DNA (Homo sapiens) CpG-island No: 22092
acgccccgattcaaacacgtcgtcactctacccgcgtacataatccgacgataaaaaaacgtctaacgacgatcaccgcccaaaacaaccaacgtacgaatatctataaaatacgtactaaaacccaacgtacgcgttttaaactaccaacgtaaaccgaccaccacgattaattccttcccgcaaaccacgaaaattcgtaccctacgtctaaatttcaaaaaaaacaatctcgacgccaacaactaccgcacgaacattacgaaacatatcaaacaaaccattattaaacaaaaacgtttaaaactaaatatactaatacataacgaaaccgaacgtaataacataataaaatactttaacgaacacctcgacgaatttatctttacgcaaaacgatttaatacaaaactacgattcccgctacgtaaaacaccgattatcattaataacattaaccgcccgacaccgattaccgtaaaataaaccaaatattccccaaacctatcaccacaacccgtataaaaaatatcttaaccgaaccgaaaaacaaattttat

SEQ ID NO: 22093 - DNA, 817 bp, Artificial Sequence
  chemically treated genomic DNA (Homo sapiens) CpG-island No: 22093
ggggatggggcgtgtttagtattacggttcgttttatttatgtattcgttggtcgaattcgacgttcgttattgtcgagtttcgtttaggttttgttttttcgtagtcggttaggtcgagaggaggcgtggttattgtcgcgtcggggcggtttggcggaggggggggaggttttttttcgtttcgtgatattttgggcgagttcgcgggcgggttgtgggtcgcgagtcgtcgtgggagcgcgtgtcgcggtttttaggagtcgtcggtcgacgtttcgtttcgtttttttggcgtttaggtttcgcgcgagttcgcgtacgcgcgcgcgcgtattcgttagaggtttgtttgaggttcgcggggattgggcgggcggaggtcgggttgtcgaagtgtgaggggaggagttcgagtcgtcgttgttgtcgtcgttaagggagaggagtatgtttgtaattcgagttaagaaagtgaagatggttattaaattatgtttcgagtgcgattaataggtgggtgtcgggggtcgggcgcgcgggcgggcggtagtggtttggcggtcgttgtttgtggaggggggtttcgtcgggttttcggaggtcgagcggtgggtagattttggggttcgtcggcggcggcggggattcggggtcggtcgggttgtatcgaggggtttttcgggaaaagttcggggtcgtggttcgttagcgtttatttggcggcggttagacggttaagtttttttttgttgtgtttcggttattggaggagcgcgtttttggtgggtttatcgggcggttgtttggagttttag

SEQ ID NO: 22094 - DNA, 817 bp, Artificial Sequence
  chemically treated genomic DNA (Homo sapiens) CpG-island No: 22094
ctaaaactccaaacaaccgcccgataaacccaccaaaaacgcgctcctccaataaccgaaacacaacaaaaaaaaacttaaccgtctaaccgccgccaaataaacgctaacgaaccacgaccccgaacttttcccgaaaaacccctcgatacaacccgaccgaccccgaatccccgccgccgccgacgaaccccaaaatctacccaccgctcgacctccgaaaacccgacgaaacccccctccacaaacaacgaccgccaaaccactaccgcccgcccgcgcgcccgacccccgacacccacctattaatcgcactcgaaacataatttaataaccatcttcactttcttaactcgaattacaaacatactcctctcccttaacgacgacaacaacgacgactcgaactcctcccctcacacttcgacaacccgacctccgcccgcccaatccccgcgaacctcaaacaaacctctaacgaatacgcgcgcgcgcgtacgcgaactcgcgcgaaacctaaacgccaaaaaaacgaaacgaaacgtcgaccgacgactcctaaaaaccgcgacacgcgctcccacgacgactcgcgacccacaacccgcccgcgaactcgcccaaaatatcacgaaacgaaaaaaaacctcccccccctccgccaaaccgccccgacgcgacaataaccacgcctcctctcgacctaaccgactacgaaaaaacaaaacctaaacgaaactcgacaataacgaacgtcgaattcgaccaacgaatacataaataaaacgaaccgtaatactaaacacgccccatcccc

SEQ ID NO: 22095 - DNA, 817 bp, Artificial Sequence
  chemically treated genomic DNA (Homo sapiens) CpG-island No: 22095
ttggggttttagatagtcgttcggtgagtttattaaaggcgcgtttttttagtggtcgggatatagtaagaaggggtttggtcgtttggtcgtcgttaggtggacgttggcgggttacggtttcgggtttttttcgggaaatttttcggtgtagttcgatcggtttcggattttcgtcgtcgtcggcgggttttaggatttgtttatcgttcggttttcgggagttcggcgaggtttttttttatagataacggtcgttaagttattgtcgttcgttcgcgcgttcggttttcggtatttatttgttggtcgtattcggggtatgatttggtggttatttttatttttttggttcgagttgtagatatgttttttttttttagcggcggtagtagcgacggttcgggtttttttttttatatttcggtagttcggttttcgttcgtttagttttcgcgggttttaaataagtttttggcgggtgcgcgcgcgcgcgtgcgcgagttcgcgcgggatttgggcgttaagggggcggggcggagcgtcggtcggcggtttttggggatcgcgatacgcgtttttacggcggttcgcgatttatagttcgttcgcgagttcgtttagagtattacgagacgaggggagatttttttttttttcgttagatcgtttcggcgcggtagtggttacgttttttttcggtttggtcgattacgagggggtaaggtttgggcgggattcggtagtaacgggcgtcgagttcgattaacgaatgtataggtagggcgggtcgtagtgttgggtacgttttattttt

SEQ ID NO: 22096 - DNA, 817 bp, Artificial Sequence
  chemically treated genomic DNA (Homo sapiens) CpG-island No: 22096
aaaaataaaacgtacccaacactacgacccgccctacctatacattcgttaatcgaactcgacgcccgttactaccgaatcccgcccaaaccttaccccctcgtaatcgaccaaaccgaaaaaaaacgtaaccactaccgcgccgaaacgatctaacgaaaaaaaaaaaaatctcccctcgtctcgtaatactctaaacgaactcgcgaacgaactataaatcgcgaaccgccgtaaaaacgcgtatcgcgatccccaaaaaccgccgaccgacgctccgccccgcccccttaacgcccaaatcccgcgcgaactcgcgcacgcgcgcgcgcgcacccgccaaaaacttatttaaaacccgcgaaaactaaacgaacgaaaaccgaactaccgaaatataaaaaaaaaaacccgaaccgtcgctactaccgccgctaaaaaaaaaaaacatatctacaactcgaaccaaaaaaataaaaataaccaccaaatcataccccgaatacgaccaacaaataaataccgaaaaccgaacgcgcgaacgaacgacaataacttaacgaccgttatctataaaaaaaaacctcgccgaactcccgaaaaccgaacgataaacaaatcctaaaacccgccgacgacgacgaaaatccgaaaccgatcgaactacaccgaaaaatttcccgaaaaaaacccgaaaccgtaacccgccaacgtccacctaacgacgaccaaacgaccaaaccccttcttactatatcccgaccactaaaaaaacgcgcctttaataaactcaccgaacgactatctaaaaccccaa

SEQ ID NO: 22097 - DNA, 566 bp, Artificial Sequence
  chemically treated genomic DNA (Homo sapiens) CpG-island No: 22097
tagatagcggggtttgcgtttcgttgtcgggtttttcgttataaattcgattgtagtaggcgttggcggaatgaacggaaagttttttttggtttatttttttatttacggatagggttggttgtttttagggacgtgtgttatcgtcgtttgttatcgttttttttgttattttatttaagtttacggtcgagaagttttttttgaagtaggttttaaatttcgttcggttttagcgtttttcgttattttttcgtcgttcgtcgtttgggaagggcgcgggttttatttgagggtttagggtcgcgaggcggaagtttagttttggttttgcgcggtcgaatttattttagtatgtcgggttcggcgaggtttaggcgcggggttaggcgttcgattagtttcgattttatggcgtcggtattaaagcgaataattttcgtgaacgtcgcgggttaacgaaattcgcgcgtaaaggttgtatcggttagtgagagttaggttttattttcggcgtatttggattggttaggataggacgttgagatcgttttataaattaatta

SEQ ID NO: 22098 - DNA, 566 bp, Artificial Sequence
  chemically treated genomic DNA (Homo sapiens) CpG-island No: 22098
taattaatttataaaacgatctcaacgtcctatcctaaccaatccaaatacgccgaaaataaaacctaactctcactaaccgatacaacctttacgcgcgaatttcgttaacccgcgacgttcacgaaaattattcgctttaataccgacgccataaaatcgaaactaatcgaacgcctaaccccgcgcctaaacctcgccgaacccgacatactaaaataaattcgaccgcgcaaaaccaaaactaaacttccgcctcgcgaccctaaaccctcaaataaaacccgcgcccttcccaaacgacgaacgacgaaaaaataacgaaaaacgctaaaaccgaacgaaatttaaaacctacttcaaaaaaaacttctcgaccgtaaacttaaataaaataacaaaaaaaacgataacaaacgacgataacacacgtccctaaaaacaaccaaccctatccgtaaataaaaaaataaaccaaaaaaaactttccgttcattccgccaacgcctactacaatcgaatttataacgaaaaacccgacaacgaaacgcaaaccccgctatcta

SEQ ID NO: 22099 - DNA, 566 bp, Artificial Sequence
  chemically treated genomic DNA (Homo sapiens) CpG-island No: 22099
tgattggtttgtgggacggttttaacgttttgttttaattaatttagatgcgtcgggggtggggtttggtttttattggtcggtgtagtttttgcgcgcgggtttcgttgattcgcggcgtttacgggaattgttcgttttagtgtcggcgttatggggtcggagttgatcgggcgtttagtttcgcgtttgggtttcgtcgagttcgatatgttgaggtgagttcggtcgcgtaagattagggttgggttttcgtttcgcggttttgggtttttaggtgaggttcgcgttttttttaggcgacgggcggcgggggagtgacggggagcgttggggtcgggcggggtttagggtttattttaagaaaaatttttcggtcgtgagtttgaatgagatggtaagaagggcgatagtaaacggcgatggtatacgtttttgggaatagttagttttgttcgtgggtagaaaaatgagttagggagaatttttcgtttatttcgttaacgtttattgtagtcgggtttatagcggggaattcgataacgaggcgtagatttcgttgtttg

SEQ ID NO: 22100 - DNA, 566 bp, Artificial Sequence
  chemically treated genomic DNA (Homo sapiens) CpG-island No: 22100
caaacaacgaaatctacgcctcgttatcgaattccccgctataaacccgactacaataaacgttaacgaaataaacgaaaaattctccctaactcatttttctacccacgaacaaaactaactattcccaaaaacgtataccatcgccgtttactatcgcccttcttaccatctcattcaaactcacgaccgaaaaatttttcttaaaataaaccctaaaccccgcccgaccccaacgctccccgtcactcccccgccgcccgtcgcctaaaaaaaacgcgaacctcacctaaaaacccaaaaccgcgaaacgaaaacccaaccctaatcttacgcgaccgaactcacctcaacatatcgaactcgacgaaacccaaacgcgaaactaaacgcccgatcaactccgaccccataacgccgacactaaaacgaacaattcccgtaaacgccgcgaatcaacgaaacccgcgcgcaaaaactacaccgaccaataaaaaccaaaccccacccccgacgcatctaaattaattaaaacaaaacgttaaaaccgtcccacaaaccaatca

SEQ ID NO: 22101 - DNA, 1012 bp, Artificial Sequence
  chemically treated genomic DNA (Homo sapiens) CpG-island No: 22101
gttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcgtattcgttgggggcgtttagaaagatgtatagaggtaacggttaggggagcggaggtttaagttatatgtttgcgttttcgggggttagagttcgttagttttcgcggatttcggttcgcggttagttcgagcggttcgggtgagtagcggtatagcggttttttcgtttcgcggttttcgttcgtcgagacgtggttttaagaagtggtgtcgtagtcggggtagaggcggaggaagtcgagtcgggtaagtcgggaaggttgcggagacgttttgtcggggtaggtgttgtagttttagttagcggtttttacggagggggcgggaggggggtttttttttttaaatttgttttggttatcgattttt

SEQ ID NO: 22102 - DNA, 1012 bp, Artificial Sequence
  chemically treated genomic DNA (Homo sapiens) CpG-island No: 22102
aaaaatcgataaccaaaacaaatttaaaaaaaaaaacccccctcccgccccctccgtaaaaaccgctaactaaaactacaacacctaccccgacaaaacgtctccgcaaccttcccgacttacccgactcgacttcctccgcctctaccccgactacgacaccacttcttaaaaccacgtctcgacgaacgaaaaccgcgaaacgaaaaaaccgctataccgctactcacccgaaccgctcgaactaaccgcgaaccgaaatccgcgaaaactaacgaactctaacccccgaaaacgcaaacatataacttaaacctccgctcccctaaccgttacctctatacatctttctaaacgcccccaacgaatacgaacgacgaaacgaaaacgaacgcgccgaaaaaaaacgaaaaaaacgcgaaacttaaccgcgccgcgctacgccgaacgccgaactctccccgcgaactccccgaacccgcgcgcgcgccccccactacccccgccccccgcgcgacgcgtaccccccaccccccgccgcgcgccctcgcacccgcccgactccacgcgacgcgcgcctaccctaacgacaacgacgacgacgacgacgcgtcctcccccgaacgccgtctccaaaactactaactacgctctccattattccgcgactactacccgaaataaacgacgaaacgaaaaaaaaatatcgacttaaccgccgaaaaaaacttaccgctcgaacgaaccctcactacgaaaacgatacgaacccaaacgcgacgcgcgaaaactacaaaacgcctaacactaaaaattaccgacgcgcgaaaacctcctcctaactcccaaacactcgctactactaaacgcccctcgcatcctcgattactataaatatctcgctcctccgccgccccctccgcgcactccgaaaaaccgccgaaacgataacaacgacgcgactccgcgaatacccaaataaccgactcgacaacgacaaaacaataacaac

SEQ ID NO: 22103 - DNA, 1012 bp, Artificial Sequence
  chemically treated genomic DNA (Homo sapiens) CpG-island No: 22103
gggaatcgataattagaataggtttgaaaaaaaaagtttttttttcgtttttttcgtagagatcgttagttgaggttgtaatatttgtttcggtaaagcgttttcgtagttttttcggtttgttcgattcggtttttttcgtttttgtttcggttgcggtattattttttggagttacgtttcggcgagcgggggtcgcggagcgagggggtcgttgtgtcgttatttattcgagtcgttcgggttggtcgcgagtcgggattcgcgagggttggcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcgggagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagt

SEQ ID NO: 22104 - DNA, 1012 bp, Artificial Sequence
  chemically treated genomic DNA (Homo sapiens) CpG-island No: 22104
actaccactactctaccgctaccgaaccgatcacctaaacacccgcgaaaccgcgccgctactaccgccccgacgacctcccgaaatacgcgaaaaaaacgacgaaaaaacgaaatatccataataaccgaaaatacgaaaaacgcccaacaacaacgaatacctaaaaaccaaaaaaaaacccccgcgcgccgacaacccccaatactaaacgccctacaacccccgcgcgccgcgcctaaacccgcatcgctctcgcaataaaaatccgcccgaacgataaaccctccccgacgaccaaaccgacacctcccccccgcctcgccgcccaccccgaacaacaaccgcgaaacaataaaaaacgcaaccaacaaccctaaaaacgacgttcgaaaaaaaacgcgccgccgccgccgccgctaccgccaaaacaaacgcgcgccgcgtaaaaccgaacgaatacgaaaacgcgcgacgaaaaataaaaaacacgcgccgcgcgaaaaacgaaaacaataaaaaacgcgcgcgcgaacccgaaaaactcgcgaaaaaaacccgacgctcgacgcaacgcgacgcgaccaaactccgcgcctctcccgcccttcctcgacgcgctcgccctcgcctcgccgctcgcattcgctaaaaacgcccaaaaaaatacacaaaaacaacgactaaaaaaacgaaaattcaaaccacatatctacgtcctcgaaaaccaaaacccgccaaccctcgcgaatcccgactcgcgaccaacccgaacgactcgaataaataacgacacaacgaccccctcgctccgcgacccccgctcgccgaaacgtaactccaaaaaataataccgcaaccgaaacaaaaacgaaaaaaaccgaatcgaacaaaccgaaaaaactacgaaaacgctttaccgaaacaaatattacaacctcaactaacgatctctacgaaaaaaacgaaaaaaaaactttttttttcaaacctattctaattatcgattccc

SEQ ID NO: 22105 - DNA, 573 bp, Artificial Sequence
  chemically treated genomic DNA (Homo sapiens) CpG-island No: 22105
gttcgtcgtcgtttcgggtggttttttttttttgtttggtttcgcgcgttttagttttgcgggaggcggcggcgagaagttgcggttttgggtgcggtgcggggcgttcgggcgataggcgggcgtaaggcgggcgcgtagtagatcggttggcgtcgtattatgttttttagcgcggtcgtagtttacgtcggtgcgtattgggacgttgtggtttttttcgcgttttttaattttttcgttgcgttcggttttggtaatttgggtaagagttttttgatcgagaatttgttgcgggtcgggggcgttttaacgtttaggttgtagtcgttcgcgttttacgattcggcgatcgttttggttatcgcgggcgcgtagtttcggtttttgtttgttagtttagtttttttaaagttgtgtttcgtagtcgaataagttagtttcgtcggggcgttttacggaacgcggtgggttttttaagtgtttagtttttttgcggatagtgcgaggttgtcgggtcgggtttcgggggatcgagattgtattttttagtttttagcgttaggtgagtta

SEQ ID NO: 22106 - DNA, 573 bp, Artificial Sequence
  chemically treated genomic DNA (Homo sapiens) CpG-island No: 22106
taactcacctaacgctaaaaactaaaaaatacaatctcgatcccccgaaacccgacccgacaacctcgcactatccgcaaaaaaactaaacacttaaaaaacccaccgcgttccgtaaaacgccccgacgaaactaacttattcgactacgaaacacaactttaaaaaaactaaactaacaaacaaaaaccgaaactacgcgcccgcgataaccaaaacgatcgccgaatcgtaaaacgcgaacgactacaacctaaacgttaaaacgcccccgacccgcaacaaattctcgatcaaaaaactcttacccaaattaccaaaaccgaacgcaacgaaaaaattaaaaaacgcgaaaaaaaccacaacgtcccaatacgcaccgacgtaaactacgaccgcgctaaaaaacataatacgacgccaaccgatctactacgcgcccgccttacgcccgcctatcgcccgaacgccccgcaccgcacccaaaaccgcaacttctcgccgccgcctcccgcaaaactaaaacgcgcgaaaccaaacaaaaaaaaaaaaccacccgaaacgacgacgaac

SEQ ID NO: 22107 - DNA, 573 bp, Artificial Sequence
  chemically treated genomic DNA (Homo sapiens) CpG-island No: 22107
tggtttatttggcgttgaaggttggaaggtatagtttcggtttttcggagttcggttcggtagtttcgtattgttcgtagagggattgagtatttgaaaagtttatcgcgtttcgtagggcgtttcggcggggttaatttgttcggttgcggggtatagttttaggggaattgggttagtaggtaggggtcggagttgcgcgttcgcggtggttagggcggtcgtcgggtcgtggggcgcgggcggttgtagtttgggcgttggggcgttttcgattcgtagtaaattttcgattaggaaatttttgtttaggttgttaaagtcgggcgtagcggggaggttgaggagcgcggaggaagttataacgttttagtacgtatcggcgtgggttgcgatcgcgttggggagtatagtgcggcgttaatcggtttgttgcgcgttcgttttgcgttcgtttgtcgttcgggcgtttcgtatcgtatttagagtcgtagtttttcgtcgtcgtttttcgtagggttggagcgcgcggagttaggtagggaggaaaggttattcgggacggcggcggat

SEQ ID NO: 22108 - DNA, 573 bp, Artificial Sequence
  chemically treated genomic DNA (Homo sapiens) CpG-island No: 22108
atccgccgccgtcccgaataacctttcctccctacctaactccgcgcgctccaaccctacgaaaaacgacgacgaaaaactacgactctaaatacgatacgaaacgcccgaacgacaaacgaacgcaaaacgaacgcgcaacaaaccgattaacgccgcactatactccccaacgcgatcgcaacccacgccgatacgtactaaaacgttataacttcctccgcgctcctcaacctccccgctacgcccgactttaacaacctaaacaaaaatttcctaatcgaaaatttactacgaatcgaaaacgccccaacgcccaaactacaaccgcccgcgccccacgacccgacgaccgccctaaccaccgcgaacgcgcaactccgacccctacctactaacccaattcccctaaaactataccccgcaaccgaacaaattaaccccgccgaaacgccctacgaaacgcgataaacttttcaaatactcaatccctctacgaacaatacgaaactaccgaaccgaactccgaaaaaccgaaactataccttccaaccttcaacgccaaataaacca

SEQ ID NO: 22109 - DNA, 505 bp, Artificial Sequence
  chemically treated genomic DNA (Homo sapiens) CpG-island No: 22109
ggttgcgtgcgaagtttttaattaggtttaaggagtcgtagagtcggggtttcgggttcgtaggatttagaagttacgcgtttcgcgtttttcgtttcgtcgttgtttgttcggtcgatttatttggtgtcgcgtgcgttggcggttcgcgcggtagttaagttaaaggtcgaggtcgaggtcgagcgcggcgtttagtagtacggcgggggttagtagggcgggcgtcggtcgtagcgcgtttcgttttagtagtagtcgcgcgtcgtttttgtaggtcgtttcgtcgcgggttattcggggcgtttaggttgtcgtttcgtcgtatttcgtcgtttgttgtatcgttttcgttagggcggcgacgcgggatttggagttcgggcgggttaggggcgcggttcgtttcgtagattttttggtttgtgtagtttttcgatttttgtttttttttttttttttgtttcgtcgagtcggagggaggagtttggattatcgtttaaaa

SEQ ID NO: 22110 - DNA, 505 bp, Artificial Sequence
  chemically treated genomic DNA (Homo sapiens) CpG-island No: 22110
ttttaaacgataatccaaactcctccctccgactcgacgaaacaaaaaaaaaaaaaaaaacaaaaatcgaaaaactacacaaaccaaaaaatctacgaaacgaaccgcgcccctaacccgcccgaactccaaatcccgcgtcgccgccctaacgaaaacgatacaacaaacgacgaaatacgacgaaacgacaacctaaacgccccgaataacccgcgacgaaacgacctacaaaaacgacgcgcgactactactaaaacgaaacgcgctacgaccgacgcccgccctactaacccccgccgtactactaaacgccgcgctcgacctcgacctcgacctttaacttaactaccgcgcgaaccgccaacgcacgcgacaccaaataaatcgaccgaacaaacaacgacgaaacgaaaaacgcgaaacgcgtaacttctaaatcctacgaacccgaaaccccgactctacgactccttaaacctaattaaaaacttcgcacgcaacc

SEQ ID NO: 22111 - DNA, 505 bp, Artificial Sequence
  chemically treated genomic DNA (Homo sapiens) CpG-island No: 22111
ttttgagcggtgatttaggttttttttttcggttcggcgaagtagggaaggggagagaagtaggagtcgggagattgtataggttagaaagtttgcggagcgggtcgcgtttttggttcgttcgggttttaagtttcgcgtcgtcgttttggcggggacggtgtagtaggcggcgggatgcggcggggcggtagtttgagcgtttcggatggttcgcggcggggcggtttgtaagagcgacgcgcggttgttgttggggcgggacgcgttgcggtcggcgttcgttttgttggttttcgtcgtgttgttgggcgtcgcgttcggtttcggtttcggtttttggtttggttgtcgcgcgggtcgttagcgtacgcgatattaggtgggtcggtcgagtagatagcggcggggcggggagcgcggggcgcgtggtttttgggttttgcgggttcggagtttcggttttgcgattttttgagtttggttgggaatttcgtacgtaatt

SEQ ID NO: 22112 - DNA, 505 bp, Artificial Sequence
  chemically treated genomic DNA (Homo sapiens) CpG-island No: 22112
aattacgtacgaaattcccaaccaaactcaaaaaatcgcaaaaccgaaactccgaacccgcaaaacccaaaaaccacgcgccccgcgctccccgccccgccgctatctactcgaccgacccacctaatatcgcgtacgctaacgacccgcgcgacaaccaaaccaaaaaccgaaaccgaaaccgaacgcgacgcccaacaacacgacgaaaaccaacaaaacgaacgccgaccgcaacgcgtcccgccccaacaacaaccgcgcgtcgctcttacaaaccgccccgccgcgaaccatccgaaacgctcaaactaccgccccgccgcatcccgccgcctactacaccgtccccgccaaaacgacgacgcgaaacttaaaacccgaacgaaccaaaaacgcgacccgctccgcaaactttctaacctatacaatctcccgactcctacttctctccccttccctacttcgccgaaccgaaaaaaaaaacctaaatcaccgctcaaaa

SEQ ID NO: 22113 - DNA, 588 bp, Artificial Sequence
  chemically treated genomic DNA (Homo sapiens) CpG-island No: 22113
aaggtgtaggcgagagttttagggcgggggtttcgcgtttcggtcgttcggcgcggcgttgggcgtatttttttgttgtaggttcgtaggggcgggggtagttggaggtgcggttcgcggggtacggcgttttttttttttcgtttcggggttcgggataggtcggggcgcgtagttttattttggtttcgatttggttgtcgtattggtcggtttggatgtgtacgattttttttatattgggcgcgtttggcgggcggttgcggacgggcgcgggcgggtcgggttggttgttgagggtcggggatcgcggtcgcgcgtttttatagtcgcggtttcgtttttcgtatcggttgatgttatcgcgggtggttaatcgggaggcgtcgtcgtagagtttcgttcggttcgtaggtttcgtatcgcgcgttttcgttcgtcgcgcgtaatgcggcgtttttttcgtagttagtttttgcgatagttttattttgcggttttgtacggagggttttttttttttacgtcggtttagagattaattcgtattattttagttttttgttttttggtagataaggtgttttg

SEQ ID NO: 22114 - DNA, 588 bp, Artificial Sequence
  chemically treated genomic DNA (Homo sapiens) CpG-island No: 22114
caaaacaccttatctaccaaaaaacaaaaaactaaaataatacgaattaatctctaaaccgacgtaaaaaaaaaaaaccctccgtacaaaaccgcaaaataaaactatcgcaaaaactaactacgaaaaaaacgccgcattacgcgcgacgaacgaaaacgcgcgatacgaaacctacgaaccgaacgaaactctacgacgacgcctcccgattaaccacccgcgataacatcaaccgatacgaaaaacgaaaccgcgactataaaaacgcgcgaccgcgatccccgaccctcaacaaccaacccgacccgcccgcgcccgtccgcaaccgcccgccaaacgcgcccaatataaaaaaaatcgtacacatccaaaccgaccaatacgacaaccaaatcgaaaccaaaataaaactacgcgccccgacctatcccgaaccccgaaacgaaaaaaaaaaaacgccgtaccccgcgaaccgcacctccaactacccccgcccctacgaacctacaacaaaaaaatacgcccaacgccgcgccgaacgaccgaaacgcgaaacccccgccctaaaactctcgcctacacctt

SEQ ID NO: 22115 - DNA, 588 bp, Artificial Sequence
  chemically treated genomic DNA (Homo sapiens) CpG-island No: 22115
tagagtattttgtttgttaaaagatagggagttgggatggtgcgggttggtttttaaatcggcgtggggaaaaaagatttttcgtataaagtcgtagggtggggttgtcgtaagggttggttgcgggaggggcgtcgtattgcgcgcggcgggcggggacgcgcggtgcggagtttgcgggtcgggcggggttttgcggcggcgtttttcgattggttattcgcggtgatattagtcgatgcgaagggcggggtcgcggttataagagcgcgcggtcgcggttttcgatttttagtagttagttcggttcgttcgcgttcgttcgtagtcgttcgttagacgcgtttagtatgagggagatcgtgtatatttaggtcggttagtgcggtaattagatcggggttaaggtgaggttgcgcgtttcggtttgtttcgggtttcggggcgggaggagggaggcgtcgtgtttcgcgggtcgtatttttagttgttttcgtttttgcgaatttgtaataaagggatgcgtttagcgtcgcgtcgggcggtcgggacgcggggttttcgttttgggattttcgtttgtatttt

SEQ ID NO: 22116 - DNA, 588 bp, Artificial Sequence
  chemically treated genomic DNA (Homo sapiens) CpG-island No: 22116
aaaatacaaacgaaaatcccaaaacgaaaaccccgcgtcccgaccgcccgacgcgacgctaaacgcatccctttattacaaattcgcaaaaacgaaaacaactaaaaatacgacccgcgaaacacgacgcctccctcctcccgccccgaaacccgaaacaaaccgaaacgcgcaacctcaccttaaccccgatctaattaccgcactaaccgacctaaatatacacgatctccctcatactaaacgcgtctaacgaacgactacgaacgaacgcgaacgaaccgaactaactactaaaaatcgaaaaccgcgaccgcgcgctcttataaccgcgaccccgcccttcgcatcgactaatatcaccgcgaataaccaatcgaaaaacgccgccgcaaaaccccgcccgacccgcaaactccgcaccgcgcgtccccgcccgccgcgcgcaatacgacgcccctcccgcaaccaacccttacgacaaccccaccctacgactttatacgaaaaatcttttttccccacgccgatttaaaaaccaacccgcaccatcccaactccctatcttttaacaaacaaaatactcta

SEQ ID NO: 22117 - DNA, 690 bp, Artificial Sequence
  chemically treated genomic DNA (Homo sapiens) CpG-island No: 22117
ggcgcgttattttggatatgtcgtttgggatcggttatcgggagttttttttttcgttttttcggttagtatcgggtttattttttcggatcgggaggtttttcgatcggggatatttttacgtgtcgagggtaaggttgattttaggagggtaaggtttacgcgttcgacgcggcgcgcgtaggaatcgaatagttcgggggtttcggagttattcgcgtattttgattacgtcgttttcgtttttttttcgtatttttcgtatttttcgtattttgcgtttttcggtcgtattttcgtcgggcgttcgttggttggttagtttattattttacgttattcgtttttaaagttcggtatttatttgtttcgcgcggtaggcgcgtcgtatttagtagtagaatttttagtagtgcgatagagatttcgtagtttaggtcggttatgatttcgggacgtttcggtttcggtggggaaaacgacggtggggagcggcggttttaggcgtttaagttcggcgtagtgcgttcgttttggtttatttatttgcgcgcgggcggatcggttcgagtttcgtttgcgtagtaggatcgcgagttgattcggtgcgtttttttttttttttttttttttttttttgttttagcgatcgttttttttttttagggtgtagggttttcggtatcgggt

SEQ ID NO: 22118 - DNA, 690 bp, Artificial Sequence
  chemically treated genomic DNA (Homo sapiens) CpG-island No: 22118
acccgataccgaaaaccctacaccctaaaaaaaaaaaacgatcgctaaaacaaaaaaaaaaaaaaaaaaaaaaaaaaaaacgcaccgaatcaactcgcgatcctactacgcaaacgaaactcgaaccgatccgcccgcgcgcaaataaataaaccaaaacgaacgcactacgccgaacttaaacgcctaaaaccgccgctccccaccgtcgttttccccaccgaaaccgaaacgtcccgaaatcataaccgacctaaactacgaaatctctatcgcactactaaaaattctactactaaatacgacgcgcctaccgcgcgaaacaaataaataccgaactttaaaaacgaataacgtaaaataataaactaaccaaccaacgaacgcccgacgaaaatacgaccgaaaaacgcaaaatacgaaaaatacgaaaaatacgaaaaaaaaacgaaaacgacgtaatcaaaatacgcgaataactccgaaacccccgaactattcgattcctacgcgcgccgcgtcgaacgcgtaaaccttaccctcctaaaatcaaccttaccctcgacacgtaaaaatatccccgatcgaaaaacctcccgatccgaaaaaataaacccgatactaaccgaaaaaacgaaaaaaaaaactcccgataaccgatcccaaacgacatatccaaaataacgcgcc

SEQ ID NO: 22119 - DNA, 690 bp, Artificial Sequence
  chemically treated genomic DNA (Homo sapiens) CpG-island No: 22119
attcggtgtcgggagttttgtattttgggagggagaggcggtcgttgaggtaggaagaggaggaggagagagaggagggacgtatcgggttagttcgcgattttgttgcgtaggcggggttcgggtcggttcgttcgcgcgtaggtgagtgagttagggcggacgtattgcgtcgggtttgggcgtttggggtcgtcgttttttatcgtcgttttttttatcgaggtcgaggcgtttcggagttatggtcggtttgaattgcggggtttttatcgtattgttaggggttttgttgttgggtgcggcgcgtttgtcgcgcggggtaggtgagtgtcgggttttggaggcggatggcgtggagtggtgagttagttagttagcggacgttcggcggagatgcggtcgagggacgtagggtgcggagggtgcggagggtgcggagagagggcggggacggcgtagttaaaatgcgcgggtggtttcgggattttcggattgttcggtttttgcgcgcgtcgcgtcgggcgcgtgggttttgtttttttggagttaattttgttttcggtacgtgagagtgttttcgatcggggagtttttcggttcgggaggatgagttcggtgttggtcgagaaggcgggaaaaggagttttcggtagtcgattttaggcgatatgtttaaggtggcgcgtt

SEQ ID NO: 22120 - DNA, 690 bp, Artificial Sequence
  chemically treated genomic DNA (Homo sapiens) CpG-island No: 22120
aacgcgccaccttaaacatatcgcctaaaatcgactaccgaaaactccttttcccgccttctcgaccaacaccgaactcatcctcccgaaccgaaaaactccccgatcgaaaacactctcacgtaccgaaaacaaaattaactccaaaaaaacaaaacccacgcgcccgacgcgacgcgcgcaaaaaccgaacaatccgaaaatcccgaaaccacccgcgcattttaactacgccgtccccgccctctctccgcaccctccgcaccctccgcaccctacgtccctcgaccgcatctccgccgaacgtccgctaactaactaactcaccactccacgccatccgcctccaaaacccgacactcacctaccccgcgcgacaaacgcgccgcacccaacaacaaaacccctaacaatacgataaaaaccccgcaattcaaaccgaccataactccgaaacgcctcgacctcgataaaaaaaacgacgataaaaaacgacgaccccaaacgcccaaacccgacgcaatacgtccgccctaactcactcacctacgcgcgaacgaaccgacccgaaccccgcctacgcaacaaaatcgcgaactaacccgatacgtccctcctctctctcctcctcctcttcctacctcaacgaccgcctctccctcccaaaatacaaaactcccgacaccgaat

SEQ ID NO: 22121 - DNA, 538 bp, Artificial Sequence
  chemically treated genomic DNA (Homo sapiens) CpG-island No: 22121
gcggggcgtaagagtagttggttttcgttcgcggtggatattttagtttttatttttttaggggagtgacgacgtgcgaggttattttatgttgtgtttcgttatatcgacgtacgaaaggtgtacgttttacgttttttcgttttacgagataatttgtttcgaggtggtgggtataatttatttttattcggtgtacgggattatatttcgtcgtgtttaattatattgttgtttcgtataaaaacgagaagacggtttttcgtattcgtgtcgatcgggtttttacgtcgggtcgagtcgagttttaacgacgttttgcgcgcgtttcgtttatttatttattcgatttatgtcgagggagcggtattttcgcgcgattttaatcgtaagggtatagacgagacgaattttatatcggtcggtacgttcgacgcgggacggtacgatattgttatgtaggttagggaagacgcggtcgcggttcgatacgagtatattaggtaagatgatttcggcgggtttcgtttgtattcga

SEQ ID NO: 22122 - DNA, 538 bp, Artificial Sequence
  chemically treated genomic DNA (Homo sapiens) CpG-island No: 22122
tcgaatacaaacgaaacccgccgaaatcatcttacctaatatactcgtatcgaaccgcgaccgcgtcttccctaacctacataacaatatcgtaccgtcccgcgtcgaacgtaccgaccgatataaaattcgtctcgtctatacccttacgattaaaatcgcgcgaaaataccgctccctcgacataaatcgaataaataaataaacgaaacgcgcgcaaaacgtcgttaaaactcgactcgacccgacgtaaaaacccgatcgacacgaatacgaaaaaccgtcttctcgtttttatacgaaacaacaatataattaaacacgacgaaatataatcccgtacaccgaataaaaataaattatacccaccacctcgaaacaaattatctcgtaaaacgaaaaaacgtaaaacgtacacctttcgtacgtcgatataacgaaacacaacataaaataacctcgcacgtcgtcactcccctaaaaaaataaaaactaaaatatccaccgcgaacgaaaaccaactactcttacgccccgc

SEQ ID NO: 22123 - DNA, 538 bp, Artificial Sequence
  chemically treated genomic DNA (Homo sapiens) CpG-island No: 22123
tcgagtgtagacgaggttcgtcggggttattttgtttgatatgttcgtgtcggatcgcgatcgcgttttttttgatttgtatagtagtatcgtgtcgtttcgcgtcggacgtgtcgatcgatatgaggttcgtttcgtttatatttttgcgattgagatcgcgcgggggtgtcgttttttcgatatagatcggataagtgggtaaacgaagcgcgcgtaggacgtcgttgggattcgattcgattcggcgtagaggttcgatcgatacgagtgcgaggagtcgttttttcgtttttatacgagataatagtgtgattgagtacgacggggtgtggtttcgtgtatcgaataaaaatgggttgtatttattatttcggggtagattatttcgtagggcgagggaacgtggagcgtgtatttttcgtgcgtcggtatgacgagatatagtatagggtgatttcgtacgtcgttatttttttgggagaataagggttggaatgtttatcgcgaacgagaattagttgtttttgcgtttcgt

SEQ ID NO: 22124 - DNA, 538 bp, Artificial Sequence
  chemically treated genomic DNA (Homo sapiens) CpG-island No: 22124
acgaaacgcaaaaacaactaattctcgttcgcgataaacattccaacccttattctcccaaaaaaataacgacgtacgaaatcaccctatactatatctcgtcataccgacgcacgaaaaatacacgctccacgttccctcgccctacgaaataatctaccccgaaataataaatacaacccatttttattcgatacacgaaaccacaccccgtcgtactcaatcacactattatctcgtataaaaacgaaaaaacgactcctcgcactcgtatcgatcgaacctctacgccgaatcgaatcgaatcccaacgacgtcctacgcgcgcttcgtttacccacttatccgatctatatcgaaaaaacgacacccccgcgcgatctcaatcgcaaaaatataaacgaaacgaacctcatatcgatcgacacgtccgacgcgaaacgacacgatactactatacaaatcaaaaaaaacgcgatcgcgatccgacacgaacatatcaaacaaaataaccccgacgaacctcgtctacactcga

SEQ ID NO: 22125 - DNA, 587 bp, Artificial Sequence
  chemically treated genomic DNA (Homo sapiens) CpG-island No: 22125
ggcgtcgagcgcgttttgtcgtttatcgcggtcggcggttgcggcgtttttttagtattagtgtcgcgattcgtaggttcgtcgtttacgtatattcgtcgttcggttgcgttatatacgtaggagatagttttcgttgtttatcgttcgttcggtttttatagatttacggttatttatatatagtttttggtttacgttattgatcgacgtttatattttagagatcggacgagttagatttttattatttattagggatatagtcgagagagacgacgcgtttcgttagagcggatatattcgagcgttgtttcgattagtttggtcgatattcgttagttttttatacgattgacgtcgaattattttttcgtagacgaggcgtttatatagttcgtgtagtttttatattacgagttagatgatacgcgacgggtcgcgcgtgattcgtgagtttacgcgtttcgataatgtagatcgtttattacgagttatatacgtttcgttttacgttatttttttttttttgtcgcgttgtatattgacgcgcgtagttattatcgtagtttttgtatttagttttt

SEQ ID NO: 22126 - DNA, 587 bp, Artificial Sequence
  chemically treated genomic DNA (Homo sapiens) CpG-island No: 22126
aaaaactaaatacaaaaactacgataataactacgcgcgtcaatatacaacgcgacaaaaaaaaaaaaataacgtaaaacgaaacgtatataactcgtaataaacgatctacattatcgaaacgcgtaaactcacgaatcacgcgcgacccgtcgcgtatcatctaactcgtaatataaaaactacacgaactatataaacgcctcgtctacgaaaaaataattcgacgtcaatcgtataaaaaactaacgaatatcgaccaaactaatcgaaacaacgctcgaatatatccgctctaacgaaacgcgtcgtctctctcgactatatccctaataaataataaaaatctaactcgtccgatctctaaaatataaacgtcgatcaataacgtaaaccaaaaactatatataaataaccgtaaatctataaaaaccgaacgaacgataaacaacgaaaactatctcctacgtatataacgcaaccgaacgacgaatatacgtaaacgacgaacctacgaatcgcgacactaatactaaaaaaacgccgcaaccgccgaccgcgataaacgacaaaacgcgctcgacgcc

SEQ ID NO: 22127 - DNA, 587 bp, Artificial Sequence
  chemically treated genomic DNA (Homo sapiens) CpG-island No: 22127
ggggattgggtatagaggttgcggtggtgattgcgcgcgttagtgtgtagcgcggtaaagagaagggagtggcgtgggacgaggcgtgtgtgattcgtggtagacggtttatattgtcgaggcgcgtagatttacgggttacgcgcggttcgtcgcgtgttatttgattcgtggtgtaggagttatacgagttgtgtgaacgtttcgtttgcggagaagtggttcgacgttagtcgtgtggggagttagcgagtgtcgattagattagtcgagataacgttcgagtgtgttcgttttagcgaggcgcgtcgtttttttcgattgtgtttttagtgggtggtgaggatttggttcgttcggtttttagagtgtaggcgtcggttagtagcgtggattaggggttatgtgtgagtgatcgtgggtttgtgggagtcgagcgggcggtgagtagcgagggttgttttttgcgtgtgtagcgtagtcgaacggcgggtgtacgtaggcggcgagtttgcgggtcgcggtattggtattaggggggcgtcgtagtcgtcggtcgcggtgggcggtagggcgcgttcggcgtt

SEQ ID NO: 22128 - DNA, 587 bp, Artificial Sequence
  chemically treated genomic DNA (Homo sapiens) CpG-island No: 22128
aacgccgaacgcgccctaccgcccaccgcgaccgacgactacgacgcccccctaataccaataccgcgacccgcaaactcgccgcctacgtacacccgccgttcgactacgctacacacgcaaaaaacaaccctcgctactcaccgcccgctcgactcccacaaacccacgatcactcacacataacccctaatccacgctactaaccgacgcctacactctaaaaaccgaacgaaccaaatcctcaccacccactaaaaacacaatcgaaaaaaacgacgcgcctcgctaaaacgaacacactcgaacgttatctcgactaatctaatcgacactcgctaactccccacacgactaacgtcgaaccacttctccgcaaacgaaacgttcacacaactcgtataactcctacaccacgaatcaaataacacgcgacgaaccgcgcgtaacccgtaaatctacgcgcctcgacaatataaaccgtctaccacgaatcacacacgcctcgtcccacgccactcccttctctttaccgcgctacacactaacgcgcgcaatcaccaccgcaacctctatacccaatcccc

SEQ ID NO: 22129 - DNA, 661 bp, Artificial Sequence
  chemically treated genomic DNA (Homo sapiens) CpG-island No: 22129
  misc_feature (459)..(459): n is either a, c, g or t
  misc_feature (525)..(525): n is either a, c, g or t
tatttattgtcgtgatcgtgatattcgtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcgtaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgtttnttcgttggatgttgggtattcgttggcgttgatacggtcggcgttggatgagcgagcggtggtgtntggggtcgaatcgtgaaacgttgttgtgcggtgtgaaagcgttgtttgtcggttatgaggtttttgggttggtgatcggatttgtgggggtttgggggtcggatcgggttttgtgtttttcgggtagggtggttag

SEQ ID NO: 22130 - DNA, 661 bp, Artificial Sequence
  chemically treated genomic DNA (Homo sapiens) CpG-island No: 22130
  misc_feature (137)..(137): n is either a, c, g or t
  misc_feature (203)..(203): n is either a, c, g or t
ctaaccaccctacccgaaaaacacaaaacccgatccgacccccaaacccccacaaatccgatcaccaacccaaaaacctcataaccgacaaacaacgctttcacaccgcacaacaacgtttcacgattcgaccccanacaccaccgctcgctcatccaacgccgaccgtatcaacgccaacgaatacccaacatccaacgaanaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctacgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgacgaatatcacgatcacgacaataaata

SEQ ID NO: 22131 - DNA, 661 bp, Artificial Sequence
  chemically treated genomic DNA (Homo sapiens) CpG-island No: 22131
  misc_feature (137)..(137): n is either a, c, g or t
  misc_feature (203)..(203): n is either a, c, g or t
ttggttattttgttcggaaaatataaagttcgattcggtttttaagtttttatagattcggttattaatttagaagttttatgatcggtagatagcgtttttatatcgtataataacgttttacggttcgattttangtattatcgttcgtttatttagcgtcgatcgtgttaacgttagcgagtatttaatatttagcgagnagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttatttacggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggcgagtattacgattacggtagtaggtg

SEQ ID NO: 22132 - DNA, 661 bp, Artificial Sequence
  chemically treated genomic DNA (Homo sapiens) CpG-island No: 22132
  misc_feature (459)..(459): n is either a, c, g or t
  misc_feature (525)..(525): n is either a, c, g or t
cacctactaccgtaatcgtaatactcgccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgtaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctnctcgctaaatattaaatactcgctaacgttaacacgatcgacgctaaataaacgaacgataatacntaaaatcgaaccgtaaaacgttattatacgatataaaaacgctatctaccgatcataaaacttctaaattaataaccgaatctataaaaacttaaaaaccgaatcgaactttatattttccgaacaaaataaccaa

SEQ ID NO: 22133 - DNA, 613 bp, Artificial Sequence
  chemically treated genomic DNA (Homo sapiens) CpG-island No: 22133
ggggcgggtagcggaggtggaggcgttttttttggatttttagttttttttcgcggcgtttttatttttcgggcgcgtttttgtatttattttgttaggggtttcggaagcggcgaagggagttgcgtttagagagattgagagcggcggttttcggggtcgtttagtcgtttatcgttcgtagttagcgttttttttttttagttcgggaaggttagcgtgtgggtagttcggttcgcgtttttgcgtttattgaggttttttgtcggttttttagttttcgtttgtttagcgttcggtcgcgacgtttcggcgtcggtttttttagtttagtcggtaggacgcgttcgggagtttcgtacgcgagttgtcggttttttgtttgggggtttgtttttttgcgatttagagtacgcggagggaattaagttagagttcgaggtagttgtgcggttgtcggggggatttttaaggggggcggggtaaaaggacggattagtagggcggtggagcggtttttaaatttttcgcgtttcgtagtttttcgtttaggtttttttgttttttacgtttgtcggtttttgggagaggttggtttttgggggtttttagg

SEQ ID NO: 22134 - DNA, 613 bp, Artificial Sequence
  chemically treated genomic DNA (Homo sapiens) CpG-island No: 22134
cctaaaaacccccaaaaaccaacctctcccaaaaaccgacaaacgtaaaaaacaaaaaaacctaaacgaaaaactacgaaacgcgaaaaatttaaaaaccgctccaccgccctactaatccgtccttttaccccgccccccttaaaaatccccccgacaaccgcacaactacctcgaactctaacttaattccctccgcgtactctaaatcgcaaaaaaacaaacccccaaacaaaaaaccgacaactcgcgtacgaaactcccgaacgcgtcctaccgactaaactaaaaaaaccgacgccgaaacgtcgcgaccgaacgctaaacaaacgaaaactaaaaaaccgacaaaaaacctcaataaacgcaaaaacgcgaaccgaactacccacacgctaaccttcccgaactaaaaaaaaaaaacgctaactacgaacgataaacgactaaacgaccccgaaaaccgccgctctcaatctctctaaacgcaactcccttcgccgcttccgaaacccctaacaaaataaatacaaaaacgcgcccgaaaaataaaaacgccgcgaaaaaaaactaaaaatccaaaaaaaacgcctccacctccgctacccgcccc

SEQ ID NO: 22135 - DNA, 613 bp, Artificial Sequence
  chemically treated genomic DNA (Homo sapiens) CpG-island No: 22135
tttggaaatttttaaaggttaattttttttaggggtcgataaacgtaaagggtagggagatttaagcggggagttgcggagcgcggggagtttgaaagtcgttttatcgttttattagttcgtttttttgtttcgttttttttagggattttttcggtaatcgtatagttgtttcggattttgatttaatttttttcgcgtgttttgaatcgtagagaggtaaatttttaaataaagagtcggtagttcgcgtgcggggttttcgggcgcgttttgtcggttgggttgggagagtcggcgtcggggcgtcgcggtcgagcgttgggtaggcggggattagagggtcggtaggaagttttagtgggcgtaggggcgcgggtcgggttgtttatacgttgattttttcgggttgggagggaggagcgttggttgcgggcggtgggcggttgggcggtttcgggagtcgtcgtttttagtttttttaggcgtagtttttttcgtcgttttcggagtttttggtagggtaagtgtagaagcgcgttcgaggagtgggggcgtcgcgggagggggttgggggtttaggagaggcgtttttattttcgttgttcgtttt

SEQ ID NO: 22136 - DNA, 613 bp, Artificial Sequence
  chemically treated genomic DNA (Homo sapiens) CpG-island No: 22136
aaaacgaacaacgaaaataaaaacgcctctcctaaacccccaaccccctcccgcgacgcccccactcctcgaacgcgcttctacacttaccctaccaaaaactccgaaaacgacgaaaaaaactacgcctaaaaaaactaaaaacgacgactcccgaaaccgcccaaccgcccaccgcccgcaaccaacgctcctccctcccaacccgaaaaaatcaacgtataaacaacccgacccgcgcccctacgcccactaaaacttcctaccgaccctctaatccccgcctacccaacgctcgaccgcgacgccccgacgccgactctcccaacccaaccgacaaaacgcgcccgaaaaccccgcacgcgaactaccgactctttatttaaaaatttacctctctacgattcaaaacacgcgaaaaaaattaaatcaaaatccgaaacaactatacgattaccgaaaaaatccctaaaaaaaacgaaacaaaaaaacgaactaataaaacgataaaacgactttcaaactccccgcgctccgcaactccccgcttaaatctccctaccctttacgtttatcgacccctaaaaaaaattaacctttaaaaatttccaaa

SEQ ID NO: 22137 - DNA, 518 bp, Artificial Sequence
  chemically treated genomic DNA (Homo sapiens) CpG-island No: 22137
aagtaagcgtatagagtaagcgttcgtttgtatcgttattttaggaagtcggttttttgttttttcgttgcgtagtatatcgtatcgttttggaaagtcgtttttattgggggtcgtcgcggtttttttttttttcgcggttaatatcgacgttgttaagaagttgtagttcgtagttagtttcggttttatttattcgagggggcgttcgagtttcggttagattatatgttttaggatgtcgtgtatttttattttaggatgcgacgttttcgttttcgttaggtagtttcgttagagaggatagggggacgaggtgttcggtatgattcgcgcgataggcggtcgcgggttttgttgggaaatgaagttttaaagcgttagtgttttttgcgagatcgtttagagcgttgaaagtaattcggtcgttagggttataataaatttgttggtagcggcggtattagaattatagagttgtgattgttcgttggaggtgttttagtatttgaaataat

SEQ ID NO: 22138 - DNA, 518 bp, Artificial Sequence
  chemically treated genomic DNA (Homo sapiens) CpG-island No: 22138
attatttcaaatactaaaacacctccaacgaacaatcacaactctataattctaataccgccgctaccaacaaatttattataaccctaacgaccgaattactttcaacgctctaaacgatctcgcaaaaaacactaacgctttaaaacttcatttcccaacaaaacccgcgaccgcctatcgcgcgaatcataccgaacacctcgtccccctatcctctctaacgaaactacctaacgaaaacgaaaacgtcgcatcctaaaataaaaatacacgacatcctaaaacatataatctaaccgaaactcgaacgccccctcgaataaataaaaccgaaactaactacgaactacaacttcttaacaacgtcgatattaaccgcgaaaaaaaaaaaaaccgcgacgacccccaataaaaacgactttccaaaacgatacgatatactacgcaacgaaaaaacaaaaaaccgacttcctaaaataacgatacaaacgaacgcttactctatacgcttactt

SEQ ID NO: 22139 - DNA, 518 bp, Artificial Sequence
  chemically treated genomic DNA (Homo sapiens) CpG-island No: 22139
gttgttttagatgttagaatatttttaacgagtagttatagttttgtagttttagtgtcgtcgttgttagtaagtttgttgtgattttggcggtcgagttatttttagcgttttgggcggtttcgtaagaaatattgacgttttgggattttattttttagtaagattcgcggtcgtttatcgcgcgagttatgtcgggtatttcgtttttttgttttttttggcggagttgtttggcggaagcgggaacgtcgtattttgaggtaaaggtgtacggtattttgggatatgtagtttggtcggggttcggacgttttttcggatgaatgggatcgaagttgattgcgaattatagttttttggtagcgtcggtgttggtcgcgggagaaggggagatcgcggcggtttttagtgagagcggttttttaggacggtgcgatgtgttgcgtagcgaagaggtaggaggtcggttttttggggtagcggtataggcgggcgtttattttgtgcgtttgttt

SEQ ID NO: 22140 - DNA, 518 bp, Artificial Sequence
  chemically treated genomic DNA (Homo sapiens) CpG-island No: 22140
aaacaaacgcacaaaataaacgcccgcctataccgctaccccaaaaaaccgacctcctacctcttcgctacgcaacacatcgcaccgtcctaaaaaaccgctctcactaaaaaccgccgcgatctccccttctcccgcgaccaacaccgacgctaccaaaaaactataattcgcaatcaacttcgatcccattcatccgaaaaaacgtccgaaccccgaccaaactacatatcccaaaataccgtacacctttacctcaaaatacgacgttcccgcttccgccaaacaactccgccaaaaaaaacaaaaaaacgaaatacccgacataactcgcgcgataaacgaccgcgaatcttactaaaaaataaaatcccaaaacgtcaatatttcttacgaaaccgcccaaaacgctaaaaataactcgaccgccaaaatcacaacaaacttactaacaacgacgacactaaaactacaaaactataactactcgttaaaaatattctaacatctaaaacaac

SEQ ID NO: 22141 - DNA, 638 bp, Artificial Sequence
  chemically treated genomic DNA (Homo sapiens) CpG-island No: 22141
tttagcgtggtggtgttcgttagtgtgtcgttattggcggtgaatagttcgttatttatcgtggtattcgtggtcgtattatcggcgtttagcgtgaatgaattgtttttttttagtattagggtattcgtttgatcgttttcgatattgaatgttttttcgtcgtttcgggtattattgatagcggtatcggaatcggttagtagtatatcgttattttttatggatacggtggtggcggtgttatcgttgcggatatttagcgtttcgttattatttacgcgggtattagtggttgtgtgttcggttagtatatttaggcgttcgttattttttagtacgatattattagttttattttttataatagagaatgtttttaggcggtttatgtcggtaacggttgtagtcgtattggtaattagtgcgtcgttttgttttagggtgatattcgtggttgtattatcggcgtttatttgtagtttggttttttgattaacggtggtattttcggttatattttcgtttttgataatttggtagtcgttattgtttataatagtgttagacgttgtatcgtcgttgtgtatatattggtattttttatttagcggtgttttcgtgggtgatttgtttag

SEQ ID NO: 22142 - DNA, 638 bp, Artificial Sequence
  chemically treated genomic DNA (Homo sapiens) CpG-island No: 22142
ctaaacaaatcacccacgaaaacaccgctaaataaaaaataccaatatatacacaacgacgatacaacgtctaacactattataaacaataacgactaccaaattatcaaaaacgaaaatataaccgaaaataccaccgttaatcaaaaaaccaaactacaaataaacgccgataatacaaccacgaatatcaccctaaaacaaaacgacgcactaattaccaatacgactacaaccgttaccgacataaaccgcctaaaaacattctctattataaaaaataaaactaataatatcgtactaaaaaataacgaacgcctaaatatactaaccgaacacacaaccactaatacccgcgtaaataataacgaaacgctaaatatccgcaacgataacaccgccaccaccgtatccataaaaaataacgatatactactaaccgattccgataccgctatcaataatacccgaaacgacgaaaaaacattcaatatcgaaaacgatcaaacgaataccctaatactaaaaaaaaacaattcattcacgctaaacgccgataatacgaccacgaataccacgataaataacgaactattcaccgccaataacgacacactaacgaacaccaccacgctaaa

SEQ ID NO: 22143 - DNA, 638 bp, Artificial Sequence
  chemically treated genomic DNA (Homo sapiens) CpG-island No: 22143
ttgaataggttatttacggaaatatcgttgaatggggaatattagtatgtgtataacggcggtatagcgtttgatattgttgtgaatagtgacggttgttagattgttaaaaacgggggtgtggtcgggaatattatcgttaattagaaggttagattgtaggtggacgtcggtggtatagttacgaatgttattttgaagtagggcggcgtattggttattagtacggttgtaatcgttatcggtataaatcgtttgggagtattttttgttgtggagggtaaagttgataatgtcgtattggaaaatggcggacgtttggatgtgttgatcggatatatagttattaatattcgcgtggatgatggcggaacgttggatgttcgtaacggtggtatcgttattatcgtatttatgggaaatggcggtgtattgttggtcgatttcggtgtcgttgttagtggtattcggagcgacggaaaggtatttagtatcggaggcggttaggcggatgttttgatgttggaaaaaggtagtttatttacgttgaacgtcggtgatacggttacggatattacggtaaatggcggattgtttatcgttagtggcggtatattggcgggtattattacgttgaa

SEQ ID NO: 22144 - DNA, 638 bp, Artificial Sequence
  chemically treated genomic DNA (Homo sapiens) CpG-island No: 22144
ttcaacgtaataatacccgccaatataccgccactaacgataaacaatccgccatttaccgtaatatccgtaaccgtatcaccgacgttcaacgtaaataaactacctttttccaacatcaaaacatccgcctaaccgcctccgatactaaatacctttccgtcgctccgaataccactaacaacgacaccgaaatcgaccaacaatacaccgccatttcccataaatacgataataacgataccaccgttacgaacatccaacgttccgccatcatccacgcgaatattaataactatatatccgatcaacacatccaaacgtccgccattttccaatacgacattatcaactttaccctccacaacaaaaaatactcccaaacgatttataccgataacgattacaaccgtactaataaccaatacgccgccctacttcaaaataacattcgtaactataccaccgacgtccacctacaatctaaccttctaattaacgataatattcccgaccacacccccgtttttaacaatctaacaaccgtcactattcacaacaatatcaaacgctataccgccgttatacacatactaatattccccattcaacgatatttccgtaaataacctattcaa

SEQ ID NO: 22145 - DNA, 539 bp, Artificial Sequence
  chemically treated genomic DNA (Homo sapiens) CpG-island No: 22145
  misc_feature (48)..(49): n is either a, c, g or t
  misc_feature (240)..(240): n is either a, c, g or t
  misc_feature (347)..(347): n is either a, c, g or t
aaagtcgtttagttttcggaggcgttttttaatttgtaggcgtttttnnatagcggtgatttcgtatattatggttattatcgtttgttttattatttcgcgggtgatgaaattttttagtatttgtgttattcgcgtgtttcgttgggcgttttgtttacggaatatttttatttgtttagttacgtcgttgtatacgttttgcggtatattcgagggttttaggttgacggaggcggncgttacgttgtcgcgggtttagagtagtataatgttgtaggtcgttgtaagagtcgttttgatggacggggaggtgggagatataggcggtagggtcggaggcgcgntatagtgttcgttatttttatatagtaggttagcgtttgttagggttttttcgcgtttatttattattttcggttcgttaagggttggttcgcggagtttaagatgttatttattatttttttcgtaaaggttaggcgttttcgtagaggttttcgtttttttaatttcgtgaggttgattaggtggatttt

SEQ ID NO: 22146 - DNA, 539 bp, Artificial Sequence
  chemically treated genomic DNA (Homo sapiens) CpG-island No: 22146
  misc_feature (193)..(193): n is either a, c, g or t
  misc_feature (300)..(300): n is either a, c, g or t
  misc_feature (491)..(492): n is either a, c, g or t
aaaatccacctaatcaacctcacgaaattaaaaaaacgaaaacctctacgaaaacgcctaacctttacgaaaaaaataataaataacatcttaaactccgcgaaccaacccttaacgaaccgaaaataataaataaacgcgaaaaaaccctaacaaacgctaacctactatataaaaataacgaacactatancgcgcctccgaccctaccgcctatatctcccacctccccgtccatcaaaacgactcttacaacgacctacaacattatactactctaaacccgcgacaacgtaacgnccgcctccgtcaacctaaaaccctcgaatataccgcaaaacgtatacaacgacgtaactaaacaaataaaaatattccgtaaacaaaacgcccaacgaaacacgcgaataacacaaatactaaaaaatttcatcacccgcgaaataataaaacaaacgataataaccataatatacgaaatcaccgctatnnaaaaacgcctacaaattaaaaaacgcctccgaaaactaaacgacttt

SEQ ID NO: 22147 - DNA, 539 bp, Artificial Sequence
  chemically treated genomic DNA (Homo sapiens) CpG-island No: 22147
  misc_feature (193)..(193): n is either a, c, g or t
  misc_feature (300)..(300): n is either a, c, g or t
  misc_feature (491)..(492): n is either a, c, g or t
aagatttatttggttaattttacggggttgaagaagcgggagtttttgcggaagcgtttggtttttgcggaggaggtgatggatgatattttggatttcgcggattaatttttgacgggtcgaaagtggtggatgggcgcggaggaattttggtagacgttggtttgttgtatggaggtggcgaatattgtgncgcgttttcgattttgtcgtttatgttttttattttttcgtttattaggacggtttttgtaacggtttgtagtattatgttgttttgggttcgcgatagcgtggcgntcgttttcgttaatttggagttttcggatgtgtcgtaggacgtgtatagcggcgtggttgggtaggtggaggtgtttcgtaggtaagacgtttagcggggtacgcgggtggtataggtgttggaaggttttattattcgcgaggtggtgaagtagacggtgatgattatggtgtacggggttatcgttatnngggggcgtttgtagattgagaagcgttttcgggagttgaacgatttt

SEQ ID NO: 22148 - DNA, 539 bp, Artificial Sequence
  chemically treated genomic DNA (Homo sapiens) CpG-island No: 22148
  misc_feature (48)..(49): n is either a, c, g or t
  misc_feature (240)..(240): n is either a, c, g or t
  misc_feature (347)..(347): n is either a, c, g or t
aaaatcgttcaactcccgaaaacgcttctcaatctacaaacgcccccnnataacgataaccccgtacaccataatcatcaccgtctacttcaccacctcgcgaataataaaaccttccaacacctataccacccgcgtaccccgctaaacgtcttacctacgaaacacctccacctacccaaccacgccgctatacacgtcctacgacacatccgaaaactccaaattaacgaaaacgancgccacgctatcgcgaacccaaaacaacataatactacaaaccgttacaaaaaccgtcctaataaacgaaaaaataaaaaacataaacgacaaaatcgaaaacgcgncacaatattcgccacctccatacaacaaaccaacgtctaccaaaattcctccgcgcccatccaccactttcgacccgtcaaaaattaatccgcgaaatccaaaatatcatccatcacctcctccgcaaaaaccaaacgcttccgcaaaaactcccgcttcttcaaccccgtaaaattaaccaaataaatctt

SEQ ID NO: 22149 - DNA, 564 bp, Artificial Sequence
  chemically treated genomic DNA (Homo sapiens) CpG-island No: 22149
  misc_feature (134)..(134): n is either a, c, g or t
  misc_feature (165)..(165): n is either a, c, g or t
  misc_feature (167)..(167): n is either a, c, g or t
  misc_feature (202)..(202): n is either a, c, g or t
  misc_feature (240)..(240): n is either a, c, g or t
  misc_feature (304)..(304): n is either a, c, g or t
  misc_feature (306)..(306): n is either a, c, g or t
  misc_feature (312)..(312): n is either a, c, g or t
  misc_feature (383)..(383): n is either a, c, g or t
ttttcgcggtttttcgagttttgagtgttgtttttagttttttttttttcgcgacgtttttcgttcggttgttcgtagtatttttaaggtcgtttttcgaatttttcgggcgcgagggtttaggcgttagttgnttcgttttgtttacgtttttttagggatttntnggttttggcggtcgtcgcgatagatttatttacgncggatcgcggagtaggacgttcgcggcgcgtagggttngtagttatgtttgcgtcgagtgaacgtattgtttgggtagtttcggttcgagttcgggtttttntntcgcgncggcgcgtttaggtgttcgtttagtagtggtcgagtcgggtagcgatttttacgcgcgtttttagtttttntgaattcgcgttttttcggcgcgttcgtttattcgttgtcgggtcggggcgggcgaggttaggtagagatacgtttttcgcggagagttcgttttagttgggcgtcgttttttgcgtgaaaatgggttcgggggttgagttagaagttcgttttttattattatcgtaggttattgtaaaa

SEQ ID NO: 22150 - DNA, 564 bp, Artificial Sequence
  chemically treated genomic DNA (Homo sapiens) CpG-island No: 22150
  misc_feature (182)..(182): n is either a, c, g or t
  misc_feature (253)..(253): n is either a, c, g or t
  misc_feature (259)..(259): n is either a, c, g or t
  misc_feature (261)..(261): n is either a, c, g or t
  misc_feature (325)..(325): n is either a, c, g or t
  misc_feature (363)..(363): n is either a, c, g or t
  misc_feature (398)..(398): n is either a, c, g or t
  misc_feature (400)..(400): n is either a, c, g or t
  misc_feature (431)..(431): n is either a, c, g or t
ttttacaataacctacgataataataaaaaacgaacttctaactcaacccccgaacccattttcacgcaaaaaacgacgcccaactaaaacgaactctccgcgaaaaacgtatctctacctaacctcgcccgccccgacccgacaacgaataaacgaacgcgccgaaaaaacgcgaattcanaaaaactaaaaacgcgcgtaaaaatcgctacccgactcgaccactactaaacgaacacctaaacgcgccgncgcgananaaaaacccgaactcgaaccgaaactacccaaacaatacgttcactcgacgcaaacataactacnaaccctacgcgccgcgaacgtcctactccgcgatccgncgtaaataaatctatcgcgacgaccgccaaaaccnanaaatccctaaaaaaacgtaaacaaaacgaancaactaacgcctaaaccctcgcgcccgaaaaattcgaaaaacgaccttaaaaatactacgaacaaccgaacgaaaaacgtcgcgaaaaaaaaaaaactaaaaacaacactcaaaactcgaaaaaccgcgaaaa

SEQ ID NO: 22151 - DNA, 564 bp, Artificial Sequence
  chemically treated genomic DNA (Homo sapiens) CpG-island No: 22151
  misc_feature (182)..(182): n is either a, c, g or t
  misc_feature (253)..(253): n is either a, c, g or t
  misc_feature (259)..(259): n is either a, c, g or t
  misc_feature (261)..(261): n is either a, c, g or t
  misc_feature (325)..(325): n is either a, c, g or t
  misc_feature (363)..(363): n is either a, c, g or t
  misc_feature (398)..(398): n is either a, c, g or t
  misc_feature (400)..(400): n is either a, c, g or t
  misc_feature (431)..(431): n is either a, c, g or t
ttttgtagtgatttgcgatggtggtggggagcgggtttttagtttagttttcgggtttatttttacgtagggagcggcgtttagttggggcgggtttttcgcgaggggcgtgtttttgtttggtttcgttcgtttcggttcggtagcgaatgagcgggcgcgtcgggagggcgcgagtttangggggttggggacgcgcgtggggatcgttattcggttcggttattgttgggcggatatttgggcgcgtcgncgcggngnaggagttcggattcgggtcgaggttgtttaggtaatgcgtttattcggcgtaaatatggttgtnggttttgcgcgtcgcgggcgttttgtttcgcgattcgncgtaagtgggtttgtcgcggcggtcgttagggttnanggatttttgagaaggcgtgggtagagcgggntagttggcgtttgggttttcgcgttcgggggattcggggagcggttttgggggtgttgcgagtaatcgggcgaggggcgtcgcggagaagggagggttgagggtagtatttagggttcgggaggtcgcgggga

SEQ ID NO: 22152 - DNA, 564 bp, Artificial Sequence
  chemically treated genomic DNA (Homo sapiens) CpG-island No: 22152
  misc_feature (134)..(134): n is either a, c, g or t
  misc_feature (165)..(165): n is either a, c, g or t
  misc_feature (167)..(167): n is either a, c, g or t
  misc_feature (202)..(202): n is either a, c, g or t
  misc_feature (240)..(240): n is either a, c, g or t
  misc_feature (304)..(304): n is either a, c, g or t
  misc_feature (306)..(306): n is either a, c, g or t
  misc_feature (312)..(312): n is either a, c, g or t
  misc_feature (383)..(383): n is either a, c, g or t
tccccgcgacctcccgaaccctaaatactaccctcaaccctcccttctccgcgacgcccctcgcccgattactcgcaacacccccaaaaccgctccccgaatcccccgaacgcgaaaacccaaacgccaactancccgctctacccacgccttctcaaaaatccntnaaccctaacgaccgccgcgacaaacccacttacgncgaatcgcgaaacaaaacgcccgcgacgcgcaaaaccnacaaccatatttacgccgaataaacgcattacctaaacaacctcgacccgaatccgaactcctncnccgcgncgacgcgcccaaatatccgcccaacaataaccgaaccgaataacgatccccacgcgcgtccccaacccccntaaactcgcgccctcccgacgcgcccgctcattcgctaccgaaccgaaacgaacgaaaccaaacaaaaacacgcccctcgcgaaaaacccgccccaactaaacgccgctccctacgtaaaaataaacccgaaaactaaactaaaaacccgctccccaccaccatcgcaaatcactacaaaa

SEQ ID NO: 22153 - DNA, 524 bp, Artificial Sequence
  chemically treated genomic DNA (Homo sapiens) CpG-island No: 22153
  misc_feature (66)..(66): n is either a, c, g or t
  misc_feature (80)..(80): n is either a, c, g or t
  misc_feature (91)..(91): n is either a, c, g or t
  misc_feature (185)..(185): n is either a, c, g or t
cggttcggagtagcgtttcgagttttttaagttcgggcgcggaggcgggggcgggcgcggcggagncggggttcgggttnggattcgtttngttcgtcgggggagtcgtcggtagtggttaagaaggcggcgcggcggacggcggttcgagagtagcgttcgcgttgcggttcgcgggatcgcgntcgcgatcgttcgggtcggttcggaggagcgtttgtcgtcgtcgtcgtcgtcgcgcgtttagcgaggtgagtgttcgttcgcggtcgggtagtttcggagtcgtagcggttcgcgcgggtcggaggtggagaaagaggtttcgtcgcggtcgcgttttcggtttttttgtggtcggcgttgtttggggtcggggcgcgggtacgttcggcgcgggttcgggtttgggatttcggtgtcgttggatacgcggcgttttcggttggtagttttggcgagtagcgagttttcgttttagtttgatattgagttagaatcgtttttttttagaagacggaagt

SEQ ID NO: 22154 - DNA, 524 bp, Artificial Sequence
  chemically treated genomic DNA (Homo sapiens) CpG-island No: 22154
  misc_feature (340)..(340): n is either a, c, g or t
  misc_feature (434)..(434): n is either a, c, g or t
  misc_feature (445)..(445): n is either a, c, g or t
  misc_feature (459)..(459): n is either a, c, g or t
acttccgtcttctaaaaaaaaacgattctaactcaatatcaaactaaaacgaaaactcgctactcgccaaaactaccaaccgaaaacgccgcgtatccaacgacaccgaaatcccaaacccgaacccgcgccgaacgtacccgcgccccgaccccaaacaacgccgaccacaaaaaaaccgaaaacgcgaccgcgacgaaacctctttctccacctccgacccgcgcgaaccgctacgactccgaaactacccgaccgcgaacgaacactcacctcgctaaacgcgcgacgacgacgacgacgacaaacgctcctccgaaccgacccgaacgatcgcgancgcgatcccgcgaaccgcaacgcgaacgctactctcgaaccgccgtccgccgcgccgccttcttaaccactaccgacgactcccccgacgaacnaaacgaatccnaacccgaaccccgnctccgccgcgcccgcccccgcctccgcgcccgaacttaaaaaactcgaaacgctactccgaaccg

SEQ ID NO: 22155 - DNA, 524 bp, Artificial Sequence
  chemically treated genomic DNA (Homo sapiens) CpG-island No: 22155
  misc_feature (340)..(340): n is either a, c, g or t
  misc_feature (434)..(434): n is either a, c, g or t
  misc_feature (445)..(445): n is either a, c, g or t
  misc_feature (459)..(459): n is either a, c, g or t
attttcgttttttaaagaaaaacggttttaatttaatgttaaattaggacggaaattcgttgttcgttaaagttgttaatcggagacgtcgcgtgtttaacggtatcggggttttagattcgaattcgcgtcgagcgtgttcgcgtttcggttttaggtagcgtcggttataaagggatcggggacgcggtcgcggcggggtttttttttttattttcgattcgcgcgagtcgttgcggtttcgggattgttcggtcgcgggcgaatatttatttcgttaggcgcgcggcggcggcggcggcggtaggcgttttttcgggtcggttcgggcggtcgcggncgcggtttcgcgggtcgtagcgcgggcgttattttcgggtcgtcgttcgtcgcgtcgtttttttggttattgtcggcggttttttcggcgggtngggcgggtttnggttcgggtttcgntttcgtcgcgttcgttttcgttttcgcgttcgggtttggggggttcggggcgttatttcgggtcg

SEQ ID NO: 22156 - DNA, 524 bp, Artificial Sequence
  chemically treated genomic DNA (Homo sapiens) CpG-island No: 22156
  misc_feature (66)..(66): n is either a, c, g or t
  misc_feature (80)..(80): n is either a, c, g or t
  misc_feature (91)..(91): n is either a, c, g or t
  misc_feature (185)..(185): n is either a, c, g or t
cgacccgaaataacgccccgaaccccccaaacccgaacgcgaaaacgaaaacgaacgcgacgaaancgaaacccgaaccnaaacccgcccnacccgccgaaaaaaccgccgacaataaccaaaaaaacgacgcgacgaacgacgacccgaaaataacgcccgcgctacgacccgcgaaaccgcgnccgcgaccgcccgaaccgacccgaaaaaacgcctaccgccgccgccgccgccgcgcgcctaacgaaataaatattcgcccgcgaccgaacaatcccgaaaccgcaacgactcgcgcgaatcgaaaataaaaaaaaaaaccccgccgcgaccgcgtccccgatccctttataaccgacgctacctaaaaccgaaacgcgaacacgctcgacgcgaattcgaatctaaaaccccgataccgttaaacacgcgacgtctccgattaacaactttaacgaacaacgaatttccgtcctaatttaacattaaattaaaaccgtttttctttaaaaaacgaaaat

SEQ ID NO: 22157 - DNA, 647 bp, Artificial Sequence
  chemically treated genomic DNA (Homo sapiens) CpG-island No: 22157
  misc_feature (236)..(236): n is either a, c, g or t
  misc_feature (507)..(507): n is either a, c, g or t
  misc_feature (539)..(539): n is either a, c, g or t
gtgggggcggagatttcgttcggtcgttcgtttttcgttagcggcggaggcggttttttcgtttgcgcgggggaggtcggggtttcggcgtttattcgaatgcgcgtttttttcgttgcggcgagtttatcgcggggtcgcgacgtttttttcgggttcgggatttcggggtcgggcgcggcgtttttttcggatcgatcgtttagtttcggttttcgtttatacggttacgggtnagggtcgggttaggtcgagaggtgttttcgattttgggtcgggataaagaggttgtcgtagtaagttaaagataattcgggttgttgcgcgtcgagtaggttacggggtgggaggagatggaggagtttttataggggatcggttttcgggtcgagcgcggggtcgttttaattcggtcggttgtttgaggcggtcgcgagcgcgggagttggagcgttgttagtcgcgttgagtttgcgtttggcgatcgcgatgtaggaggttcggganttgagggaggacggcgagagcggaggttcgtngattcgtatcgtcggggtaggtattcgggtttcgggggtagtaacgtcggggtttttgtagaacggggattgtttggggaagtggttttcgtatagtgttcggagagg

SEQ ID NO: 22158 - DNA, 647 bp, Artificial Sequence
  chemically treated genomic DNA (Homo sapiens) CpG-island No: 22158
  misc_feature (109)..(109): n is either a, c, g or t
  misc_feature (141)..(141): n is either a, c, g or t
  misc_feature (412)..(412): n is either a, c, g or t
cctctccgaacactatacgaaaaccacttccccaaacaatccccgttctacaaaaaccccgacgttactacccccgaaacccgaatacctaccccgacgatacgaatcnacgaacctccgctctcgccgtcctccctcaantcccgaacctcctacatcgcgatcgccaaacgcaaactcaacgcgactaacaacgctccaactcccgcgctcgcgaccgcctcaaacaaccgaccgaattaaaacgaccccgcgctcgacccgaaaaccgatcccctataaaaactcctccatctcctcccaccccgtaacctactcgacgcgcaacaacccgaattatctttaacttactacgacaacctctttatcccgacccaaaatcgaaaacacctctcgacctaacccgaccctnacccgtaaccgtataaacgaaaaccgaaactaaacgatcgatccgaaaaaaacgccgcgcccgaccccgaaatcccgaacccgaaaaaaacgtcgcgaccccgcgataaactcgccgcaacgaaaaaaacgcgcattcgaataaacgccgaaaccccgacctcccccgcgcaaacgaaaaaaccgcctccgccgctaacgaaaaacgaacgaccgaacgaaatctccgcccccac

SEQ ID NO: 22159 - DNA, 647 bp, Artificial Sequence
  chemically treated genomic DNA (Homo sapiens) CpG-island No: 22159
  misc_feature (109)..(109): n is either a, c, g or t
  misc_feature (141)..(141): n is either a, c, g or t
  misc_feature (412)..(412): n is either a, c, g or t
ttttttcgggtattgtgcgggagttatttttttaaatagttttcgttttgtaagggtttcggcgttgttgttttcgagattcgggtgtttgtttcggcggtgcgggttngcgggttttcgttttcgtcgtttttttttagntttcgggttttttgtatcgcggtcgttaggcgtaggtttagcgcggttgatagcgttttagttttcgcgttcgcggtcgttttaggtagtcgatcgggttggggcggtttcgcgttcggttcgggagtcgattttttgtgagggtttttttatttttttttatttcgtgatttgttcgacgcgtaatagttcgagttgtttttaatttgttgcggtagtttttttgtttcgatttagggtcgggggtatttttcggtttggttcggttttngttcgtagtcgtgtgagcgggggtcgggattgggcggtcggttcgggaggggcgtcgcgttcgatttcggagtttcgagttcgaggggagcgtcgcggtttcgcggtgggttcgtcgtagcggagggggcgcgtattcgggtgagcgtcggggtttcggtttttttcgcgtagacgaaggggtcgttttcgtcgttggcgggggacgagcggtcgaacggagttttcgtttttat

SEQ ID NO: 22160 - DNA, 647 bp, Artificial Sequence
  chemically treated genomic DNA (Homo sapiens) CpG-island No: 22160
  misc_feature (236)..(236): n is either a, c, g or t
  misc_feature (507)..(507): n is either a, c, g or t
  misc_feature (539)..(539): n is either a, c, g or t
ataaaaacgaaaactccgttcgaccgctcgtcccccgccaacgacgaaaacgaccccttcgtctacgcgaaaaaaaccgaaaccccgacgctcacccgaatacgcgccccctccgctacgacgaacccaccgcgaaaccgcgacgctcccctcgaactcgaaactccgaaatcgaacgcgacgcccctcccgaaccgaccgcccaatcccgacccccgctcacacgactacgaacnaaaaccgaaccaaaccgaaaaatacccccgaccctaaatcgaaacaaaaaaactaccgcaacaaattaaaaacaactcgaactattacgcgtcgaacaaatcacgaaataaaaaaaaataaaaaaaccctcacaaaaaatcgactcccgaaccgaacgcgaaaccgccccaacccgatcgactacctaaaacgaccgcgaacgcgaaaactaaaacgctatcaaccgcgctaaacctacgcctaacgaccgcgatacaaaaaacccgaaanctaaaaaaaaacgacgaaaacgaaaacccgcnaacccgcaccgccgaaacaaacacccgaatctcgaaaacaacaacgccgaaacccttacaaaacgaaaactatttaaaaaaataactcccgcacaatacccgaaaaaa

SEQ ID NO: 22161 - DNA, 514 bp, Artificial Sequence
  chemically treated genomic DNA (Homo sapiens) CpG-island No: 22161
agattggtagggttattacgcgtttgttgatttcgcgtagatattttcgaaaatttgtttaataggggtttcgtatgtgtcggagtggtttaagttgtcgtttgtggtgatatggggggggcgtagagttgattgttatggggtgttgtcggcgggatttatagtgattattcgtgtgtgcgatgtagacgtttttgtattggaggcggtagattgtgtagtgagttttgttttcgatgcgtgttgatagtcggttattcgatgtcgcgtcgagtgttgtttcgggtttgcgttggagagttttgtagttgtatgttaggaacgagttgcgtgttgttgtcgtagtgttcgcgtataatgggtatgcgttgagttttagaagagtgttgacgagtgttcggacgtttgcgagttattggcgtatgcgattatgtgttttgtttgaattcgtatagtatgacgttagcgatacgatttcgtgttttgaaatcgtattgtgttgtaaaagcgagaa

SEQ ID NO: 22162 - DNA, 514 bp, Artificial Sequence
  chemically treated genomic DNA (Homo sapiens) CpG-island No: 22162
ttctcgcttttacaacacaatacgatttcaaaacacgaaatcgtatcgctaacgtcatactatacgaattcaaacaaaacacataatcgcatacgccaataactcgcaaacgtccgaacactcgtcaacactcttctaaaactcaacgcatacccattatacgcgaacactacgacaacaacacgcaactcgttcctaacatacaactacaaaactctccaacgcaaacccgaaacaacactcgacgcgacatcgaataaccgactatcaacacgcatcgaaaacaaaactcactacacaatctaccgcctccaatacaaaaacgtctacatcgcacacacgaataatcactataaatcccgccgacaacaccccataacaatcaactctacgccccccccatatcaccacaaacgacaacttaaaccactccgacacatacgaaacccctattaaacaaattttcgaaaatatctacgcgaaatcaacaaacgcgtaataaccctaccaatct

SEQ ID NO: 22163 - DNA, 514 bp, Artificial Sequence
  chemically treated genomic DNA (Homo sapiens) CpG-island No: 22163
ttttcgtttttgtagtataatgcgattttaggatacgaaatcgtgtcgttgacgttatgttgtgcgaatttaggtaaagtatataatcgtatgcgttagtagttcgtaaacgttcgagtattcgttagtatttttttaagatttagcgtatgtttattgtgcgcgagtattgcgatagtaatacgtagttcgtttttgatatataattatagggttttttaacgtagattcgggatagtattcggcgcgatatcggatgatcgattattagtacgtatcgagggtaagatttattgtataatttatcgtttttaatgtaagagcgtttatatcgtatatacgagtgattattatgggtttcgtcgatagtattttatgataattagttttgcgttttttttatgttattataagcgatagtttgagttatttcgatatatgcgaagtttttgttgagtagattttcgagagtatttacgcgagattagtagacgcgtggtagttttattaattt

SEQ ID NO: 22164 - DNA, 514 bp, Artificial Sequence
  chemically treated genomic DNA (Homo sapiens) CpG-island No: 22164
aaattaataaaactaccacgcgtctactaatctcgcgtaaatactctcgaaaatctactcaacaaaaacttcgcatatatcgaaataactcaaactatcgcttataataacataaaaaaaacgcaaaactaattatcataaaatactatcgacgaaacccataataatcactcgtatatacgatataaacgctcttacattaaaaacgataaattatacaataaatcttaccctcgatacgtactaataatcgatcatccgatatcgcgccgaatactatcccgaatctacgttaaaaaaccctataattatatatcaaaaacgaactacgtattactatcgcaatactcgcgcacaataaacatacgctaaatcttaaaaaaatactaacgaatactcgaacgtttacgaactactaacgcatacgattatatactttacctaaattcgcacaacataacgtcaacgacacgatttcgtatcctaaaatcgcattatactacaaaaacgaaaa

SEQ ID NO: 22165 - DNA, 506 bp, Artificial Sequence
  chemically treated genomic DNA (Homo sapiens) CpG-island No: 22165
ttgttttattttcgaaaattttcgggtagatttcgtggttaattcggggttattgaatgtggcgataaggcgttaagtcgaagttatttttcgcgtcgtagaggtatatagcggttttagggcggaagtgttaatttcggttcggaattgtcggggcggaattatgttttaaggattcgttttatattagatggttatggagcgatatattttcgggtttgttcgggttttgttttttcggttgcggatattatttcgtacgtcgattcgcgttgtgtgacgtttcgaaagttttgtagcggagaaattattttgattttttatcgtacggcggattttttcgatcgtaggtattttatagtggtttcggtagaagttacgtcgttttatagtgtttatagtgtttatcgttgtttatcgttgggtcgagtttcgtgtgtgttattatagttgtttgtttagttatcgcgatatttatagatttatgtgatttttttatttttttt

SEQ ID NO: 22166 - DNA, 506 bp, Artificial Sequence
  chemically treated genomic DNA (Homo sapiens) CpG-island No: 22166
aaaaaaaataaaaaaatcacataaatctataaatatcgcgataactaaacaaacaactataataacacacacgaaactcgacccaacgataaacaacgataaacactataaacactataaaacgacgtaacttctaccgaaaccactataaaatacctacgatcgaaaaaatccgccgtacgataaaaaatcaaaataatttctccgctacaaaactttcgaaacgtcacacaacgcgaatcgacgtacgaaataatatccgcaaccgaaaaaacaaaacccgaacaaacccgaaaatatatcgctccataaccatctaatataaaacgaatccttaaaacataattccgccccgacaattccgaaccgaaattaacacttccgccctaaaaccgctatatacctctacgacgcgaaaaataacttcgacttaacgccttatcgccacattcaataaccccgaattaaccacgaaatctacccgaaaattttcgaaaataaaacaa

SEQ ID NO: 22167 - DNA, 506 bp, Artificial Sequence
  chemically treated genomic DNA (Homo sapiens) CpG-island No: 22167
agagagaatgagaagattatatggatttgtgagtatcgcggtgattagatagataattgtggtgatatatacgagattcgatttagcggtagataacgatggatattatggatattgtgaagcggcgtaatttttatcggaattattatggggtgtttacgatcgaagaaattcgtcgtgcggtgaaaagttagagtggttttttcgttgtaagattttcggaacgttatataacgcgaatcgacgtgcggaatggtattcgtaatcgagaaggtagagttcggataaattcgaaaatatgtcgttttatggttatttggtgtgaaacgaatttttgaagtataatttcgtttcgataatttcgggtcggaattaatattttcgttttaaaatcgttatgtgtttttgcggcgcgggaaatggtttcggtttggcgttttgtcgttatatttaatgatttcgggttaattacgaggtttattcgggaattttcgagggtggggtaa

SEQ ID NO: 22168 - DNA, 506 bp, Artificial Sequence
  chemically treated genomic DNA (Homo sapiens) CpG-island No: 22168
ttaccccaccctcgaaaattcccgaataaacctcgtaattaacccgaaatcattaaatataacgacaaaacgccaaaccgaaaccatttcccgcgccgcaaaaacacataacgattttaaaacgaaaatattaattccgacccgaaattatcgaaacgaaattatacttcaaaaattcgtttcacaccaaataaccataaaacgacatattttcgaatttatccgaactctaccttctcgattacgaataccattccgcacgtcgattcgcgttatataacgttccgaaaatcttacaacgaaaaaaccactctaacttttcaccgcacgacgaatttcttcgatcgtaaacaccccataataattccgataaaaattacgccgcttcacaatatccataatatccatcgttatctaccgctaaatcgaatctcgtatatatcaccacaattatctatctaatcaccgcgatactcacaaatccatataatcttctcattctctct

SEQ ID NO: 22169 - DNA, 509 bp, Artificial Sequence
  chemically treated genomic DNA (Homo sapiens) CpG-island No: 22169
  misc_feature (30)..(30): n is either a, c, g or t
  misc_feature (49)..(49): n is either a, c, g or t
  misc_feature (333)..(333): n is either a, c, g or t
  misc_feature (354)..(354): n is either a, c, g or t
  misc_feature (365)..(365): n is either a, c, g or t
  misc_feature (436)..(436): n is either a, c, g or t
ttttgcgtgggcgaatttttcgtgtcgtgngacgcgcgggcgtttaggnttatatagtttagttagtgatgttaagcgcgggcggggtcgttagttgaggggttagtaggtttatgcgtttgacgtttgcgtacgcgtttaggttgtgcgtttttcgttttttttttttttttatttttttttacgttttgttcgtttttcgttttttttcgataatcgttttttttattttttatttttattttcgtttttttttttttttttttcgtatgcgttatatggttttttcggtttagttaagagtttggaattacgtgatttgtttatttgtantgtcgcggagcgttttatttncggtttttttngtggttagaagaaagtggtttatttgtcgttagttagagatttcgcggatttgtttttattcgtaggagangattaatttttttaggcggtagaagggacggggatagaggggggaggggatttgagggaaggaagggaaaagt

SEQ ID NO: 22170 - DNA, 509 bp, Artificial Sequence
  chemically treated genomic DNA (Homo sapiens) CpG-island No: 22170
  misc_feature (74)..(74): n is either a, c, g or t
  misc_feature (145)..(145): n is either a, c, g or t
  misc_feature (156)..(156): n is either a, c, g or t
  misc_feature (177)..(177): n is either a, c, g or t
  misc_feature (461)..(461): n is either a, c, g or t
  misc_feature (480)..(480): n is either a, c, g or t
acttttcccttccttccctcaaatcccctcccccctctatccccgtcccttctaccgcctaaaaaaattaatcntctcctacgaataaaaacaaatccgcgaaatctctaactaacgacaaataaaccactttcttctaaccacnaaaaaaaccgnaaataaaacgctccgcgacantacaaataaacaaatcacgtaattccaaactcttaactaaaccgaaaaaaccatataacgcatacgaaaaaaaaaaaaaaaaaaacgaaaataaaaataaaaaataaaaaaaacgattatcgaaaaaaaacgaaaaacgaacaaaacgtaaaaaaaaataaaaaaaaaaaaaaaacgaaaaacgcacaacctaaacgcgtacgcaaacgtcaaacgcataaacctactaacccctcaactaacgaccccgcccgcgcttaacatcactaactaaactatataancctaaacgcccgcgcgtcncacgacacgaaaaattcgcccacgcaaaa

SEQ ID NO: 22171 - DNA, 509 bp, Artificial Sequence
  chemically treated genomic DNA (Homo sapiens) CpG-island No: 22171
  misc_feature (74)..(74): n is either a, c, g or t
  misc_feature (145)..(145): n is either a, c, g or t
  misc_feature (156)..(156): n is either a, c, g or t
  misc_feature (177)..(177): n is either a, c, g or t
  misc_feature (461)..(461): n is either a, c, g or t
  misc_feature (480)..(480): n is either a, c, g or t
gtttttttttttttttttttaaatttttttttttttttattttcgttttttttgtcgtttgaaagggttaattnttttttgcgggtaaaaataggttcgcggagtttttaattggcgatagatgggttatttttttttggttatnaaaggggtcgngaatggagcgtttcgcggtantataaatgggtaggttacgtggttttaggtttttggttggatcgggaagattatatggcgtatgcgggggaggaaggaggaggggcgggggtaggggtggagggtgaggggagcggttgtcggaggagggcgggagacgagtaaggcgtggggagaagtggggaggaggggagaacggggagcgtatagtttggacgcgtgcgtaggcgttaggcgtatagatttgttagttttttagttagcggtttcgttcgcgtttagtattattaattgggttatataantttgagcgttcgcgcgttntacgatacgaggaattcgtttacgtagga

SEQ ID NO: 22172 - DNA, 509 bp, Artificial Sequence
  chemically treated genomic DNA (Homo sapiens) CpG-island No: 22172
  misc_feature (30)..(30): n is either a, c, g or t
  misc_feature (49)..(49): n is either a, c, g or t
  misc_feature (333)..(333): n is either a, c, g or t
  misc_feature (354)..(354): n is either a, c, g or t
  misc_feature (365)..(365): n is either a, c, g or t
  misc_feature (436)..(436): n is either a, c, g or t
tcctacgtaaacgaattcctcgtatcgtanaacgcgcgaacgctcaaanttatataacccaattaataatactaaacgcgaacgaaaccgctaactaaaaaactaacaaatctatacgcctaacgcctacgcacgcgtccaaactatacgctccccgttctcccctcctccccacttctccccacgccttactcgtctcccgccctcctccgacaaccgctcccctcaccctccacccctacccccgcccctcctccttcctcccccgcatacgccatataatcttcccgatccaaccaaaaacctaaaaccacgtaacctacccatttatantaccgcgaaacgctccattcncgacccctttnataaccaaaaaaaaataacccatctatcgccaattaaaaactccgcgaacctatttttacccgcaaaaaanaattaaccctttcaaacgacaaaaaaaacgaaaataaaaaaaaaaaaaaatttaaaaaaaaaaaaaaaaaaac

SEQ ID NO: 22173 - DNA, 631 bp, Artificial Sequence
  chemically treated genomic DNA (Homo sapiens) CpG-island No: 22173
  misc_feature (125)..(125): n is either a, c, g or t
  misc_feature (133)..(133): n is either a, c, g or t
  misc_feature (147)..(147): n is either a, c, g or t
  misc_feature (167)..(167): n is either a, c, g or t
  misc_feature (352)..(352): n is either a, c, g or t
  misc_feature (359)..(359): n is either a, c, g or t
  misc_feature (368)..(368): n is either a, c, g or t
  misc_feature (397)..(397): n is either a, c, g or t
  misc_feature (452)..(452): n is either a, c, g or t
  misc_feature (457)..(457): n is either a, c, g or t
  misc_feature (503)..(503): n is either a, c, g or t
  misc_feature (508)..(508): n is either a, c, g or t
  misc_feature (561)..(561): n is either a, c, g or t
tttatttcgtcgcgttagatcgttagtttttagttttcgcgtcggaggggcggtgttttgcggggacgcgagttcgtattggtttgcgtggtcgttagggcggtgaaatgacggtttcggggcgngggttttngcggtttggttggncggcgtcgtttcgttttttngtcgttcgtgttgattgaggcgttgtagttaggagtcgcggtcggttgtttagcgttcgtcgttttcgcgcgttcgtagtcgttttcgcgtcgatatgcgtttggtcgtcgtcgcgaacgaggcgtatacggtttttttggcggtttcggggttgttgggttgtaagtagtgcggcgggggtcgncgattanggacgaggntatttgggcgaggggttgagcgggtcgtntgggtatttgggcgggtgggtattcggtcgagttgttttgtgtaatacggaggtntacgnttgtttttttatagtcgttttcggttagtattcgaaaacgtttttntagantagggcgggttttcggggagtagcgtttcggtttttttgcgtttttcgggggnaaggggttgtttgcggtgggtgggagatttgcgtatcgtgagtcgtttttgggtagaaaatgttaagttg

SEQ ID NO: 22174 - DNA, 631 bp, Artificial Sequence
  chemically treated genomic DNA (Homo sapiens) CpG-island No: 22174
  misc_feature (71)..(71): n is either a, c, g or t
  misc_feature (124)..(124): n is either a, c, g or t
  misc_feature (129)..(129): n is either a, c, g or t
  misc_feature (175)..(175): n is either a, c, g or t
  misc_feature (180)..(180): n is either a, c, g or t
  misc_feature (235)..(235): n is either a, c, g or t
  misc_feature (264)..(264): n is either a, c, g or t
  misc_feature (273)..(273): n is either a, c, g or t
  misc_feature (280)..(280): n is either a, c, g or t
  misc_feature (465)..(465): n is either a, c, g or t
  misc_feature (485)..(485): n is either a, c, g or t
  misc_feature (499)..(499): n is either a, c, g or t
  misc_feature (507)..(507): n is either a, c, g or t
caacttaacattttctacccaaaaacgactcacgatacgcaaatctcccacccaccgcaaacaaccccttncccccgaaaaacgcaaaaaaaccgaaacgctactccccgaaaacccgccctantctanaaaaacgttttcgaatactaaccgaaaacgactataaaaaaacaancgtanacctccgtattacacaaaacaactcgaccgaatacccacccgcccaaatacccanacgacccgctcaacccctcgcccaaatancctcgtccntaatcgncgacccccgccgcactacttacaacccaacaaccccgaaaccgccaaaaaaaccgtatacgcctcgttcgcgacgacgaccaaacgcatatcgacgcgaaaacgactacgaacgcgcgaaaacgacgaacgctaaacaaccgaccgcgactcctaactacaacgcctcaatcaacacgaacgacnaaaaaacgaaacgacgccgnccaaccaaaccgcnaaaacccncgccccgaaaccgtcatttcaccgccctaacgaccacgcaaaccaatacgaactcgcgtccccgcaaaacaccgcccctccgacgcgaaaactaaaaactaacgatctaacgcgacgaaataaa

SEQ ID NO: 22175 - DNA, 631 bp, Artificial Sequence
  chemically treated genomic DNA (Homo sapiens) CpG-island No: 22175
  misc_feature (71)..(71): n is either a, c, g or t
  misc_feature (124)..(124): n is either a, c, g or t
  misc_feature (129)..(129): n is either a, c, g or t
  misc_feature (175)..(175): n is either a, c, g or t
  misc_feature (180)..(180): n is either a, c, g or t
  misc_feature (235)..(235): n is either a, c, g or t
  misc_feature (264)..(264): n is either a, c, g or t
  misc_feature (273)..(273): n is either a, c, g or t
  misc_feature (280)..(280): n is either a, c, g or t
  misc_feature (465)..(465): n is either a, c, g or t
  misc_feature (485)..(485): n is either a, c, g or t
  misc_feature (499)..(499): n is either a, c, g or t
  misc_feature (507)..(507): n is either a, c, g or t
tagtttagtattttttgtttagggacgatttacggtgcgtaggttttttatttatcgtaggtaattttttnttttcgaggggcgtaggagggtcgggacgttgtttttcgggagttcgttttantttgngggagcgttttcggatgttgatcgggagcgattgtgaggaggtaancgtgnattttcgtgttgtatagggtagttcggtcgggtgtttattcgtttaggtatttangcggttcgtttagtttttcgtttaggtantttcgtttntggtcgncggttttcgtcgtattgtttgtagtttagtagtttcgagatcgttaaaggggtcgtgtacgtttcgttcgcggcggcggttaagcgtatgtcggcgcggggacggttgcggacgcgcggaggcggcgagcgttgggtagtcggtcgcggtttttggttgtagcgttttagttagtacggacggtnggggggcggggcggcgtcgnttaattaagtcgtnggggtttncgtttcggggtcgttattttatcgttttggcggttacgtaagttaatgcgggttcgcgttttcgtaaagtatcgttttttcggcgcggaggttgggaattggcggtttgacgcggcgaggtgaa

SEQ ID NO: 22176 - DNA, 631 bp, Artificial Sequence
  chemically treated genomic DNA (Homo sapiens) CpG-island No: 22176
  misc_feature (125)..(125): n is either a, c, g or t
  misc_feature (133)..(133): n is either a, c, g or t
  misc_feature (147)..(147): n is either a, c, g or t
  misc_feature (167)..(167): n is either a, c, g or t
  misc_feature (352)..(352): n is either a, c, g or t
  misc_feature (359)..(359): n is either a, c, g or t
  misc_feature (368)..(368): n is either a, c, g or t
  misc_feature (397)..(397): n is either a, c, g or t
  misc_feature (452)..(452): n is either a, c, g or t
  misc_feature (457)..(457): n is either a, c, g or t
  misc_feature (503)..(503): n is either a, c, g or t
  misc_feature (508)..(508): n is either a, c, g or t
  misc_feature (561)..(561): n is either a, c, g or t
ttcacctcgccgcgtcaaaccgccaattcccaacctccgcgccgaaaaaacgatactttacgaaaacgcgaacccgcattaacttacgtaaccgccaaaacgataaaataacgaccccgaaacgnaaaccccnacgacttaattaancgacgccgccccgccccccnaccgtccgtactaactaaaacgctacaaccaaaaaccgcgaccgactacccaacgctcgccgcctccgcgcgtccgcaaccgtccccgcgccgacatacgcttaaccgccgccgcgaacgaaacgtacacgacccctttaacgatctcgaaactactaaactacaaacaatacgacgaaaaccgncgaccanaaacgaaantacctaaacgaaaaactaaacgaaccgcntaaatacctaaacgaataaacacccgaccgaactaccctatacaacacgaaaatncacgnttacctcctcacaatcgctcccgatcaacatccgaaaacgctcccncaaantaaaacgaactcccgaaaaacaacgtcccgaccctcctacgcccctcgaaaanaaaaaattacctacgataaataaaaaacctacgcaccgtaaatcgtccctaaacaaaaaatactaaacta

SEQ ID NO: 22177 - DNA, 545 bp, Artificial Sequence
  chemically treated genomic DNA (Homo sapiens) CpG-island No: 22177
  misc_feature (530)..(531): n is either a, c, g or t
cggtggtcgagtcgtaaggtatggttattttgtcgtagattttcggtagttagaacgggaaagtcgaatatgtatattttgaaggttggaaagtgtgggagaacgttagcgcgttgtagtaaataatgtttttgatgagtgaaaagaatgagtgatgtcgtcgagatattagattttttgcgtttgtttttatagggtgagcgtttgattgaagtttttgtcggtataggtaaaatttttacgattgcggcgttttatttgcgtttgttatttggattaggcggtttcgtcgttttttttcgttcgttgatcgttgaagaattgttggtggttatttttatcgaggttgttacggtagaattgcgcggtcgtattcgtaataatatttacgaagtgcgtatcggttgtttgcgtgaaattatcgataatttattgtacgaacgtttgttggaagagatcgacgataaagcgtaagtcgcgtagtggttgttgttagtcgaacggtagatggatgaagcggagatgttaanntttcgaattttatt

SEQ ID NO: 22178 - DNA, 545 bp, Artificial Sequence
  chemically treated genomic DNA (Homo sapiens) CpG-island No: 22178
  misc_feature (15)..(16): n is either a, c, g or t
aataaaattcgaaannttaacatctccgcttcatccatctaccgttcgactaacaacaaccactacgcgacttacgctttatcgtcgatctcttccaacaaacgttcgtacaataaattatcgataatttcacgcaaacaaccgatacgcacttcgtaaatattattacgaatacgaccgcgcaattctaccgtaacaacctcgataaaaataaccaccaacaattcttcaacgatcaacgaacgaaaaaaaacgacgaaaccgcctaatccaaataacaaacgcaaataaaacgccgcaatcgtaaaaattttacctataccgacaaaaacttcaatcaaacgctcaccctataaaaacaaacgcaaaaaatctaatatctcgacgacatcactcattcttttcactcatcaaaaacattatttactacaacgcgctaacgttctcccacactttccaaccttcaaaatatacatattcgactttcccgttctaactaccgaaaatctacgacaaaataaccataccttacgactcgaccaccg

SEQ ID NO: 22179 - DNA, 545 bp, Artificial Sequence
  chemically treated genomic DNA (Homo sapiens) CpG-island No: 22179
  misc_feature (15)..(16): n is either a, c, g or t
aatggagttcggaannttagtattttcgttttatttatttgtcgttcggttaataataattattgcgcggtttgcgttttatcgtcgattttttttagtaggcgttcgtatagtggattgtcggtggttttacgtagatagtcgatgcgtatttcgtggatattgttacggatacgatcgcgtaattttgtcgtggtagtttcggtaaaggtgattattagtagttttttaacggttagcgggcggggaaaggcggcggaatcgtttagtttaagtaataggcgtaaatagagcgtcgtaatcgtaaaggttttgtttgtgtcggtagaggttttaattaggcgtttattttgtaagggtaagcgtaaaggatttagtgtttcggcgatattatttattttttttatttattaggggtattgtttgttgtaacgcgttgacgtttttttatattttttagtttttagggtgtatatattcggttttttcgttttggttgtcggaaatttgcgatagaatagttatgttttgcggttcgattatcg

SEQ ID NO: 22180 - DNA, 545 bp, Artificial Sequence
  chemically treated genomic DNA (Homo sapiens) CpG-island No: 22180
  misc_feature (530)..(531): n is either a, c, g or t
cgataatcgaaccgcaaaacataactattctatcgcaaatttccgacaaccaaaacgaaaaaaccgaatatatacaccctaaaaactaaaaaatataaaaaaacgtcaacgcgttacaacaaacaatacccctaataaataaaaaaaataaataatatcgccgaaacactaaatcctttacgcttacccttacaaaataaacgcctaattaaaacctctaccgacacaaacaaaacctttacgattacgacgctctatttacgcctattacttaaactaaacgattccgccgcctttccccgcccgctaaccgttaaaaaactactaataatcacctttaccgaaactaccacgacaaaattacgcgatcgtatccgtaacaatatccacgaaatacgcatcgactatctacgtaaaaccaccgacaatccactatacgaacgcctactaaaaaaaatcgacgataaaacgcaaaccgcgcaataattattattaaccgaacgacaaataaataaaacgaaaatactaannttccgaactccatt

SEQ ID NO: 22181 - DNA, 725 bp, Artificial Sequence
  chemically treated genomic DNA (Homo sapiens) CpG-island No: 22181
tcgttacgtagcgcgttttgtttttttggcgtaatgtcgatacggtagtaattggtcgcgcgtagaattcgtggaaagagtgtaatattcggcggatggaagaagataacgttcgtttggcgcggcgtagtagcggtggcggcgcggtgttttacgatttcggtaatatttgttttatttttatggttggtaagtcggagtacgataaaattatttttacgtcgattgtgtttaatgcgttgaacgcgttcggcgttagcgtcgaagcgttcggacgtaacgatttggtggtgaaaatcgtcgaaggcgatcgtaaagttttaggttcggtttatcgcgaaattaaagatcgcggtttttattacggtattttgttatttaatgtcgattttagtcgtttggtaaattattttaattcggataaaaagaaattggcggcgaaaggtattacgtcggtacgttttcgcgtgattaattttatcgagttggtggtcggggattatttatgagtaagtttgcgaagttataatcgaggtttttttcgtttattatgggtttgagacgatttttgttcggattcgtttatcggattcgttgaattttttcgtatgtatcgggttataatagcgggggcggttgtaatataggtcggattttttattatattgttgtttcggtagtcggataagttgttgtagttgatgcgggtttttttgatttagtag

SEQ ID NO: 22182 - DNA, 725 bp, Artificial Sequence
  chemically treated genomic DNA (Homo sapiens) CpG-island No: 22182
ctactaaatcaaaaaaacccgcatcaactacaacaacttatccgactaccgaaacaacaatataataaaaaatccgacctatattacaaccgcccccgctattataacccgatacatacgaaaaaattcaacgaatccgataaacgaatccgaacaaaaatcgtctcaaacccataataaacgaaaaaaacctcgattataacttcgcaaacttactcataaataatccccgaccaccaactcgataaaattaatcacgcgaaaacgtaccgacgtaatacctttcgccgccaatttctttttatccgaattaaaataatttaccaaacgactaaaatcgacattaaataacaaaataccgtaataaaaaccgcgatctttaatttcgcgataaaccgaacctaaaactttacgatcgccttcgacgattttcaccaccaaatcgttacgtccgaacgcttcgacgctaacgccgaacgcgttcaacgcattaaacacaatcgacgtaaaaataattttatcgtactccgacttaccaaccataaaaataaaacaaatattaccgaaatcgtaaaacaccgcgccgccaccgctactacgccgcgccaaacgaacgttatcttcttccatccgccgaatattacactctttccacgaattctacgcgcgaccaattactaccgtatcgacattacgccaaaaaaacaaaacgcgctacgtaacga

SEQ ID NO: 22183 - DNA, 725 bp, Artificial Sequence
  chemically treated genomic DNA (Homo sapiens) CpG-island No: 22183
ttgttgaattaagagaattcgtattagttgtagtagtttattcggttgtcggggtagtagtatgatgaggagttcggtttgtattataatcgttttcgttattatgattcggtgtatgcgagggaatttagcggattcgatggacgggttcgagtagaggtcgttttaaatttataatgggcgaaaaaggtttcggttatggtttcgtaaatttgtttatgggtgattttcggttattagttcggtgaggttggttacgcgggaacgtatcgacgtaatgtttttcgtcgttagtttttttttattcggattgagatagtttgttaggcggttgaggtcggtattgagtagtaaggtgtcgtggtggaagtcgcgatttttggtttcgcgataggtcgagtttgagattttgcggtcgttttcgacggtttttattattagatcgttacgttcggacgtttcggcgttgacgtcgagcgcgtttagcgtattgagtataatcgacgtggagatagttttatcgtatttcggtttgttagttataaaggtaaagtaggtattgtcgagatcgtggaatatcgcgtcgttatcgttattgcgtcgcgttaggcggacgttatttttttttattcgtcgggtattatattttttttacgggttttgcgcgcgattaattattatcgtgtcggtattgcgttagagaaatagaacgcgttgcgtggcgg

SEQ ID NO: 22184 - DNA, 725 bp, Artificial Sequence
  chemically treated genomic DNA (Homo sapiens) CpG-island No: 22184
ccgccacgcaacgcgttctatttctctaacgcaataccgacacgataataattaatcgcgcgcaaaacccgtaaaaaaaatataatacccgacgaataaaaaaaaataacgtccgcctaacgcgacgcaataacgataacgacgcgatattccacgatctcgacaatacctactttacctttataactaacaaaccgaaatacgataaaactatctccacgtcgattatactcaatacgctaaacgcgctcgacgtcaacgccgaaacgtccgaacgtaacgatctaataataaaaaccgtcgaaaacgaccgcaaaatctcaaactcgacctatcgcgaaaccaaaaatcgcgacttccaccacgacaccttactactcaataccgacctcaaccgcctaacaaactatctcaatccgaataaaaaaaaactaacgacgaaaaacattacgtcgatacgttcccgcgtaaccaacctcaccgaactaataaccgaaaatcacccataaacaaatttacgaaaccataaccgaaacctttttcgcccattataaatttaaaacgacctctactcgaacccgtccatcgaatccgctaaattccctcgcatacaccgaatcataataacgaaaacgattataatacaaaccgaactcctcatcatactactaccccgacaaccgaataaactactacaactaatacgaattctcttaattcaacaa

SEQ ID NO: 22185 - DNA, 507 bp, Artificial Sequence
  chemically treated genomic DNA (Homo sapiens) CpG-island No: 22185
  misc_feature (372)..(373): n is either a, c, g or t
tacgttgttgtttttttcgtgttgatgagcgttagcggtatgtcgtagatggtcgtagtggtataggtggatttttcgcgtcggcgtgtatatcgggtttatttggttatgtatttgttttacgggtagggcgtacgatgttagttagcggcggttttttttatttattcggttagttaggattttattttttagtcggtcgagtatttgtattagtatcggcgggaatattatattgttatcgttttcgtcgtcggattgttgaagggtatacgttaggttgcggcgttgcgttttcgttagtttatcggtggtagtttcgattttgatgagtggcgtgaaagttttcggttgataaatcgtttggatgtnngttttgtcgttttgtatcgtgggtagacggaacgttttttatttcgattaagggatttggcggtttttagatagcgagattgaaattggaattcgatttttagcggtcgattttagaggatttttttaatattt

SEQ ID NO: 22186 - DNA, 507 bp, Artificial Sequence
  chemically treated genomic DNA (Homo sapiens) CpG-island No: 22186
  misc_feature (135)..(136): n is either a, c, g or t
aaatattaaaaaaatcctctaaaatcgaccgctaaaaatcgaattccaatttcaatctcgctatctaaaaaccgccaaatcccttaatcgaaataaaaaacgttccgtctacccacgatacaaaacgacaaaacnnacatccaaacgatttatcaaccgaaaactttcacgccactcatcaaaatcgaaactaccaccgataaactaacgaaaacgcaacgccgcaacctaacgtatacccttcaacaatccgacgacgaaaacgataacaatataatattcccgccgatactaatacaaatactcgaccgactaaaaaataaaatcctaactaaccgaataaataaaaaaaaccgccgctaactaacatcgtacgccctacccgtaaaacaaatacataaccaaataaacccgatatacacgccgacgcgaaaaatccacctataccactacgaccatctacgacataccgctaacgctcatcaacacgaaaaaaacaacaacgta

SEQ ID NO: 22187 - DNA, 507 bp, Artificial Sequence
  chemically treated genomic DNA (Homo sapiens) CpG-island No: 22187
  misc_feature (135)..(136): n is either a, c, g or t
ggatattaaggggattttttagagtcggtcgttaggaatcgagttttaattttagtttcgttgtttggaaatcgttaagttttttggtcgggatgggaggcgtttcgtttgtttacgatatagaacgatagagtnngtatttagacgatttattagtcgggagtttttacgttatttattagggtcgaaattgttatcggtgagttggcgaaaacgtagcgtcgtagtttggcgtatgttttttagtagttcggcggcgaagacggtggtagtgtggtgttttcgtcggtgttggtgtagatgttcgatcggttggaaagtgaaattttggttgatcgggtgagtgaggaaagtcgtcgttggttggtatcgtgcgttttgttcgtggagtagatgtataattagatggattcggtgtatacgtcggcgcgaaaaatttatttgtattattgcgattatttgcggtatgtcgttggcgtttattagtacggaaggggtaatagcgtg

SEQ ID NO: 22188 - DNA, 507 bp, Artificial Sequence
  chemically treated genomic DNA (Homo sapiens) CpG-island No: 22188
  misc_feature (372)..(373): n is either a, c, g or t
cacgctattaccccttccgtactaataaacgccaacgacataccgcaaataatcgcaataatacaaataaatttttcgcgccgacgtatacaccgaatccatctaattatacatctactccacgaacaaaacgcacgataccaaccaacgacgactttcctcactcacccgatcaaccaaaatttcactttccaaccgatcgaacatctacaccaacaccgacgaaaacaccacactaccaccgtcttcgccgccgaactactaaaaaacatacgccaaactacgacgctacgttttcgccaactcaccgataacaatttcgaccctaataaataacgtaaaaactcccgactaataaatcgtctaaatacnnactctatcgttctatatcgtaaacaaacgaaacgcctcccatcccgaccaaaaaacttaacgatttccaaacaacgaaactaaaattaaaactcgattcctaacgaccgactctaaaaaatccccttaatatcc

SEQ ID NO: 22189 - DNA, 571 bp, Artificial Sequence
  chemically treated genomic DNA (Homo sapiens) CpG-island No: 22189
gttttgtaaggttgggaagttaaatttttgcgcgtaggaaaagttaatattagcgatagttattttcgtttgcgtgacggagaggtatttttgtttggttgaattttttcgacggtttttttagaggatttttagtattttcgcgcgggtgttggtgggtttagaatcgttcgcgtaggggaatattagttggcgtggcgaatcgttggcgaaatttaatcgcgtttagcgtaaagcgtttcgtcgcgatatttagatggtattttaggattttattagcgtcgtgaattcgcgtaaaatcgtgcgcgagattttgcgtgaatcgatgcgttatttgttattattgaaaaaattcgaataattggcgcgcgttagcgaaatgttgaaggcggtcgatttcgatgatagcgttttcgataaacgtttatcgtagttaagcggcggttagttttagcgcgtttgtttggttcgcgcgttggcggtcgaatcgaaattattgattttggatgaagtcgtttttaattttgatttcgtgttataggcgggtgttattcgtttgttgaaaaagtta

SEQ ID NO: 22190 - DNA, 571 bp, Artificial Sequence
  chemically treated genomic DNA (Homo sapiens) CpG-island No: 22190
taactttttcaacaaacgaataacacccgcctataacacgaaatcaaaattaaaaacgacttcatccaaaatcaataatttcgattcgaccgccaacgcgcgaaccaaacaaacgcgctaaaactaaccgccgcttaactacgataaacgtttatcgaaaacgctatcatcgaaatcgaccgccttcaacatttcgctaacgcgcgccaattattcgaattttttcaataataacaaataacgcatcgattcacgcaaaatctcgcgcacgattttacgcgaattcacgacgctaataaaatcctaaaataccatctaaatatcgcgacgaaacgctttacgctaaacgcgattaaatttcgccaacgattcgccacgccaactaatattcccctacgcgaacgattctaaacccaccaacacccgcgcgaaaatactaaaaatcctctaaaaaaaccgtcgaaaaaattcaaccaaacaaaaatacctctccgtcacgcaaacgaaaataactatcgctaatattaacttttcctacgcgcaaaaatttaacttcccaaccttacaaaac

SEQ ID NO: 22191 - DNA, 571 bp, Artificial Sequence
  chemically treated genomic DNA (Homo sapiens) CpG-island No: 22191
tagtttttttagtaggcgaatgatattcgtttgtaatacgagattaaggttagaaacggttttatttagaattagtagtttcggttcgatcgttagcgcgcgagttaggtagacgcgttggagttggtcgtcgtttaattgcggtgggcgtttgtcgagaacgttgttatcgagatcgatcgtttttagtatttcgttggcgcgcgttagttgttcggatttttttagtgatagtaggtggcgtatcggtttacgtaggatttcgcgtacggttttgcgcggatttacggcgttgatggagttttgaaatattatttgaatatcgcggcggaacgttttacgttgggcgcgattgagtttcgttagcggttcgttacgttagttaatatttttttgcgcgggcgattttaaatttattagtattcgcgcgagggtattggggattttttagagaggtcgtcgaaggagtttagttaaatagaaatgttttttcgttacgtagacgaaggtagttgtcgttgatattggttttttttgcgcgtagggatttaattttttagttttgtagggt

SEQ ID NO: 22192 - DNA, 571 bp, Artificial Sequence
  chemically treated genomic DNA (Homo sapiens) CpG-island No: 22192
accctacaaaactaaaaaattaaatccctacgcgcaaaaaaaaccaatatcaacgacaactaccttcgtctacgtaacgaaaaaacatttctatttaactaaactccttcgacgacctctctaaaaaatccccaataccctcgcgcgaatactaataaatttaaaatcgcccgcgcaaaaaaatattaactaacgtaacgaaccgctaacgaaactcaatcgcgcccaacgtaaaacgttccgccgcgatattcaaataatatttcaaaactccatcaacgccgtaaatccgcgcaaaaccgtacgcgaaatcctacgtaaaccgatacgccacctactatcactaaaaaaatccgaacaactaacgcgcgccaacgaaatactaaaaacgatcgatctcgataacaacgttctcgacaaacgcccaccgcaattaaacgacgaccaactccaacgcgtctacctaactcgcgcgctaacgatcgaaccgaaactactaattctaaataaaaccgtttctaaccttaatctcgtattacaaacgaatatcattcgcctactaaaaaaacta

SEQ ID NO: 22193 - DNA, 688 bp, Artificial Sequence
  chemically treated genomic DNA (Homo sapiens) CpG-island No: 22193
ttttagcgcggtttgtattggttaattgattaatgttatcgtatagcgtcgattcgttgtattgtacgcgttgttgtgtacgggtttacgtcggaacgttaatcggttgaggcgtcgtcgcggttgacgggcgaagttattataagttatgtgggtttgtgtgcgttatgtataattttcggttgtattttgcgcgtatgtatacgttggcgttttgttgtttttattttgaatttcgttaatttggtatttagcggcggtttgtttttaagcgtcgttttcggtgcgacgttttggaggttgggtagtcgttaacgcgcgcgtttaatattataattttcgtcgttgtaataatttggcgttattgtttggttcgtgatattcgtaatcgagttacggtttttcgtttagcgcgaagtaagtttgtcgtttaattgtcggtgggtatattttgtttgttacggtttcgttgataacgattttggttcgttggttttaacgtaacgttcgtcgtttggagtttgtttaagcgggttttatttgttgtgtaagttttttttcgtttgcggtatgcgtatgcgttttgttttaacgcggtttttgttaagttattttatacgttttcgtttattttgtttatatgcgtaaatttgtacgtattacgtattttgatgtattgttagatttg

SEQ ID NO: 22194 - DNA, 688 bp, Artificial Sequence
  chemically treated genomic DNA (Homo sapiens) CpG-island No: 22194
caaatctaacaatacatcaaaatacgtaatacgtacaaatttacgcatataaacaaaataaacgaaaacgtataaaataacttaacaaaaaccgcgttaaaacaaaacgcatacgcataccgcaaacgaaaaaaaacttacacaacaaataaaacccgcttaaacaaactccaaacgacgaacgttacgttaaaaccaacgaaccaaaatcgttatcaacgaaaccgtaacaaacaaaatatacccaccgacaattaaacgacaaacttacttcgcgctaaacgaaaaaccgtaactcgattacgaatatcacgaaccaaacaataacgccaaattattacaacgacgaaaattataatattaaacgcgcgcgttaacgactacccaacctccaaaacgtcgcaccgaaaacgacgcttaaaaacaaaccgccgctaaataccaaattaacgaaattcaaaataaaaacaacaaaacgccaacgtatacatacgcgcaaaatacaaccgaaaattatacataacgcacacaaacccacataacttataataacttcgcccgtcaaccgcgacgacgcctcaaccgattaacgttccgacgtaaacccgtacacaacaacgcgtacaatacaacgaatcgacgctatacgataacattaatcaattaaccaatacaaaccgcgctaaaa

SEQ ID NO: 22195 - DNA, 688 bp, Artificial Sequence
  chemically treated genomic DNA (Homo sapiens) CpG-island No: 22195
taagtttggtagtatattaaaatgcgtggtgcgtgtaagtttgcgtatataagtaaaataaacgggggcgtgtaggatagtttagtagaggtcgcgttagggtaaggcgtatacgtatatcgtaggcggaaaagggtttgtataataagtaaggttcgtttgggtaaattttaggcggcgggcgttacgttagggttaacgggttaaaatcgttgttagcggggtcgtggtaggtaaaatgtgtttatcggtagttgggcggtaggtttatttcgcgttaagcgaaagatcgtaattcggttgcggatattacgggttaggtaatggcgttaaattgttataacggcggaagttgtggtattgagcgcgcgcgttagcggttgtttaatttttaaaacgtcgtatcggaggcggcgtttgggagtaggtcgtcgttgggtattaggttagcggggtttaaggtaagggtagtaaaacgttagcgtgtatatacgcgtagggtatagtcgggggttatatatagcgtatatagatttatatggtttgtggtggtttcgttcgttaatcgcggcggcgttttagtcggttggcgtttcggcgtgggttcgtgtatagtagcgcgtgtagtgtaacgaatcggcgttatacgatggtattagttagttagttagtgtaggtcgcgttgggg

SEQ ID NO: 22196 - DNA, 688 bp, Artificial Sequence
  chemically treated genomic DNA (Homo sapiens) CpG-island No: 22196
ccccaacgcgacctacactaactaactaactaataccatcgtataacgccgattcgttacactacacgcgctactatacacgaacccacgccgaaacgccaaccgactaaaacgccgccgcgattaacgaacgaaaccaccacaaaccatataaatctatatacgctatatataacccccgactataccctacgcgtatatacacgctaacgttttactacccttaccttaaaccccgctaacctaatacccaacgacgacctactcccaaacgccgcctccgatacgacgttttaaaaattaaacaaccgctaacgcgcgcgctcaataccacaacttccgccgttataacaatttaacgccattacctaacccgtaatatccgcaaccgaattacgatctttcgcttaacgcgaaataaacctaccgcccaactaccgataaacacattttacctaccacgaccccgctaacaacgattttaacccgttaaccctaacgtaacgcccgccgcctaaaatttacccaaacgaaccttacttattatacaaacccttttccgcctacgatatacgtatacgccttaccctaacgcgacctctactaaactatcctacacgcccccgtttattttacttatatacgcaaacttacacgcaccacgcattttaatatactaccaaactta

SEQ ID NO: 22197 - DNA, 663 bp, Artificial Sequence
  chemically treated genomic DNA (Homo sapiens) CpG-island No: 22197
gtagttcgtcggcgcggtagtttagttatagtatcggtttttcgagtagttaggttatcgcggtcgtcgttcggttcgcggttttttttatttgtaatttcgcgtttttcgtcgttttagttttttgcgttttttttttttgttgttgtcgttttgcgggggatgtttggggcggtgtcggcgacggcggcgtttgtttttcggcggtaggagtcgggtattttttttcggcgtgtttcggaggcgtcgggttcgttatttttagttgtgtttttagatagggacggggtcgggcgcgcgcgcgggcgcgtttgggtgtgggtgtcgtcgagggcggggcgtcggtggcggtaggtttcggagcggggcgcgtatcgcggggtataggcggttgggggttttgtgacgttataggttacggagggggagtcgttcgggaaagtgggtgcggtcgagttcgcgtaggggcggggtcgggcgtcgggagttgggcggtgttttcggggggttttgggtttttggagggttttttcgggattcgaggaaaacgatttttttttttgtagcggcgggagagggcgaagtggaggattgttgttcggtttcgtatttaaaagagatttaaggttttaggtaaaatagattggatatttttattttttt

SEQ ID NO: 22198 - DNA, 663 bp, Artificial Sequence
  chemically treated genomic DNA (Homo sapiens) CpG-island No: 22198
aaaaaaataaaaatatccaatctattttacctaaaaccttaaatctcttttaaatacgaaaccgaacaacaatcctccacttcgccctctcccgccgctacaaaaaaaaaaatcgttttcctcgaatcccgaaaaaaccctccaaaaacccaaaaccccccgaaaacaccgcccaactcccgacgcccgaccccgcccctacgcgaactcgaccgcacccactttcccgaacgactccccctccgtaacctataacgtcacaaaacccccaaccgcctataccccgcgatacgcgccccgctccgaaacctaccgccaccgacgccccgccctcgacgacacccacacccaaacgcgcccgcgcgcgcgcccgaccccgtccctatctaaaaacacaactaaaaataacgaacccgacgcctccgaaacacgccgaaaaaaaatacccgactcctaccgccgaaaaacaaacgccgccgtcgccgacaccgccccaaacatcccccgcaaaacgacaacaacaaaaaaaaaaaacgcaaaaaactaaaacgacgaaaaacgcgaaattacaaataaaaaaaaccgcgaaccgaacgacgaccgcgataacctaactactcgaaaaaccgatactataactaaactaccgcgccgacgaactac

SEQ ID NO: 22199 - DNA, 663 bp, Artificial Sequence
  chemically treated genomic DNA (Homo sapiens) CpG-island No: 22199
gagaaagtgaaaatgtttaatttattttgtttggagttttgggttttttttggatacggaatcgagtagtagttttttatttcgttttttttcgtcgttgtaagggaaaaggtcgtttttttcgagtttcggagaggttttttaggaatttagagtttttcggggatatcgtttagttttcggcgttcggtttcgtttttgcgcgaattcggtcgtatttattttttcgggcggtttttttttcgtggtttgtggcgttataaggtttttagtcgtttgtgtttcgcggtgcgcgtttcgtttcgggatttgtcgttatcgacgtttcgttttcggcggtatttatatttaggcgcgttcgcgcgcgcgttcggtttcgtttttgtttggaagtatagttgaagatggcgagttcggcgttttcggagtacgtcgaggagggatgttcggtttttgtcgtcgaggagtaggcgtcgtcgtcgtcgatatcgttttaggtatttttcgtagagcggtagtagtaggaggaggaagcgtaggaagttggggcggcggagggcgcggggttgtaggtggaggaggtcgcgggtcgggcggcggtcgcggtaatttggttgttcggggagtcggtgttgtggttgggttgtcgcgtcgacgagttgt

SEQ ID NO: 22200 - DNA, 663 bp, Artificial Sequence
  chemically treated genomic DNA (Homo sapiens) CpG-island No: 22200
acaactcgtcgacgcgacaacccaaccacaacaccgactccccgaacaaccaaattaccgcgaccgccgcccgacccgcgacctcctccacctacaaccccgcgccctccgccgccccaacttcctacgcttcctcctcctactactaccgctctacgaaaaatacctaaaacgatatcgacgacgacgacgcctactcctcgacgacaaaaaccgaacatccctcctcgacgtactccgaaaacgccgaactcgccatcttcaactatacttccaaacaaaaacgaaaccgaacgcgcgcgcgaacgcgcctaaatataaataccgccgaaaacgaaacgtcgataacgacaaatcccgaaacgaaacgcgcaccgcgaaacacaaacgactaaaaaccttataacgccacaaaccacgaaaaaaaaaccgcccgaaaaaataaatacgaccgaattcgcgcaaaaacgaaaccgaacgccgaaaactaaacgatatccccgaaaaactctaaattcctaaaaaacctctccgaaactcgaaaaaaacgaccttttcccttacaacgacgaaaaaaaacgaaataaaaaactactactcgattccgtatccaaaaaaaacccaaaactccaaacaaaataaattaaacattttcactttctc

SEQ ID NO: 22201 - DNA, 601 bp, Artificial Sequence
  chemically treated genomic DNA (Homo sapiens) CpG-island No: 22201
gttagtcgttgtaggtgtggtgtggagtgcgcgtggtttgttgtgcggttgtttgttttttttcgttcggttcgttttttataggttggtgtagtgggtttcggttcggttcgtaggcgtagtggtgtgtttcgtggttggtggtgtggtcggttgggtcgttcggtttttcgcgagttgcgggtcgttgggttcgtttttgtgttttttttgtttcggtttcgtgtcgttattgtggttgtgagtgtattttgtcgtgatttttgtagatttttgttcgtttgtcgtcggttgttcgttttttgttttgtatgcgttttgtcgggttgtgcgtttttgtgtttgggttgttacgcggaatttgtattatagtttttttgttttttattttggtatgcggtcggtgttgatgcgtgtcgttggtgagtgtgtcgttggtgtgtttggttcgtcgttgtttggtcggtgtcgtgcgcgtggtatgtttgacgttgtcggttgtttcgtgtgttgttgggttgtcgttaggttggttgttgtgtttgggttggcgtgttttgtgttgtttttagtgtggtgtatgttgtttatgcgcgttttt

SEQ ID NO: 22202 - DNA, 601 bp, Artificial Sequence
  chemically treated genomic DNA (Homo sapiens) CpG-island No: 22202
aaaaacgcgcataaacaacatacaccacactaaaaacaacacaaaacacgccaacccaaacacaacaaccaacctaacgacaacccaacaacacacgaaacaaccgacaacgtcaaacataccacgcgcacgacaccgaccaaacaacgacgaaccaaacacaccaacgacacactcaccaacgacacgcatcaacaccgaccgcataccaaaataaaaaacaaaaaaactataatacaaattccgcgtaacaacccaaacacaaaaacgcacaacccgacaaaacgcatacaaaacaaaaaacgaacaaccgacgacaaacgaacaaaaatctacaaaaatcacgacaaaatacactcacaaccacaataacgacacgaaaccgaaacaaaaaaaacacaaaaacgaacccaacgacccgcaactcgcgaaaaaccgaacgacccaaccgaccacaccaccaaccacgaaacacaccactacgcctacgaaccgaaccgaaacccactacaccaacctataaaaaacgaaccgaacgaaaaaaaacaaacaaccgcacaacaaaccacgcgcactccacaccacacctacaacgactaac

SEQ ID NO: 22203 - DNA, 601 bp, Artificial Sequence
  chemically treated genomic DNA (Homo sapiens) CpG-island No: 22203
agagacgcgtatggataatatgtattatattagagatagtataaggtacgttagtttaaatataataattagtttagcgataatttagtagtatacgaagtaatcgatagcgttaaatatattacgcgtacgatatcgattagatagcggcgaattaagtatattagcgatatatttattagcgatacgtattaatatcgatcgtatgttaaaatggaggatagaagaattatggtataaatttcgcgtgataatttagatatagagacgtatagttcgataagacgtatataggataggagacggatagtcgacgataaacgaatagagatttatagaagttacgatagaatgtatttataattataatgacggtacgagatcgaggtagaagaggtataagaacgagtttagcgattcgtagttcgcggaaggtcgagcggtttagtcgattatattattaattacggagtatattattacgtttacgagtcgagtcgaggtttattatattagtttataggagacgagtcgagcgagaaaagataagtaatcgtatagtaagttacgcgtattttatattatatttgtaacgattgat

SEQ ID NO: 22204 - DNA, 601 bp, Artificial Sequence
  chemically treated genomic DNA (Homo sapiens) CpG-island No: 22204
atcaatcgttacaaatataatataaaatacgcgtaacttactatacgattacttatcttttctcgctcgactcgtctcctataaactaatataataaacctcgactcgactcgtaaacgtaataatatactccgtaattaataatataatcgactaaaccgctcgaccttccgcgaactacgaatcgctaaactcgttcttatacctcttctacctcgatctcgtaccgtcattataattataaatacattctatcgtaacttctataaatctctattcgtttatcgtcgactatccgtctcctatcctatatacgtcttatcgaactatacgtctctatatctaaattatcacgcgaaatttataccataattcttctatcctccattttaacatacgatcgatattaatacgtatcgctaataaatatatcgctaatatacttaattcgccgctatctaatcgatatcgtacgcgtaatatatttaacgctatcgattacttcgtatactactaaattatcgctaaactaattattatatttaaactaacgtaccttatactatctctaatataatacatattatccatacgcgtctct

SEQ ID NO: 22205 - DNA, 857 bp, Artificial Sequence
  chemically treated genomic DNA (Homo sapiens) CpG-island No: 22205
ttacggcgcgaaatatgaggagcgtcggtcgtgtgattatatgttcggtttatcgttatatgacgtcgggcgatacgggttatcgcgaggaagggttgagttagtatcgcgtatacgatagtcgtggatagttaattgtcgtgaaagatacgtagggttatgaaacgcggtatgaatataatatcgtcggtgatttgatcgtcgttattgtttcggacggtagtagaaacgggatatagtacgatgcgtggggaaaggtcgttcgtattacgtagggcgggttgacgcgtagtatggaatacgatgttgtcggacgggttattcgtttgattagtgaaaacggtagttatattatttttcgttacgatgtatttgatcggttgatataggaaatcggttttgacggtcgtatatagcgttattattacgaattgatcggtaaatttattcgaagcgaggatgagggtttggttatttattggttttatgacgaagtagatcgatttacgtatcgtatcgtgaagggtgaaatcggagagcggtggtagtatgacgaacgtggttggttgatagatattcgttatattcgcgatagggattacgtgtcggggtatataggtttgtagttatcggtcgttggacggtaaagtttttagaggatatatatcgaagtaattagtttcgttatcgttgatttaattcgaaaatcgtagggtcgaaattttgtaaatcgaagagagttacgggaacggtttacgagggttcgtagcgagaatcgatatatcgggttttatttttttttttattagattggttagtagaataataaaatcgtaagagataaaattcgacgataa

SEQ ID NO: 22206 - DNA, 857 bp, Artificial Sequence
  chemically treated genomic DNA (Homo sapiens) CpG-island No: 22206
ttatcgtcgaattttatctcttacgattttattattctactaaccaatctaataaaaaaaaaaataaaacccgatatatcgattctcgctacgaaccctcgtaaaccgttcccgtaactctcttcgatttacaaaatttcgaccctacgattttcgaattaaatcaacgataacgaaactaattacttcgatatatatcctctaaaaactttaccgtccaacgaccgataactacaaacctatataccccgacacgtaatccctatcgcgaatataacgaatatctatcaaccaaccacgttcgtcatactaccaccgctctccgatttcacccttcacgatacgatacgtaaatcgatctacttcgtcataaaaccaataaataaccaaaccctcatcctcgcttcgaataaatttaccgatcaattcgtaataataacgctatatacgaccgtcaaaaccgatttcctatatcaaccgatcaaatacatcgtaacgaaaaataatataactaccgttttcactaatcaaacgaataacccgtccgacaacatcgtattccatactacgcgtcaacccgccctacgtaatacgaacgacctttccccacgcatcgtactatatcccgtttctactaccgtccgaaacaataacgacgatcaaatcaccgacgatattatattcataccgcgtttcataaccctacgtatctttcacgacaattaactatccacgactatcgtatacgcgatactaactcaacccttcctcgcgataacccgtatcgcccgacgtcatataacgataaaccgaacatataatcacacgaccgacgctcctcatatttcgcgccgtaa

SEQ ID NO: 22207 - DNA, 857 bp, Artificial Sequence
  chemically treated genomic DNA (Homo sapiens) CpG-island No: 22207
ttatcgtcgggttttgttttttacggttttgttgttttgttggttaatttgataaagggggagatggggttcggtgtgtcgattttcgttgcgggttttcgtgggtcgttttcgtggtttttttcggtttatagggtttcggttttgcggttttcggattgggttagcggtggcggggttggttgtttcggtgtgtgttttttgggagttttgtcgtttagcggtcggtggttgtaggtttgtatgtttcggtacgtggtttttgtcgcggatatggcggatgtttgttagttagttacgttcgttatgttgttatcgtttttcggttttattttttacggtgcggtgcgtgagtcggtttgtttcgttatagggttagtgggtgattagatttttattttcgtttcggataagtttgtcggttagttcgtggtgataacgttgtgtgcggtcgttaaagtcggttttttgtattagtcggttaagtatatcgtaacggaaggtggtgtggttgtcgtttttattggttaggcggatgattcgttcggtagtatcgtattttatattgcgcgttagttcgttttgcgtggtacggacggtttttttttacgtatcgtattgtgtttcgtttttgttgtcgttcggggtaatgacggcggttaggttatcggcgatgttgtatttatatcgcgttttatggttttgcgtgttttttacggtaattaattgtttacggttgtcgtatgcgcggtattgatttagttttttttcgcggtgattcgtatcgttcgacgttatgtaacggtaaatcggatatgtggttatacgatcgacgttttttatgtttcgcgtcgtgg

SEQ ID NO: 22208 - DNA, 857 bp, Artificial Sequence
  chemically treated genomic DNA (Homo sapiens) CpG-island No: 22208
ccacgacgcgaaacataaaaaacgtcgatcgtataaccacatatccgatttaccgttacataacgtcgaacgatacgaatcaccgcgaaaaaaaactaaatcaataccgcgcatacgacaaccgtaaacaattaattaccgtaaaaaacacgcaaaaccataaaacgcgatataaatacaacatcgccgataacctaaccgccgtcattaccccgaacgacaacaaaaacgaaacacaatacgatacgtaaaaaaaaaccgtccgtaccacgcaaaacgaactaacgcgcaatataaaatacgatactaccgaacgaatcatccgcctaaccaataaaaacgacaaccacaccaccttccgttacgatatacttaaccgactaatacaaaaaaccgactttaacgaccgcacacaacgttatcaccacgaactaaccgacaaacttatccgaaacgaaaataaaaatctaatcacccactaaccctataacgaaacaaaccgactcacgcaccgcaccgtaaaaaataaaaccgaaaaacgataacaacataacgaacgtaactaactaacaaacatccgccatatccgcgacaaaaaccacgtaccgaaacatacaaacctacaaccaccgaccgctaaacgacaaaactcccaaaaaacacacaccgaaacaaccaaccccgccaccgctaacccaatccgaaaaccgcaaaaccgaaaccctataaaccgaaaaaaaccacgaaaacgacccacgaaaacccgcaacgaaaatcgacacaccgaaccccatctccccctttatcaaattaaccaacaaaacaacaaaaccgtaaaaaacaaaacccgacgataa

SEQ ID NO: 22209 - DNA, 628 bp, Artificial Sequence
  chemically treated genomic DNA (Homo sapiens) CpG-island No: 22209
  misc_feature (247)..(247): n is either a, c, g or t
cgtatttcggtcgttagcgggtaaaggtttgagcgtcgtagttttagtcgttggagttgattagttttttttttttttttaacgtgttacgtatcgcgttatcgaaagcgattagtcgttgtgggatgagtgtacgtagcgcggtattattcgttagtagatcgtgttttagtttttgaattaacgttttggcggtggtgggcggtacggaagtaattatattgagaaatttatattcgaaatttangcgggtggggagggggatggggattaattagcggcgtttatcgtttatcgttataaaatgtttaaatttgttgttgataattgagtatttttggttcggcggtttcgaagatgcggtgttcgttggtcggatgatttaatatacgtatattgttttacgtgtttttacgatttttagcgacgaatatagtcgtaggaagttgtcggaaatatagcggttcgcgttacggaagtcgagtatcgggttttttttatttggttcgtaacgtttattatcgattaggttggtatattcgttcgattttttattcgagagacggtttttttttttttttttatcgttattgttcgatttattatttcgtgttttttcgttcgtttt

SEQ ID NO: 22210 - DNA, 628 bp, Artificial Sequence
  chemically treated genomic DNA (Homo sapiens) CpG-island No: 22210
  misc_feature (382)..(382): n is either a, c, g or t
aaaacgaacgaaaaaacacgaaataataaatcgaacaataacgataaaaaaaaaaaaaaaaaccgtctctcgaataaaaaatcgaacgaatataccaacctaatcgataataaacgttacgaaccaaataaaaaaaacccgatactcgacttccgtaacgcgaaccgctatatttccgacaacttcctacgactatattcgtcgctaaaaatcgtaaaaacacgtaaaacaatatacgtatattaaatcatccgaccaacgaacaccgcatcttcgaaaccgccgaaccaaaaatactcaattatcaacaacaaatttaaacattttataacgataaacgataaacgccgctaattaatccccatccccctccccacccgcntaaatttcgaatataaatttctcaatataattacttccgtaccgcccaccaccgccaaaacgttaattcaaaaactaaaacacgatctactaacgaataataccgcgctacgtacactcatcccacaacgactaatcgctttcgataacgcgatacgtaacacgttaaaaaaaaaaaaaaaactaatcaactccaacgactaaaactacgacgctcaaacctttacccgctaacgaccgaaatacg

SEQ ID NO: 22211 - DNA, 628 bp, Artificial Sequence
  chemically treated genomic DNA (Homo sapiens) CpG-island No: 22211
  misc_feature (382)..(382): n is either a, c, g or t
aggacgagcggaggaatacgagataatgagtcgagtagtgacgatgagagagagagagagaatcgtttttcggatgagaaatcgaacgaatatgttaatttggtcggtggtgagcgttacgagttagatgaagagaattcgatgttcggttttcgtggcgcgggtcgttatgttttcgatagttttttgcgattgtgttcgtcgttggagatcgtgaaggtacgtgaaatagtgtgcgtatgttagattattcggttagcgaatatcgtattttcgaagtcgtcggattagaggtgtttagttattagtaataggtttgaatattttatggcggtgagcggtaagcgtcgttggttgatttttatttttttttttattcgtntggatttcgggtgtgggttttttaatgtgattattttcgtatcgtttattatcgttagggcgttgatttaggggttgaaatacgatttgttggcggatgatatcgcgttacgtgtatttattttataacggttgatcgttttcgatgacgcggtacgtagtacgttgaaagaggaggaaaaattggttaattttagcgattggggttacgacgtttaggtttttgttcgttggcgatcggagtacg

SEQ ID NO: 22212 - DNA, 628 bp, Artificial Sequence
  chemically treated genomic DNA (Homo sapiens) CpG-island No: 22212
  misc_feature (247)..(247): n is either a, c, g or t
cgtactccgatcgccaacgaacaaaaacctaaacgtcgtaaccccaatcgctaaaattaaccaatttttcctcctctttcaacgtactacgtaccgcgtcatcgaaaacgatcaaccgttataaaataaatacacgtaacgcgatatcatccgccaacaaatcgtatttcaacccctaaatcaacgccctaacgataataaacgatacgaaaataatcacattaaaaaacccacacccgaaatccanacgaataaaaaaaaaaataaaaatcaaccaacgacgcttaccgctcaccgccataaaatattcaaacctattactaataactaaacacctctaatccgacgacttcgaaaatacgatattcgctaaccgaataatctaacatacgcacactatttcacgtaccttcacgatctccaacgacgaacacaatcgcaaaaaactatcgaaaacataacgacccgcgccacgaaaaccgaacatcgaattctcttcatctaactcgtaacgctcaccaccgaccaaattaacatattcgttcgatttctcatccgaaaaacgattctctctctctctctcatcgtcactactcgactcattatctcgtattcctccgctcgtcct

SEQ ID NO: 22213 - DNA, 656 bp, Artificial Sequence
  chemically treated genomic DNA (Homo sapiens) CpG-island No: 22213
gcgaggtaacgcgtttcgttacgattagcgcggggtaggacgggtttgtagttttattaagcggttgcgtattttgtacgttgcggattcgtttcggatagttcgttggaatgtgtgagagtcgaatcggttattgtttattgcgtaaaaaacggggacgcggcggtttttttttggcggtattattgggaatgtttcgttggtgggatggtaagagcggtcgttgcgggtatgataggtagtagtggttttcggatgttcggaggtggatgtgggttgtcgcgttcgtacgattatcgacgtcgttgacgtggtgaacgtgcgcgtatatggcgaattcgagttgtggtttgcggtgagtaagtgttggtaattatcggtatgatcggttttggtttgtggttgttgttttttggttacggcggcgagaaagttagtatcgataacgtgtggcggtacggtggttttttcgttatcggttggaatgggttgattttgtcgttggcggtaattatgttttttttcggcggtttggagttgattgggattattgtcggtgaagcgcgcgattcggaaaaaagtattttaaaagcggtaaattaggtggtgtatcgtattttgttgttgtatatcggtttattggtggttttattggt

SEQ ID NO: 22214 - DNA, 656 bp, Artificial Sequence
  chemically treated genomic DNA (Homo sapiens) CpG-island No: 22214
accaataaaaccaccaataaaccgatatacaacaacaaaatacgatacaccacctaatttaccgcttttaaaatacttttttccgaatcgcgcgcttcaccgacaataatcccaatcaactccaaaccgccgaaaaaaaacataattaccgccaacgacaaaatcaacccattccaaccgataacgaaaaaaccaccgtaccgccacacgttatcgatactaactttctcgccgccgtaaccaaaaaacaacaaccacaaaccaaaaccgatcataccgataattaccaacacttactcaccgcaaaccacaactcgaattcgccatatacgcgcacgttcaccacgtcaacgacgtcgataatcgtacgaacgcgacaacccacatccacctccgaacatccgaaaaccactactacctatcatacccgcaacgaccgctcttaccatcccaccaacgaaacattcccaataataccgccaaaaaaaaaccgccgcgtccccgttttttacgcaataaacaataaccgattcgactctcacacattccaacgaactatccgaaacgaatccgcaacgtacaaaatacgcaaccgcttaataaaactacaaacccgtcctaccccgcgctaatcgtaacgaaacgcgttacctcgc

SEQ ID NO: 22215 - DNA, 656 bp, Artificial Sequence
  chemically treated genomic DNA (Homo sapiens) CpG-island No: 22215
gttagtaaaattattagtgaatcgatgtataatagtaggatgcgatatattatttgatttatcgtttttggaatgttttttttcggatcgcgcgttttatcggtagtaattttaattagttttagatcgtcgaaggagaatataattatcgttagcgataaaattagtttattttagtcggtggcgaagaaattatcgtatcgttatacgttgtcgatattggttttttcgtcgtcgtgattagaaaatagtagttataggttaaagtcgattatatcgatgattgttagtatttatttatcgtaaattataattcggattcgttatatacgcgtacgtttattacgttaacggcgtcgatgatcgtacgaacgcggtagtttatatttattttcgaatattcgggaattattattgtttattatgttcgtagcggtcgtttttgttattttattagcggaatatttttagtagtgtcgttaggaggaagtcgtcgcgttttcgttttttgcgtagtgggtaatgatcgattcggtttttatatattttagcgggttattcggagcggattcgtagcgtgtaaaatacgtaatcgtttgatggggttgtaaattcgttttgtttcgcgttaatcgtgacgaaacgcgttgtttcgt

SEQ ID NO: 22216 - DNA, 656 bp, Artificial Sequence
  chemically treated genomic DNA (Homo sapiens) CpG-island No: 22216
acgaaacaacgcgtttcgtcacgattaacgcgaaacaaaacgaatttacaaccccatcaaacgattacgtattttacacgctacgaatccgctccgaataacccgctaaaatatataaaaaccgaatcgatcattacccactacgcaaaaaacgaaaacgcgacgacttcctcctaacgacactactaaaaatattccgctaataaaataacaaaaacgaccgctacgaacataataaacaataataattcccgaatattcgaaaataaatataaactaccgcgttcgtacgatcatcgacgccgttaacgtaataaacgtacgcgtatataacgaatccgaattataatttacgataaataaatactaacaatcatcgatataatcgactttaacctataactactattttctaatcacgacgacgaaaaaaccaatatcgacaacgtataacgatacgataatttcttcgccaccgactaaaataaactaattttatcgctaacgataattatattctccttcgacgatctaaaactaattaaaattactaccgataaaacgcgcgatccgaaaaaaaacattccaaaaacgataaatcaaataatatatcgcatcctactattatacatcgattcactaataattttactaac

SEQ ID NO: 22217 - DNA, 626 bp, Artificial Sequence
  chemically treated genomic DNA (Homo sapiens) CpG-island No: 22217
agcgttcgggcgcggtgtttaatgtgttagttagcgttatcgtaatgttgtacggtttttcgtcggtcgaagtcgtcgcgttttatacgcgatattcgttataacggcgacgtgcgtgattcgcgtagtatacggaaatgatgtgttttacggaaaaatgtcgttagattcgtggttagcgaattgataaacgtttgttatttatcgttgggtagattaatagtagaaggtatataatgatcgaaattcgtagtttaagatcgtacgagaatagtcggtgaattacgttcgatagggcgtaaagattcggtttttaatattacgttattttaaatgtttgaaagtaggtcgtattgataaaaatatgtcgagaaatatttgttttagtcgatcggtcgtttttcgcgttagtcggaattcgtaaggtacgtaatttacgtatatacgtacgcgttggaaagattattataacgataatcggcgagtagcgcggttcggtaaaattttggaagaacggagtagtaggcgaaaggttagtatacggcgacgcgtagcgaagggcgatttagtaagagcgacgatacggatagacggattaaaggaaacgtgattcgcgttaggacgga

SEQ ID NO: 22218 - DNA, 626 bp, Artificial Sequence
  chemically treated genomic DNA (Homo sapiens) CpG-island No: 22218
tccgtcctaacgcgaatcacgtttcctttaatccgtctatccgtatcgtcgctcttactaaatcgcccttcgctacgcgtcgccgtatactaacctttcgcctactactccgttcttccaaaattttaccgaaccgcgctactcgccgattatcgttataataatctttccaacgcgtacgtatatacgtaaattacgtaccttacgaattccgactaacgcgaaaaacgaccgatcgactaaaacaaatatttctcgacatatttttatcaatacgacctactttcaaacatttaaaataacgtaatattaaaaaccgaatctttacgccctatcgaacgtaattcaccgactattctcgtacgatcttaaactacgaatttcgatcattatataccttctactattaatctacccaacgataaataacaaacgtttatcaattcgctaaccacgaatctaacgacatttttccgtaaaacacatcatttccgtatactacgcgaatcacgcacgtcgccgttataacgaatatcgcgtataaaacgcgacgacttcgaccgacgaaaaaccgtacaacattacgataacgctaactaacacattaaacaccgcgcccgaacgct

SEQ ID NO: 22219 - DNA, 626 bp, Artificial Sequence
  chemically treated genomic DNA (Homo sapiens) CpG-island No: 22219
ttcgttttggcgcgggttacgttttttttggttcgtttgttcgtgtcgtcgtttttgttggatcgtttttcgttgcgcgtcgtcgtgtgttggtttttcgtttgttgtttcgtttttttagggttttgtcgggtcgcgttgttcgtcggttgtcgttgtgatagtttttttagcgcgtgcgtgtgtgcgtgggttacgtgttttgcgggtttcgattggcgcggggggcggtcggtcggttgaggtaggtatttttcggtatgtttttgttagtgcggtttgtttttaggtatttggggtagcgtggtgttgggagtcgggtttttgcgttttatcgagcgtggtttatcggttgttttcgtgcggttttgggttgcgggtttcggttattgtgtgttttttgttgttagtttgtttagcggtgagtggtaggcgtttattaattcgttgattacgaatttgacggtattttttcgtgaggtatattattttcgtgtgttgcgcggattacgtacgtcgtcgttgtggcgagtatcgcgtatggagcgcggcggtttcgatcggcgaagagtcgtatagtattgcgatgacgttggttgatatattgggtatcgcgttcggacgtt

SEQ ID NO: 22220 - DNA, 626 bp, Artificial Sequence
  chemically treated genomic DNA (Homo sapiens) CpG-island No: 22220
aacgtccgaacgcgatacccaatatatcaaccaacgtcatcgcaatactatacgactcttcgccgatcgaaaccgccgcgctccatacgcgatactcgccacaacgacgacgtacgtaatccgcgcaacacacgaaaataatatacctcacgaaaaaataccgtcaaattcgtaatcaacgaattaataaacgcctaccactcaccgctaaacaaactaacaacaaaaaacacacaataaccgaaacccgcaacccaaaaccgcacgaaaacaaccgataaaccacgctcgataaaacgcaaaaacccgactcccaacaccacgctaccccaaatacctaaaaacaaaccgcactaacaaaaacataccgaaaaatacctacctcaaccgaccgaccgccccccgcgccaatcgaaacccgcaaaacacgtaacccacgcacacacgcacgcgctaaaaaaactatcacaacgacaaccgacgaacaacgcgacccgacaaaaccctaaaaaaacgaaacaacaaacgaaaaaccaacacacgacgacgcgcaacgaaaaacgatccaacaaaaacgacgacacgaacaaacgaaccaaaaaaaacgtaacccgcgccaaaacgaa

SEQ ID NO: 22221 - DNA, 949 bp, Artificial Sequence
  chemically treated genomic DNA (Homo sapiens) CpG-island No: 22221
cgtttatacgttcgggttgtcgttcgcgttaaaagtcgtgggcgtgtaggttcgggttgcgttttgtcgtcgtcgttatttcgcgcgcgttttttttcggcgtcggcgggttgttcgcggtgtcggttacgtttatcgttgtttatttagcgttagacgagtttacggtaatttcgatgatgtcgttgatcgcgtagtttgttaatcggttcgttcgttagcgttttcggcgatacgtggtcgaatttggcgttcgtcgattcgttcgagaagcgcgtatttggtattatgcgatttcgttttgttttacgatatatgttttagcgcggaggtgagttggtaggttttttttatgtcggtgtcggacggttcgtcgtcgatcgttattatgatatcgttttgtataattttttttcggttgatcgttttgatcgtttgcgttttcgagataaatattcgtattcggtcggtgtggtggtatacgttattttcgtttattatcgacgggtcgatcgtcgtggttttgattatcgaatttttcggcgttatgttgttcgtcgggaagtagatcgtttaggttagttttttcgtttgttgtttttttcggcggtaggattacgttattcggttttatttcgttttgttcgcgttatgtatttggcggaaggcgcgttcgtcgttcggagtttgttattatttaaggttttcgttttatcgttggtcgggtacggatattgcgtttagatttattaggttaagttttttcgtgtggttttgtttcggggtacggtcgtaagtaggggtttaggcggggatattcgggttgtggtgacgtgtttaagggcgataagcggagcgttataattatatttcgattatgtttttcgtgtgatgagataggagggtgaaaatgtatgggatttcgtagtatattatattgagagatgga

SEQ ID NO: 22222 - DNA, 949 bp, Artificial Sequence
  chemically treated genomic DNA (Homo sapiens) CpG-island No: 22222
tccatctctcaatataatatactacgaaatcccatacattttcaccctcctatctcatcacacgaaaaacataatcgaaatataattataacgctccgcttatcgcccttaaacacgtcaccacaacccgaatatccccgcctaaacccctacttacgaccgtaccccgaaacaaaaccacacgaaaaaacttaacctaataaatctaaacgcaatatccgtacccgaccaacgataaaacgaaaaccttaaataataacaaactccgaacgacgaacgcgccttccgccaaatacataacgcgaacaaaacgaaataaaaccgaataacgtaatcctaccgccgaaaaaaacaacaaacgaaaaaactaacctaaacgatctacttcccgacgaacaacataacgccgaaaaattcgataatcaaaaccacgacgatcgacccgtcgataataaacgaaaataacgtataccaccacaccgaccgaatacgaatatttatctcgaaaacgcaaacgatcaaaacgatcaaccgaaaaaaaattatacaaaacgatatcataataacgatcgacgacgaaccgtccgacaccgacataaaaaaaacctaccaactcacctccgcgctaaaacatatatcgtaaaacaaaacgaaatcgcataataccaaatacgcgcttctcgaacgaatcgacgaacgccaaattcgaccacgtatcgccgaaaacgctaacgaacgaaccgattaacaaactacgcgatcaacgacatcatcgaaattaccgtaaactcgtctaacgctaaataaacaacgataaacgtaaccgacaccgcgaacaacccgccgacgccgaaaaaaaacgcgcgcgaaataacgacgacgacaaaacgcaacccgaacctacacgcccacgacttttaacgcgaacgacaacccgaacgtataaacg

SEQ ID NO: 22223 - DNA, 949 bp, Artificial Sequence
  chemically treated genomic DNA (Homo sapiens) CpG-island No: 22223
tttattttttagtatgatgtgttgcggggttttatatatttttatttttttgttttattatacggggggtataatcggagtgtggttgtagcgtttcgtttatcgtttttggatacgttattatagttcggatattttcgtttgggtttttatttgcggtcgtgtttcgaagtaaagttatacgggggaatttggtttggtgaatttgagcgtaatgttcgtgttcggttaacggtggggcgagaattttgaatggtggtaggtttcgagcgacgggcgcgtttttcgttaggtgtatggcgcgagtaggacggggtagagtcggatgacgtgattttgtcgtcggagaaggtaataagcgaaagggttgatttggacggtttgtttttcgacgggtaatatagcgtcggaaggttcggtgattaaggttacggcgatcgattcgtcggtggtgggcgaagatggcgtatattattatatcggtcgggtgcgggtgtttgtttcggaagcgtaggcgattaaggcgattaatcgggaagagattgtgtagggcgatattatggtggcgatcggcggcgggtcgttcggtatcggtatggaagagatttattagtttattttcgcgttaaagtatatatcgtggggtaagacggagtcgtataatattagatgcgcgtttttcgggcgagtcgacgggcgttagattcggttacgtgtcgtcggaggcgttggcgggcgggtcgattggtaagttgcgcgattaacgatattatcgagattgtcgtggattcgtttgacgttaaatgggtagcgatgaacgtaatcggtatcgcggataattcgtcgacgtcggaagagggcgcgcgcgaggtggcggcggcggtagagcgtaattcggatttgtacgtttacgatttttagcgcggacgatagttcggacgtgtgggcg

SEQ ID NO: 22224 - DNA, 949 bp, Artificial Sequence
  chemically treated genomic DNA (Homo sapiens) CpG-island No: 22224
cgcccacacgtccgaactatcgtccgcgctaaaaatcgtaaacgtacaaatccgaattacgctctaccgccgccgccacctcgcgcgcgccctcttccgacgtcgacgaattatccgcgataccgattacgttcatcgctacccatttaacgtcaaacgaatccacgacaatctcgataatatcgttaatcgcgcaacttaccaatcgacccgcccgccaacgcctccgacgacacgtaaccgaatctaacgcccgtcgactcgcccgaaaaacgcgcatctaatattatacgactccgtcttaccccacgatatatactttaacgcgaaaataaactaataaatctcttccataccgataccgaacgacccgccgccgatcgccaccataatatcgccctacacaatctcttcccgattaatcgccttaatcgcctacgcttccgaaacaaacacccgcacccgaccgatataataatatacgccatcttcgcccaccaccgacgaatcgatcgccgtaaccttaatcaccgaaccttccgacgctatattacccgtcgaaaaacaaaccgtccaaatcaaccctttcgcttattaccttctccgacgacaaaatcacgtcatccgactctaccccgtcctactcgcgccatacacctaacgaaaaacgcgcccgtcgctcgaaacctaccaccattcaaaattctcgccccaccgttaaccgaacacgaacattacgctcaaattcaccaaaccaaattcccccgtataactttacttcgaaacacgaccgcaaataaaaacccaaacgaaaatatccgaactataataacgtatccaaaaacgataaacgaaacgctacaaccacactccgattataccccccgtataataaaacaaaaaaataaaaatatataaaaccccgcaacacatcatactaaaaaataaa

SEQ ID NO: 22225 - DNA, 518 bp, Artificial Sequence
  chemically treated genomic DNA (Homo sapiens) CpG-island No: 22225
gatatgggcggttcggtaaataaagtagcgtacgtattcggtgtgggtttgttgagtatttaaatttatggttcgatggcggcgattatggcggtaggtatggtgttatcgttggtaatgggtttggtaataatggtggcgcgtcgtaaattcgataaagcgtagtaggaaggtggtaaagtcgttttggtattgggattgtgttttatttcggaaggtgtaatttcgtttgttgttcgtgattcgatgcgtgtgttgtcgtgttgtatcgtgggtggggcgttgattggcgtaattttaatggcgattggtgcgaaattgatggtatcgtacggtggtttgtttgttttgttgatttttggcgttattacgtcggtattgggttatttggtagtaattattgtcggtacgttggtggcgggtttggtttatgtttttttgaaacgttcggaagtggacgtagtagcgaaagtagcgtaatataaggtgtgtttagggtagaaattttttgttttgta

SEQ ID NO: 22226 - DNA, 518 bp, Artificial Sequence
  chemically treated genomic DNA (Homo sapiens) CpG-island No: 22226
tacaaaacaaaaaatttctaccctaaacacaccttatattacgctactttcgctactacgtccacttccgaacgtttcaaaaaaacataaaccaaacccgccaccaacgtaccgacaataattactaccaaataacccaataccgacgtaataacgccaaaaatcaacaaaacaaacaaaccaccgtacgataccatcaatttcgcaccaatcgccattaaaattacgccaatcaacgccccacccacgatacaacacgacaacacacgcatcgaatcacgaacaacaaacgaaattacaccttccgaaataaaacacaatcccaataccaaaacgactttaccaccttcctactacgctttatcgaatttacgacgcgccaccattattaccaaacccattaccaacgataacaccatacctaccgccataatcgccgccatcgaaccataaatttaaatactcaacaaacccacaccgaatacgtacgctactttatttaccgaaccgcccatatc

SEQ ID NO: 22227 - DNA, 518 bp, Artificial Sequence
  chemically treated genomic DNA (Homo sapiens) CpG-island No: 22227
tataggataggaaatttttgttttgaatatattttgtattacgttgttttcgttattgcgtttattttcggacgttttaggaaggtataggttaaattcgttattagcgtatcggtaataattgttattaggtaatttaatatcggcgtaatagcgttagggattagtagaataaatagattatcgtgcggtgttattagtttcgtattaatcgttattgagattgcgttagttagcgttttatttacgatatagtacggtagtatacgtatcggattacgagtagtaaacggaattgtatttttcgaaatgaagtatagttttaatattagagcggttttgttatttttttgttgcgttttgtcgaatttgcgacgcgttattattgttgttagatttattgttagcggtggtattatatttgtcgttataatcgtcgttatcgggttataggtttgagtatttagtagatttatatcgaatgcgtacgttgttttgtttatcggatcgtttatgtt

SEQ ID NO: 22228 - DNA, 518 bp, Artificial Sequence
  chemically treated genomic DNA (Homo sapiens) CpG-island No: 22228
aacataaacgatccgataaacaaaacaacgtacgcattcgatataaatctactaaatactcaaacctataacccgataacgacgattataacgacaaatataataccaccgctaacaataaatctaacaacaataataacgcgtcgcaaattcgacaaaacgcaacaaaaaaataacaaaaccgctctaatattaaaactatacttcatttcgaaaaatacaattccgtttactactcgtaatccgatacgtatactaccgtactatatcgtaaataaaacgctaactaacgcaatctcaataacgattaatacgaaactaataacaccgcacgataatctatttattctactaatccctaacgctattacgccgatattaaattacctaataacaattattaccgatacgctaataacgaatttaacctataccttcctaaaacgtccgaaaataaacgcaataacgaaaacaacgtaatacaaaatatattcaaaacaaaaatttcctatcctata

SEQ ID NO: 22229 - DNA, 635 bp, Artificial Sequence
  chemically treated genomic DNA (Homo sapiens) CpG-island No: 22229
tagtcgtttaacggtacggttttatcgtcgtttttgtagtttttgacgaagacggaatcggtttttaggcgttcggtttatgcggtgcgcgcgggagaggtcgcgcgtttatatcgtcgcgttaaggtcgtattggttgtcgttggtaagttgtagcgtttgtttttttgatgtgaaacgcgtgattattagtatcggatcgaaaattttttcgcgatttaaggacgtattcgggtttatatttataaagatggtcgggtcgatggcggtagttagttcggcgttacggttatttaataatagttgttttttgttttcgttttttcgaattaaagttattgaatcgagtcggcgttggcgtcgtcgattaaggtgttttggtgggtgtcgatttagtggattgttcggttggtcgtttggttttgcgtgtttatcgcgttaaattatcgggaggtttttttcgaaggggtttcgggatgtattttttttttttaaagtcgggggggcgtgcgattatagggttttaaaagttttttgcggttcgagtagtttgtggtcgtaatatatatcgtgggtagaggatttataaacggggagggatattatacggttttttcggttttttttttttttgt

SEQ ID NO: 22230 - DNA, 635 bp, Artificial Sequence
  chemically treated genomic DNA (Homo sapiens) CpG-island No: 22230
acaaaaaaaaaaaaaaccgaaaaaaccgtataatatccctccccgtttataaatcctctacccacgatatatattacgaccacaaactactcgaaccgcaaaaaacttttaaaaccctataatcgcacgcccccccgactttaaaaaaaaaaaatacatcccgaaaccccttcgaaaaaaacctcccgataatttaacgcgataaacacgcaaaaccaaacgaccaaccgaacaatccactaaatcgacacccaccaaaacaccttaatcgacgacgccaacgccgactcgattcaataactttaattcgaaaaaacgaaaacaaaaaacaactattattaaataaccgtaacgccgaactaactaccgccatcgacccgaccatctttataaatataaacccgaatacgtccttaaatcgcgaaaaaattttcgatccgatactaataatcacgcgtttcacatcaaaaaaacaaacgctacaacttaccaacgacaaccaatacgaccttaacgcgacgatataaacgcgcgacctctcccgcgcgcaccgcataaaccgaacgcctaaaaaccgattccgtcttcgtcaaaaactacaaaaacgacgataaaaccgtaccgttaaacgacta

SEQ ID NO: 22231 - DNA, 635 bp, Artificial Sequence
  chemically treated genomic DNA (Homo sapiens) CpG-island No: 22231
gtaggggggagaagagtcgggaagatcgtgtggtattttttttcgtttataagttttttatttacggtgtatattgcggttataagttgttcgagtcgtaaaagatttttagggttttgtaatcgtacgttttttcggttttaaagagggaaggtgtatttcgaagttttttcggagagagtttttcggtaatttagcgcggtgaatacgtagggttaaacggttagtcgggtaatttattggatcggtatttattagggtattttaatcgacggcgttaacgtcgattcggtttaatagttttaattcgggaaggcgaaagtaaagggtaattgttgttggatggtcgtaacgtcgggttggttgtcgttatcggttcgattatttttgtggatgtggattcgaatgcgtttttaagtcgcgaagagattttcggttcggtgttggtggttacgcgttttatattagaagaataggcgttatagtttgttaacgatagttagtacggttttggcgcggcggtatggacgcgcgatttttttcgcgcgtatcgtatgagtcggacgtttgaaagtcggtttcgttttcgttaaaaattataaggacggcgataggatcgtgtcgttgggcggtta

SEQ ID NO: 22232 - DNA, 635 bp, Artificial Sequence
  chemically treated genomic DNA (Homo sapiens) CpG-island No: 22232
taaccgcccaacgacacgatcctatcgccgtccttataatttttaacgaaaacgaaaccgactttcaaacgtccgactcatacgatacgcgcgaaaaaaatcgcgcgtccataccgccgcgccaaaaccgtactaactatcgttaacaaactataacgcctattcttctaatataaaacgcgtaaccaccaacaccgaaccgaaaatctcttcgcgacttaaaaacgcattcgaatccacatccacaaaaataatcgaaccgataacgacaaccaacccgacgttacgaccatccaacaacaattaccctttactttcgccttcccgaattaaaactattaaaccgaatcgacgttaacgccgtcgattaaaataccctaataaataccgatccaataaattacccgactaaccgtttaaccctacgtattcaccgcgctaaattaccgaaaaactctctccgaaaaaacttcgaaatacaccttccctctttaaaaccgaaaaaacgtacgattacaaaaccctaaaaatcttttacgactcgaacaacttataaccgcaatatacaccgtaaataaaaaacttataaacgaaaaaaaataccacacgatcttcccgactcttctcccccctac

SEQ ID NO: 22233 - DNA, 904 bp, Artificial Sequence
  chemically treated genomic DNA (Homo sapiens) CpG-island No: 22233
ttttaattagttaattcgtatttatatatattttatatttttattattaatatttatagtttttttttcgcggtatttcgatttttatattattattattattttatcggcgcgttttcgtatttttttatttaatatacgtagtcgttattatcgattaataaaagtaattacgaatagtatcgacggttatttattttatttttagtagtttaataagtatatatatattatacgatcgaaaataataacgttataatataattaacgatatatacgtttttagatatatattaaaattttattacgcgatttaggaagagtataagaacgatatcgagataagatagattcgaattatatttcgtataataatacgcgagtcgagtaaagattaatacgagtaggattatacgaaatagtatataatatacgtatatattttaatacgattaaagttatattatataaaataagattataataaattatatttaaatacgcgagttatatattatcgcgcgaagttagaagtagtcgataataagtaagtatattataatatcgaagaacgtcgtatattaatatattcgagttaaaagcgaacgtatcgtagataacgttacgacgataatttcgagttatatacgttagttatagaaataatatacgtataataaaatcggaagtttaagataataacgtatgtaagcgtatcgatcgtaataataaatatatacggaagtatgtacgacgagtaatacgcgatatatttagtagatatttaaattatagtatcgaagtcgatacgagataatatttatcgttaatataatagtaacgaatatattaaatattagagcgacgaaaattatattatatacgaataaaacgtacgaattat

SEQ ID NO: 22234 - DNA, 904 bp, Artificial Sequence
  chemically treated genomic DNA (Homo sapiens) CpG-island No: 22234
ataattcgtacgttttattcgtatataatataattttcgtcgctctaatatttaatatattcgttactattatattaacgataaatattatctcgtatcgacttcgatactataatttaaatatctactaaatatatcgcgtattactcgtcgtacatacttccgtatatatttattattacgatcgatacgcttacatacgttattatcttaaacttccgattttattatacgtatattatttctataactaacgtatataactcgaaattatcgtcgtaacgttatctacgatacgttcgcttttaactcgaatatattaatatacgacgttcttcgatattataatatacttacttattatcgactacttctaacttcgcgcgataatatataactcgcgtatttaaatataatttattataatcttattttatataatataactttaatcgtattaaaatatatacgtatattatatactatttcgtataatcctactcgtattaatctttactcgactcgcgtattattatacgaaatataattcgaatctatcttatctcgatatcgttcttatactcttcctaaatcgcgtaataaaattttaatatatatctaaaaacgtatatatcgttaattatattataacgttattattttcgatcgtataatatatatatacttattaaactactaaaaataaaataaataaccgtcgatactattcgtaattacttttattaatcgataataacgactacgtatattaaataaaaaaatacgaaaacgcgccgataaaataataataataatataaaaatcgaaataccgcgaaaaaaaaactataaatattaataataaaaatataaaatatatataaatacgaattaactaattaaaa

SEQ ID NO: 22235 - DNA, 904 bp, Artificial Sequence
  chemically treated genomic DNA (Homo sapiens) CpG-island No: 22235
gtggttcgtgcgttttattcgtgtgtggtatggttttcgtcgttttggtgtttggtgtgttcgttgttgttgtgttggcggtgagtgttgtttcgtgtcggtttcggtgttgtggtttgggtgtttgttgagtgtgtcgcgtgttgttcgtcgtgtatgttttcgtgtgtgtttgttgttgcggtcggtgcgtttgtatgcgttgttgttttgggttttcggttttgttgtgcgtgtgttgtttttgtggttggcgtgtgtggttcggggttgtcgtcgtgacgttgtttgcggtgcgttcgtttttgattcgagtgtgttggtgtgcggcgtttttcggtgttgtggtgtgtttgtttgttgtcggttgtttttggtttcgcgcgatggtgtgtggttcgcgtgtttgggtgtggtttgttgtggttttgttttgtgtgatgtggttttagtcgtgttggggtgtgtgcgtgtgttgtgtgttgtttcgtgtggttttgttcgtgttggtttttgttcggttcgcgtgttgttgtgcggggtgtggttcgggtttgttttgtttcggtgtcgtttttgtgttttttttgggtcgcgtggtggggttttggtgtgtgtttgagggcgtgtgtgtcgttggttgtgttgtggcgttgttgttttcggtcgtgtggtgtgtgtgtgtttgttgggttgttgggggtggggtgggtggtcgtcggtgttgttcgtggttgtttttgttggtcggtggtggcggttgcgtgtgttgggtgggggggtgcgggggcgcgtcggtggggtggtggtggtggtgtgggggtcggggtgtcgcggggggggggttgtgggtgttggtggtgggggtgtggggtgtgtgtgggtgcgggttggttggttgggg

SEQ ID NO: 22236 - DNA, 904 bp, Artificial Sequence
  chemically treated genomic DNA (Homo sapiens) CpG-island No: 22236
ccccaaccaaccaacccgcacccacacacaccccacacccccaccaccaacacccacaaccccccccccgcgacaccccgacccccacaccaccaccaccaccccaccgacgcgcccccgcacccccccacccaacacacgcaaccgccaccaccgaccaacaaaaacaaccacgaacaacaccgacgaccacccaccccacccccaacaacccaacaaacacacacacaccacacgaccgaaaacaacaacgccacaacacaaccaacgacacacacgccctcaaacacacaccaaaaccccaccacgcgacccaaaaaaaacacaaaaacgacaccgaaacaaaacaaacccgaaccacaccccgcacaacaacacgcgaaccgaacaaaaaccaacacgaacaaaaccacacgaaacaacacacaacacacgcacacaccccaacacgactaaaaccacatcacacaaaacaaaaccacaacaaaccacacccaaacacgcgaaccacacaccatcgcgcgaaaccaaaaacaaccgacaacaaacaaacacaccacaacaccgaaaaacgccgcacaccaacacactcgaatcaaaaacgaacgcaccgcaaacaacgtcacgacgacaaccccgaaccacacacgccaaccacaaaaacaacacacgcacaacaaaaccgaaaacccaaaacaacaacgcatacaaacgcaccgaccgcaacaacaaacacacacgaaaacatacacgacgaacaacacgcgacacactcaacaaacacccaaaccacaacaccgaaaccgacacgaaacaacactcaccgccaacacaacaacaacgaacacaccaaacaccaaaacgacgaaaaccataccacacacgaataaaacgcacgaaccac

SEQ ID NO: 22237 - DNA, 515 bp, Artificial Sequence
  chemically treated genomic DNA (Homo sapiens) CpG-island No: 22237
  misc_feature (114)..(114): n is either a, c, g or t
  misc_feature (174)..(174): n is either a, c, g or t
  misc_feature (331)..(331): n is either a, c, g or t
ttgtcggtgtgtggattcgtttattagtatgttgtcgtagcgcgtagtttagcgataattggtcgatcgatatttggggttagtaacgattatcggtgtcggtggttttataanaattagttgcgtttagtattgtgtgtgtatatagattttagtgagtttagtttttaggtncggatattttagttatattcgattcgttttgaagcgtaggtagatatatatttacgcgttttttttgtcgacgttgagtttatagagattcggtggatattgagtatcgatatcgtttaagtgcgttggggttttaagttgtgaaattacgtcgttntttataattttgatatcgacgggtttcgttcgagtttagagatttttggtgattatttggggtcggggataatgttgagataagtttatttcggtaaattggtcgtgcgtttggatttatttttatttatttcggtttaataaattcgttcgatttttcgtgtgcgtggattcggtgttttata

SEQ ID NO: 22238 - DNA, 515 bp, Artificial Sequence
  chemically treated genomic DNA (Homo sapiens) CpG-island No: 22238
  misc_feature (185)..(185): n is either a, c, g or t
  misc_feature (342)..(342): n is either a, c, g or t
  misc_feature (402)..(402): n is either a, c, g or t
tataaaacaccgaatccacgcacacgaaaaatcgaacgaatttattaaaccgaaataaataaaaataaatccaaacgcacgaccaatttaccgaaataaacttatctcaacattatccccgaccccaaataatcaccaaaaatctctaaactcgaacgaaacccgtcgatatcaaaattataaanaacgacgtaatttcacaacttaaaaccccaacgcacttaaacgatatcgatactcaatatccaccgaatctctataaactcaacgtcgacaaaaaaaacgcgtaaatatatatctacctacgcttcaaaacgaatcgaatataactaaaatatccgnacctaaaaactaaactcactaaaatctatatacacacacaatactaaacgcaactaattnttataaaaccaccgacaccgataatcgttactaaccccaaatatcgatcgaccaattatcgctaaactacgcgctacgacaacatactaataaacgaatccacacaccgacaa

SEQ ID NO: 22239 - DNA, 515 bp, Artificial Sequence
  chemically treated genomic DNA (Homo sapiens) CpG-island No: 22239
  misc_feature (185)..(185): n is either a, c, g or t
  misc_feature (342)..(342): n is either a, c, g or t
  misc_feature (402)..(402): n is either a, c, g or t
tataaggtatcgggtttacgtatacggaagatcgaacgggtttattaagtcgaaatgaatggagataaatttaggcgtacggttaatttgtcgaggtgggtttgttttaatattgttttcgattttaaatggttattaggagtttttgggttcgggcgagattcgtcggtgttagagttataagnggcggcgtgattttatagtttggggttttagcgtatttgggcgatgtcgatatttagtgtttatcgggtttttatggatttagcgtcggtaaagagggcgcgtgagtatgtgtttgtttgcgttttagagcgggtcggatgtgattagggtgttcgngtttaagaattgggtttattgggatttatgtgtatatataatgttaaacgtaattggttnttatgaaattatcggtatcggtgatcgttgttagttttagatgtcggtcggttaattgtcgttagattacgcgttgcggtagtatattaatgagcgagtttatatatcggtag

SEQ ID NO: 22240 - DNA, 515 bp, Artificial Sequence
  chemically treated genomic DNA (Homo sapiens) CpG-island No: 22240
  misc_feature (114)..(114): n is either a, c, g or t
  misc_feature (174)..(174): n is either a, c, g or t
  misc_feature (331)..(331): n is either a, c, g or t
ctaccgatatataaactcgctcattaatatactaccgcaacgcgtaatctaacgacaattaaccgaccgacatctaaaactaacaacgatcaccgataccgataatttcataanaaccaattacgtttaacattatatatacacataaatcccaataaacccaattcttaaacncgaacaccctaatcacatccgacccgctctaaaacgcaaacaaacacatactcacgcgccctctttaccgacgctaaatccataaaaacccgataaacactaaatatcgacatcgcccaaatacgctaaaaccccaaactataaaatcacgccgccncttataactctaacaccgacgaatctcgcccgaacccaaaaactcctaataaccatttaaaatcgaaaacaatattaaaacaaacccacctcgacaaattaaccgtacgcctaaatttatctccattcatttcgacttaataaacccgttcgatcttccgtatacgtaaacccgataccttata

SEQ ID NO: 22241 - DNA, 942 bp, Artificial Sequence
  chemically treated genomic DNA (Homo sapiens) CpG-island No: 22241
tttatcggcgatgtttttttttagtaataggcgcgtttcggcgatgtatatttgtttttggttgtagaaaatgtttgttgcggtggcgtttgtcgtttgttgtaaattcgggtagttagcgaagaacgagtgttggacgtattttgcgcgttcgatttttagttagacgcgttttatgttgcgtgtcgatttagtagttttatttaagataagtttggtttttcggtacgggttgaatcggtaataggtaattgcggcgattaggaagtaagttcgggtttaattggaacgtagatagcgtttgttcggttttatgattaaaattcggttattaacggtgttaagcgacgaacgcgaggtttcgggagtaaggtcgggtttttttcgttagtttcgcgagacgaatcgtattgagcggtgattttttagacggttttagaattacgttgtttttcgtcgttagcgtcgggtcgagtttttagtaagttagtaatagcgggaagttttacggtacgatggcggtaattacgtcgatcggtttacgtacgattatcgttagtttatggttattggtggtcgttatttcgttatatattttgtcgatcgtttcggcgtattagcgaatggcgcgcgtcgcgtcgggaatattattacgtagattgtgacgaatcggtttgtcggtgtcgagagtttttagtagtgttagtttttcggcgtgggtttttattaaatcggcgagtttatttagtatcgttttacgtttagtcggagaagagagtgattagtcgtcgcgtttaaatacgtcgcgtgttgcgtttatcgtacggtcgatatcgacgtttttgtcgcgggtaattttcgttagcggtgtttgggtgatcggattaacggttttaaaggttttatttttcgtcgtagtagtatatttatcgttaataaata

SEQ ID NO: 22242 - DNA, 942 bp, Artificial Sequence
  chemically treated genomic DNA (Homo sapiens) CpG-island No: 22242
tatttattaacgataaatatactactacgacgaaaaataaaacctttaaaaccgttaatccgatcacccaaacaccgctaacgaaaattacccgcgacaaaaacgtcgatatcgaccgtacgataaacgcaacacgcgacgtatttaaacgcgacgactaatcactctcttctccgactaaacgtaaaacgatactaaataaactcgccgatttaataaaaacccacgccgaaaaactaacactactaaaaactctcgacaccgacaaaccgattcgtcacaatctacgtaataatattcccgacgcgacgcgcgccattcgctaatacgccgaaacgatcgacaaaatatataacgaaataacgaccaccaataaccataaactaacgataatcgtacgtaaaccgatcgacgtaattaccgccatcgtaccgtaaaacttcccgctattactaacttactaaaaactcgacccgacgctaacgacgaaaaacaacgtaattctaaaaccgtctaaaaaatcaccgctcaatacgattcgtctcgcgaaactaacgaaaaaaacccgaccttactcccgaaacctcgcgttcgtcgcttaacaccgttaataaccgaattttaatcataaaaccgaacaaacgctatctacgttccaattaaacccgaacttacttcctaatcgccgcaattacctattaccgattcaacccgtaccgaaaaaccaaacttatcttaaataaaactactaaatcgacacgcaacataaaacgcgtctaactaaaaatcgaacgcgcaaaatacgtccaacactcgttcttcgctaactacccgaatttacaacaaacgacaaacgccaccgcaacaaacattttctacaaccaaaaacaaatatacatcgccgaaacgcgcctattactaaaaaaaaacatcgccgataaa

SEQ ID NO: 22243 - DNA, 942 bp, Artificial Sequence
  chemically treated genomic DNA (Homo sapiens) CpG-island No: 22243
tatttattaacggtgaatatattgttgcggcggaaaatgaaatttttgaaatcgttgattcggttatttaggtatcgttggcgaaaattgttcgcggtaagagcgtcgatatcgatcgtgcgatgagcgtagtacgcggcgtatttgaacgcggcgattggttattttttttttcggttaaacgtaaagcggtattgaataaattcgtcgatttaatggaagtttacgtcgaagagttggtattgttggaaattttcgatatcggtaaatcgattcgttatagtttgcgtgatgatattttcggcgcggcgcgcgttattcgttggtacgtcgaagcgatcgataaagtgtatggcgaagtggcgattattagtagttatgagttggcgatgatcgtgcgtgaatcggtcggcgtgattgtcgttatcgtgtcgtggaatttttcgttgttgttgatttgttggaaattcggttcggcgttggcggcgggaaatagcgtgattttaaaatcgtttgaaaaattatcgtttagtgcgattcgtttcgcggggttggcgaaagaagttcggttttgttttcgggatttcgcgttcgtcgtttgatatcgttggtgatcgggttttggttatgaagtcgggtaggcgttgtttgcgttttagttagattcgaatttattttttgatcgtcgtagttgtttgttatcggtttaattcgtatcgggaaattaggtttgttttgaataggattgttgggtcgatacgtaatatgaaacgcgtttggttggaagtcgggcgcgtaaaatgcgtttaatattcgtttttcgttgattgttcggatttgtaataggcggtaagcgttatcgtagtaggtattttttataattagggataggtgtgtatcgtcggaacgcgtttgttgttggaagagagtatcgtcgatgaa

SEQ ID NO: 22244 - DNA, 942 bp, Artificial Sequence
  chemically treated genomic DNA (Homo sapiens) CpG-island No: 22244
ttcatcgacgatactctcttccaacaacaaacgcgttccgacgatacacacctatccctaattataaaaaatacctactacgataacgcttaccgcctattacaaatccgaacaatcaacgaaaaacgaatattaaacgcattttacgcgcccgacttccaaccaaacgcgtttcatattacgtatcgacccaacaatcctattcaaaacaaacctaatttcccgatacgaattaaaccgataacaaacaactacgacgatcaaaaaataaattcgaatctaactaaaacgcaaacaacgcctacccgacttcataaccaaaacccgatcaccaacgatatcaaacgacgaacgcgaaatcccgaaaacaaaaccgaacttctttcgccaaccccgcgaaacgaatcgcactaaacgataatttttcaaacgattttaaaatcacgctatttcccgccgccaacgccgaaccgaatttccaacaaatcaacaacaacgaaaaattccacgacacgataacgacaatcacgccgaccgattcacgcacgatcatcgccaactcataactactaataatcgccacttcgccatacactttatcgatcgcttcgacgtaccaacgaataacgcgcgccgcgccgaaaatatcatcacgcaaactataacgaatcgatttaccgatatcgaaaatttccaacaataccaactcttcgacgtaaacttccattaaatcgacgaatttattcaataccgctttacgtttaaccgaaaaaaaaaataaccaatcgccgcgttcaaatacgccgcgtactacgctcatcgcacgatcgatatcgacgctcttaccgcgaacaattttcgccaacgatacctaaataaccgaatcaacgatttcaaaaatttcattttccgccgcaacaatatattcaccgttaataaata

SEQ ID NO: 22245 - DNA, 822 bp, Artificial Sequence
  chemically treated genomic DNA (Homo sapiens) CpG-island No: 22245
tagcgcggttattagcggttggttgtggattatcgtattgttcgttaattcgtcgaggcgttggtagaaggtcgtagtaaagcgtaggttaatagtcgaaaggggtgaaaaaaattgtttttgttcgtaagttgcgtgagtcgaaaatggcgttgcggcggataaagtttttgtcgattaatttcgtaaaggcgaatcgtattggtagaagttggcgatattattttttgcgatggtgaagttatgaagggggtgtatcggtcgatgaaagcgttattatcggggaatcggtacggtgattcgtgaattcggcggcgattttgttttcgttatcggcggtatcgtattttttttgattggttggtgattgagtgtagcgttaatttcggcggatatttttggatcggatgatcgcgatggtggaaggcgtatagcgacgtaaacgtcgaacgaaattgttttgattattttgttgattgttttgattatgtttttttattggtaatcgttacgttgtggtcgtttttcgcgtggggcgtaatgtagttagcgtaacggtattggtggcgttgttggtttgtttgatttaattattattggcggtttgttgttagcgatcggcgtcgtcgggatgagcggatgttaagcgcgaatgtgattgttattagcggacgtgtagttgaagggtaggtgacgttgacgttttgtaacgtattgcgtattggcgtggagaaatgtcgtatggttggttgttattacggatgttaatgttaaaatattgttgggattgcgttttagagtttgcggaattcggtatttttt

SEQ ID NO: 22246 - DNA, 822 bp, Artificial Sequence
  chemically treated genomic DNA (Homo sapiens) CpG-island No: 22246
aaaaaataccgaattccgcaaactctaaaacgcaatcccaacaatattttaacattaacatccgtaataacaaccaaccatacgacatttctccacgccaatacgcaatacgttacaaaacgtcaacgtcacctacccttcaactacacgtccgctaataacaatcacattcgcgcttaacatccgctcatcccgacgacgccgatcgctaacaacaaaccgccaataataattaaatcaaacaaaccaacaacgccaccaataccgttacgctaactacattacgccccacgcgaaaaacgaccacaacgtaacgattaccaataaaaaaacataatcaaaacaatcaacaaaataatcaaaacaatttcgttcgacgtttacgtcgctatacgccttccaccatcgcgatcatccgatccaaaaatatccgccgaaattaacgctacactcaatcaccaaccaatcaaaaaaaatacgataccgccgataacgaaaacaaaatcgccgccgaattcacgaatcaccgtaccgattccccgataataacgctttcatcgaccgatacacccccttcataacttcaccatcgcaaaaaataatatcgccaacttctaccaatacgattcgcctttacgaaattaatcgacaaaaactttatccgccgcaacgccattttcgactcacgcaacttacgaacaaaaacaatttttttcacccctttcgactattaacctacgctttactacgaccttctaccaacgcctcgacgaattaacgaacaatacgataatccacaaccaaccgctaataaccgcgcta

SEQ ID NO: 22247 - DNA, 822 bp, Artificial Sequence
  chemically treated genomic DNA (Homo sapiens) CpG-island No: 22247
gaagaatatcgagtttcgtaaattttaaaacgtaattttaatagtgttttgatattagtattcgtggtggtagttagttatgcggtatttttttacgttagtgcgtaatacgttgtagaacgttaacgttatttgttttttaattgtacgttcgttggtggtaattatattcgcgtttagtattcgtttatttcggcgacgtcgatcgttgataataggtcgttaatagtggttggattagatagattagtagcgttattagtatcgttacgttgattgtattacgttttacgcggaaaacggttatagcgtggcggttgttagtaaaaagatatagttagggtaattagtagaatggttagggtaatttcgttcggcgtttgcgtcgttgtgcgttttttattatcgcgattattcgatttagaaatgttcgtcggggttaacgttatatttaattattagttagttagaaagaatacggtgtcgtcggtgacggaggtaaaatcgtcgtcggatttacggattatcgtgtcgatttttcggtgatggcgtttttatcgatcgatgtattttttttataattttattatcgtaggggataatatcgttagtttttattagtacgattcgtttttacgaagttggtcggtaggaattttgttcgtcgtagcgttattttcggtttacgtagtttgcgggtaaaggtagttttttttatttttttcgattgttggtttgcgttttattgcggttttttgttagcgtttcggcgaattagcgaatagtacggtgatttatagttaatcgttaatggtcgcgtta

SEQ ID NO: 22248 - DNA, 822 bp, Artificial Sequence
  chemically treated genomic DNA (Homo sapiens) CpG-island No: 22248
taacgcgaccattaacgattaactataaatcaccgtactattcgctaattcgccgaaacgctaacaaaaaaccgcaataaaacgcaaaccaacaatcgaaaaaaataaaaaaaactacctttacccgcaaactacgtaaaccgaaaataacgctacgacgaacaaaattcctaccgaccaacttcgtaaaaacgaatcgtactaataaaaactaacgatattatcccctacgataataaaattataaaaaaaatacatcgatcgataaaaacgccatcaccgaaaaatcgacacgataatccgtaaatccgacgacgattttacctccgtcaccgacgacaccgtattctttctaactaactaataattaaatataacgttaaccccgacgaacatttctaaatcgaataatcgcgataataaaaaacgcacaacgacgcaaacgccgaacgaaattaccctaaccattctactaattaccctaactatatctttttactaacaaccgccacgctataaccgttttccgcgtaaaacgtaatacaatcaacgtaacgatactaataacgctactaatctatctaatccaaccactattaacgacctattatcaacgatcgacgtcgccgaaataaacgaatactaaacgcgaatataattaccaccaacgaacgtacaattaaaaaacaaataacgttaacgttctacaacgtattacgcactaacgtaaaaaaataccgcataactaactaccaccacgaatactaatatcaaaacactattaaaattacgttttaaaatttacgaaactcgatattcttc

SEQ ID NO: 22249 - DNA, 613 bp, Artificial Sequence
  chemically treated genomic DNA (Homo sapiens) CpG-island No: 22249
gcgaaaatcgagatacgtttagagataggaggagggaagtgtaggtttcgttaataagtatttaggtttcgttcgttacgtcgttggttacgtttcggtcggttttttcgttcgcgcgtagtcgtttgtagattcggaagtggatggcgggagatatggcgtaattgcggcgcgtgagtttttttttgtttagattaatgttcgtttagcggtgtttttacgtttttgtattcgggatgtggggggcgtatagattttgaaattttcgtatcgttttttttatttcgagtaaattttgcgtttcgttagagtgttaaaatcgttttagggttggttttgttttcgtcgttttgtcgtagggttgcgtaggtagttgttttcgcgtcgttttttttttaaaattttttagtgattttttcgttagtttcgcgttacgtaaagtttcgtttgcgaggcggatttacgtttttcgggttttaagtttcgtttttgcggtttttggggcgtagcgtcgtagtcgttattcgggaggggtcgcgtttttgtttggtttggggattttgtagattttatttttgatttgtttgtcgcgtagttttttttgggtcgtttt

SEQ ID NO: 22250 - DNA, 613 bp, Artificial Sequence
  chemically treated genomic DNA (Homo sapiens) CpG-island No: 22250
aaaacgacccaaaaaaaactacgcgacaaacaaatcaaaaataaaatctacaaaatccccaaaccaaacaaaaacgcgacccctcccgaataacgactacgacgctacgccccaaaaaccgcaaaaacgaaacttaaaacccgaaaaacgtaaatccgcctcgcaaacgaaactttacgtaacgcgaaactaacgaaaaaatcactaaaaaattttaaaaaaaaaacgacgcgaaaacaactacctacgcaaccctacgacaaaacgacgaaaacaaaaccaaccctaaaacgattttaacactctaacgaaacgcaaaatttactcgaaataaaaaaaacgatacgaaaatttcaaaatctatacgccccccacatcccgaatacaaaaacgtaaaaacaccgctaaacgaacattaatctaaacaaaaaaaaactcacgcgccgcaattacgccatatctcccgccatccacttccgaatctacaaacgactacgcgcgaacgaaaaaaccgaccgaaacgtaaccaacgacgtaacgaacgaaacctaaatacttattaacgaaacctacacttccctcctcctatctctaaacgtatctcgattttcgc

SEQ ID NO: 22251 - DNA, 613 bp, Artificial Sequence
  chemically treated genomic DNA (Homo sapiens) CpG-island No: 22251
ggaacggtttaaggaggattacgcggtaggtagattaggggtggggtttgtagaatttttagattaggtagagacgcggtttttttcgaatggcggttgcggcgttgcgttttaggggtcgtaaggacgaggtttgggattcggagggcgtggattcgtttcgtaggcgggattttacgtggcgcggggttggcggaggggttattgaagggttttaagaggaaaacggcgcgaaagtagttgtttacgtagttttacggtagaacgacggagatagaattagttttagggcgattttaatattttgacgggacgtagaatttattcggggtggagagagcggtgcggggattttaaggtttgtacgttttttatatttcgggtatagaagcgtgagggtatcgttaagcgaatattaatttaaataaaggaaaatttacgcgtcgtagttgcgttatatttttcgttatttattttcgggtttgtaggcggttgcgcgcgaacggagaggtcggtcggggcgtggttagcgacgtggcgggcggggtttgaatatttattgacggggtttgtatttttttttttttatttttgggcgtgtttcggttttcgt

SEQ ID NO: 22252 - DNA, 613 bp, Artificial Sequence
  chemically treated genomic DNA (Homo sapiens) CpG-island No: 22252
acgaaaaccgaaacacgcccaaaaataaaaaaaaaaaaatacaaaccccgtcaataaatattcaaaccccgcccgccacgtcgctaaccacgccccgaccgacctctccgttcgcgcgcaaccgcctacaaacccgaaaataaataacgaaaaatataacgcaactacgacgcgtaaattttcctttatttaaattaatattcgcttaacgataccctcacgcttctatacccgaaatataaaaaacgtacaaaccttaaaatccccgcaccgctctctccaccccgaataaattctacgtcccgtcaaaatattaaaatcgccctaaaactaattctatctccgtcgttctaccgtaaaactacgtaaacaactactttcgcgccgttttcctcttaaaacccttcaataacccctccgccaaccccgcgccacgtaaaatcccgcctacgaaacgaatccacgccctccgaatcccaaacctcgtccttacgacccctaaaacgcaacgccgcaaccgccattcgaaaaaaaccgcgtctctacctaatctaaaaattctacaaaccccacccctaatctacctaccgcgtaatcctccttaaaccgttcc

SEQ ID NO: 22253 - DNA, 686 bp, Artificial Sequence
  chemically treated genomic DNA (Homo sapiens) CpG-island No: 22253
ttcgtaattttcgttatattattgtgtttattagtcgtgtttttttatgttgttgtaatatttgtttatttcgtttttaataaattttttattattatattattaacgtatttacgcgatagttattatatacgttgttataatatttttggcgcgttgtttttatattgtacgttgtagttttatatttttattattttatattttgttcgtttgcgtttttaatatgatttcgttttttttatacgtttcgcggtatatattcggttcgttgtttcgagatttgttttttttatattgtatattcgcggtttaatcggtcgtcgcgcgcgtagtacgcggcgcgttttttgtcgtttatttgggcgtcggttttttttcgcgtcgttttttatcggtttttattttggattttcggttatgtcgtttttcgcgttttcgtttttcgcgttttggtcggtagaagtcggggttatttaaggtttttattttttataacgggtcgcggttattattcggatttattttttaattaggaaattttacggggcgaaattaacgtttagcgtagatcggatattattgtttgacgttattatacgggtttagtttatatagaggtttttcgtaaatttcgttattatttagcgggttttcgttaggttttgggtcgttttgtttttttt

SEQ ID NO: 22254 - DNA, 686 bp, Artificial Sequence
  chemically treated genomic DNA (Homo sapiens) CpG-island No: 22254
aaaaaaaacaaaacgacccaaaacctaacgaaaacccgctaaataataacgaaatttacgaaaaacctctatataaactaaacccgtataataacgtcaaacaataatatccgatctacgctaaacgttaatttcgccccgtaaaatttcctaattaaaaaataaatccgaataataaccgcgacccgttataaaaaataaaaaccttaaataaccccgacttctaccgaccaaaacgcgaaaaacgaaaacgcgaaaaacgacataaccgaaaatccaaaataaaaaccgataaaaaacgacgcgaaaaaaaaccgacgcccaaataaacgacaaaaaacgcgccgcgtactacgcgcgcgacgaccgattaaaccgcgaatatacaatataaaaaaaacaaatctcgaaacaacgaaccgaatatataccgcgaaacgtataaaaaaaacgaaatcatattaaaaacgcaaacgaacaaaatataaaataataaaaatataaaactacaacgtacaatataaaaacaacgcgccaaaaatattataacaacgtatataataactatcgcgtaaatacgttaataatataataataaaaaatttattaaaaacgaaataaacaaatattacaacaacataaaaaaacacgactaataaacacaataatataacgaaaattacgaa

SEQ ID NO: 22255 - DNA, 686 bp, Artificial Sequence
  chemically treated genomic DNA (Homo sapiens) CpG-island No: 22255
gggggagataaagcggtttagggtttagcgggggttcgttgggtagtagcggggtttgcggggggtttttgtgtgggttgggttcgtgtagtggcgttaaatagtggtgttcggtttacgttgggcgttaatttcgtttcgtggagttttttggttgggaagtagattcgggtagtggtcgcggttcgttgtggagggtggaggttttggatagtttcggtttttgtcggttagggcgcggaaagcggaggcgcgaagggcggtatggtcgaaggtttaggatggaggtcgatgggagacggcgcgaagggaggtcggcgtttaagtaggcggtagagagcgcgtcgcgtgttgcgcgcgcggcggtcgattgggtcgcgagtgtgtagtgtaaagggggtaggtttcggggtagcgagtcgggtgtgtgtcgcggagcgtgtgaaaagggcggggttatgttgagggcgtaagcgggtagagtgtagagtggtggaggtgtagggttatagcgtgtagtgtaggggtagcgcgttaggggtgttgtagtagcgtgtgtagtggttgtcgcgtgggtgcgttagtggtgtgatggtgggaagtttgttgagggcggggtaagtaagtgttgtagtagtatggagaagtacggttagtgagtatagtagtgtagcgagagttgcgag

SEQ ID NO: 22256 - DNA, 686 bp, Artificial Sequence
  chemically treated genomic DNA (Homo sapiens) CpG-island No: 22256
ctcgcaactctcgctacactactatactcactaaccgtacttctccatactactacaacacttacttaccccgccctcaacaaacttcccaccatcacaccactaacgcacccacgcgacaaccactacacacgctactacaacacccctaacgcgctacccctacactacacgctataaccctacacctccaccactctacactctacccgcttacgccctcaacataaccccgcccttttcacacgctccgcgacacacacccgactcgctaccccgaaacctaccccctttacactacacactcgcgacccaatcgaccgccgcgcgcgcaacacgcgacgcgctctctaccgcctacttaaacgccgacctcccttcgcgccgtctcccatcgacctccatcctaaaccttcgaccataccgcccttcgcgcctccgctttccgcgccctaaccgacaaaaaccgaaactatccaaaacctccaccctccacaacgaaccgcgaccactacccgaatctacttcccaaccaaaaaactccacgaaacgaaattaacgcccaacgtaaaccgaacaccactatttaacgccactacacgaacccaacccacacaaaaaccccccgcaaaccccgctactacccaacgaacccccgctaaaccctaaaccgctttatctccccc

SEQ ID NO: 22257 - DNA, 541 bp, Artificial Sequence
  chemically treated genomic DNA (Homo sapiens) CpG-island No: 22257
gggacggcgggttttgttgattatttaggatttatatgatttgttgtaaattcgttaaggcgtgcgtcgatgtaacgttttgtcgttatggcgatgtttattttggtgagttgggttttgaaatagtggggggaagggggtaagatttcgcgagtagttgtgattagagtatttgttagtaaatcgtttacggtattcgtcgaattaacgcgtgtcgttaaggtcgtttattgtacgttgtacgaattgttgtagtgtatttttatcgtggagagttggcgtttgtatatgggggggggaacggggtggaggtataagatgtaagtatagaaatattaataatacggtgtattgggggggcgtttatggagggaattacgtagggagaaattggggttgatcgaagcgtgtgtgagttgtagggatggaggaaggaaggggattatggagggttgtgatatttgcgtaggagggatagcgtgtggtagcggggaagggttataaataaagcgagatttgaggcgtgaatgtagttgtagaa

SEQ ID NO: 22258 - DNA, 541 bp, Artificial Sequence
  chemically treated genomic DNA (Homo sapiens) CpG-island No: 22258
ttctacaactacattcacgcctcaaatctcgctttatttataacccttccccgctaccacacgctatccctcctacgcaaatatcacaaccctccataatccccttccttcctccatccctacaactcacacacgcttcgatcaaccccaatttctccctacgtaattccctccataaacgcccccccaatacaccgtattattaatatttctatacttacatcttatacctccaccccgttcccccccccatatacaaacgccaactctccacgataaaaatacactacaacaattcgtacaacgtacaataaacgaccttaacgacacgcgttaattcgacgaataccgtaaacgatttactaacaaatactctaatcacaactactcgcgaaatcttacccccttccccccactatttcaaaacccaactcaccaaaataaacatcgccataacgacaaaacgttacatcgacgcacgccttaacgaatttacaacaaatcatataaatcctaaataatcaacaaaacccgccgtccc

SEQ ID NO: 22259 - DNA, 541 bp, Artificial Sequence
  chemically treated genomic DNA (Homo sapiens) CpG-island No: 22259
ttttatagttatatttacgttttagatttcgttttatttataattttttttcgttattatacgttattttttttgcgtaggtattataattttttatagttttttttttttttttatttttgtaatttatatacgtttcggttagttttaatttttttttgcgtagttttttttataaacgtttttttaatgtatcgtgttgttggtatttttgtgtttatattttgtgtttttatttcgtttttttttttatatgtaaacgttagttttttacggtaagaatatattataatagttcgtgtagcgtgtagtaggcggttttggcgatacgcgttagttcggcgggtgtcgtaggcggtttattagtaaatgttttaattatagttgttcgcggaattttatttttttttttttattattttaaaatttagtttattagggtaagtatcgttatagcggtaaagcgttatatcggcgtacgttttggcgggtttatagtaaattatgtaaattttaggtggttagtaaggttcgtcgtttt

SEQ ID NO: 22260 - DNA, 541 bp, Artificial Sequence
  chemically treated genomic DNA (Homo sapiens) CpG-island No: 22260
aaaacgacgaaccttactaaccacctaaaatttacataatttactataaacccgccaaaacgtacgccgatataacgctttaccgctataacgatacttaccctaataaactaaattttaaaataataaaaaaaaaaaaataaaattccgcgaacaactataattaaaacatttactaataaaccgcctacgacacccgccgaactaacgcgtatcgccaaaaccgcctactacacgctacacgaactattataatatattcttaccgtaaaaaactaacgtttacatataaaaaaaaaaacgaaataaaaacacaaaatataaacacaaaaataccaacaacacgatacattaaaaaaacgtttataaaaaaaactacgcaaaaaaaaattaaaactaaccgaaacgtatataaattacaaaaataaaaaaaaaaaaaaaactataaaaaattataatacctacgcaaaaaaaataacgtataataacgaaaaaaaattataaataaaacgaaatctaaaacgtaaatataactataaaa

SEQ ID NO: 22261 - DNA, 805 bp, Artificial Sequence
  chemically treated genomic DNA (Homo sapiens) CpG-island No: 22261
ttgtattttttttagttcgattcgtttttttttgaacgtttggtttgcgtttagatttattttttttacgtttagtttttcgttgatatttatttttttgattattatttttttatcgtatttcgggggcgttgtgttgtcgttgtattgtcgcgttgacggttgatatcgcgagttcggtatcgttatatttagcgtttcgtgcgggcgtttaaggttatagatcgttcgttagtggtcgaaggcgcgttgtagtttatcgttgtttgcgaattattttttttgtagtattttcgtttttaggttgcggtgaaaacgttttagttttttttgcgtttgcggatgataaggtcgggagtgttttattcggatatttaggcgtattagttatagttttagcgtcgtttaggtgtcggtggtgtcgttttacggtgagtcgttatttatggttattcggttcggtaggtcgtaacgtttaaatacgttgaataagttggtgtggacgggttttaggcggtgaatcggtatagtggtttcgtttcgggaataacggattggttgttattagggtaagcgaatggaggtttacggttaagggaagatttattgcggcggtggttattattatgattaatttcggcgcgtatattgcggaaattacgcgtggtgcggtgttgtttatttataaaggttttcgtgaagtaggaattatggtttggcggtattagttagtcgtttatttattacgaggtagtatttaattggtttgttacgatcgattagagtgcgtatgatgaaatattta

SEQ ID NO: 22262 - DNA, 805 bp, Artificial Sequence
  chemically treated genomic DNA (Homo sapiens) CpG-island No: 22262
taaatatttcatcatacgcactctaatcgatcgtaacaaaccaattaaatactacctcgtaataaataaacgactaactaataccgccaaaccataattcctacttcacgaaaacctttataaataaacaacaccgcaccacgcgtaatttccgcaatatacgcgccgaaattaatcataataataaccaccgccgcaataaatcttcccttaaccgtaaacctccattcgcttaccctaataacaaccaatccgttattcccgaaacgaaaccactataccgattcaccgcctaaaacccgtccacaccaacttattcaacgtatttaaacgttacgacctaccgaaccgaataaccataaataacgactcaccgtaaaacgacaccaccgacacctaaacgacgctaaaactataactaatacgcctaaatatccgaataaaacactcccgaccttatcatccgcaaacgcaaaaaaaactaaaacgttttcaccgcaacctaaaaacgaaaatactacaaaaaaaataattcgcaaacaacgataaactacaacgcgccttcgaccactaacgaacgatctataaccttaaacgcccgcacgaaacgctaaatataacgataccgaactcgcgatatcaaccgtcaacgcgacaatacaacgacaacacaacgcccccgaaatacgataaaaaaataataatcaaaaaaataaatatcaacgaaaaactaaacgtaaaaaaaataaatctaaacgcaaaccaaacgttcaaaaaaaaacgaatcgaactaaaaaaaatacaa

SEQ ID NO: 22263 - DNA, 805 bp, Artificial Sequence
  chemically treated genomic DNA (Homo sapiens) CpG-island No: 22263
taggtattttattatgcgtattttagtcgatcgtgataaattagttgaatgttgtttcgtaatggatgagcggttggttgatgtcgttaagttataatttttgttttacgaaaatttttgtggatagatagtatcgtattacgcgtgattttcgtaatatacgcgtcggagttgattatgatggtgattatcgtcgtagtaaatttttttttggtcgtggatttttattcgtttattttggtggtagttaattcgttgttttcgggacggggttattgtatcgatttatcgtttgaaattcgtttatattaatttgtttagcgtgtttgagcgttacggtttgtcggatcggatgattatggataacggtttatcgtggggcgatattatcggtatttggacggcgttggagttgtggttgatgcgtttgggtattcgggtggggtattttcggttttattattcgtagacgtaggggaagttggagcgtttttatcgtagtttgaaggcggaagtgttgtagggaaaatggttcgtagatagcggtgaattgtagcgcgttttcgattattggcggacggtttataattttgaacgttcgtacgaggcgttggatatggcggtatcgggttcgcggtattagtcgttagcgcggtagtatagcggtaatataacgttttcggaatacgatgaaggggtgatggttaggaaagtggatattagcggaaagttgagcgtgaaaggggtaagtttgagcgtaggttaggcgtttaggggagaacgggtcgggttgaaggagatgtag

SEQ ID NO: 22264 - DNA, 805 bp, Artificial Sequence
  chemically treated genomic DNA (Homo sapiens) CpG-island No: 22264
ctacatctccttcaacccgacccgttctcccctaaacgcctaacctacgctcaaacttacccctttcacgctcaactttccgctaatatccactttcctaaccatcaccccttcatcgtattccgaaaacgttatattaccgctatactaccgcgctaacgactaataccgcgaacccgataccgccatatccaacgcctcgtacgaacgttcaaaattataaaccgtccgccaataatcgaaaacgcgctacaattcaccgctatctacgaaccattttccctacaacacttccgccttcaaactacgataaaaacgctccaacttcccctacgtctacgaataataaaaccgaaaataccccacccgaatacccaaacgcatcaaccacaactccaacgccgtccaaataccgataatatcgccccacgataaaccgttatccataatcatccgatccgacaaaccgtaacgctcaaacacgctaaacaaattaatataaacgaatttcaaacgataaatcgatacaataaccccgtcccgaaaacaacgaattaactaccaccaaaataaacgaataaaaatccacgaccaaaaaaaaatttactacgacgataatcaccatcataatcaactccgacgcgtatattacgaaaatcacgcgtaatacgatactatctatccacaaaaattttcgtaaaacaaaaattataacttaacgacatcaaccaaccgctcatccattacgaaacaacattcaactaatttatcacgatcgactaaaatacgcataataaaataccta

SEQ ID NO: 22265 - DNA, 990 bp, Artificial Sequence
  chemically treated genomic DNA (Homo sapiens) CpG-island No: 22265
agatagatagacgggaggtttcgcggcgcgtttttttaggaatgaaagggattcgcggggcgagtatttttaaattcggcgtttcggggatttgcgttgagatacgggtcgggcggcgtagtttgaggagaaagtcggttaggtttttgatatttagtcggattaattgcgcggagatttcgcgttgatatttatcgcgttttgtcgggtaattatttcgggtggtcgcggaagcgtttgggcgtcgtgggttttcgtagtaaacgcggggcgggagtacgatttagggtcggcgtaatgtgattggtttaggtttttttcggagttttttattggttttgggtatcgagtatgggcgttgcgttagtgcgcgttggcgtaaggttggtggaagtcgcgttgtgtaggttcgtgttcggttggcgcggcgtgggtaagttgtttgtcggttacggttttcggatttcggtcgttcgttttgtattaattttttgggagaggcggttcggggcgggggtgggtagtcggtttgcgttcgtggtttttacgtttttcggttttcgggggtcgtcgcgggcgcgggttggggttcggatttggtttttggtttttggttttggtgttttcgggagcgtgtttttgggttcggcgtcggtttttgtcgcgggaggtttttgggcggcgtggggtttttttttatgttttgtttttggttttaggcgttttttaggtttatggaaatcgtattcggggacgcggggaattggggaatatgtcgggttggggcggcgcgtttcggggggggggaaattcgggacgtttcgagcgtttattcggcgggacgcggtcgtgagttttgttcgcggtcgtgagttttgtttatcgttttcgcgtcgttttcggggttgttggggttcgggttttcgttgagagtcgtgggaaggtggtgtcggattgtggggtagtagtagggatgaggggttgattgat

SEQ ID NO: 22266 - DNA, 990 bp, Artificial Sequence
  chemically treated genomic DNA (Homo sapiens) CpG-island No: 22266
atcaatcaacccctcatccctactactaccccacaatccgacaccaccttcccacgactctcaacgaaaacccgaaccccaacaaccccgaaaacgacgcgaaaacgataaacaaaactcacgaccgcgaacaaaactcacgaccgcgtcccgccgaataaacgctcgaaacgtcccgaatttccccccccccgaaacgcgccgccccaacccgacatattccccaattccccgcgtccccgaatacgatttccataaacctaaaaaacgcctaaaaccaaaaacaaaacataaaaaaaaaccccacgccgcccaaaaacctcccgcgacaaaaaccgacgccgaacccaaaaacacgctcccgaaaacaccaaaaccaaaaaccaaaaaccaaatccgaaccccaacccgcgcccgcgacgacccccgaaaaccgaaaaacgtaaaaaccacgaacgcaaaccgactacccacccccgccccgaaccgcctctcccaaaaaattaatacaaaacgaacgaccgaaatccgaaaaccgtaaccgacaaacaacttacccacgccgcgccaaccgaacacgaacctacacaacgcgacttccaccaaccttacgccaacgcgcactaacgcaacgcccatactcgatacccaaaaccaataaaaaactccgaaaaaaacctaaaccaatcacattacgccgaccctaaatcgtactcccgccccgcgtttactacgaaaacccacgacgcccaaacgcttccgcgaccacccgaaataattacccgacaaaacgcgataaatatcaacgcgaaatctccgcgcaattaatccgactaaatatcaaaaacctaaccgactttctcctcaaactacgccgcccgacccgtatctcaacgcaaatccccgaaacgccgaatttaaaaatactcgccccgcgaatccctttcattcctaaaaaaacgcgccgcgaaacctcccgtctatctatct

SEQ ID NO: 22267 - DNA, 990 bp, Artificial Sequence
  chemically treated genomic DNA (Homo sapiens) CpG-island No: 22267
attaattaattttttatttttgttattgttttataattcggtattatttttttacgatttttagcggaggttcgggttttagtagtttcggaagcggcgcggaggcggtgggtagagtttacggtcgcgggtagaatttacggtcgcgtttcgtcgggtgggcgttcggaacgtttcgggttttttttttttcggagcgcgtcgttttaattcggtatgttttttagtttttcgcgttttcgagtgcggtttttataggtttggaaagcgtttagaattaaaggtagaatatgaggagagattttacgtcgtttaggggtttttcgcggtagaggtcgacgtcgagtttaaggatacgttttcggggatattaaagttaaaggttaaaggttaagttcgagttttagttcgcgttcgcggcgattttcggaggtcgaagggcgtgggaattacgggcgtaagtcggttgtttattttcgtttcgggtcgttttttttaggagattagtgtagggcgagcggtcggaattcgggaatcgtagtcgataggtagtttatttacgtcgcgttagtcgggtacgaatttgtataacgcgatttttattaattttgcgttagcgcgtattgacgtagcgtttatgttcggtatttaggattaatagaaagtttcgaaggggatttgggttaattatattgcgtcggttttgagtcgtgttttcgtttcgcgtttgttacggaggtttacgacgtttaggcgttttcgcgattattcggagtgattgttcggtagagcgcggtaggtgttaacgcggggttttcgcgtagttggttcggttgggtgttaaagatttggtcggttttttttttaggttgcgtcgttcggttcgtgttttagcgtaggttttcggggcgtcgagtttgggggtgttcgtttcgcgggttttttttatttttaggaaaacgcgtcgcggggtttttcgtttgtttgttt

SEQ ID NO: 22268 - DNA, 990 bp, Artificial Sequence
  chemically treated genomic DNA (Homo sapiens) CpG-island No: 22268
aaacaaacaaacgaaaaaccccgcgacgcgttttcctaaaaataaaaaaaacccgcgaaacgaacacccccaaactcgacgccccgaaaacctacgctaaaacacgaaccgaacgacgcaacctaaaaaaaaaaccgaccaaatctttaacacccaaccgaaccaactacgcgaaaaccccgcgttaacacctaccgcgctctaccgaacaatcactccgaataatcgcgaaaacgcctaaacgtcgtaaacctccgtaacaaacgcgaaacgaaaacacgactcaaaaccgacgcaatataattaacccaaatccccttcgaaactttctattaatcctaaataccgaacataaacgctacgtcaatacgcgctaacgcaaaattaataaaaatcgcgttatacaaattcgtacccgactaacgcgacgtaaataaactacctatcgactacgattcccgaattccgaccgctcgccctacactaatctcctaaaaaaaacgacccgaaacgaaaataaacaaccgacttacgcccgtaattcccacgcccttcgacctccgaaaatcgccgcgaacgcgaactaaaactcgaacttaacctttaacctttaactttaatatccccgaaaacgtatccttaaactcgacgtcgacctctaccgcgaaaaacccctaaacgacgtaaaatctctcctcatattctacctttaattctaaacgctttccaaacctataaaaaccgcactcgaaaacgcgaaaaactaaaaaacataccgaattaaaacgacgcgctccgaaaaaaaaaaaacccgaaacgttccgaacgcccacccgacgaaacgcgaccgtaaattctacccgcgaccgtaaactctacccaccgcctccgcgccgcttccgaaactactaaaacccgaacctccgctaaaaatcgtaaaaaaataataccgaattataaaacaataacaaaaataaaaaattaattaat

SEQ ID NO: 22269 - DNA, 535 bp, Artificial Sequence
  chemically treated genomic DNA (Homo sapiens) CpG-island No: 22269
gggttaggttgagtatttatagggggcgaaagaagggaaggagggaagagttggcgacgagcgcgtagggagcgcgataaattggggatgcgataattggaataattggggggcggaggagttgggtggcgtagatgatttgggtaattacgtgggtaagggtaggtggtacggtgaatacgttggtagggtgagtgaaacgagtaaacggagggtagcgaaggaatattgggaggaagtttgtacggcgtagtatcgcggcgggagaggcgtgacggtttatacgagatgaggggagaagagggcgtgaaaaaagggggttaaatggagtgcgggcgttggcgagacgatcgtttgtattacggaaaaataagggtgataaaattaaagcgggaaggtcggtgggagggtaaggataagtgtggtatgaaaagttcgagcggggacgtatcgggaaagtgtaatcgcgtagtacggatttattaatgaggtatacgtacgggtaattttgttaggaaggagatggggtgaaata

SEQ ID NO: 22270 - DNA, 535 bp, Artificial Sequence
  chemically treated genomic DNA (Homo sapiens) CpG-island No: 22270
tatttcaccccatctccttcctaacaaaattacccgtacgtatacctcattaataaatccgtactacgcgattacactttcccgatacgtccccgctcgaacttttcataccacacttatccttaccctcccaccgaccttcccgctttaattttatcacccttatttttccgtaatacaaacgatcgtctcgccaacgcccgcactccatttaacccccttttttcacgccctcttctcccctcatctcgtataaaccgtcacgcctctcccgccgcgatactacgccgtacaaacttcctcccaatattccttcgctaccctccgtttactcgtttcactcaccctaccaacgtattcaccgtaccacctacccttacccacgtaattacccaaatcatctacgccacccaactcctccgccccccaattattccaattatcgcatccccaatttatcgcgctccctacgcgctcgtcgccaactcttccctccttcccttctttcgccccctataaatactcaacctaaccc

SEQ ID NO: 22271 - DNA, 535 bp, Artificial Sequence
  chemically treated genomic DNA (Homo sapiens) CpG-island No: 22271
tattttattttattttttttttgataaggttattcgtacgtgtattttattagtaaattcgtattacgcggttatattttttcggtgcgttttcgttcgggttttttatgttatatttatttttgtttttttatcggttttttcgttttaattttgttatttttattttttcgtggtgtaaacggtcgtttcgttaacgttcgtattttatttaattttttttttttacgtttttttttttttttatttcgtataggtcgttacgtttttttcgtcgcggtattacgtcgtataaatttttttttaatattttttcgttgtttttcgtttgttcgttttatttattttattagcgtgtttatcgtgttatttgtttttatttacgtaattatttaaattatttgcgttatttaattttttcgttttttaattattttaattgtcgtatttttaatttgtcgcgttttttacgcgttcgtcgttagttttttttttttttttttttttcgttttttatgaatgtttaatttagttt

SEQ ID NO: 22272 - DNA, 535 bp, Artificial Sequence
  chemically treated genomic DNA (Homo sapiens) CpG-island No: 22272
aaactaaattaaacattcataaaaaacgaaaaaaaaaaaaaaaaaaaaaactaacgacgaacgcgtaaaaaacgcgacaaattaaaaatacgacaattaaaataattaaaaaacgaaaaaattaaataacgcaaataatttaaataattacgtaaataaaaacaaataacacgataaacacgctaataaaataaataaaacgaacaaacgaaaaacaacgaaaaaatattaaaaaaaaatttatacgacgtaataccgcgacgaaaaaaacgtaacgacctatacgaaataaaaaaaaaaaaaaacgtaaaaaaaaaaaattaaataaaatacgaacgttaacgaaacgaccgtttacaccacgaaaaaataaaaataacaaaattaaaacgaaaaaaccgataaaaaaacaaaaataaatataacataaaaaacccgaacgaaaacgcaccgaaaaaatataaccgcgtaatacgaatttactaataaaatacacgtacgaataaccttatcaaaaaaaaaataaaataaaata

SEQ ID NO: 22273 - DNA, 516 bp, Artificial Sequence
  chemically treated genomic DNA (Homo sapiens) CpG-island No: 22273
ggcgacgggaaataaatcgggggatttttgttgtaggtgtcgcgaaattggcgcgtatatattgaaaatacgggtcggtgtgtagcgtacggggcgcgggaattacgggttggtagtgggtcgggaggttgggggtggaatgtcggagagggacggggtaagttgggggcgggcgagaatcggggggcggttgggagcgcggagtgttatgatgatttgcgattcgtttgtagatgcgaattgttattgcgtggttgtagatatcgtttatgtgaaaagttacggataagttattgcgatattacggaaagttattgcgatgtattcgcggaggttgttgaatagggtcgatgtgcgtttatacgttcgcgcgtatattatttcgttgggcgttttggagtacgattttgtttcgtattcggttcgttttatattgggggggttgttcggtggttgtattcgggacgtgacggatttattttaataaattgaatattatatttaaagatttatttt

SEQ ID NO: 22274 - DNA, 516 bp, Artificial Sequence
  chemically treated genomic DNA (Homo sapiens) CpG-island No: 22274
aaaataaatctttaaatataatattcaatttattaaaataaatccgtcacgtcccgaatacaaccaccgaacaacccccccaatataaaacgaaccgaatacgaaacaaaatcgtactccaaaacgcccaacgaaataatatacgcgcgaacgtataaacgcacatcgaccctattcaacaacctccgcgaatacatcgcaataactttccgtaatatcgcaataacttatccgtaacttttcacataaacgatatctacaaccacgcaataacaattcgcatctacaaacgaatcgcaaatcatcataacactccgcgctcccaaccgccccccgattctcgcccgcccccaacttaccccgtccctctccgacattccacccccaacctcccgacccactaccaacccgtaattcccgcgccccgtacgctacacaccgacccgtattttcaatatatacgcgccaatttcgcgacacctacaacaaaaatcccccgatttatttcccgtcgcc

SEQ ID NO: 22275 - DNA, 516 bp, Artificial Sequence
  chemically treated genomic DNA (Homo sapiens) CpG-island No: 22275
aaaataagtttttagatgtgatatttagtttgttgaggtggattcgttacgtttcgggtgtagttatcggataatttttttaatataaagcgggtcgggtacgggataaagtcgtgttttaaagcgtttaacggagtaatgtacgcgcgggcgtataaacgtatatcggttttatttagtagttttcgcgagtatatcgtaatagtttttcgtggtatcgtaatagtttattcgtagttttttatataggcggtgtttgtagttacgtaatagtagttcgtatttgtaggcgggtcgtaggttattatggtatttcgcgtttttaatcgtttttcggttttcgttcgtttttaatttatttcgttttttttcgatattttatttttagtttttcgatttattgttaattcgtgattttcgcgtttcgtgcgttgtatatcgattcgtatttttagtatatgcgcgttaatttcgcgatatttgtagtaagaatttttcgatttgtttttcgtcgtt

SEQ ID NO: 22276 - DNA, 516 bp, Artificial Sequence
  chemically treated genomic DNA (Homo sapiens) CpG-island No: 22276
aacgacgaaaaacaaatcgaaaaattcttactacaaatatcgcgaaattaacgcgcatatactaaaaatacgaatcgatatacaacgcacgaaacgcgaaaatcacgaattaacaataaatcgaaaaactaaaaataaaatatcgaaaaaaaacgaaataaattaaaaacgaacgaaaaccgaaaaacgattaaaaacgcgaaataccataataacctacgacccgcctacaaatacgaactactattacgtaactacaaacaccgcctatataaaaaactacgaataaactattacgataccacgaaaaactattacgatatactcgcgaaaactactaaataaaaccgatatacgtttatacgcccgcgcgtacattactccgttaaacgctttaaaacacgactttatcccgtacccgacccgctttatattaaaaaaattatccgataactacacccgaaacgtaacgaatccacctcaacaaactaaatatcacatctaaaaacttatttt

SEQ ID NO: 22277 - DNA, 579 bp, Artificial Sequence
  chemically treated genomic DNA (Homo sapiens) CpG-island No: 22277
gtgtggtgggttgtgaaagttgatgagtacggatcgcggggtaacgggtttaaaaataggggttcgggttgcgtggtcgattgttaaaatgttgtataaggaatggtgtaagtaggggtaaagtttgcgttggatgttaggagttggcgggtggggcggattaggaatcggggcgtcggaatgggaatatttataaattacgaggagcgaaaagtgatagcgggggttagggcgtattgttggggggttataagggaacgagggacggaatggagggtaacgggcgagtgggaatggtgagtggggatgtagttgaaagagtgtgttggaggacgattgtatggcgggcgggatgcgggttggatttgaaagaggagttagttggggggtaggggagttaggttagggaaaggtagggagcgacgggcgatatagtggtcggggaagagggggtattacgggcgggtatcgcgacgtgggggtgggatcgggggaatatgatattatcgatgtggcggaaggagatgaagggaacgttgagaattttgggtggtaagcgcgaatgaattggaattagat

SEQ ID NO: 22278 - DNA, 579 bp, Artificial Sequence
  chemically treated genomic DNA (Homo sapiens) CpG-island No: 22278
atctaattccaattcattcgcgcttaccacccaaaattctcaacgttcccttcatctccttccgccacatcgataatatcatattcccccgatcccacccccacgtcgcgatacccgcccgtaataccccctcttccccgaccactatatcgcccgtcgctccctacctttccctaacctaactcccctaccccccaactaactcctctttcaaatccaacccgcatcccgcccgccatacaatcgtcctccaacacactctttcaactacatccccactcaccattcccactcgcccgttaccctccattccgtccctcgttcccttataaccccccaacaatacgccctaacccccgctatcacttttcgctcctcgtaatttataaatattcccattccgacgccccgattcctaatccgccccacccgccaactcctaacatccaacgcaaactttacccctacttacaccattccttatacaacattttaacaatcgaccacgcaacccgaacccctatttttaaacccgttaccccgcgatccgtactcatcaactttcacaacccaccacac

SEQ ID NO: 22279 - DNA, 579 bp, Artificial Sequence
  chemically treated genomic DNA (Homo sapiens) CpG-island No: 22279
atttagttttagtttattcgcgtttattatttaaaatttttaacgttttttttattttttttcgttatatcggtgatattatattttttcggttttatttttacgtcgcggtattcgttcgtggtattttttttttttcgattattatatcgttcgtcgttttttatttttttttggtttaatttttttgttttttaattagttttttttttaaatttagttcgtatttcgttcgttatgtaatcgttttttaatatatttttttagttgtatttttatttattatttttattcgttcgttgttttttatttcgtttttcgtttttttataattttttaataatacgttttaattttcgttattatttttcgtttttcgtagtttataaatgtttttatttcggcgtttcggtttttaattcgttttattcgttagtttttggtatttagcgtaagttttatttttatttatattattttttatataatattttgatagtcggttacgtaattcgaatttttgtttttaagttcgttgtttcgcggttcgtatttattagtttttataatttattatat

SEQ ID NO: 22280 - DNA, 579 bp, Artificial Sequence
  chemically treated genomic DNA (Homo sapiens) CpG-island No: 22280
atataataaattataaaaactaataaatacgaaccgcgaaacaacgaacttaaaaacaaaaattcgaattacgtaaccgactatcaaaatattatataaaaaataatataaataaaaataaaacttacgctaaataccaaaaactaacgaataaaacgaattaaaaaccgaaacgccgaaataaaaacatttataaactacgaaaaacgaaaaataataacgaaaattaaaacgtattattaaaaaattataaaaaaacgaaaaacgaaataaaaaacaacgaacgaataaaaataataaataaaaatacaactaaaaaaatatattaaaaaacgattacataacgaacgaaatacgaactaaatttaaaaaaaaaactaattaaaaaacaaaaaaattaaaccaaaaaaaaataaaaaacgacgaacgatataataatcgaaaaaaaaaaaataccacgaacgaataccgcgacgtaaaaataaaaccgaaaaaatataatatcaccgatataacgaaaaaaaataaaaaaaacgttaaaaattttaaataataaacgcgaataaactaaaactaaat

SEQ ID NO: 22281 - DNA, 657 bp, Artificial Sequence
  chemically treated genomic DNA (Homo sapiens) CpG-island No: 22281
  misc_feature (542)..(542): n is either a, c, g or t
gcgggtgcgttgggtgaagcggttgcgaaagcgagatttgcgtaaaagcggaagatgcgtagttcgaaaggggaggtagacgaaggtaattagcgtaataggattcgggggtttcgtggtgattggcggtgcgatttaggtaggttgggcgcgatcgggtaggcgggcggatggggtcgggattagcggggggggtgtataggtgcgggagggcgtatttaatagacgcgatgatgtaggtacggagacgtacggcgggcggatgtacgttaagggcgagttttgtagggcgtattgggtaaggggcgtggtgtcggggagcgacggatggatattgggtatttattgaagtgcgttatagtatttagacgcggattcggcgggcgcgcggttcgcggaaacgtaaggttcgggaatcgaaattcgtttgttgatagtattcgtatgcgtttatggaatttgtttaaatatcgttggttcgtattcgttagtcgcgacgtaagatcgacgggttcggttttttcggaaaagatttgaagaantttgttgcggtttttgtcgtcgtttttggtcgcgtagcggttgttttatcgttatcgagttattattacgatataggggagtaatgtttgtcgttatgataataaagttagatat

SEQ ID NO: 22282 - DNA, 657 bp, Artificial Sequence
  chemically treated genomic DNA (Homo sapiens) CpG-island No: 22282
  misc_feature (116)..(116): n is either a, c, g or t
atatctaactttattatcataacgacaaacattactcccctatatcgtaataataactcgataacgataaaacaaccgctacgcgaccaaaaacgacgacaaaaaccgcaacaaanttcttcaaatcttttccgaaaaaaccgaacccgtcgatcttacgtcgcgactaacgaatacgaaccaacgatatttaaacaaattccataaacgcatacgaatactatcaacaaacgaatttcgattcccgaaccttacgtttccgcgaaccgcgcgcccgccgaatccgcgtctaaatactataacgcacttcaataaatacccaatatccatccgtcgctccccgacaccacgccccttacccaatacgccctacaaaactcgcccttaacgtacatccgcccgccgtacgtctccgtacctacatcatcgcgtctattaaatacgccctcccgcacctatacaccccccccgctaatcccgaccccatccgcccgcctacccgatcgcgcccaacctacctaaatcgcaccgccaatcaccacgaaacccccgaatcctattacgctaattaccttcgtctacctcccctttcgaactacgcatcttccgcttttacgcaaatctcgctttcgcaaccgcttcacccaacgcacccgc

SEQ ID NO: 22283 - DNA, 657 bp, Artificial Sequence
  chemically treated genomic DNA (Homo sapiens) CpG-island No: 22283
  misc_feature (116)..(116): n is either a, c, g or t
atgtttagttttattattatagcggtaggtattatttttttgtatcgtaataataattcgatagcgatggggtagtcgttacgcggttaggagcgacgataggggtcgtagtaggnttttttaggtttttttcgaaggggtcgagttcgtcggttttacgtcgcgattagcgggtacgggttaacggtatttgagtaagttttatgggcgtatacgggtgttattaataagcgagtttcgattttcgggttttgcgttttcgcggatcgcgcgttcgtcgagttcgcgtttaagtattgtggcgtattttaatgggtatttaatgtttattcgtcgtttttcgatattacgttttttatttaatgcgttttgtaagattcgtttttagcgtgtattcgttcgtcgtacgttttcgtatttgtattatcgcgtttattaagtacgttttttcgtatttgtatatttttttcgttagtttcggttttattcgttcgtttattcggtcgcgtttagtttatttgggtcgtatcgttagttattacggggttttcgggttttattgcgttagttattttcgtttattttttttttcgggttacgtatttttcgtttttgcgtaggtttcgttttcgtaatcgttttatttagcgtattcgt

SEQ ID NO: 22284 - DNA, 657 bp, Artificial Sequence
  chemically treated genomic DNA (Homo sapiens) CpG-island No: 22284
  misc_feature (542)..(542): n is either a, c, g or t
acgaatacgctaaataaaacgattacgaaaacgaaacctacgcaaaaacgaaaaatacgtaacccgaaaaaaaaaataaacgaaaataactaacgcaataaaacccgaaaaccccgtaataactaacgatacgacccaaataaactaaacgcgaccgaataaacgaacgaataaaaccgaaactaacgaaaaaaatatacaaatacgaaaaaacgtacttaataaacgcgataatacaaatacgaaaacgtacgacgaacgaatacacgctaaaaacgaatcttacaaaacgcattaaataaaaaacgtaatatcgaaaaacgacgaataaacattaaatacccattaaaatacgccacaatacttaaacgcgaactcgacgaacgcgcgatccgcgaaaacgcaaaacccgaaaatcgaaactcgcttattaataacacccgtatacgcccataaaacttactcaaataccgttaacccgtacccgctaatcgcgacgtaaaaccgacgaactcgaccccttcgaaaaaaacctaaaaaancctactacgacccctatcgtcgctcctaaccgcgtaacgactaccccatcgctatcgaattattattacgatacaaaaaaataatacctaccgctataataataaaactaaacat

SEQ ID NO: 22285 - DNA, 1140 bp, Artificial Sequence
  chemically treated genomic DNA (Homo sapiens) CpG-island No: 22285
ggatatgaatatagaaggggtcgtatgtgttacgggatttgcgaattgcgtatcgttgcggggattgtgtggcgacggttacggttgaaaatatttggggttggcgttattaggggtaggggtgggagaagaggagaattgggtagagaggaggagacgcgtaatttggttcgatacggttgtgcggattattattcggttgcgtatcgtaggaaaattgcgtttaagagggatggaataaggagcgtatatgtttaagttagtttattcggagttaggggtattatattaggcggcgcggtagtttaggacgtataggcgtttgtaatcgagcgttgtataacgttaggagcgaaatagtttatatagcgtgagtagaacgacgcgggggtcgtagaatagattttcgttagtagtagggcgtattcgtagttgcggaatttttgttatcgataggaattcgtttgagtgttaattatattagtaattataaaagtatcggacgaagtcggatttgagggtagttagtagcgataattaatcggttttagtattattcgtagtaggcgggcgttgagtatttgataggattgtatttttttacgtttattcggttaggtagtaggcgtaggcgatataggtttaagtaggcgcgtacggataaggaaacgtatttttttataattagcgggttttcgttcgtattcgttttattagtagacgtaaaaagtatagtaggtataagagcgggataggcgagggggtagtttcggaaatagttttaagtaaaatattagttatttacgttttttgtttcgggcgggtaagtattcgaggcggatacgtcgttgggttggggtattatatgtgacgtttagttggttagtttgtaggtttaggtcgacgaaaattttcgacgagttagggtttttttaggcgatttttttaattacgttaagttgttttatttttaaacgtttgtaggcgatatgcgttgtggttcgtttcgtacgtttaatttttttgaagcgttgttagtaggcgttaggcgttagtagcggataaaatattaatcgttatagagcggtaaatttttcgttataggagtttatattgattttatagtatagtagtcgtatg

SEQ ID NO: 22286 - DNA, 1140 bp, Artificial Sequence
  chemically treated genomic DNA (Homo sapiens) CpG-island No: 22286
catacgactactatactataaaatcaatataaactcctataacgaaaaatttaccgctctataacgattaatattttatccgctactaacgcctaacgcctactaacaacgcttcaaaaaaattaaacgtacgaaacgaaccacaacgcatatcgcctacaaacgtttaaaaataaaacaacttaacgtaattaaaaaaatcgcctaaaaaaaccctaactcgtcgaaaattttcgtcgacctaaacctacaaactaaccaactaaacgtcacatataataccccaacccaacgacgtatccgcctcgaatacttacccgcccgaaacaaaaaacgtaaataactaatattttacttaaaactatttccgaaactaccccctcgcctatcccgctcttatacctactatactttttacgtctactaataaaacgaatacgaacgaaaacccgctaattataaaaaaatacgtttccttatccgtacgcgcctacttaaacctatatcgcctacgcctactacctaaccgaataaacgtaaaaaaatacaatcctatcaaatactcaacgcccgcctactacgaataatactaaaaccgattaattatcgctactaactaccctcaaatccgacttcgtccgatacttttataattactaatataattaacactcaaacgaattcctatcgataacaaaaattccgcaactacgaatacgccctactactaacgaaaatctattctacgacccccgcgtcgttctactcacgctatataaactatttcgctcctaacgttatacaacgctcgattacaaacgcctatacgtcctaaactaccgcgccgcctaatataatacccctaactccgaataaactaacttaaacatatacgctccttattccatccctcttaaacgcaattttcctacgatacgcaaccgaataataatccgcacaaccgtatcgaaccaaattacgcgtctcctcctctctacccaattctcctcttctcccacccctacccctaataacgccaaccccaaatattttcaaccgtaaccgtcgccacacaatccccgcaacgatacgcaattcgcaaatcccgtaacacatacgaccccttctatattcatatcc

SEQ ID NO: 22287 - DNA, 1140 bp, Artificial Sequence
  chemically treated genomic DNA (Homo sapiens) CpG-island No: 22287
tatacggttattgtgttgtaagattagtgtgagtttttatagcggagagtttatcgttttgtagcgattggtgttttattcgttattggcgtttaacgtttattggtagcgttttagaagggttgggcgtacggagcgggttataacgtatatcgtttgtaggcgtttgggggtagagtagtttggcgtaattgaagggatcgtttgggaaaattttgattcgtcgaagattttcgtcggtttgagtttgtaagttagttagttggacgttatatgtggtattttagtttagcggcgtgttcgtttcggatatttgttcgttcggggtaggaggcgtggatggttgatattttatttagagttattttcgggattgttttttcgtttatttcgtttttatgtttgttgtgttttttacgtttgttggtaaagcggatgcgggcgagagttcgttgattgtaaagaaatacgtttttttgttcgtacgcgtttgtttaagtttatatcgtttacgtttgttgtttaatcggatgaacgtaggagagtgtagttttgttaggtgtttagcgttcgtttgttacgggtagtgttagagtcggttggttgtcgttgttggttatttttagattcggtttcgttcggtgtttttatgattgttggtgtaattagtatttaggcgggtttttgtcgatagtaggaatttcgtaattgcgaatacgttttgttattagcgggagtttgttttgcggttttcgcgtcgttttgtttacgttgtataagttatttcgtttttggcgttatatagcgttcgattataagcgtttatgcgttttaagttgtcgcgtcgtttggtgtggtgtttttggtttcggataaattggtttaggtatatgcgttttttattttattttttttaggcgtagtttttttgcgatacgtagtcggataatggttcgtatagtcgtatcgggttaggttacgcgtttttttttttttgtttaatttttttttttttttatttttatttttagtagcgttagttttaggtatttttagtcgtaatcgtcgttatatagttttcgtagcggtacgtaattcgtaggtttcgtggtatatacggttttttttatatttatgttt

SEQ ID NO: 22288 - DNA, 1140 bp, Artificial Sequence
  chemically treated genomic DNA (Homo sapiens) CpG-island No: 22288
aaacataaatataaaaaaaaccgtatataccacgaaacctacgaattacgtaccgctacgaaaactatataacgacgattacgactaaaaatacctaaaactaacgctactaaaaataaaaataaaaaaaaaaaaaaattaaacaaaaaaaaaaaaacgcgtaacctaacccgatacgactatacgaaccattatccgactacgtatcgcaaaaaaactacgcctaaaaaaaataaaataaaaaacgcatatacctaaaccaatttatccgaaaccaaaaacaccacaccaaacgacgcgacaacttaaaacgcataaacgcttataatcgaacgctatataacgccaaaaacgaaataacttatacaacgtaaacaaaacgacgcgaaaaccgcaaaacaaactcccgctaataacaaaacgtattcgcaattacgaaattcctactatcgacaaaaacccgcctaaatactaattacaccaacaatcataaaaacaccgaacgaaaccgaatctaaaaataaccaacaacgacaaccaaccgactctaacactacccgtaacaaacgaacgctaaacacctaacaaaactacactctcctacgttcatccgattaaacaacaaacgtaaacgatataaacttaaacaaacgcgtacgaacaaaaaaacgtatttctttacaatcaacgaactctcgcccgcatccgctttaccaacaaacgtaaaaaacacaacaaacataaaaacgaaataaacgaaaaaacaatcccgaaaataactctaaataaaatatcaaccatccacgcctcctaccccgaacgaacaaatatccgaaacgaacacgccgctaaactaaaataccacatataacgtccaactaactaacttacaaactcaaaccgacgaaaatcttcgacgaatcaaaattttcccaaacgatcccttcaattacgccaaactactctacccccaaacgcctacaaacgatatacgttataacccgctccgtacgcccaacccttctaaaacgctaccaataaacgttaaacgccaataacgaataaaacaccaatcgctacaaaacgataaactctccgctataaaaactcacactaatcttacaacacaataaccgtata

SEQ ID NO: 22289 - DNA, 596 bp, Artificial Sequence
  chemically treated genomic DNA (Homo sapiens) CpG-island No: 22289
gcgagggatggtcgataaattaggggaaaattttagcgtagttttacggtgtagtattagaatattcgacgttcgggaaacggttcgggggagtttattcgttagcgatagtgaataggtaattttgattatttaaacggatatagatgcgggaacgggtgcgcgatttggaggtttgtagcgatagggtatagtcgaatgtttcgcgttagggcgaacgttgagagggaatcgacggtatggttagagcgaggagaaagggtatgatttagatcggtaagatgaaatacggtttgaagttagttgcgggggggcgtgggcgtgtatggttttattatgtagagattatcgcggtttaggtaagcggggagacgtaggggcggtagtattacgttagatggtcggattgtacgtataggagaagtgcggttgtgggggttggtataatacgcggtcgcgcgttttatgtaatatatgggacgataattggtatggtaggcgacgacgggttcgttcggcgttagttattacgaaattattaagtaacgattgtaataattagtatatcgattaataagtgagaatttgacgaaatt

SEQ ID NO: 22290 - DNA, 596 bp, Artificial Sequence
  chemically treated genomic DNA (Homo sapiens) CpG-island No: 22290
aatttcgtcaaattctcacttattaatcgatatactaattattacaatcgttacttaataatttcgtaataactaacgccgaacgaacccgtcgtcgcctaccataccaattatcgtcccatatattacataaaacgcgcgaccgcgtattataccaacccccacaaccgcacttctcctatacgtacaatccgaccatctaacgtaatactaccgcccctacgtctccccgcttacctaaaccgcgataatctctacataataaaaccatacacgcccacgcccccccgcaactaacttcaaaccgtatttcatcttaccgatctaaatcataccctttctcctcgctctaaccataccgtcgattccctctcaacgttcgccctaacgcgaaacattcgactataccctatcgctacaaacctccaaatcgcgcacccgttcccgcatctatatccgtttaaataatcaaaattacctattcactatcgctaacgaataaactcccccgaaccgtttcccgaacgtcgaatattctaatactacaccgtaaaactacgctaaaattttcccctaatttatcgaccatccctcgc

SEQ ID NO: 22291 - DNA, 596 bp, Artificial Sequence
  chemically treated genomic DNA (Homo sapiens) CpG-island No: 22291
agtttcgttaggtttttatttattggtcgatatgttaattattgtagtcgttgtttgatagtttcgtggtagttgacgtcgaacgggttcgtcgtcgtttgttatgttagttatcgttttatgtattatatggggcgcgcggtcgcgtattgtgttagtttttatagtcgtattttttttgtgcgtgtagttcggttatttggcgtggtattgtcgtttttacgttttttcgtttgtttgggtcgcggtggtttttgtatagtggggttatgtacgtttacgttttttcgtagttggttttaaatcgtgttttattttgtcggtttaggttatgtttttttttttcgttttaattatatcgtcggtttttttttaacgttcgttttggcgcggggtattcggttatgttttgtcgttgtaggtttttaagtcgcgtattcgttttcgtatttatgttcgtttgggtagttaaggttgtttatttattatcgttggcgggtgggttttttcgggtcgtttttcgggcgtcgagtattttagtattgtatcgtgggattacgttaaggtttttttttaatttgtcggttatttttcgt

SEQ ID NO: 22292 - DNA, 596 bp, Artificial Sequence
  chemically treated genomic DNA (Homo sapiens) CpG-island No: 22292
acgaaaaataaccgacaaattaaaaaaaaaccttaacgtaatcccacgatacaatactaaaatactcgacgcccgaaaaacgacccgaaaaaacccacccgccaacgataataaataaacaaccttaactacccaaacgaacataaatacgaaaacgaatacgcgacttaaaaacctacaacgacaaaacataaccgaataccccgcgccaaaacgaacgttaaaaaaaaaccgacgatataattaaaacgaaaaaaaaaaacataacctaaaccgacaaaataaaacacgatttaaaaccaactacgaaaaaacgtaaacgtacataaccccactatacaaaaaccaccgcgacccaaacaaacgaaaaaacgtaaaaacgacaataccacgccaaataaccgaactacacgcacaaaaaaaatacgactataaaaactaacacaatacgcgaccgcgcgccccatataatacataaaacgataactaacataacaaacgacgacgaacccgttcgacgtcaactaccacgaaactatcaaacaacgactacaataattaacatatcgaccaataaataaaaacctaacgaaact

SEQ ID NO: 22293 - DNA, 530 bp, Artificial Sequence
  chemically treated genomic DNA (Homo sapiens) CpG-island No: 22293
  misc_feature (472)..(472): n is either a, c, g or t
gagattacgattacgacgattacgtcgacgatttggaaaacgaggacgacgcgacggcgatatttacggcgttgttattgcgttcggtataagttaagcgatcgtttgttttgtttttttatttatgatttataggatttgttgtaaatcgttttcgttattcggcgatgtaacgttatgcgtaatcgcgttgcgtataggagattacgggttacgtatagaggggaggggtggcggtatttagtgtttacgagtggtagtagatgggcgcgggtttcgattaggtcgcgcgcggtggatcgggtggcgtaggggacgcgtaggggtgtggtggggtttgtggttgtttgggtcgcgagtttatcggtcgtggggcgtttgtgtgacgcggggtagcgggggtttgacggattattacgttagcgtttttcggcgttcggtcgtttttgtttggttaattgattattgttangtatagcgtcgattttaagtagattatcgaagaaagaagaatatatgtagggaggaat

SEQ ID NO: 22294 - DNA, 530 bp, Artificial Sequence
  chemically treated genomic DNA (Homo sapiens) CpG-island No: 22294
  misc_feature (59)..(59): n is either a, c, g or t
attcctccctacatatattcttctttcttcgataatctacttaaaatcgacgctatacntaacaataatcaattaaccaaacaaaaacgaccgaacgccgaaaaacgctaacgtaataatccgtcaaacccccgctaccccgcgtcacacaaacgccccacgaccgataaactcgcgacccaaacaaccacaaaccccaccacacccctacgcgtcccctacgccacccgatccaccgcgcgcgacctaatcgaaacccgcgcccatctactaccactcgtaaacactaaataccgccacccctcccctctatacgtaacccgtaatctcctatacgcaacgcgattacgcataacgttacatcgccgaataacgaaaacgatttacaacaaatcctataaatcataaataaaaaaacaaaacaaacgatcgcttaacttataccgaacgcaataacaacgccgtaaatatcgccgtcgcgtcgtcctcgttttccaaatcgtcgacgtaatcgtcgtaatcgtaatctc

SEQ ID NO: 22295 - DNA, 530 bp, Artificial Sequence
  chemically treated genomic DNA (Homo sapiens) CpG-island No: 22295
  misc_feature (59)..(59): n is either a, c, g or t
gtttttttttgtatatattttttttttttcggtagtttgtttaaaatcggcgttatatntggtagtagttagttagttaggtaggaacggtcgagcgtcggggggcgttgacgtagtggttcgttaggttttcgttgtttcgcgttatatagacgttttacggtcggtaggttcgcgatttaaatagttatagattttattatatttttgcgcgttttttgcgttattcgatttatcgcgcgcgatttagtcgaagttcgcgtttatttgttattattcgtgggtattaggtatcgttattttttttttttatacgtaattcgtggttttttgtacgtaacgcggttgcgtatggcgttatatcgtcgggtggcgaaggcggtttatagtaaattttgtaagttataggtggagaggtaaggtaagcggtcgtttaatttatatcgggcgtaatggtaacgtcgtaaatgtcgtcgtcgcgtcgttttcgttttttaggtcgtcggcgtagtcgtcgtagtcgtagtttt

SEQ ID NO: 22296 - DNA, 530 bp, Artificial Sequence
  chemically treated genomic DNA (Homo sapiens) CpG-island No: 22296
  misc_feature (472)..(472): n is either a, c, g or t
aaaactacgactacgacgactacgccgacgacctaaaaaacgaaaacgacgcgacgacgacatttacgacgttaccattacgcccgatataaattaaacgaccgcttaccttacctctccacctataacttacaaaatttactataaaccgccttcgccacccgacgatataacgccatacgcaaccgcgttacgtacaaaaaaccacgaattacgtataaaaaaaaaaaataacgatacctaatacccacgaataataacaaataaacgcgaacttcgactaaatcgcgcgcgataaatcgaataacgcaaaaaacgcgcaaaaatataataaaatctataactatttaaatcgcgaacctaccgaccgtaaaacgtctatataacgcgaaacaacgaaaacctaacgaaccactacgtcaacgccccccgacgctcgaccgttcctacctaactaactaactactaccanatataacgccgattttaaacaaactaccgaaaaaaaaaaaatatatacaaaaaaaaac

SEQ ID NO: 22297 - DNA, 651 bp, Artificial Sequence
  chemically treated genomic DNA (Homo sapiens) CpG-island No: 22297
  misc_feature (624)..(625): n is either a, c, g or t
tttattatttggttcgaggatgcgttcgtggtgtcgtattcgattattatttgcgtaggagatgcgttcgtcgagtcgtattcgtttattatttgcgtaggaggatgcgtcgtcgagtcgtattcgtttattaattgcgtaggaggatgcgttcgtcggtcgtattcgtttattatttgcgtaggaggatgcgttcgtcgagtcgtatcgttgattatttgcgtaggaggatgcgttcgtcgagtcgtattcgtttttatttgtatacgaagatgcgttcgtcgagtcgtattcgtttattatttcgtaggaggatgcgttcgtcgagtcgtattcgtttattatttgcgtaggggatgcgttcgtcgagtcgtattcgtttattatttgtatacgaagatgcgtcgtcgagtggtattcgtgttttttttgcgcgcggagatggtttgtaaattgaatatttataggtggtcggttgttaattgattattgttatcgtatagcgtcgatttttgttatatgtttttaacggttatattgggggcgtggcgttagagagttgagggggtcgttgaaagggatgttattgaagattagattataacgtgtcggggtagaaaaggnnatatttaaaatgtggcgggcgaaaaa

SEQ ID NO: 22298 - DNA, 651 bp, Artificial Sequence
  chemically treated genomic DNA (Homo sapiens) CpG-island No: 22298
  misc_feature (27)..(28): n is either a, c, g or t
tttttcgcccgccacattttaaatatnnccttttctaccccgacacgttataatctaatcttcaataacatccctttcaacgaccccctcaactctctaacgccacgcccccaatataaccgttaaaaacatataacaaaaatcgacgctatacgataacaataatcaattaacaaccgaccacctataaatattcaatttacaaaccatctccgcgcgcaaaaaaaacacgaataccactcgacgacgcatcttcgtatacaaataataaacgaatacgactcgacgaacgcatcccctacgcaaataataaacgaatacgactcgacgaacgcatcctcctacgaaataataaacgaatacgactcgacgaacgcatcttcgtatacaaataaaaacgaatacgactcgacgaacgcatcctcctacgcaaataatcaacgatacgactcgacgaacgcatcctcctacgcaaataataaacgaatacgaccgacgaacgcatcctcctacgcaattaataaacgaatacgactcgacgacgcatcctcctacgcaaataataaacgaatacgactcgacgaacgcatctcctacgcaaataataatcgaatacgacaccacgaacgcatcctcgaaccaaataataaa

SEQ ID NO: 22299 - DNA, 651 bp, Artificial Sequence
  chemically treated genomic DNA (Homo sapiens) CpG-island No: 22299
  misc_feature (27)..(28): n is either a, c, g or t
tttttcgttcgttatattttaggtgtnnttttttttatttcggtacgttatgatttggtttttaataatattttttttagcgatttttttagttttttgacgttacgtttttagtgtagtcgttagaagtatgtaataaaaatcggcgttatacgatggtagtagttagttagtagtcggttatttgtaggtatttagtttgtaggttattttcgcgcgtaaggggggtacgggtgttattcgacgacgtattttcgtatgtaaatggtgaacgggtgcgattcgacgaacgtattttttacgtaaatggtgaacgggtgcgattcgacgaacgtatttttttacgaaatggtgaacgggtgcgattcgacgaacgtattttcgtatgtaaatgggaacgggtgcgattcgacgaacgtatttttttacgtaaatggttaacggtgcgattcgacgaacgtatttttttacgtaaatggtgaacgggtgcgatcgacgaacgtatttttttacgtaattggtgaacgggtgcgattcgacgacgtatttttttacgtaaatggtgaacgggtgcgattcgacgaacgtattttttacgtaaatggtgatcgggtgcgatattacgaacgtattttcgaattaaatggtgaa

SEQ ID NO: 22300 - DNA, 651 bp, Artificial Sequence
  chemically treated genomic DNA (Homo sapiens) CpG-island No: 22300
  misc_feature (624)..(625): n is either a, c, g or t
ttcaccatttaattcgaaaatacgttcgtaatatcgcacccgatcaccatttacgtaaaaaatacgttcgtcgaatcgcacccgttcaccatttacgtaaaaaaatacgtcgtcgaatcgcacccgttcaccaattacgtaaaaaaatacgttcgtcgatcgcacccgttcaccatttacgtaaaaaaatacgttcgtcgaatcgcaccgttaaccatttacgtaaaaaaatacgttcgtcgaatcgcacccgttcccatttacatacgaaaatacgttcgtcgaatcgcacccgttcaccatttcgtaaaaaaatacgttcgtcgaatcgcacccgttcaccatttacgtaaaaaatacgttcgtcgaatcgcacccgttcaccatttacatacgaaaatacgtcgtcgaataacacccgtaccccccttacgcgcgaaaataacctacaaactaaatacctacaaataaccgactactaactaactactaccatcgtataacgccgatttttattacatacttctaacgactacactaaaaacgtaacgtcaaaaaactaaaaaaatcgctaaaaaaaatattattaaaaaccaaatcataacgtaccgaaataaaaaaaannacacctaaaatataacgaacgaaaaa

SEQ ID NO: 22301 - DNA, 732 bp, Artificial Sequence
  chemically treated genomic DNA (Homo sapiens) CpG-island No: 22301
  misc_feature (561)..(561): n is either a, c, g or t
ttattgttcggggatggggagtaagtttagttagtcgttgttttcggtgtcgcgtgcgtagttgtacgttatttttagacgaatcgatgattggatgatggtcgtcgtagtcgttatattgatgatacggatgtgttttttcgtaatattatgttatcggagagttgttaacgtatggttatcgtcgggtatggcgttgtttcgtagataggtagaatttgatggtatgtttgcgattaatgtaaacgtgtttatcggattatgcgttagaatgcgttgttgtttgagcgaaatttgttgtatcgttatcgaaacgggtatatataggtagagtggtcgtgaagaaagtaattagcgatggtgttttgacgggttcgagttttgttgtgaaacggagagagattgcgtgttacgttcgcgttggattgttgtgatcgtgggtattgtattgggcggttattatcggcggttttaatagtgaaatagtaaggacgttatgttgggagcggtggaacgtcgtttcggtaacgatttttttcgtttttagtggagtggttgatnggataatggtttatgttatcgggttatgaaatacgttagttcgttcggatgttgggatttgaatcgaagatacggtgcggagttcggagagtaacggaggttcggttattgttattgatttattgttatcgtatagcgtcgatttttcgtatagtacgtacgtgtttatat

SEQ ID NO: 22302 - DNA, 732 bp, Artificial Sequence
  chemically treated genomic DNA (Homo sapiens) CpG-island No: 22302
  misc_feature (172)..(172): n is either a, c, g or t
atataaacacgtacgtactatacgaaaaatcgacgctatacgataacaataaatcaataacaataaccgaacctccgttactctccgaactccgcaccgtatcttcgattcaaatcccaacatccgaacgaactaacgtatttcataacccgataacataaaccattatccnatcaaccactccactaaaaacgaaaaaaatcgttaccgaaacgacgttccaccgctcccaacataacgtccttactatttcactattaaaaccgccgataataaccgcccaatacaatacccacgatcacaacaatccaacgcgaacgtaacacgcaatctctctccgtttcacaacaaaactcgaacccgtcaaaacaccatcgctaattactttcttcacgaccactctacctatatatacccgtttcgataacgatacaacaaatttcgctcaaacaacaacgcattctaacgcataatccgataaacacgtttacattaatcgcaaacataccatcaaattctacctatctacgaaacaacgccatacccgacgataaccatacgttaacaactctccgataacataatattacgaaaaaacacatccgtatcatcaatataacgactacgacgaccatcatccaatcatcgattcgtctaaaaataacgtacaactacgcacgcgacaccgaaaacaacgactaactaaacttactccccatccccgaacaataa

SEQ ID NO: 22303 - DNA, 732 bp, Artificial Sequence
  chemically treated genomic DNA (Homo sapiens) CpG-island No: 22303
  misc_feature (172)..(172): n is either a, c, g or t
gtataagtacgtacgtattgtacggaaaatcggcgttatacgatggtagtaagttagtagtaatagtcggattttcgttatttttcggatttcgtatcgtgttttcggtttaagttttaatattcgggcgaattggcgtgttttatagttcggtagtatgaattattatttngttagttattttattggagacgaggaagatcgttgtcgaagcggcgttttatcgtttttagtatgacgtttttattgttttattgttgaagtcgtcggtagtgatcgtttagtgtagtgtttacgattatagtagtttagcgcgaacgtgatacgtagttttttttcgttttatagtagaattcgaattcgttagagtattatcgttgattgttttttttacggttattttgtttgtatgtgttcgtttcgatggcggtatagtaggtttcgtttaagtaatagcgtattttggcgtatgattcggtaaatacgtttgtattgatcgtaggtatattattaagttttgtttgtttgcgaagtagcgttatattcgacgataattatacgttggtagtttttcgataatatggtgttacggagaagtatattcgtattattagtgtgacgattgcggcggttattatttagttatcggttcgtttgagaatgacgtgtaattgcgtacgcgatatcggagataacggttgattaagtttattttttattttcgggtaataa

SEQ ID NO: 22304 - DNA, 732 bp, Artificial Sequence
  chemically treated genomic DNA (Homo sapiens) CpG-island No: 22304
  misc_feature (561)..(561): n is either a, c, g or t
ttattacccgaaaataaaaaataaacttaatcaaccgttatctccgatatcgcgtacgcaattacacgtcattctcaaacgaaccgataactaaataataaccgccgcaatcgtcacactaataatacgaatatacttctccgtaacaccatattatcgaaaaactaccaacgtataattatcgtcgaatataacgctacttcgcaaacaaacaaaacttaataatatacctacgatcaatacaaacgtatttaccgaatcatacgccaaaatacgctattacttaaacgaaacctactataccgccatcgaaacgaacacatacaaacaaaataaccgtaaaaaaaacaatcaacgataatactctaacgaattcgaattctactataaaacgaaaaaaaactacgtatcacgttcgcgctaaactactataatcgtaaacactacactaaacgatcactaccgacgacttcaacaataaaacaataaaaacgtcatactaaaaacgataaaacgccgcttcgacaacgatcttcctcgtctccaataaaataactaacnaaataataattcatactaccgaactataaaacacgccaattcgcccgaatattaaaacttaaaccgaaaacacgatacgaaatccgaaaaataacgaaaatccgactattactactaacttactaccatcgtataacgccgattttccgtacaatacgtacgtacttatac

SEQ ID NO: 22305 - DNA, 664 bp, Artificial Sequence
  chemically treated genomic DNA (Homo sapiens) CpG-island No: 22305
cgtcgggtatggttgatgcgtatatttatatttttgaatcgggtcgtagttattgggaaggttatgaaatcggtattcgcgtagcggtaaaaggtggtattattattatgatcgaaatgtcgtttaattagttgtttgtaacggttgatcgcgttttaattgaattgaagttcgatgtcgttaaaggtaagttgattattgatgcggtataattcggtggtttggtgttttataatatcgatcgtttgtatgagttggatgaagtgggcgttgtcggttttaaatgtttcgttgcgatttgtggcgatcgcggtatcgataacgattttcgtgatgtaaacgattggtagttttttaaaggtgcgtagaagttgggcgaattgggttagtcggtgttggtgtattgcgaaaacgcgttgatttgtgacgaattgggcgaagaagcgaagcgtgaaggtcgcgtaatcgtttatgattatgtggtttcgcgttcggtatttatcgaagtggaagtaattcgtcgcgtattgtatttggcgaaagttgttggttgtcgtttgtacgtttgttacgttagtagttcggaaggtgttgaggaagtgattcgtgtacgttaggaaggttagacgtatatgtgatgggattaggttattgtaaaaaaaaa

SEQ ID NO: 22306 - DNA, 664 bp, Artificial Sequence
  chemically treated genomic DNA (Homo sapiens) CpG-island No: 22306
tttttttttacaataacctaatcccatcacatatacgtctaaccttcctaacgtacacgaatcacttcctcaacaccttccgaactactaacgtaacaaacgtacaaacgacaaccaacaactttcgccaaatacaatacgcgacgaattacttccacttcgataaataccgaacgcgaaaccacataatcataaacgattacgcgaccttcacgcttcgcttcttcgcccaattcgtcacaaatcaacgcgttttcgcaatacaccaacaccgactaacccaattcgcccaacttctacgcacctttaaaaaactaccaatcgtttacatcacgaaaatcgttatcgataccgcgatcgccacaaatcgcaacgaaacatttaaaaccgacaacgcccacttcatccaactcatacaaacgatcgatattataaaacaccaaaccaccgaattataccgcatcaataatcaacttacctttaacgacatcgaacttcaattcaattaaaacgcgatcaaccgttacaaacaactaattaaacgacatttcgatcataataataataccaccttttaccgctacgcgaataccgatttcataaccttcccaataactacgacccgattcaaaaatataaatatacgcatcaaccatacccgacg

SEQ ID NO: 22307 - DNA, 664 bp, Artificial Sequence
  chemically treated genomic DNA (Homo sapiens) CpG-island No: 22307
tttttttttataatagtttggttttattatatgtacgtttgatttttttgacgtgtacgagttatttttttaatatttttcgggttgttgacgtggtaaacgtgtagacggtaattagtaattttcgttagatatagtacgcggcgaattgtttttatttcggtaaatatcggacgcgaagttatatagttatgagcggttacgcgatttttacgtttcgttttttcgtttagttcgttataaattagcgcgttttcgtagtgtattagtatcggttgatttagttcgtttagtttttgcgtatttttgaagaattgttagtcgtttatattacggaagtcgttgtcgatatcgcgatcgttataggtcgtaacgaagtatttgaagtcgataacgtttattttatttagtttatgtagacggtcgatgttgtaagatattaggttatcgagttgtgtcgtattaatagttagtttgtttttagcggtatcgaattttagtttaattgaagcgcggttaatcgttgtaggtagttggttgagcggtatttcgattatggtggtgatattattttttgtcgttgcgcgagtatcggttttataatttttttagtggttacgattcggtttagaaatatgggtgtgcgtattaattatgttcggcg

SEQ ID NO: 22308 - DNA, 664 bp, Artificial Sequence
  chemically treated genomic DNA (Homo sapiens) CpG-island No: 22308
cgccgaacataattaatacgcacacccatatttctaaaccgaatcgtaaccactaaaaaaattataaaaccgatactcgcgcaacgacaaaaaataatatcaccaccataatcgaaataccgctcaaccaactacctacaacgattaaccgcgcttcaattaaactaaaattcgataccgctaaaaacaaactaactattaatacgacacaactcgataacctaatatcttacaacatcgaccgtctacataaactaaataaaataaacgttatcgacttcaaatacttcgttacgacctataacgatcgcgatatcgacaacgacttccgtaatataaacgactaacaattcttcaaaaatacgcaaaaactaaacgaactaaatcaaccgatactaatacactacgaaaacgcgctaatttataacgaactaaacgaaaaaacgaaacgtaaaaatcgcgtaaccgctcataactatataacttcgcgtccgatatttaccgaaataaaaacaattcgccgcgtactatatctaacgaaaattactaattaccgtctacacgtttaccacgtcaacaacccgaaaaatattaaaaaaataactcgtacacgtcaaaaaaatcaaacgtacatataataaaaccaaactattataaaaaaaaa

SEQ ID NO: 22309 - DNA, 1032 bp, Artificial Sequence
  chemically treated genomic DNA (Homo sapiens) CpG-island No: 22309
ttaggggaattcggaaaattagtttcgcgcgtatcggagagggggaggggaggggacggtcgtcgggagtttttcgggttttcgggtaatcggcgtcgttttcgtatatcggacggtagtagtattcggtcggtcgggggtcgaggacgttgttcgggcgttcggcgagtttcggtcgcgttaggtcgttatcgtttttttttcgttgtttttagagtcgggcggtagggttattgtttcgatagcgtttgtcgcgtttttcgttcgcgacgtcgttgtcgtcgttattcggagtcggagtcgaggagtcgggtaggtttaatagcggtttttttttcgggtcgttcgtcgggtcgttcgttttttcgttcgttttttttcgttttttttattcgttttcgaattttttttttttttttttttcgttttttcgttatcgttttttcgttgttttgtttgttttttttcgttagcggcggtggtttttcgagacgcgtagggggcgggagtaggaggtagtttcgtttttttacgagtttgcggggtcgcggtaggggtcgagattgcgtttcgcgtcgtcgcgttatatttattcgagcgagagacggcgaggggagggaggacggagggagcggagagaaaggaggaggaatggggtaggggcggaggggagttattgttttataggtcgcggcggtaatagcgttatcgtttcggtcgcgacgggtgaagaggttgcgcgtcgcgattttgcggcgggggcgggggcggggcggtttttcgtcggtttcgttttaatcgttaatagtcgggtaggaggtttgcgcgggttagttagcgcgcgggggcggtgcgggtcgacgtcggcggttgggggtagcgggtcgggggtcgggggaggggtagtcggcggtcgtgggttcgcgtgtaaggcgcgtcgtgaggtttattttggtttaggtttttcgaggtttgttcgttgttttttgttcgtttttcgatttcgtattttcggattttcgagttttttag

SEQ ID NO: 22310 - DNA, 1032 bp, Artificial Sequence
  chemically treated genomic DNA (Homo sapiens) CpG-island No: 22310
ctaaaaaactcgaaaatccgaaaatacgaaatcgaaaaacgaacaaaaaacaacgaacaaacctcgaaaaacctaaaccaaaataaacctcacgacgcgccttacacgcgaacccacgaccgccgactacccctcccccgacccccgacccgctacccccaaccgccgacgtcgacccgcaccgcccccgcgcgctaactaacccgcgcaaacctcctacccgactattaacgattaaaacgaaaccgacgaaaaaccgccccgcccccgcccccgccgcaaaatcgcgacgcgcaacctcttcacccgtcgcgaccgaaacgataacgctattaccgccgcgacctataaaacaataactcccctccgcccctaccccattcctcctcctttctctccgctccctccgtcctccctcccctcgccgtctctcgctcgaataaatataacgcgacgacgcgaaacgcaatctcgacccctaccgcgaccccgcaaactcgtaaaaaaacgaaactacctcctactcccgccccctacgcgtctcgaaaaaccaccgccgctaacgaaaaaaaacaaacaaaacaacgaaaaaacgataacgaaaaaacgaaaaaaaaaaaaaaaaaaaattcgaaaacgaataaaaaaaacgaaaaaaaacgaacgaaaaaacgaacgacccgacgaacgacccgaaaaaaaaaccgctattaaacctacccgactcctcgactccgactccgaataacgacgacaacgacgtcgcgaacgaaaaacgcgacaaacgctatcgaaacaataaccctaccgcccgactctaaaaacaacgaaaaaaaaacgataacgacctaacgcgaccgaaactcgccgaacgcccgaacaacgtcctcgacccccgaccgaccgaatactactaccgtccgatatacgaaaacgacgccgattacccgaaaacccgaaaaactcccgacgaccgtcccctcccctccccctctccgatacgcgcgaaactaattttccgaattcccctaa

SEQ ID NO: 22311 - DNA, 1032 bp, Artificial Sequence
  chemically treated genomic DNA (Homo sapiens) CpG-island No: 22311
ttggggggttcgggagttcgggagtgcggggtcggggagcgggtagggagtagcgggtaggtttcgaggggtttgggttagagtgggttttacggcgcgttttgtacgcgaatttacggtcgtcggttgtttttttttcggttttcggttcgttgtttttagtcgtcgacgtcggttcgtatcgttttcgcgcgttgattggttcgcgtaggttttttgttcggttgttggcggttggggcgaagtcggcgggaggtcgtttcgttttcgttttcgtcgtagagtcgcggcgcgtagtttttttattcgtcgcggtcggggcggtggcgttgttgtcgtcgcggtttgtgaggtagtaattttttttcgtttttgttttattttttttttttttttttcgtttttttcgtttttttttttttcgtcgtttttcgttcgagtgaatgtggcgcggcggcgcgggacgtagtttcggtttttgtcgcggtttcgtaagttcgtgaggagacggagttgttttttgttttcgttttttgcgcgtttcggggagttatcgtcgttggcgaaggagaataagtagggtagcggagggacggtggcgggaaaacgggagagggaggagaagagggttcgagggcgagtagggaaagcggggagggacggacggaaggacggacggttcgacggacggttcggggagggggtcgttattgagtttgttcgatttttcggtttcggtttcgggtggcggcggtagcggcgtcgcggacgaagggcgcggtaagcgttatcgagataataattttgtcgttcggttttgggggtaacggagaggaagcggtggcggtttagcgcggtcgaggttcgtcgagcgttcgggtagcgttttcggttttcggtcggtcgggtgttgttgtcgttcggtgtgcgggggcggcgtcggttgttcggaaattcgaagggttttcggcggtcgttttttttttttttttttttcggtgcgcgcggagttggtttttcgggtttttttgg

SEQ ID NO: 22312 - DNA, 1032 bp, Artificial Sequence
  chemically treated genomic DNA (Homo sapiens) CpG-island No: 22312
ccaaaaaaacccgaaaaaccaactccgcgcgcaccgaaaaaaaaaaaaaaaaaaaacgaccgccgaaaacccttcgaatttccgaacaaccgacgccgcccccgcacaccgaacgacaacaacacccgaccgaccgaaaaccgaaaacgctacccgaacgctcgacgaacctcgaccgcgctaaaccgccaccgcttcctctccgttacccccaaaaccgaacgacaaaattattatctcgataacgcttaccgcgcccttcgtccgcgacgccgctaccgccgccacccgaaaccgaaaccgaaaaatcgaacaaactcaataacgaccccctccccgaaccgtccgtcgaaccgtccgtccttccgtccgtccctccccgctttccctactcgccctcgaaccctcttctcctccctctcccgttttcccgccaccgtccctccgctaccctacttattctccttcgccaacgacgataactccccgaaacgcgcaaaaaacgaaaacaaaaaacaactccgtctcctcacgaacttacgaaaccgcgacaaaaaccgaaactacgtcccgcgccgccgcgccacattcactcgaacgaaaaacgacgaaaaaaaaaaaaacgaaaaaaacgaaaaaaaaaaaaaaaaaataaaacaaaaacgaaaaaaaattactacctcacaaaccgcgacgacaacaacgccaccgccccgaccgcgacgaataaaaaaactacgcgccgcgactctacgacgaaaacgaaaacgaaacgacctcccgccgacttcgccccaaccgccaacaaccgaacaaaaaacctacgcgaaccaatcaacgcgcgaaaacgatacgaaccgacgtcgacgactaaaaacaacgaaccgaaaaccgaaaaaaaaacaaccgacgaccgtaaattcgcgtacaaaacgcgccgtaaaacccactctaacccaaacccctcgaaacctacccgctactccctacccgctccccgaccccgcactcccgaactcccgaaccccccaa

SEQ ID NO: 22313 - DNA, 672 bp, Artificial Sequence
  chemically treated genomic DNA (Homo sapiens) CpG-island No: 22313
ggttcgtttataaagcggtggtcgcgaattatcgatcggattgaatgtttagaatggttgtcggaatgattttgtcgtttatagtagggttacggtgtgtatcggacgtacgaagtgtacgtcgtttgcgtttaacgtattagtttcgggatcggtagtttcgttagagaagtcgtaatatattcggtagtagtgtttcggtgttttcgttttttatatgggcgcgattagtagttattcgtttttatcggtagttagacgtttagtttggttaacgtaatatcgtaattacgcgtttaattttttgtcgttttgttcggtttggtttagcgtcgaacgtttggggtatcgtcggggcgcgtttttcgattttatattcggttgcgtttcgttaggttagtatttttacggtcgacgaagcgagagtaattttgaacggtgtcggtgcgagtatcgtttttttttcgcgtaagtgtcgtacgattttacgttggtcgggttggggggttattcgggtaattataaagtttttaatatcgtttttatttgtgatacgaatagggtcgtaagatgttttcgcggtcggattaaatttacgcgggagattattagggggaacgggggagtagttttaagaaaaagaggtagtgttgttgtggttgttttagagga

SEQ ID NO: 22314 - DNA, 672 bp, Artificial Sequence
  chemically treated genomic DNA (Homo sapiens) CpG-island No: 22314
tcctctaaaacaaccacaacaacactacctctttttcttaaaactactcccccgttccccctaataatctcccgcgtaaatttaatccgaccgcgaaaacatcttacgaccctattcgtatcacaaataaaaacgatattaaaaactttataattacccgaataaccccccaacccgaccaacgtaaaatcgtacgacacttacgcgaaaaaaaaacgatactcgcaccgacaccgttcaaaattactctcgcttcgtcgaccgtaaaaatactaacctaacgaaacgcaaccgaatataaaatcgaaaaacgcgccccgacgataccccaaacgttcgacgctaaaccaaaccgaacaaaacgacaaaaaattaaacgcgtaattacgatattacgttaaccaaactaaacgtctaactaccgataaaaacgaataactactaatcgcgcccatataaaaaacgaaaacaccgaaacactactaccgaatatattacgacttctctaacgaaactaccgatcccgaaactaatacgttaaacgcaaacgacgtacacttcgtacgtccgatacacaccgtaaccctactataaacgacaaaatcattccgacaaccattctaaacattcaatccgatcgataattcgcgaccaccgctttataaacgaacc

SEQ ID NO: 22315 - DNA, 672 bp, Artificial Sequence
  chemically treated genomic DNA (Homo sapiens) CpG-island No: 22315
ttttttagagtaattatagtagtattgttttttttttttgaggttgttttttcgttttttttggtggtttttcgcgtgaatttggttcgatcgcggggatattttgcgattttgttcgtgttatagataaaggcggtattggaaattttgtgattgttcgagtggttttttaattcggttagcgtgggatcgtgcggtatttacgcggaggggaaacggtgttcgtatcggtatcgtttaaggttgttttcgtttcgtcggtcgtgaaagtattaatttggcgaagcgtaatcggatgtgaaatcgaaaaacgcgtttcggcgatgttttaggcgttcgacgttgagttaaatcgagtaaagcggtagaagattgggcgcgtggttgcggtattacgttgattaggttgagcgtttgattatcgataaaggcgaatggttgttgatcgcgtttatgtgaagggcgaaagtatcgaagtattgttgtcgaatatgttgcgatttttttggcgaaattgtcgatttcgaaattgatgcgttgggcgtaagcgacgtgtatttcgtgcgttcggtgtatatcgtgattttgttgtgggcgataaagttatttcggtaattattttgggtatttagttcgatcggtgattcgcggttatcgttttatgggcgagtt

SEQ ID NO: 22316 - DNA, 672 bp, Artificial Sequence
  chemically treated genomic DNA (Homo sapiens) CpG-island No: 22316
aactcgcccataaaacgataaccgcgaatcaccgatcgaactaaatacccaaaataattaccgaaataactttatcgcccacaacaaaatcacgatatacaccgaacgcacgaaatacacgtcgcttacgcccaacgcatcaatttcgaaatcgacaatttcgccaaaaaaatcgcaacatattcgacaacaatacttcgatactttcgcccttcacataaacgcgatcaacaaccattcgcctttatcgataatcaaacgctcaacctaatcaacgtaataccgcaaccacgcgcccaatcttctaccgctttactcgatttaactcaacgtcgaacgcctaaaacatcgccgaaacgcgtttttcgatttcacatccgattacgcttcgccaaattaatactttcacgaccgacgaaacgaaaacaaccttaaacgataccgatacgaacaccgtttcccctccgcgtaaataccgcacgatcccacgctaaccgaattaaaaaaccactcgaacaatcacaaaatttccaataccgcctttatctataacacgaacaaaatcgcaaaatatccccgcgatcgaaccaaattcacgcgaaaaaccaccaaaaaaaacgaaaaaacaacctcaaaaaaaaaaaacaatactactataattactctaaaaaa

SEQ ID NO: 22317 - DNA, 633 bp, Artificial Sequence
  chemically treated genomic DNA (Homo sapiens) CpG-island No: 22317
cggatgttcggtagggtatagtagtggcggtaggtgcgtggacgggtcggttgtgtttattaaacgggttgtgcgcgtttaaaaaggggtatgttaaaacggcgtacggttcgaaattgtttcggacgagataggtacggaatggtcgacggagtcgtaagtttgtttgggcgttttagttgcgtagaattttcgttggcgcgttttgattacggaattggcgatcggggttatcggtgtgcggttacgtttatttggcgcggcgacgtcgttatcgtttgtgattacgggtcgtaattcgtttagacggtcggatagttaatatttacgtcgtggacggcgtttgattgggttaaaacgtattcgcgttgacgaagcgaattattttgtgtatatcgcgggcggaagggttcgggagcgtagggcgcgcgcggtatgaaggtcgtttatacggttagtttgtcgcggttgagaggatatttgttatgggaagttgttgttttcggatcgcggggacggtgtgaaacgcgttaagatggaagggaagtaatatgttgaaatattttgtcggaaaattagatggttatttgtggatgttggagttggtcggggcgcgagtgatttttaagggga

SEQ ID NO: 22318 - DNA, 633 bp, Artificial Sequence
  chemically treated genomic DNA (Homo sapiens) CpG-island No: 22318
tccccttaaaaatcactcgcgccccgaccaactccaacatccacaaataaccatctaattttccgacaaaatatttcaacatattacttcccttccatcttaacgcgtttcacaccgtccccgcgatccgaaaacaacaacttcccataacaaatatcctctcaaccgcgacaaactaaccgtataaacgaccttcataccgcgcgcgccctacgctcccgaacccttccgcccgcgatatacacaaaataattcgcttcgtcaacgcgaatacgttttaacccaatcaaacgccgtccacgacgtaaatattaactatccgaccgtctaaacgaattacgacccgtaatcacaaacgataacgacgtcgccgcgccaaataaacgtaaccgcacaccgataaccccgatcgccaattccgtaatcaaaacgcgccaacgaaaattctacgcaactaaaacgcccaaacaaacttacgactccgtcgaccattccgtacctatctcgtccgaaacaatttcgaaccgtacgccgttttaacatacccctttttaaacgcgcacaacccgtttaataaacacaaccgacccgtccacgcacctaccgccactactataccctaccgaacatccg

SEQ ID NO: 22319 - DNA, 633 bp, Artificial Sequence
  chemically treated genomic DNA (Homo sapiens) CpG-island No: 22319
tttttttagggattattcgcgtttcggttagttttaatatttataagtggttatttaatttttcggtaaagtgttttaatatattattttttttttattttggcgcgttttatatcgttttcgcggttcgggagtagtagttttttatggtaaatgtttttttagtcgcggtaagttggtcgtgtaggcggtttttatgtcgcgcgcgttttacgttttcgggttttttcgttcgcggtgtgtataaggtagttcgtttcgttagcgcgggtgcgttttggtttaattaagcgtcgtttacggcgtaaatattggttattcggtcgtttgagcgagttacggttcgtaattataagcggtagcggcgtcgtcgcgttaggtgggcgtggtcgtatatcggtagtttcggtcgttaatttcgtggttagggcgcgttagcgggaattttacgtagttggggcgtttaggtaagtttgcggtttcgtcggttatttcgtgtttatttcgttcggggtaatttcgggtcgtacgtcgttttggtatatttttttttaagcgcgtatagttcgtttagtgggtatagtcggttcgtttacgtatttgtcgttattgttgtgttttgtcgggtattcg

SEQ ID NO: 22320 - DNA, 633 bp, Artificial Sequence
  chemically treated genomic DNA (Homo sapiens) CpG-island No: 22320
cgaatacccgacaaaacacaacaataacgacaaatacgtaaacgaaccgactatacccactaaacgaactatacgcgcttaaaaaaaaatataccaaaacgacgtacgacccgaaattaccccgaacgaaataaacacgaaataaccgacgaaaccgcaaacttacctaaacgccccaactacgtaaaattcccgctaacgcgccctaaccacgaaattaacgaccgaaactaccgatatacgaccacgcccacctaacgcgacgacgccgctaccgcttataattacgaaccgtaactcgctcaaacgaccgaataaccaatatttacgccgtaaacgacgcttaattaaaccaaaacgcacccgcgctaacgaaacgaactaccttatacacaccgcgaacgaaaaaacccgaaaacgtaaaacgcgcgcgacataaaaaccgcctacacgaccaacttaccgcgactaaaaaaacatttaccataaaaaactactactcccgaaccgcgaaaacgatataaaacgcgccaaaataaaaaaaaaataatatattaaaacactttaccgaaaaattaaataaccacttataaatattaaaactaaccgaaacgcgaataatccctaaaaaaa

SEQ ID NO: 22321 - DNA, 748 bp, Artificial Sequence
  chemically treated genomic DNA (Homo sapiens) CpG-island No: 22321
gtatacgtcggggtttagggttcgtttcgttgttattgattttaagtaacgtatagcgtcgatttgggggtagtggtcggattaagtgtgtataattattcggagagaagatcgttaatttggggagaaaggggatcggtagatgagaggattgttggatatgtagtacgagagagattggggcgggaggggatgtagataacggcgcgatatattgttttgataatgtattgttgcggaatgtggagttgggatgtttaggcgtttgacggatcgacggacggtgggcggggatagtatatatagtgtgggagtggagtggatgtggatcggagtagaatgtttaaggggggcggtcgggattaatgtaattggtggtgatcgacggttagcgtcgtgaagataaggtacgggggttgtcggtggcggcgagggtaatgtgatataatgtaagagacgtcggtaggggggcgagggtatgagcgggtaggcgtaggggattatcgaatattttatttttttattttatcggtgatcgaattcgagagaattatgggtttatggggaaaggtaagtcgtcggaggtaatggcgttatagtatagtggtgatacgtagtgtaaggaggtgtataagagtataacgggagtttcgtagcgtaaggtataatatgtagaggggagtttggtatagacgcgaggattagaaggaatgcgtaaacgtatacgaaattaggatttatggagaaa

SEQ ID NO: 22322 - DNA, 748 bp, Artificial Sequence
  chemically treated genomic DNA (Homo sapiens) CpG-island No: 22322
tttctccataaatcctaatttcgtatacgtttacgcattccttctaatcctcgcgtctataccaaactcccctctacatattataccttacgctacgaaactcccgttatactcttatacacctccttacactacgtatcaccactatactataacgccattacctccgacgacttacctttccccataaacccataattctctcgaattcgatcaccgataaaataaaaaaataaaatattcgataatcccctacgcctacccgctcataccctcgcccccctaccgacgtctcttacattatatcacattaccctcgccgccaccgacaacccccgtaccttatcttcacgacgctaaccgtcgatcaccaccaattacattaatcccgaccgccccccttaaacattctactccgatccacatccactccactcccacactatatatactatccccgcccaccgtccgtcgatccgtcaaacgcctaaacatcccaactccacattccgcaacaatacattatcaaaacaatatatcgcgccgttatctacatcccctcccgccccaatctctctcgtactacatatccaacaatcctctcatctaccgatcccctttctccccaaattaacgatcttctctccgaataattatacacacttaatccgaccactacccccaaatcgacgctatacgttacttaaaatcaataacaacgaaacgaaccctaaaccccgacgtatac

SEQ ID NO: 22323 - DNA, 748 bp, Artificial Sequence
  chemically treated genomic DNA (Homo sapiens) CpG-island No: 22323
tttttttatagattttaatttcgtatgcgtttgcgtattttttttagttttcgcgtttgtgttaggtttttttttatatattgtgttttacgttgcgaagttttcgttatgtttttgtatatttttttgtattacgtgttattattgtattatagcgttattgttttcggcggtttgtttttttttatgggtttatggttttttcgggttcggttatcggtagggtggggaggtagggtattcggtggttttttgcgtttattcgtttatattttcgtttttttatcggcgttttttatattatgttatattattttcgtcgttatcggtagttttcgtgttttgtttttacggcgttaatcgtcggttattattagttatattaatttcggtcgttttttttaagtattttatttcggtttatatttattttatttttatattgtgtgtgttgttttcgtttatcgttcgtcggttcgttaagcgtttaagtattttagttttatatttcgtagtagtatattgttaaaatagtatgtcgcgtcgttgtttgtattttttttcgttttaatttttttcgtattatatatttagtaatttttttatttatcggttttttttttttttaaattggcggtttttttttcgggtggttgtatatatttaattcggttattatttttaaatcggcgttatacgttgtttgaagttagtagtagcgaggcgggttttgggtttcgacgtgtgt

SEQ ID NO: 22324 - DNA, 748 bp, Artificial Sequence
  chemically treated genomic DNA (Homo sapiens) CpG-island No: 22324
acacacgtcgaaacccaaaacccgcctcgctactactaacttcaaacaacgtataacgccgatttaaaaataataaccgaattaaatatatacaaccacccgaaaaaaaaaccgccaatttaaaaaaaaaaaaaaccgataaataaaaaaattactaaatatataatacgaaaaaaattaaaacgaaaaaaaatacaaacaacgacgcgacatactattttaacaatatactactacgaaatataaaactaaaatacttaaacgcttaacgaaccgacgaacgataaacgaaaacaacacacacaatataaaaataaaataaatataaaccgaaataaaatacttaaaaaaaacgaccgaaattaatataactaataataaccgacgattaacgccgtaaaaacaaaacacgaaaactaccgataacgacgaaaataatataacataatataaaaaacgccgataaaaaaacgaaaatataaacgaataaacgcaaaaaaccaccgaataccctacctccccaccctaccgataaccgaacccgaaaaaaccataaacccataaaaaaaaacaaaccgccgaaaacaataacgctataatacaataataacacgtaatacaaaaaaatatacaaaaacataacgaaaacttcgcaacgtaaaacacaatatataaaaaaaaacctaacacaaacgcgaaaactaaaaaaaatacgcaaacgcatacgaaattaaaatctataaaaaaa

SEQ ID NO: 22325 - DNA, 532 bp, Artificial Sequence
  chemically treated genomic DNA (Homo sapiens) CpG-island No: 22325
gcgcgttttgtacgcgaatttacggtcgtcggttgttttttttcggttttcggttcgttgtttttagtcgtcgacgtcggttcgtacgttttcgcgcgttgattggttcgcgtaggttttttgttcggttgttggcgttggggcgaagtcggcgggaggtcgtttcgttttcgttttcgtcgtaggtcgcggcgcgtagtttttttattcgtcgcggtcggggcggtggcgttgtgtcgtcgcggtttgtgaggtagtaattttttttcgtttttgttttatttttttttttttttttcgtttttttcgtttttttttttttcgtcgtttttgttcgagtgaatgtggcgcggcggcgcgggacgtagtttcggtttttgcgcggtttcgtaagttcgtgaggagacggagttgttttttgttttcgtttttgcgcgtttcggggagttatcgtcgttggcgaaggagaataagtagtgagattagaataaattttttagttttttaggaaaagataaggattttgtagtat

SEQ ID NO: 22326 - DNA, 532 bp, Artificial Sequence
  chemically treated genomic DNA (Homo sapiens) CpG-island No: 22326
atactacaaaatccttatcttttcctaaaaaactaaaaaatttattctaatctcactacttattctccttcgccaacgacgataactccccgaaacgcgcaaaaacgaaaacaaaaaacaactccgtctcctcacgaacttacgaaaccgcgcaaaaaccgaaactacgtcccgcgccgccgcgccacattcactcgaacaaaaacgacgaaaaaaaaaaaaacgaaaaaaacgaaaaaaaaaaaaaaaaataaaacaaaaacgaaaaaaaattactacctcacaaaccgcgacgacacaacgccaccgccccgaccgcgacgaataaaaaaactacgcgccgcgacctacgacgaaaacgaaaacgaaacgacctcccgccgacttcgccccaacgccaacaaccgaacaaaaaacctacgcgaaccaatcaacgcgcgaaaacgtacgaaccgacgtcgacgactaaaaacaacgaaccgaaaaccgaaaaaaaacaaccgacgaccgtaaattcgcgtacaaaacgcgc

SEQ ID NO: 22327 - DNA, 532 bp, Artificial Sequence
  chemically treated genomic DNA (Homo sapiens) CpG-island No: 22327
atgttgtaagatttttatttttttttagaagattgagagatttattttagttttattgtttgttttttttcgttagcggcggtggtttttcgagacgcgtaggggcgggagtaggaggtagtttcgtttttttacgagtttgcggggtcgcgtaggggtcgagattgcgtttcgcgtcgtcgcgttatatttattcgagtagagacggcgaggggagggaggacggagggagcggagagaaaggaggagaatggggtaggggcggaggggagttattgttttataggtcgcggcggtatagcgttatcgtttcggtcgcgacgggtgaagaggttgcgcgtcgcgatttgcggcgggggcgggggcggggcggtttttcgtcggtttcgttttaacgttaatagtcgggtaggaggtttgcgcgggttagttagcgcgcgggggcgtgcgggtcgacgtcggcggttgggggtagcgggtcgggggtcgggggagggtagtcggcggtcgtgggttcgcgtgtaaggcgcgt

SEQ ID NO: 22328 - DNA, 532 bp, Artificial Sequence
  chemically treated genomic DNA (Homo sapiens) CpG-island No: 22328
acgcgccttacacgcgaacccacgaccgccgactaccctcccccgacccccgacccgctacccccaaccgccgacgtcgacccgcacgcccccgcgcgctaactaacccgcgcaaacctcctacccgactattaacgttaaaacgaaaccgacgaaaaaccgccccgcccccgcccccgccgcaaatcgcgacgcgcaacctcttcacccgtcgcgaccgaaacgataacgctataccgccgcgacctataaaacaataactcccctccgcccctaccccattctcctcctttctctccgctccctccgtcctccctcccctcgccgtctctactcgaataaatataacgcgacgacgcgaaacgcaatctcgacccctacgcgaccccgcaaactcgtaaaaaaacgaaactacctcctactcccgcccctacgcgtctcgaaaaaccaccgccgctaacgaaaaaaaacaaacaataaaactaaaataaatctctcaatcttctaaaaaaaaataaaaatcttacaacat

SEQ ID NO: 22329 - DNA, 680 bp, Artificial Sequence
  chemically treated genomic DNA (Homo sapiens) CpG-island No: 22329
gtattcgtagagattggggcggggaggcgagtagagatgtgtcgtattttgtatgggataaagaagtgatgtagaatgtgtagttgggcgtgagcggaggataggtagataagatggtgcgacggatcgagggcggggatattagaggagtgtggatcggagtataatgtttgagggggggcggacgggaggatatatatagttcgtgatcgatcggtatcgcggtacgggagggttgtttgggcggcgtgcgagttgtgataatatgaatgagatattcgttatgggggaaagatgttatcgttagcgcggatcgggcgagcgaggtggtttatgcgtgatttttatgttttttaggatttgttgtaaattcgtttacgttatgtatcgattaacgttatgtcgtaaacgcgttgtttattttggtgattacgggttttgtatagtaggggtagtgcgggaaggtatttatacgatttgttttttatagatttgttagtatgtcgtttattttttacgcggattaacggttattcgtttgttaattcgtggttttcgaatattttatataatcgttattcgttcggtcgttttatttcgtattaggcggagaatgtaggtgggtggagtttttttttttattgttttagaatgtttattatttttgtttcgttgggtat

SEQ ID NO: 22330 - DNA, 680 bp, Artificial Sequence
  chemically treated genomic DNA (Homo sapiens) CpG-island No: 22330
atacccaacgaaacaaaaataataaacattctaaaacaataaaaaaaaaaactccacccacctacattctccgcctaatacgaaataaaacgaccgaacgaataacgattatataaaatattcgaaaaccacgaattaacaaacgaataaccgttaatccgcgtaaaaaataaacgacatactaacaaatctataaaaaacaaatcgtataaataccttcccgcactacccctactatacaaaacccgtaatcaccaaaataaacaacgcgtttacgacataacgttaatcgatacataacgtaaacgaatttacaacaaatcctaaaaaacataaaaatcacgcataaaccacctcgctcgcccgatccgcgctaacgataacatctttcccccataacgaatatctcattcatattatcacaactcgcacgccgcccaaacaaccctcccgtaccgcgataccgatcgatcacgaactatatatatcctcccgtccgccccccctcaaacattatactccgatccacactcctctaatatccccgccctcgatccgtcgcaccatcttatctacctatcctccgctcacgcccaactacacattctacatcacttctttatcccatacaaaatacgacacatctctactcgcctccccgccccaatctctacgaatac

SEQ ID NO: 22331 - DNA, 680 bp, Artificial Sequence
  chemically treated genomic DNA (Homo sapiens) CpG-island No: 22331
gtatttagcggagtaagagtggtaaatattttggaatagtggggagggaggttttatttatttgtatttttcgtttaatacgaaatggaacggtcgaacgggtaacggttatgtaaagtgttcgggaattacgagttgataggcgggtaatcgttggttcgcgtaagaggtaggcggtatattagtaaatttgtaagaggtaggtcgtgtgggtattttttcgtattgtttttattatataaaattcgtggttattaaggtaagtaacgcgtttgcggtatggcgttaatcggtgtatggcgtaggcgggtttatagtaaattttgaaagatataggggttacgtatgggttatttcgttcgttcggttcgcgttggcggtgatattttttttttatagcgggtgttttatttatattgttataattcgtacgtcgtttaggtaattttttcgtgtcgcggtatcggtcggttacgagttgtatatgttttttcgttcgtttttttttaagtattgtatttcggtttatatttttttggtgttttcgttttcggttcgtcgtattattttatttgtttatttttcgtttacgtttagttgtatattttgtattatttttttgttttatataaagtacggtatatttttgttcgttttttcgttttaatttttgcgggtat

SEQ ID NO: 22332 - DNA, 680 bp, Artificial Sequence
  chemically treated genomic DNA (Homo sapiens) CpG-island No: 22332
atacccgcaaaaattaaaacgaaaaaacgaacaaaaatataccgtactttatataaaacaaaaaaataatacaaaatatacaactaaacgtaaacgaaaaataaacaaataaaataatacgacgaaccgaaaacgaaaacaccaaaaaaatataaaccgaaatacaatacttaaaaaaaaacgaacgaaaaaacatatacaactcgtaaccgaccgataccgcgacacgaaaaaattacctaaacgacgtacgaattataacaatataaataaaacacccgctataaaaaaaaaatatcaccgccaacgcgaaccgaacgaacgaaataacccatacgtaacccctatatctttcaaaatttactataaacccgcctacgccatacaccgattaacgccataccgcaaacgcgttacttaccttaataaccacgaattttatataataaaaacaatacgaaaaaatacccacacgacctacctcttacaaatttactaatataccgcctacctcttacgcgaaccaacgattacccgcctatcaactcgtaattcccgaacactttacataaccgttacccgttcgaccgttccatttcgtattaaacgaaaaatacaaataaataaaacctccctccccactattccaaaatatttaccactcttactccgctaaatac

SEQ ID NO: 22333 - DNA, 674 bp, Artificial Sequence
  chemically treated genomic DNA (Homo sapiens) CpG-island No: 22333
aggttcgcgtttgtgggattagtaggggaaagagatatcgatttcgcgggtggtattgcggtgaacgcgttgggttatgcgtatcggaattgcgtgaagcgttgaacgaataggcgagtaagttttggtatacggtaacggttatattaacgagtcggtattgcgattggcgaaaaaattgtcgacgttacgtttgtcgatcgcgtttttttttgtaatttcggtgcggagttaacgaagcggcgttaaaattggcgcgtaaattcgtttacgatcgttcggtagttataagagcggtatcgtggcgtttaaaaatgcgttttatggtgtacgttgtttattgttagtgcgggtgggtagttagtttatttataggatttgcgttattgtcggcggatattcgttatgttgtatatatcgatttttttttgttagcgcgttgattgcgattttattgtgcggtgttgtcgatttttacgggaagcgggttgtgtattcgtaagttttttacggttcgtattttttttttagggcgtgtttgggtaatatacggtcgggttcggaagtgtttattcgggatcgtttatattataggcgcgttttttgcgttttgtattggttaattgatttattgttatcgtatgcgtcgatttggacgaagatgatagtgagat

SEQ ID NO: 22334 - DNA, 674 bp, Artificial Sequence
  chemically treated genomic DNA (Homo sapiens) CpG-island No: 22334
atctcactatcatcttcgtccaaatcgacgcatacgataacaataaatcaattaaccaatacaaaacgcaaaaaacgcgcctataatataaacgatcccgaataaacacttccgaacccgaccgtatattacccaaacacgccctaaaaaaaaaatacgaaccgtaaaaaacttacgaatacacaacccgcttcccgtaaaaatcgacaacaccgcacaataaaatcgcaatcaacgcgctaacaaaaaaaaatcgatatatacaacataacgaatatccgccgacaataacgcaaatcctataaataaactaactacccacccgcactaacaataaacaacgtacaccataaaacgcatttttaaacgccacgataccgctcttataactaccgaacgatcgtaaacgaatttacgcgccaattttaacgccgcttcgttaactccgcaccgaaattacaaaaaaaaacgcgatcgacaaacgtaacgtcgacaattttttcgccaatcgcaataccgactcgttaatataaccgttaccgtataccaaaacttactcgcctattcgttcaacgcttcacgcaattccgatacgcataacccaacgcgttcaccgcaataccacccgcgaaatcgatatctctttcccctactaatcccacaaacgcgaacct

SEQ ID NO: 22335 - DNA, 674 bp, Artificial Sequence
  chemically treated genomic DNA (Homo sapiens) CpG-island No: 22335
attttattattattttcgtttaaatcggcgtatacgatggtagtaagttagttagttagtgtaggacgtagaaaacgcgtttgtgatataaacggtttcggataggtattttcgggttcgatcgtgtgttgtttaaatacgttttgggggaaaaatacgggtcgtgaaaagtttgcgggtgtataattcgtttttcgtgagggtcgataatatcgtatagtagagtcgtaattagcgcgttggtagagaaaaatcggtatatgtagtatgacgaatattcgtcggtagtggcgtaaattttgtgaataggttggttgtttattcgtattgatagtaaatagcgtgtattatgaaacgtatttttgaacgttacgatgtcgtttttatggttgtcgagcggtcgtgagcgaatttacgcgttagttttagcgtcgtttcgttggtttcgtatcggagttataaaagaagacgcgatcggtaaacgtggcgtcgataattttttcgttagtcgtagtatcggttcgttggtgtaatcgttgtcgtatgttagaatttattcgtttgttcgtttagcgttttacgtagtttcggtgcgtatggtttagcgcgtttatcgtaatgttattcgcgaagtcgatattttttttttttgttgattttataagcgcgaattt

SEQ ID NO: 22336 - DNA, 674 bp, Artificial Sequence
  chemically treated genomic DNA (Homo sapiens) CpG-island No: 22336
aaattcgcgcttataaaatcaacaaaaaaaaaaaatatcgacttcgcgaataacattacgataaacgcgctaaaccatacgcaccgaaactacgtaaaacgctaaacgaacaaacgaataaattctaacatacgacaacgattacaccaacgaaccgatactacgactaacgaaaaaattatcgacgccacgtttaccgatcgcgtcttcttttataactccgatacgaaaccaacgaaacgacgctaaaactaacgcgtaaattcgctcacgaccgctcgacaaccataaaaacgacatcgtaacgttcaaaaatacgtttcataatacacgctatttactatcaatacgaataaacaaccaacctattcacaaaatttacgccactaccgacgaatattcgtcatactacatataccgatttttctctaccaacgcgctaattacgactctactatacgatattatcgaccctcacgaaaaacgaattatacacccgcaaacttttcacgacccgtatttttcccccaaaacgtatttaaacaacacacgatcgaacccgaaaatacctatccgaaaccgtttatatcacaaacgcgttttctacgtcctacactaactaactaacttactaccatcgtatacgccgatttaaacgaaaataataataaaat

SEQ ID NO: 22337 - DNA, 535 bp, Artificial Sequence
  chemically treated genomic DNA (Homo sapiens) CpG-island No: 22337
tcgttattatttgcgttcgaggatgcgttcgtggtgtcgtattcgattattattgcgtaggaggatgcgttcgtcgagtcgtattcgtttattatttgcgtggaggatgcgttcgtcgagtcgtattcgtttattaattgcgtaggaggagcgttcgtcgagtcgtattcgtttattatttgcgtaggaggatgcgttttcgagtcgtattcgttgattatttgcgtaggaggatgcgttcgtcgagtgtattcgtttattatttgtatacgaagatgcgttcgtcgagtcgtattttttattatttgcgtaggaggatgcgttcgtcgagtcgtattcgtttatttttgcgtaggaggatgcgttcgtcgagtcgtattcgtttattatttgtaacgaagatgcgttcgtcgagtggtatcggtgtattttttgcgcgcggagatgttttgtaagattaaatattttataggtgggtcgtgaaggtagggcggcgagggttagcgtaggggttattatttgatgtttattattt

SEQ ID NO: 22338 - DNA, 535 bp, Artificial Sequence
  chemically treated genomic DNA (Homo sapiens) CpG-island No: 22338
aaataataaacatcaaataataacccctacgctaaccctcgccgccctaccttcacgacccacctataaaatatttaatcttacaaaacatctccgcgcgcaaaaaatacaccgataccactcgacgaacgcatcttcgttacaaataataaacgaatacgactcgacgaacgcatcctcctacgcaaaaataaacgaatacgactcgacgaacgcatcctcctacgcaaataataaaaaatacgactcgacgaacgcatcttcgtatacaaataataaacgaatacactcgacgaacgcatcctcctacgcaaataatcaacgaatacgactcgaaaacgcatcctcctacgcaaataataaacgaatacgactcgacgaacgctcctcctacgcaattaataaacgaatacgactcgacgaacgcatcctccacgcaaataataaacgaatacgactcgacgaacgcatcctcctacgcaataataatcgaatacgacaccacgaacgcatcctcgaacgcaaataataacga

SEQ ID NO: 22339 - DNA, 535 bp, Artificial Sequence
  chemically treated genomic DNA (Homo sapiens) CpG-island No: 22339
aggtagtgggtattagatggtgatttttacgttgattttcgtcgttttgtttttacggtttatttgtaaggtatttagttttgtaaggtattttcgcgcgtaaagggtgtatcggtgttattcgacgaacgtattttcgttgtaaatggtgaacgggtgcgattcgacgaacgtatttttttacgtaaaggtgaacgggtgcgattcgacgaacgtatttttttacgtaaatggtgaagggtgcgattcgacgaacgtattttcgtatgtaaatggtgaacgggtgtattcgacgaacgtatttttttacgtaaatggttaacgggtgcgattcgagaacgtatttttttacgtaaatggtgaacgggtgcgattcgacgaacgttttttttacgtaattggtgaacgggtgcgattcgacgaacgtattttttacgtaaatggtgaacgggtgcgattcgacgaacgtatttttttacgtaatggtgatcgggtgcgatattacgaacgtattttcgaacgtaaatggtgacgg

SEQ ID NO: 22340 - DNA, 535 bp, Artificial Sequence
  chemically treated genomic DNA (Homo sapiens) CpG-island No: 22340
ccgtcaccatttacgttcgaaaatacgttcgtaatatcgcacccgatcaccattacgtaaaaaaatacgttcgtcgaatcgcacccgttcaccatttacgtaaaaaatacgttcgtcgaatcgcacccgttcaccaattacgtaaaaaaaacgttcgtcgaatcgcacccgttcaccatttacgtaaaaaaatacgttctcgaatcgcacccgttaaccatttacgtaaaaaaatacgttcgtcgaatacacccgttcaccatttacatacgaaaatacgttcgtcgaatcgcacccttcaccatttacgtaaaaaaatacgttcgtcgaatcgcacccgttcacctttacgtaaaaaaatacgttcgtcgaatcgcacccgttcaccatttacaacgaaaatacgttcgtcgaataacaccgatacaccctttacgcgcgaaaataccttacaaaactaaataccttacaaataaaccgtaaaaacaaaacgacgaaaatcaacgtaaaaatcaccatctaatacccactacct

SEQ ID NO: 22341 - DNA, 1311 bp, Artificial Sequence
  chemically treated genomic DNA (Homo sapiens) CpG-island No: 22341
gatcgcggtttgatatcgtattttgtttttttaatagttttggggcgcgcggtttatggagtcggggttgttgcggtcggcgtcggtgagcgaggttatcgttttgtattataattatatcggtaagtttcgcggtgcgcgttattagtcgggtgtcggtttgcgcgtcgacgtcgtggtgtgtttggcggtgtgcgtttttatcgtgttagagaatttagtcgtgttgttggtgttcggacgttattcgcgtttttacgtttttatgtttttgtttttgggtagttttacgttgtcggatttgttggtaggcgtcgtttacgtcgttaatattttattgtcggggtcgtttacgttgaaattgtttttcgcgttttggttcgtacgggagggaggcgttttcgtggtatttattgcgttcgtgttgagttttttggttatcgcgttggagcgtagttttattatggcgcgtagggggttcgcgttcgtttttagtcgggggcgtacgttggcgatggtagtcgcggtttggggcgtgtcgttgtttttcgggtttttgttagcgttgggttggaattgtttgggtcgtttggacgtttgttttattgttttgtcgttttacgttaaggtttacgtgtttttttgcgtgttcgttttcgtgggtattttggtcgttatttgtgtattttacgcgcgtatttattgttaggtacgcgttaacgcgcggcgtttgtcggtacggttcgggattgcggggattatttcgattcgggcgcgtcgtaagtcgcgttcgttggttttgttgcgtacgtttagcgtggtgtttttggtttttgtggtatgttggggttttttttttttgttgttgttgttcgacgtggcgtgttcggcgcgtatttgttttgtatttttgtaggtcgatttttttttgggattggttatggttaatttatttttgaattttattatttatacgtttattaatcgcgatttgcgttacgcgtttttgcgtttggtttgttgcggacgttatttttgcggtagagattcgagtggtttttagtagtcggcgagcgcggttgaggttttcgggggtttgcgtcgttgtttgttttcgggttttgatgggagttttagcggttcggagcgtttatcgttttagcgcgacgggttggatattagcggttttataggtagtttcggtgtatttatagtcgttcggattttggtattagaatcggttgtagattgatattttcggtttacgattgtttttttaagttttatagatttgttttttttatataaagg

SEQ ID NO: 22342 - DNA, 1311 bp, Artificial Sequence
  chemically treated genomic DNA (Homo sapiens) CpG-island No: 22342
cctttatataaaaaaaacaaatctataaaacttaaaaaaacaatcgtaaaccgaaaatatcaatctacaaccgattctaataccaaaatccgaacgactataaatacaccgaaactacctataaaaccgctaatatccaacccgtcgcgctaaaacgataaacgctccgaaccgctaaaactcccatcaaaacccgaaaacaaacaacgacgcaaacccccgaaaacctcaaccgcgctcgccgactactaaaaaccactcgaatctctaccgcaaaaataacgtccgcaacaaaccaaacgcaaaaacgcgtaacgcaaatcgcgattaataaacgtataaataataaaattcaaaaataaattaaccataaccaatcccaaaaaaaaatcgacctacaaaaatacaaaacaaatacgcgccgaacacgccacgtcgaacaacaacaacaaaaaaaaaaaaccccaacataccacaaaaaccaaaaacaccacgctaaacgtacgcaacaaaaccaacgaacgcgacttacgacgcgcccgaatcgaaataatccccgcaatcccgaaccgtaccgacaaacgccgcgcgttaacgcgtacctaacaataaatacgcgcgtaaaatacacaaataacgaccaaaatacccacgaaaacgaacacgcaaaaaaacacgtaaaccttaacgtaaaacgacaaaacaataaaacaaacgtccaaacgacccaaacaattccaacccaacgctaacaaaaacccgaaaaacaacgacacgccccaaaccgcgactaccatcgccaacgtacgcccccgactaaaaacgaacgcgaaccccctacgcgccataataaaactacgctccaacgcgataaccaaaaaactcaacacgaacgcaataaataccacgaaaacgcctccctcccgtacgaaccaaaacgcgaaaaacaatttcaacgtaaacgaccccgacaataaaatattaacgacgtaaacgacgcctaccaacaaatccgacaacgtaaaactacccaaaaacaaaaacataaaaacgtaaaaacgcgaataacgtccgaacaccaacaacacgactaaattctctaacacgataaaaacgcacaccgccaaacacaccacgacgtcgacgcgcaaaccgacacccgactaataacgcgcaccgcgaaacttaccgatataattataatacaaaacgataacctcgctcaccgacgccgaccgcaacaaccccgactccataaaccgcgcgccccaaaactattaaaaaaacaaaatacgatatcaaaccgcgatc

SEQ ID NO: 22343 - DNA, 1311 bp, Artificial Sequence
  chemically treated genomic DNA (Homo sapiens) CpG-island No: 22343
tttttatgtaaaaagaataagtttgtaaaatttgggaagatagtcgtgggtcgagggtgttagtttgtagtcggttttgatattagagttcgggcggttgtgggtgtatcggggttgtttgtggagtcgttggtgtttagttcgtcgcgttggggcgatgagcgtttcgagtcgttgaagtttttattaaggttcgggggtaggtagcggcgtaggttttcggaagttttagtcgcgttcgtcgattgttgggagttattcgggtttttgtcgtaggagtggcgttcgtagtagattaggcgtaggagcgcgtggcgtaggtcgcggttggtgagcgtgtagatgatggggtttagaagtgagttggttatggttagttttaggaagggatcggtttgtaggagtataggataggtgcgcgtcgggtacgttacgtcgagtaatagtagtaggaagagggggttttaatatgttataaaggttaggagtattacgttgagcgtgcgtagtaaggttagcgagcgcggtttgcgacgcgttcgggtcgaggtggttttcgtagtttcgggtcgtgtcggtaggcgtcgcgcgttggcgcgtatttggtagtagatgcgcgcgtagagtgtatagatagcggttaggatgtttacgaaggcgagtacgtagaagagtacgtaggttttggcgtagagcggtaagatagtggagtaagcgtttaggcgatttaggtaattttagtttagcgttggtaggagttcgaggagtagcgatacgttttaggtcgcggttgttatcgttagcgtgcgttttcgattggagacgggcgcgggttttttgcgcgttatggtgaggttgcgttttagcgcgatggttaggaggtttagtacggacgtagtgagtgttacgaagacgtttttttttcgtgcgaattagagcgcgggggatagttttagcgtgagcggtttcgatagtaggatgttggcggcgtaggcggcgtttgttagtagattcgataacgtgaggttgtttaggagtaggaatatgggagcgtggaagcgcgggtggcgttcgagtattaataatacggttagattttttagtacgatgaaggcgtatatcgttaggtatattacggcgtcggcgcgtaggtcggtattcggttggtagcgcgtatcgcggagtttgtcggtgtagttgtaatgtaggacgatgatttcgtttatcggcgtcggtcgtagtagtttcgattttatgggtcgcgcgttttaaggttgttggagaggtaagatacggtgttaggtcgcggtt

SEQ ID NO: 22344 - DNA, 1311 bp, Artificial Sequence
  chemically treated genomic DNA (Homo sapiens) CpG-island No: 22344
aaccgcgacctaacaccgtatcttacctctccaacaaccttaaaacgcgcgacccataaaatcgaaactactacgaccgacgccgataaacgaaatcatcgtcctacattacaactacaccgacaaactccgcgatacgcgctaccaaccgaataccgacctacgcgccgacgccgtaatatacctaacgatatacgccttcatcgtactaaaaaatctaaccgtattattaatactcgaacgccacccgcgcttccacgctcccatattcctactcctaaacaacctcacgttatcgaatctactaacaaacgccgcctacgccgccaacatcctactatcgaaaccgctcacgctaaaactatcccccgcgctctaattcgcacgaaaaaaaaacgtcttcgtaacactcactacgtccgtactaaacctcctaaccatcgcgctaaaacgcaacctcaccataacgcgcaaaaaacccgcgcccgtctccaatcgaaaacgcacgctaacgataacaaccgcgacctaaaacgtatcgctactcctcgaactcctaccaacgctaaactaaaattacctaaatcgcctaaacgcttactccactatcttaccgctctacgccaaaacctacgtactcttctacgtactcgccttcgtaaacatcctaaccgctatctatacactctacgcgcgcatctactaccaaatacgcgccaacgcgcgacgcctaccgacacgacccgaaactacgaaaaccacctcgacccgaacgcgtcgcaaaccgcgctcgctaaccttactacgcacgctcaacgtaatactcctaacctttataacatattaaaaccccctcttcctactactattactcgacgtaacgtacccgacgcgcacctatcctatactcctacaaaccgatcccttcctaaaactaaccataaccaactcacttctaaaccccatcatctacacgctcaccaaccgcgacctacgccacgcgctcctacgcctaatctactacgaacgccactcctacgacaaaaacccgaataactcccaacaatcgacgaacgcgactaaaacttccgaaaacctacgccgctacctacccccgaaccttaataaaaacttcaacgactcgaaacgctcatcgccccaacgcgacgaactaaacaccaacgactccacaaacaaccccgatacacccacaaccgcccgaactctaatatcaaaaccgactacaaactaacaccctcgacccacgactatcttcccaaattttacaaacttattctttttacataaaaa

SEQ ID NO: 22345 - DNA, 708 bp, Artificial Sequence
  chemically treated genomic DNA (Homo sapiens) CpG-island No: 22345
ggcgcgtaggtttggaattcggggtttagatttttcgcgatttggattacgcggttaagcgcgtttagggtcgcgtgttttcgtttcgtcgttatgttgggcgtcgtggtggtcgcgtagttgggcgatagtaggcgtgggcgggggtggggagcggttttttagcggtttttatcgtttgaggttagggttcggggatttttattgtgatacggcgggcgttcggttttgtttagttatggtgatttgcgcgcgtttcgcgttttttttacgcgtagcgatggaggcgtcggggttcgggcggtggaggcggaatcggagcgcggttatggcggggtgagtgaggcgggatgtgttcgggttgcgggtatcgcgggtcgcgagcgtttttgcggtcgtgttcggagattaggaaaacgggcgttacggtttagggcgttttcgagtttttcgttaggattcggagggttaggagggcgcgatttgggtggatatttttgttggacggcgtaatttttggggtggttcgggagcggcggaaatcgagcgagagaattaggaggcgttgcgtagaaggaggttcgggggtttcgaggcgttgaggggttcgatttgcgttttggggttggtagtcgagaggtcgcggtggggttattttttcgttttattgggtttggtggaggtttaggaggggtatgcgtagtcgtt

SEQ ID NO: 22346 - DNA, 708 bp, Artificial Sequence
  chemically treated genomic DNA (Homo sapiens) CpG-island No: 22346
aacgactacgcatacccctcctaaacctccaccaaacccaataaaacgaaaaaataaccccaccgcgacctctcgactaccaaccccaaaacgcaaatcgaacccctcaacgcctcgaaacccccgaacctccttctacgcaacgcctcctaattctctcgctcgatttccgccgctcccgaaccaccccaaaaattacgccgtccaacaaaaatatccacccaaatcgcgccctcctaaccctccgaatcctaacgaaaaactcgaaaacgccctaaaccgtaacgcccgttttcctaatctccgaacacgaccgcaaaaacgctcgcgacccgcgatacccgcaacccgaacacatcccgcctcactcaccccgccataaccgcgctccgattccgcctccaccgcccgaaccccgacgcctccatcgctacgcgtaaaaaaaacgcgaaacgcgcgcaaatcaccataactaaacaaaaccgaacgcccgccgtatcacaataaaaatccccgaaccctaacctcaaacgataaaaaccgctaaaaaaccgctccccacccccgcccacgcctactatcgcccaactacgcgaccaccacgacgcccaacataacgacgaaacgaaaacacgcgaccctaaacgcgcttaaccgcgtaatccaaatcgcgaaaaatctaaaccccgaattccaaacctacgcgcc

SEQ ID NO: 22347 - DNA, 708 bp, Artificial Sequence
  chemically treated genomic DNA (Homo sapiens) CpG-island No: 22347
ggcgattgcgtatgttttttttgagtttttattaggtttagtgaggcgaggaagtgattttatcgcggtttttcggttgttaattttagaacgtagatcgagttttttaacgtttcggagttttcgggtttttttttgcgtagcgttttttggttttttcgttcggttttcgtcgttttcgggttattttaagagttgcgtcgtttaataaaaatatttatttaggtcgcgtttttttggtttttcgagttttggcggggaattcggaggcgttttgggtcgtggcgttcgtttttttggttttcgggtacggtcgtaggggcgttcgcggttcgcgatgttcgtagttcgggtatatttcgttttatttatttcgttatggtcgcgtttcggtttcgtttttatcgttcgagtttcggcgtttttatcgttgcgcgtgggggaggcgcggagcgcgcgtaggttattatgattaagtagagtcgggcgttcgtcgtgttataataaaagttttcgggttttggttttaggcggtagggatcgttgaggggtcgttttttattttcgtttacgtttgttgtcgtttagttgcgcggttattacggcgtttagtatggcggcggggcgggggtacgcgattttgagcgcgtttagtcgcgtggtttaagtcgcggggagtttgaatttcgagttttaggtttgcgcgtt

SEQ ID NO: 22348 - DNA, 708 bp, Artificial Sequence
  chemically treated genomic DNA (Homo sapiens) CpG-island No: 22348
aacgcgcaaacctaaaactcgaaattcaaactccccgcgacttaaaccacgcgactaaacgcgctcaaaatcgcgtacccccgccccgccgccatactaaacgccgtaataaccgcgcaactaaacgacaacaaacgtaaacgaaaataaaaaacgacccctcaacgatccctaccgcctaaaaccaaaacccgaaaacttttattataacacgacgaacgcccgactctacttaatcataataacctacgcgcgctccgcgcctcccccacgcgcaacgataaaaacgccgaaactcgaacgataaaaacgaaaccgaaacgcgaccataacgaaataaataaaacgaaatatacccgaactacgaacatcgcgaaccgcgaacgcccctacgaccgtacccgaaaaccaaaaaaacgaacgccacgacccaaaacgcctccgaattccccgccaaaactcgaaaaaccaaaaaaacgcgacctaaataaatatttttattaaacgacgcaactcttaaaataacccgaaaacgacgaaaaccgaacgaaaaaaccaaaaaacgctacgcaaaaaaaaacccgaaaactccgaaacgttaaaaaactcgatctacgttctaaaattaacaaccgaaaaaccgcgataaaatcacttcctcgcctcactaaacctaataaaaactcaaaaaaaacatacgcaatcgcc

SEQ ID NO: 22349 - DNA, 561 bp, Artificial Sequence
  chemically treated genomic DNA (Homo sapiens) CpG-island No: 22349
gtgcggtagcgacgttatcgattacgcggtgggcgatagcgtatgcggttacggttcgtttttcgagacggttattattaacgtagtgaataattataagttgcgtaaaatgtcgtaaggtagtttttggaaaaacgtcgtttgttacgattcggcgtagtttgttatgagcggcgtgcgcgatgttaacgtgcgcgtaggggattttgtggtggtggtagggtttggcgtaatcggttaaattgttatttaattggttaaacgcgttggcgtttttgtggtgattggcgtcgaatttatcgtttatcgttgtgatattgttcgtcgttacggcgcggatttttgttttaattttatcggtattgatgtaggtaaagagattaaaacgttgatcggtaagtagggtgtcgatgtgattatcgaaattagcggttacgtcgacgcgttgtaaatcgcgtttcgcggtttgtttatggtcgtattatttttatgtcgcgtttgtaagtcgtttgtcgaaggtttttatttcggagtcgagcgtattttaataacggtaaaatg

SEQ ID NO: 22350 - DNA, 561 bp, Artificial Sequence
  chemically treated genomic DNA (Homo sapiens) CpG-island No: 22350
cattttaccgttattaaaatacgctcgactccgaaataaaaaccttcgacaaacgacttacaaacgcgacataaaaataatacgaccataaacaaaccgcgaaacgcgatttacaacgcgtcgacgtaaccgctaatttcgataatcacatcgacaccctacttaccgatcaacgttttaatctctttacctacatcaataccgataaaattaaaacaaaaatccgcgccgtaacgacgaacaatatcacaacgataaacgataaattcgacgccaatcaccacaaaaacgccaacgcgtttaaccaattaaataacaatttaaccgattacgccaaaccctaccaccaccacaaaatcccctacgcgcacgttaacatcgcgcacgccgctcataacaaactacgccgaatcgtaacaaacgacgtttttccaaaaactaccttacgacattttacgcaacttataattattcactacgttaataataaccgtctcgaaaaacgaaccgtaaccgcatacgctatcgcccaccgcgtaatcgataacgtcgctaccgcac

SEQ ID NO: 22351 - DNA, 561 bp, Artificial Sequence
  chemically treated genomic DNA (Homo sapiens) CpG-island No: 22351
tattttgtcgttattgaaatgcgttcggtttcgagataaaaattttcggtaaacggtttgtaaacgcgatatagagatggtgcggttataagtagatcgcggagcgcgatttgtagcgcgtcggcgtagtcgttggtttcgataattatatcggtattttgtttgtcggttagcgttttgatttttttatttatattagtgtcgatggggttaaggtagaaattcgcgtcgtggcgacgggtaatattatagcgatgggcgatagattcgacgttaattattatagaagcgttagcgcgtttagttagttggatggtaatttgatcgattgcgttaagttttattattattataaaattttttacgcgtacgttggtatcgcgtacgtcgtttatggtaaattgcgtcgggtcgtagtagacggcgtttttttaggagttgttttgcggtattttgcgtagtttgtagttatttattgcgttaatgatgatcgtttcggagagcgggtcgtagtcgtatacgttgtcgtttatcgcgtagtcggtaacgtcgttgtcgtat

SEQ ID NO: 22352 - DNA, 561 bp, Artificial Sequence
  chemically treated genomic DNA (Homo sapiens) CpG-island No: 22352
atacgacaacgacgttaccgactacgcgataaacgacaacgtatacgactacgacccgctctccgaaacgatcatcattaacgcaataaataactacaaactacgcaaaataccgcaaaacaactcctaaaaaaacgccgtctactacgacccgacgcaatttaccataaacgacgtacgcgataccaacgtacgcgtaaaaaattttataataataataaaacttaacgcaatcgatcaaattaccatccaactaactaaacgcgctaacgcttctataataattaacgtcgaatctatcgcccatcgctataatattacccgtcgccacgacgcgaatttctaccttaaccccatcgacactaatataaataaaaaaatcaaaacgctaaccgacaaacaaaataccgatataattatcgaaaccaacgactacgccgacgcgctacaaatcgcgctccgcgatctacttataaccgcaccatctctatatcgcgtttacaaaccgtttaccgaaaatttttatctcgaaaccgaacgcatttcaataacgacaaaata

SEQ ID NO: 22353 - DNA, 551 bp, Artificial Sequence
  chemically treated genomic DNA (Homo sapiens) CpG-island No: 22353
  misc_feature (307)..(307): n is either a, c, g or t
  misc_feature (460)..(460): n is either a, c, g or t
  misc_feature (463)..(463): n is either a, c, g or t
tttcggtttgggcggtcgtttttcggaaggttattcggtcgcggttgtttttttcgtaaaattcgatatttagcgcgtttatattgtgatttaggcgcgttcgattgtagggttgtaacgtttgcgttatttgttgttgttgtggggggtagatcgtaacggcgttaattcgatgacgtcggaagaggtgtatcgtgttgttaatgaacgtttgatgtagatgatgtcgtaggtattgttttcgttagacgcgatggggttaaagttatttgaatcggtaacggggatcgtttagtcgatttcgtantaatcggcgataggaaatgtagttattgcgtttgttgcgtcgatatagtttgttgttaatcgttttttataaagggttacgtcgtcgtaaagtggtgtttaatcgtttgcgcgtggcgtcgggagggtaatagtggcgagttatcgtagttanggnagttttggtaatttggttttcgttttttattgcgttgttgttgtaaattatggtttggtcggataatttgattgtgtatcggtaaatt

SEQ ID NO: 22354 - DNA, 551 bp, Artificial Sequence
  chemically treated genomic DNA (Homo sapiens) CpG-island No: 22354
  misc_feature (89)..(89): n is either a, c, g or t
  misc_feature (92)..(92): n is either a, c, g or t
  misc_feature (245)..(245): n is either a, c, g or t
aatttaccgatacacaatcaaattatccgaccaaaccataatttacaacaacaacgcaataaaaaacgaaaaccaaattaccaaaactnccntaactacgataactcgccactattaccctcccgacgccacgcgcaaacgattaaacaccactttacgacgacgtaaccctttataaaaaacgattaacaacaaactatatcgacgcaacaaacgcaataactacatttcctatcgccgattantacgaaatcgactaaacgatccccgttaccgattcaaataactttaaccccatcgcgtctaacgaaaacaatacctacgacatcatctacatcaaacgttcattaacaacacgatacacctcttccgacgtcatcgaattaacgccgttacgatctaccccccacaacaacaacaaataacgcaaacgttacaaccctacaatcgaacgcgcctaaatcacaatataaacgcgctaaatatcgaattttacgaaaaaaacaaccgcgaccgaataaccttccgaaaaacgaccgcccaaaccgaaa

SEQ ID NO: 22355 - DNA, 551 bp, Artificial Sequence
  chemically treated genomic DNA (Homo sapiens) CpG-island No: 22355
  misc_feature (89)..(89): n is either a, c, g or t
  misc_feature (92)..(92): n is either a, c, g or t
  misc_feature (245)..(245): n is either a, c, g or t
agtttgtcggtatataattaggttattcggttaggttatgatttgtagtaatagcgtaatgaggaacgaaggttagattattaaggttnttntggttacgatagttcgttattattgttttttcggcgttacgcgtaggcggttgagtattattttgcggcggcgtagttttttgtggagagcgattagtagtaggttgtgtcggcgtagtaggcgtagtagttgtattttttgtcgtcggttgntgcggagtcggttgagcgattttcgttgtcggtttaggtaattttggttttatcgcgtttggcgaaggtaatatttgcggtattatttgtattagacgtttattagtaatacgatgtatttttttcggcgttatcgggttagcgtcgttacgatttgttttttatagtagtagtagataacgtaaacgttgtagttttgtagtcggacgcgtttgaattatagtataagcgcgttgggtatcgagttttacggaagagataatcgcgatcggatagtttttcgggaaacgatcgtttagatcggaa

SEQ ID NO: 22356 - DNA, 551 bp, Artificial Sequence
  chemically treated genomic DNA (Homo sapiens) CpG-island No: 22356
  misc_feature (307)..(307): n is either a, c, g or t
  misc_feature (460)..(460): n is either a, c, g or t
  misc_feature (463)..(463): n is either a, c, g or t
ttccgatctaaacgatcgtttcccgaaaaactatccgatcgcgattatctcttccgtaaaactcgatacccaacgcgcttatactataattcaaacgcgtccgactacaaaactacaacgtttacgttatctactactactataaaaaacaaatcgtaacgacgctaacccgataacgccgaaaaaaatacatcgtattactaataaacgtctaatacaaataataccgcaaatattaccttcgccaaacgcgataaaaccaaaattacctaaaccgacaacgaaaatcgctcaaccgactccgcancaaccgacgacaaaaaatacaactactacgcctactacgccgacacaacctactactaatcgctctccacaaaaaactacgccgccgcaaaataatactcaaccgcctacgcgtaacgccgaaaaaacaataataacgaactatcgtaaccanaanaaccttaataatctaaccttcgttcctcattacgctattactacaaatcataacctaaccgaataacctaattatataccgacaaact

SEQ ID NO: 22357 - DNA, 689 bp, Artificial Sequence
  chemically treated genomic DNA (Homo sapiens) CpG-island No: 22357
gtgtttagtcgttgggtttattttattgtttatcggtttcgtattcgtttgttagaatttcgttagtgttagtaatcgattgcgtacggcgtttgttagacgatcggtttgtttatggttcgttatatcgatatagagtggtataatggcggtagcggaaaatagcgttagttgttcgcgtcgttagtcgtaatcgcggtagatgtcgtttttattattttagaggtaacggtttatcgtatcggacgggtattggttttttggcggaatagtgtttttgtttttttttcgttttttagcgtcgagatgttggcgatggcgttttttagtttaaataggaaggtatttagatcgatggggatgaattgggtggtacgaatgttcgttagacgattagtattacgtagttaacgggaagagtaattttaatcggaggtcgtttcgtcgcgtaaatcgcggtatatttcgttgggcgggcgattagaatgtttcgcggttttaacgtttttaagttaggattcgttacgcggcgtgtcgcgatcgttttagtaacggttgagtagcgattcgttcggtattcgtataatatggcgataggtttgattagggattaacgattttgtatcgtttatttagaaggtatattttattttaaggtggtcgagatagcgggcgatcgttatattatt

SEQ ID NO: 22358 - DNA, 689 bp, Artificial Sequence
  chemically treated genomic DNA (Homo sapiens) CpG-island No: 22358
aataatataacgatcgcccgctatctcgaccaccttaaaataaaatataccttctaaataaacgatacaaaatcgttaatccctaatcaaacctatcgccatattatacgaataccgaacgaatcgctactcaaccgttactaaaacgatcgcgacacgccgcgtaacgaatcctaacttaaaaacgttaaaaccgcgaaacattctaatcgcccgcccaacgaaatataccgcgatttacgcgacgaaacgacctccgattaaaattactcttcccgttaactacgtaatactaatcgtctaacgaacattcgtaccacccaattcatccccatcgatctaaataccttcctatttaaactaaaaaacgccatcgccaacatctcgacgctaaaaaacgaaaaaaaaacaaaaacactattccgccaaaaaaccaatacccgtccgatacgataaaccgttacctctaaaataataaaaacgacatctaccgcgattacgactaacgacgcgaacaactaacgctattttccgctaccgccattataccactctatatcgatataacgaaccataaacaaaccgatcgtctaacaaacgccgtacgcaatcgattactaacactaacgaaattctaacaaacgaatacgaaaccgataaacaataaaataaacccaacgactaaacac

SEQ ID NO: 22359 - DNA, 689 bp, Artificial Sequence
  chemically treated genomic DNA (Homo sapiens) CpG-island No: 22359
gatggtgtagcggtcgttcgttatttcgattattttaaaatggaatatgttttttggatggacggtgtagaatcgttaatttttaattaggtttatcgttatgttgtgcggatgtcggacggatcgttgtttaatcgttattgggacgatcgcgatacgtcgcgtgacgaattttggtttgaggacgttgaaatcgcgaaatattttggtcgttcgtttaacgaggtgtatcgcgatttacgcggcggggcggttttcggttgggattatttttttcgttggttgcgtgatattggtcgtttggcgagtattcgtattatttagtttatttttatcgatttgaatgtttttttgtttaaattggagagcgttatcgttaatatttcggcgttgaaaggcgagaaagagatagaagtattgtttcgttagaaagttagtgttcgttcgatgcggtaaatcgttatttttgggatgatgaaaacggtatttatcgcgattacgattggcgacgcgaataattggcgttgtttttcgttgtcgttattgtgttattttatgtcggtatggcgaattatgaataggtcgatcgtttggtaaacgtcgtgcgtagtcggttattgatattggcgggattttggtaagcgagtacgaaatcggtgaatagtgggataaatttaacggttgggtat

SEQ ID NO: 22360 - DNA, 689 bp, Artificial Sequence
  chemically treated genomic DNA (Homo sapiens) CpG-island No: 22360
atacccaaccgttaaatttatcccactattcaccgatttcgtactcgcttaccaaaatcccgccaatatcaataaccgactacgcacgacgtttaccaaacgatcgacctattcataattcgccataccgacataaaataacacaataacgacaacgaaaaacaacgccaattattcgcgtcgccaatcgtaatcgcgataaataccgttttcatcatcccaaaaataacgatttaccgcatcgaacgaacactaactttctaacgaaacaatacttctatctctttctcgcctttcaacgccgaaatattaacgataacgctctccaatttaaacaaaaaaacattcaaatcgataaaaataaactaaataatacgaatactcgccaaacgaccaatatcacgcaaccaacgaaaaaaataatcccaaccgaaaaccgccccgccgcgtaaatcgcgatacacctcgttaaacgaacgaccaaaatatttcgcgatttcaacgtcctcaaaccaaaattcgtcacgcgacgtatcgcgatcgtcccaataacgattaaacaacgatccgtccgacatccgcacaacataacgataaacctaattaaaaattaacgattctacaccgtccatccaaaaaacatattccattttaaaataatcgaaataacgaacgaccgctacaccatc

SEQ ID NO: 22361 - DNA, 500 bp, Artificial Sequence
  chemically treated genomic DNA (Homo sapiens) CpG-island No: 22361
gtcgttttcgtcgttcgtttcgttatttgcgcgtaagtggttagcgtcgtcgtcgttatcgtgacgagcgttatttaatttagtcgttaatgtcgttgatcgtagcgtgcgcgttttcggaattggtttttggtaaagtttggattcgttatttaattgtacgttcgtaagatgtataggttgaagagtagcgcgaataggaagaagtatatgtgtagtcgatggtgattgaggtttttgtcgtcgtcgttatcgaatcggttgttagcgcgttagttgttgaagaagtggtcggtgtcgtagaagttttcgtttaggttgtcgaatcgtaatcggaagtggttgaaacgacgtattttgaagtgatcgttgtcgcggtaattgaatagtcgtagtgagttatcgagtttgatgttgtcgtagtttaggaagttgtagaataagtagaatcggtggttgaatcgtaggaagagacggtagatattgaatagtattgtttg

SEQ ID NO: 22362 - DNA, 500 bp, Artificial Sequence
  chemically treated genomic DNA (Homo sapiens) CpG-island No: 22362
caaacaatactattcaatatctaccgtctcttcctacgattcaaccaccgattctacttattctacaacttcctaaactacgacaacatcaaactcgataactcactacgactattcaattaccgcgacaacgatcacttcaaaatacgtcgtttcaaccacttccgattacgattcgacaacctaaacgaaaacttctacgacaccgaccacttcttcaacaactaacgcgctaacaaccgattcgataacgacgacgacaaaaacctcaatcaccatcgactacacatatacttcttcctattcgcgctactcttcaacctatacatcttacgaacgtacaattaaataacgaatccaaactttaccaaaaaccaattccgaaaacgcgcacgctacgatcaacgacattaacgactaaattaaataacgctcgtcacgataacgacgacgacgctaaccacttacgcgcaaataacgaaacgaacgacgaaaacgac

SEQ ID NO: 22363 - DNA, 500 bp, Artificial Sequence
  chemically treated genomic DNA (Homo sapiens) CpG-island No: 22363
taggtaatattgtttaatatttgtcgtttttttttgcggtttaattatcggttttgtttgttttgtaattttttgggttacggtaatattagattcggtaatttattgcggttgtttagttatcgcggtagcgattattttaggatgcgtcgttttaattattttcggttgcggttcggtaatttgaacgggggtttttacgatatcggttatttttttaataattggcgcgttaataatcggttcgatagcggcggcgatagggattttagttattatcggttgtatatgtatttttttttgttcgcgttgttttttaatttgtatattttgcggacgtataattggatagcggatttagattttgttagaggttagtttcggagacgcgtacgttacggttaacggtattggcgattgggttggataacgttcgttacgatagcgacgacgacgttgattatttacgcgtaggtgacgaggcgagcggcgagaacgat

SEQ ID NO: 22364 - DNA, 500 bp, Artificial Sequence
  chemically treated genomic DNA (Homo sapiens) CpG-island No: 22364
atcgttctcgccgctcgcctcgtcacctacgcgtaaataatcaacgtcgtcgtcgctatcgtaacgaacgttatccaacccaatcgccaataccgttaaccgtaacgtacgcgtctccgaaactaacctctaacaaaatctaaatccgctatccaattatacgtccgcaaaatatacaaattaaaaaacaacgcgaacaaaaaaaaatacatatacaaccgataataactaaaatccctatcgccgccgctatcgaaccgattattaacgcgccaattattaaaaaaataaccgatatcgtaaaaacccccgttcaaattaccgaaccgcaaccgaaaataattaaaacgacgcatcctaaaataatcgctaccgcgataactaaacaaccgcaataaattaccgaatctaatattaccgtaacccaaaaaattacaaaacaaacaaaaccgataattaaaccgcaaaaaaaaacgacaaatattaaacaatattaccta

SEQ ID NO: 22365 - DNA, 599 bp, Artificial Sequence
  chemically treated genomic DNA (Homo sapiens) CpG-island No: 22365
atatattaagtaggttattgttgagtaggaacgtttgggattggatgtgttggtatatggcgaggtcgagcgtaatgatatggtggaatattttggcgagtatttcgacggatttgtttttacgtaaaacggttgggtatagagttacggttttcgttgcgtgaagttatcgattgttattggtgatattagtcgttcggtatcgattatcgtggagtgggcgaagtatgcgtaatcgttgatcgataaatcggtgaaagggatgttgacggggtcggtgattatattttgttggtcgttttcgcgtgaagatgttagtcgtgaaattatcgttaaatagattgcgttggtcgtgcgtgatgaagtggtcgatttggaagtcgttggaattggtattatttagattgacgaatcggcgttgcgcgaaggtttatcgttgcgtcgtagcgattgggatgcgtatttttagtggggcgtagaggtttttcgtattaacgtcgtcgtggcgaaagatgatatataaatttatatttatatgtgttattgcgagtttaacgatattatggattcgattgcggcgttggacgtagacgttatta

SEQ ID NO: 22366 - DNA, 599 bp, Artificial Sequence
  chemically treated genomic DNA (Homo sapiens) CpG-island No: 22366
taataacgtctacgtccaacgccgcaatcgaatccataatatcgttaaactcgcaataacacatataaatataaatttatatatcatctttcgccacgacgacgttaatacgaaaaacctctacgccccactaaaaatacgcatcccaatcgctacgacgcaacgataaaccttcgcgcaacgccgattcgtcaatctaaataataccaattccaacgacttccaaatcgaccacttcatcacgcacgaccaacgcaatctatttaacgataatttcacgactaacatcttcacgcgaaaacgaccaacaaaatataatcaccgaccccgtcaacatccctttcaccgatttatcgatcaacgattacgcatacttcgcccactccacgataatcgataccgaacgactaatatcaccaataacaatcgataacttcacgcaacgaaaaccgtaactctatacccaaccgttttacgtaaaaacaaatccgtcgaaatactcgccaaaatattccaccatatcattacgctcgacctcgccatataccaacacatccaatcccaaacgttcctactcaacaataacctacttaatatat

SEQ ID NO: 22367 - DNA, 599 bp, Artificial Sequence
  chemically treated genomic DNA (Homo sapiens) CpG-island No: 22367
tgatgacgtttgcgtttagcgtcgtaatcgaatttatgatgtcgttgaattcgtaataatatatgtgagtgtggatttgtgtgttatttttcgttacggcggcgttgatacggaaggtttttacgttttattggagatacgtattttagtcgttacgacgtagcggtaaattttcgcgtagcgtcggttcgttaatttggatgatgttaattttagcggtttttagatcggttattttattacgtacggttagcgtaatttgtttggcgatggttttacggttgatatttttacgcgggaacgattagtagagtatggttatcggtttcgttagtattttttttatcggtttgtcggttagcgattgcgtatatttcgtttattttacggtaatcggtgtcgggcggttaatgttattaatgataatcggtggttttacgtagcgggaatcgtagttttgtatttaatcgttttgcgtaaagataaattcgtcgaggtgttcgttaaagtattttattatgttattacgttcggtttcgttatgtattagtatatttagttttaaacgtttttgtttaataatggtttgtttgatatgt

SEQ ID NO: 22368 - DNA, 599 bp, Artificial Sequence
  chemically treated genomic DNA (Homo sapiens) CpG-island No: 22368
acatatcaaacaaaccattattaaacaaaaacgtttaaaactaaatatactaatacataacgaaaccgaacgtaataacataataaaatactttaacgaacacctcgacgaatttatctttacgcaaaacgattaaatacaaaactacgattcccgctacgtaaaaccaccgattatcattaataacattaaccgcccgacaccgattaccgtaaaataaacgaaatatacgcaatcgctaaccgacaaaccgataaaaaaaatactaacgaaaccgataaccatactctactaatcgttcccgcgtaaaaatatcaaccgtaaaaccatcgccaaacaaattacgctaaccgtacgtaataaaataaccgatctaaaaaccgctaaaattaacatcatccaaattaacgaaccgacgctacgcgaaaatttaccgctacgtcgtaacgactaaaatacgtatctccaataaaacgtaaaaaccttccgtatcaacgccgccgtaacgaaaaataacacacaaatccacactcacatatattattacgaattcaacgacatcataaattcgattacgacgctaaacgcaaacgtcatca

SEQ ID NO: 22369 - DNA, 573 bp, Artificial Sequence
  chemically treated genomic DNA (Homo sapiens) CpG-island No: 22369
ttttttaaaatggagcggaggaggaaaatgtttattatagttttatttcgtttttcgtagacggttagtattaattagtagcgcgtagagcgagtataaagttaggggaggagtttgttgttgttttagtaataattacggaaattaagacgagcgcggtcgcggaagtatcgcggtttatatatttcgtagttaggcgggttttgggagaggcgcgagttaggtttggtcggcgttcgcggagaaaagaagtagttaagtttatgaattataatttcggttgtcgttttttttttttttaatcgttaagtgcgttaaggtaggaatgacgtatgcgttgcgtttagaggcggggttaagtcggatttgaatttataacgtatgcgttttatggagtttgttgggggagggaagcggggtggttggcgtgacgcggaaggcgggttttttgcgttcgtgggcggagttattagtttcgggcgggtttttcgtcgatttgaattcgaaaaggttattttggattttttagagttaaatgttggttttttagataagggtttttttatttttttt

SEQ ID NO: 22370 - DNA, 573 bp, Artificial Sequence
  chemically treated genomic DNA (Homo sapiens) CpG-island No: 22370
aaaaaaaataaaaaaacccttatctaaaaaaccaacatttaactctaaaaaatccaaaataaccttttcgaattcaaatcgacgaaaaacccgcccgaaactaataactccgcccacgaacgcaaaaaacccgccttccgcgtcacgccaaccaccccgcttccctcccccaacaaactccataaaacgcatacgttataaattcaaatccgacttaaccccgcctctaaacgcaacgcatacgtcattcctaccttaacgcacttaacgattaaaaaaaaaaaaaacgacaaccgaaattataattcataaacttaactacttcttttctccgcgaacgccgaccaaacctaactcgcgcctctcccaaaacccgcctaactacgaaatatataaaccgcgatacttccgcgaccgcgctcgtcttaatttccgtaattattactaaaacaacaacaaactcctcccctaactttatactcgctctacgcgctactaattaatactaaccgtctacgaaaaacgaaataaaactataataaacattttcctcctccgctccattttaaaaaa

SEQ ID NO: 22371 - DNA, 573 bp, Artificial Sequence
  chemically treated genomic DNA (Homo sapiens) CpG-island No: 22371
ggaaaaaatggggggatttttgtttggggaattagtatttaattttgggaagtttaaaataattttttcgggtttaggtcggcggaaagttcgttcgaagttagtggtttcgtttacgagcgtaaaagattcgtttttcgcgttacgttagttatttcgttttttttttttagtaagttttataaggcgtatgcgttatgagtttaggttcgatttaatttcgtttttaagcgtagcgtatgcgttatttttattttagcgtatttaacggttaggagaggagaaagcggtaatcggggttgtagtttatgggtttgattgtttttttttttcgcgggcgtcgattaggtttggttcgcgttttttttaggattcgtttggttgcgagatatgtaagtcgcgatattttcgcgatcgcgttcgttttggttttcgtggttgttgttggggtaatagtaggttttttttttagttttgtattcgttttgcgcgttattaattggtgttagtcgtttgcggggggcggggtgaagttgtgatggatatttttttttttcgttttattttgggaaa

SEQ ID NO: 22372 - DNA, 573 bp, Artificial Sequence
  chemically treated genomic DNA (Homo sapiens) CpG-island No: 22372
tttcccaaaataaaacgaaaaaaaaaaatatccatcacaacttcaccccgccccccgcaaacgactaacaccaattaataacgcgcaaaacgaatacaaaactaaaaaaaaaacctactattaccccaacaacaaccacgaaaaccaaaacgaacgcgatcgcgaaaatatcgcgacttacatatctcgcaaccaaacgaatcctaaaaaaaacgcgaaccaaacctaatcgacgcccgcgaaaaaaaaaaacaatcaaacccataaactacaaccccgattaccgctttctcctctcctaaccgttaaatacgctaaaataaaaataacgcatacgctacgcttaaaaacgaaattaaatcgaacctaaactcataacgcatacgccttataaaacttactaaaaaaaaaaaacgaaataactaacgtaacgcgaaaaacgaatcttttacgctcgtaaacgaaaccactaacttcgaacgaactttccgccgacctaaacccgaaaaaattattttaaacttcccaaaattaaatactaattccccaaacaaaaatccccccattttttcc

SEQ ID NO: 22373 - DNA, 545 bp, Artificial Sequence
  chemically treated genomic DNA (Homo sapiens) CpG-island No: 22373
gcgggtattgcgggtcgggagttacggggtttggattcgggtgcgaggggcgggggttttcgtcgttttttcggtttttgcgttgggggttcgttttgatcgcgtacgcggggttagaatgtatttatttgagtagtacggcggcgtttgttatcgtgtttagcgtcgatagcggtagtaggtagcggtttatgtcgggtcggggataggcgttaggcgttaggggtcggcgcggagtttgttgtatattagtcgtttgggtagtttcgaggaagagcgcgcgacgtagttataggcgagcggaggcgtaggcgcggttgggttcgcgttcggaattgggttgcgaggggcggggcgcgggcggagggggcggggattttagggacgggatttatgagtatcggttttgagcgttgttatagttgggattggtggttttaggagtttgtgggcgtggttagttcgggggcggggtttatggtttgttcgaatgacgttatatttgtcgtagcgtataaggcgttacgtagttttggagtgaaata

SEQ ID NO: 22374 - DNA, 545 bp, Artificial Sequence
  chemically treated genomic DNA (Homo sapiens) CpG-island No: 22374
tatttcactccaaaactacgtaacgccttatacgctacgacaaatataacgtcattcgaacaaaccataaaccccgcccccgaactaaccacgcccacaaactcctaaaaccaccaatcccaactataacaacgctcaaaaccgatactcataaatcccgtccctaaaatccccgccccctccgcccgcgccccgcccctcgcaacccaattccgaacgcgaacccaaccgcgcctacgcctccgctcgcctataactacgtcgcgcgctcttcctcgaaactacccaaacgactaatatacaacaaactccgcgccgacccctaacgcctaacgcctatccccgacccgacataaaccgctacctactaccgctatcgacgctaaacacgataacaaacgccgccgtactactcaaataaatacattctaaccccgcgtacgcgatcaaaacgaacccccaacgcaaaaaccgaaaaaacgacgaaaacccccgcccctcgcacccgaatccaaaccccgtaactcccgacccgcaatacccgc

SEQ ID NO: 22375 - DNA, 545 bp, Artificial Sequence
  chemically treated genomic DNA (Homo sapiens) CpG-island No: 22375
tattttattttagaattgcgtagcgttttatacgttgcggtaagtgtgacgttattcgaataaattataggtttcgttttcggattagttacgtttataggtttttgaaattattaattttagttgtgatagcgtttaggatcgatgtttataggtttcgtttttaggattttcgtttttttcgttcgcgtttcgtttttcgtagtttagtttcggacgcgggtttagtcgcgtttgcgttttcgttcgtttgtggttgcgtcgcgcgttttttttcggagttatttaggcggttggtgtgtagtaagtttcgcgtcgatttttgacgtttgacgtttgttttcggttcggtatgagtcgttatttgttgtcgttgtcggcgttgggtacggtagtaggcgtcgtcgtgttgtttaagtgagtatattttagtttcgcgtgcgcggttaaggcgggtttttagcgtaggggtcgggaaggcggcggagattttcgtttttcgtattcgggtttaggtttcgtagttttcgattcgtagtgttcgt

SEQ ID NO: 22376 - DNA, 545 bp, Artificial Sequence
  chemically treated genomic DNA (Homo sapiens) CpG-island No: 22376
acgaacactacgaatcgaaaactacgaaacctaaacccgaatacgaaaaacgaaaatctccgccgccttcccgacccctacgctaaaaacccgccttaaccgcgcacgcgaaactaaaatatactcacttaaacaacacgacgacgcctactaccgtacccaacgccgacaacgacaacaaataacgactcataccgaaccgaaaacaaacgtcaaacgtcaaaaatcgacgcgaaacttactacacaccaaccgcctaaataactccgaaaaaaaacgcgcgacgcaaccacaaacgaacgaaaacgcaaacgcgactaaacccgcgtccgaaactaaactacgaaaaacgaaacgcgaacgaaaaaaacgaaaatcctaaaaacgaaacctataaacatcgatcctaaacgctatcacaactaaaattaataatttcaaaaacctataaacgtaactaatccgaaaacgaaacctataatttattcgaataacgtcacacttaccgcaacgtataaaacgctacgcaattctaaaataaaata

SEQ ID NO: 22377 - DNA, 948 bp, Artificial Sequence
  chemically treated genomic DNA (Homo sapiens) CpG-island No: 22377
tcgtgttagatacggtgggttcgttcgtgttagatacggtgggttcgttcgtgttagatacggtggattcgttcgtgttgtgttagatacggtggattcgttcgtgttagacgcggtggattcgttcgtgttagatacggtggattcgttcgtgttgtgttagatacggtggattcgttcgtgttgtgttagatacggtggattcgttcgtgttagatacggtgggttcgttcgtgttagatacggtgggttcgttcgtgttagacgcggtgggttcgttcgtgttagacgcggtggattttttcgtgttgtgttagatacggtggattcgttcgtgttagatacggtggattcgttcgtgttagatacggtggattcgttcgtgttagatacggtggattcgttcgtgttgtgttagatacggtggattcgttcgtgttagatacggtgggttcgttcgtgttagatacggtgggttcgttcgtgttagacgcggtgggttcgttcgtgttagacgcggtggattttttcgtgttgtgttagatacggtggattcgttcgtgttagatacggtggattcgttcgtgttagatacggtggattcgttcgtgttagatacggtggattcgttcgtgttgtgttagatacggtggattcgttcgtgttgtgttagatacggtgggttcgttcgtgttgtgttagatacggtggattcgttcgtgttgtgttagatacggtgggttcgttcgtgttagacgcggtgggttcgttcgtgttagacgcggtgggttcgttcgtgttgtgttagatacggtgggttcgttcgtgttgtgttagatacggtgggttcgtttgtgttgtgttagatacggtgggttcgttcgtgttagatattgtttattgatttttttagtggatgtgaggaatgggatttgagatattgttgtt

SEQ ID NO: 22378 - DNA, 948 bp, Artificial Sequence
  chemically treated genomic DNA (Homo sapiens) CpG-island No: 22378
aacaacaatatctcaaatcccattcctcacatccactaaaaaaatcaataaacaatatctaacacgaacgaacccaccgtatctaacacaacacaaacgaacccaccgtatctaacacaacacgaacgaacccaccgtatctaacacaacacgaacgaacccaccgcgtctaacacgaacgaacccaccgcgtctaacacgaacgaacccaccgtatctaacacaacacgaacgaatccaccgtatctaacacaacacgaacgaacccaccgtatctaacacaacacgaacgaatccaccgtatctaacacaacacgaacgaatccaccgtatctaacacgaacgaatccaccgtatctaacacgaacgaatccaccgtatctaacacgaacgaatccaccgtatctaacacaacacgaaaaaatccaccgcgtctaacacgaacgaacccaccgcgtctaacacgaacgaacccaccgtatctaacacgaacgaacccaccgtatctaacacgaacgaatccaccgtatctaacacaacacgaacgaatccaccgtatctaacacgaacgaatccaccgtatctaacacgaacgaatccaccgtatctaacacgaacgaatccaccgtatctaacacaacacgaaaaaatccaccgcgtctaacacgaacgaacccaccgcgtctaacacgaacgaacccaccgtatctaacacgaacgaacccaccgtatctaacacgaacgaatccaccgtatctaacacaacacgaacgaatccaccgtatctaacacaacacgaacgaatccaccgtatctaacacgaacgaatccaccgcgtctaacacgaacgaatccaccgtatctaacacaacacgaacgaatccaccgtatctaacacgaacgaacccaccgtatctaacacgaacgaacccaccgtatctaacacga

SEQ ID NO: 22379 - DNA, 948 bp, Artificial Sequence
  chemically treated genomic DNA (Homo sapiens) CpG-island No: 22379
gatagtaatgttttaggttttattttttatatttattgaggaagttaatgggtaatgtttaatacgaacgagtttatcgtgtttaatataatataaacgagtttatcgtgtttaatataatacgaacgagtttatcgtgtttaatataatacgaacgagtttatcgcgtttaatacgaacgagtttatcgcgtttaatacgaacgagtttatcgtgtttaatataatacgaacgagtttatcgtgtttaatataatacgaacgagtttatcgtgtttaatataatacgaacgagtttatcgtgtttaatataatacgaacgagtttatcgtgtttaatacgaacgagtttatcgtgtttaatacgaacgagtttatcgtgtttaatacgaacgagtttatcgtgtttaatataatacgaaggagtttatcgcgtttaatacgaacgaatttatcgcgtttaatacgaacgaatttatcgtgtttaatacgaacgaatttatcgtgtttaatacgaacgagtttatcgtgtttaatataatacgaacgagtttatcgtgtttaatacgaacgagtttatcgtgtttaatacgaacgagtttatcgtgtttaatacgaacgagtttatcgtgtttaatataatacgaaggagtttatcgcgtttaatacgaacgaatttatcgcgtttaatacgaacgaatttatcgtgtttaatacgaacgaatttatcgtgtttaatacgaacgagtttatcgtgtttaatataatacgaacgagtttatcgtgtttaatataatacgaacgagtttatcgtgtttaatacgaacgagtttatcgcgtttaatacgaacgagtttatcgtgtttaatataatacgaacgagtttatcgtgtttaatacgaacgagtttatcgtgtttaatacgaacgagtttatcgtgtttaatacga

SEQ ID NO: 22380 - DNA, 948 bp, Artificial Sequence
  chemically treated genomic DNA (Homo sapiens) CpG-island No: 22380
tcgtattaaacacgataaactcgttcgtattaaacacgataaactcgttcgtattaaacacgataaactcgttcgtattatattaaacacgataaactcgttcgtattaaacgcgataaactcgttcgtattaaacacgataaactcgttcgtattatattaaacacgataaactcgttcgtattatattaaacacgataaactcgttcgtattaaacacgataaattcgttcgtattaaacacgataaattcgttcgtattaaacgcgataaattcgttcgtattaaacgcgataaactccttcgtattatattaaacacgataaactcgttcgtattaaacacgataaactcgttcgtattaaacacgataaactcgttcgtattaaacacgataaactcgttcgtattatattaaacacgataaactcgttcgtattaaacacgataaattcgttcgtattaaacacgataaattcgttcgtattaaacgcgataaattcgttcgtattaaacgcgataaactccttcgtattatattaaacacgataaactcgttcgtattaaacacgataaactcgttcgtattaaacacgataaactcgttcgtattaaacacgataaactcgttcgtattatattaaacacgataaactcgttcgtattatattaaacacgataaactcgttcgtattatattaaacacgataaactcgttcgtattatattaaacacgataaactcgttcgtattaaacgcgataaactcgttcgtattaaacgcgataaactcgttcgtattatattaaacacgataaactcgttcgtattatattaaacacgataaactcgtttatattatattaaacacgataaactcgttcgtattaaacattacccattaacttcctcaataaatataaaaaataaaacctaaaacattactatc

SEQ ID NO: 22381 - DNA, 521 bp, Artificial Sequence
  chemically treated genomic DNA (Homo sapiens) CpG-island No: 22381
cgtgaattttcgaacgtttacggttggttgtgacgtaatcgaggtttgggtttaattagttacggttggggttcggttgtttttgggtgataattttaatttggtcgtttatttgtagttggtaggtgaacggtataatgcgttcgttaatttttgtttcgatgtagcggtgttcgatattattgtggatgtggtaagcgaagtttagcggcgttgatttcgtaggtaaattaacgatattatttttcggcgtaaagacgtatattcggtcgttaaagatttgattacgtatttcgtcgagtatttcgtcggaattagttatttttttttgttacgtaattagtttacgtagttaggtaattcggtttttatgtttcgaacgtgcgtcgttagtagtcgcgttttttttatatttttagtgcgtagtaatatttaattttgtatttttatgtatttgtttggtgcggatttggattttaacggtttttttattcggttttagaattacggtatgaatagat

SEQ ID NO: 22382 - DNA, 521 bp, Artificial Sequence
  chemically treated genomic DNA (Homo sapiens) CpG-island No: 22382
atctattcataccgtaattctaaaaccgaataaaaaaaccgttaaaatccaaatccgcaccaaacaaatacataaaaatacaaaattaaatattactacgcactaaaaatataaaaaaaacgcgactactaacgacgcacgttcgaaacataaaaaccgaattacctaactacgtaaactaattacgtaacaaaaaaaaataactaattccgacgaaatactcgacgaaatacgtaatcaaatctttaacgaccgaatatacgtctttacgccgaaaaataatatcgttaatttacctacgaaatcaacgccgctaaacttcgcttaccacatccacaataatatcgaacaccgctacatcgaaacaaaaattaacgaacgcattataccgttcacctaccaactacaaataaacgaccaaattaaaattatcacccaaaaacaaccgaaccccaaccgtaactaattaaacccaaacctcgattacgtcacaaccaaccgtaaacgttcgaaaattcacg

SEQ ID NO: 22383 - DNA, 521 bp, Artificial Sequence
  chemically treated genomic DNA (Homo sapiens) CpG-island No: 22383
gtttatttatatcgtggttttggggtcgggtggaaaaatcgttgagatttaaattcgtattaaatagatgtatgaagatgtagagttgggtgttgttgcgtattggaaatataaagagggcgcggttgttggcggcgtacgttcgggatatgaagatcggattgtttggttgcgtaaattgattgcgtggtaggaagagatggttgatttcggcgaaatgttcgacgaagtacgtagttaggtttttgacgatcgggtgtacgtttttacgtcgaaaggtgatgtcgttgatttgtttgcgggattaacgtcgttggatttcgtttattatatttatagtgatgtcggatatcgttgtatcggggtaaaaattggcgggcgtattgtgtcgtttatttattagttgtagatgggcgattagattgaaattattatttagaaatagtcgaattttagtcgtgattggttaaatttaaatttcggttacgttataattagtcgtgggcgttcgaaaatttacg

SEQ ID NO: 22384 - DNA, 521 bp, Artificial Sequence
  chemically treated genomic DNA (Homo sapiens) CpG-island No: 22384
cgtaaattttcgaacgcccacgactaattataacgtaaccgaaatttaaatttaaccaatcacgactaaaattcgactatttctaaataataatttcaatctaatcgcccatctacaactaataaataaacgacacaatacgcccgccaatttttaccccgatacaacgatatccgacatcactataaatataataaacgaaatccaacgacgttaatcccgcaaacaaatcaacgacatcacctttcgacgtaaaaacgtacacccgatcgtcaaaaacctaactacgtacttcgtcgaacatttcgccgaaatcaaccatctcttcctaccacgcaatcaatttacgcaaccaaacaatccgatcttcatatcccgaacgtacgccgccaacaaccgcgccctctttatatttccaatacgcaacaacacccaactctacatcttcatacatctatttaatacgaatttaaatctcaacgatttttccacccgaccccaaaaccacgatataaataaac

SEQ ID NO: 22385 - DNA, 1024 bp, Artificial Sequence
  chemically treated genomic DNA (Homo sapiens) CpG-island No: 22385
gcgggtcgattatcgaggtgtgtaaagattgatagtcgttcgtttttggaatggcgatatagttttttacgcggttcggacgcggtttgtataggttgtgtatttggtttagtacgcgataataggtgttagaattattgacgattacgcggaaagcgtagatcgattggttcggtagttacgaaatcgcgtattatatgttgggtatcgtagttggttcgtatttttattcgattattgtgcgtgagttttagcggatgattggcgaagaaattaaagcgtagattttggaaagagaaggtcgtttgtcggatgtcgttatcgtttgtgttggcggcggttcgaatgttatcggtatgtttgttgattttattaatgaaattaacgtcggtttgattggtgtggagttaggtggttacggtatcgaaattggcgagtacggcgtatcgttaaaatatggtcgcgtgggtatttatttcggtatgaaagcgtcgatgatgtaaatcgaagacgggtagattgaagaattttattttattttcgtcggattggatttttcgtttgtcggtttataatacgcgtattttaatagtattggacgcgttgattacgtgtttattatcgatgatgaagtttttgaagtttttaaaacgttgtgtttgtacgaagggattatttcggcgttggaatttttttacgttttaggagttttcggtttggttaatttatttttacgatatttcgttttgattgtcgtttattgggggtttatgttggttgaaatcgacggcgaaatcgtgtttagttcgcgtggcgcgttagttataggaatggaaaattttttgtagagcgcggttcgcgattaggtttatagtaatacgcgggtacgatttttaatggtgcgaaaaggtttttttgcgttatcggaaaattcgtaaggtattcgtgggtaggatgaatttgttcgcgtgagttgggatgaggcgttggattttatttattaataatataaacgtattcgtga

SEQ ID NO: 22386 - DNA, 1024 bp, Artificial Sequence
  chemically treated genomic DNA (Homo sapiens) CpG-island No: 22386
tcacgaatacgtttatattattaataaataaaatccaacgcctcatcccaactcacgcgaacaaattcatcctacccacgaataccttacgaattttccgataacgcaaaaaaaccttttcgcaccattaaaaatcgtacccgcgtattactataaacctaatcgcgaaccgcgctctacaaaaaattttccattcctataactaacgcgccacgcgaactaaacacgatttcgccgtcgatttcaaccaacataaacccccaataaacgacaatcaaaacgaaatatcgtaaaaataaattaaccaaaccgaaaactcctaaaacgtaaaaaaattccaacgccgaaataatcccttcgtacaaacacaacgttttaaaaacttcaaaaacttcatcatcgataataaacacgtaatcaacgcgtccaatactattaaaatacgcgtattataaaccgacaaacgaaaaatccaatccgacgaaaataaaataaaattcttcaatctacccgtcttcgatttacatcatcgacgctttcataccgaaataaatacccacgcgaccatattttaacgatacgccgtactcgccaatttcgataccgtaaccacctaactccacaccaatcaaaccgacgttaatttcattaataaaatcaacaaacataccgataacattcgaaccgccgccaacacaaacgataacgacatccgacaaacgaccttctctttccaaaatctacgctttaatttcttcgccaatcatccgctaaaactcacgcacaataatcgaataaaaatacgaaccaactacgatacccaacatataatacgcgatttcgtaactaccgaaccaatcgatctacgctttccgcgtaatcgtcaataattctaacacctattatcgcgtactaaaccaaatacacaacctatacaaaccgcgtccgaaccgcgtaaaaaactatatcgccattccaaaaacgaacgactatcaatctttacacacctcgataatcgacccgc

SEQ ID NO: 22387 - DNA, 1024 bp, Artificial Sequence
  chemically treated genomic DNA (Homo sapiens) CpG-island No: 22387
ttacgaatgcgtttatgttgttggtgaataagatttagcgttttattttaatttacgcgaataaatttattttgtttacgaatgttttgcgggtttttcggtgacgtaagaaagttttttcgtattattggaaatcgtattcgcgtattgttgtgaatttggtcgcgaatcgcgttttgtaaggagttttttatttttgtggttaacgcgttacgcgagttaaatacggtttcgtcgtcggttttaattagtatgggtttttaatgggcggtagttagaacgggatatcgtgaggatgagttggttaaatcgaggatttttgaggcgtgggaggattttagcgtcgggatgattttttcgtgtaggtatagcgttttgaaggttttaagggttttattatcggtaatagatacgtaattagcgcgtttagtgttgttaagatacgcgtgttgtgggtcgatagacgggaaatttagttcggcggagatggagtaagattttttaatttgttcgttttcggtttgtattatcggcgtttttatatcgaaatagatatttacgcgattatgttttagcggtgcgtcgtgttcgttagtttcgatatcgtgattatttggttttatattaattaggtcgacgttggttttattgatgaaattagtaaatatgtcgatggtattcgaatcgtcgttaatataggcgataacggtattcggtaggcgattttttttttttagaatttgcgttttggttttttcgttaattattcgttgaaatttacgtataatggtcggataaggatgcgggttagttgcggtgtttagtatatagtgcgcggtttcgtaattatcggattagtcgatttacgtttttcgcgtgatcgttaatgattttgatatttgttatcgcgtgttgggttagatgtatagtttgtataagtcgcgttcgggtcgcgtgaaagattatatcgttattttaaaagcgaacggttattagtttttgtatatttcgatgatcggttcgt

SEQ ID NO: 22388 - DNA, 1024 bp, Artificial Sequence
  chemically treated genomic DNA (Homo sapiens) CpG-island No: 22388
acgaaccgatcatcgaaatatacaaaaactaataaccgttcgcttttaaaataacgatataatctttcacgcgacccgaacgcgacttatacaaactatacatctaacccaacacgcgataacaaatatcaaaatcattaacgatcacgcgaaaaacgtaaatcgactaatccgataattacgaaaccgcgcactatatactaaacaccgcaactaacccgcatccttatccgaccattatacgtaaatttcaacgaataattaacgaaaaaaccaaaacgcaaattctaaaaaaaaaaaatcgcctaccgaataccgttatcgcctatattaacgacgattcgaataccatcgacatatttactaatttcatcaataaaaccaacgtcgacctaattaatataaaaccaaataatcacgatatcgaaactaacgaacacgacgcaccgctaaaacataatcgcgtaaatatctatttcgatataaaaacgccgataatacaaaccgaaaacgaacaaattaaaaaatcttactccatctccgccgaactaaatttcccgtctatcgacccacaacacgcgtatcttaacaacactaaacgcgctaattacgtatctattaccgataataaaacccttaaaaccttcaaaacgctatacctacacgaaaaaatcatcccgacgctaaaatcctcccacgcctcaaaaatcctcgatttaaccaactcatcctcacgatatcccgttctaactaccgcccattaaaaacccatactaattaaaaccgacgacgaaaccgtatttaactcgcgtaacgcgttaaccacaaaaataaaaaactccttacaaaacgcgattcgcgaccaaattcacaacaatacgcgaatacgatttccaataatacgaaaaaactttcttacgtcaccgaaaaacccgcaaaacattcgtaaacaaaataaatttattcgcgtaaattaaaataaaacgctaaatcttattcaccaacaacataaacgcattcgtaa

SEQ ID NO: 22389 - DNA, 685 bp, Artificial Sequence
  chemically treated genomic DNA (Homo sapiens) CpG-island No: 22389
cgattgtggggttcggtggcgtttgttattggttcggcgttgacgggtaaattggttattatgtttgattatcgggtgattttcgcgttgttgacgttgggcgtggtatttatgttgttcggtttttttattcgttcgacgatttagttataaggggtaagtcgttagtaggagagtatcggttggtttgcgtggttggcgttggttcgttagaattggcgttttttggtttgcgtttgtttattgtagggggtatatgcggtttattacggttttagcgttatttattggtaggtagttggttattcggtttcggcggtggggtatttgtggtcgttgggcgtggtggcggaagttattatttttgcgttgagtaataaattttttcgtcgttgtagtgtacgcgatatgttgttgatttcggcgatttgcggcgtagtgcgttggggtattatgggaatttattatgtttgtaattcgtgaatacgatcgttaaacgttagtttaagttcgaatgcgacgttattaggattatcgtgtaatattatacggtagatagataaatagagggttattagtatcgacgatacggttttgttgggtaaattgcgttttaagacgttggttagcgacggaatatttaaggaataacgtgcgggaattttcgttattaataaagaaatag

SEQ ID NO: 22390 - DNA, 685 bp, Artificial Sequence
  chemically treated genomic DNA (Homo sapiens) CpG-island No: 22390
ctatttctttattaataacgaaaattcccgcacgttattccttaaatattccgtcgctaaccaacgtcttaaaacgcaatttacccaacaaaaccgtatcgtcgatactaataaccctctatttatctatctaccgtataatattacacgataatcctaataacgtcgcattcgaacttaaactaacgtttaacgatcgtattcacgaattacaaacataataaattcccataataccccaacgcactacgccgcaaatcgccgaaatcaacaacatatcgcgtacactacaacgacgaaaaaatttattactcaacgcaaaaataataacttccgccaccacgcccaacgaccacaaataccccaccgccgaaaccgaataaccaactacctaccaataaataacgctaaaaccgtaataaaccgcatataccccctacaataaacaaacgcaaaccaaaaaacgccaattctaacgaaccaacgccaaccacgcaaaccaaccgatactctcctactaacgacttaccccttataactaaatcgtcgaacgaataaaaaaaccgaacaacataaataccacgcccaacgtcaacaacgcgaaaatcacccgataatcaaacataataaccaatttacccgtcaacgccgaaccaataacaaacgccaccgaaccccacaatcg

SEQ ID NO: 22391 - DNA, 685 bp, Artificial Sequence
  chemically treated genomic DNA (Homo sapiens) CpG-island No: 22391
ttgtttttttattgatgacgaaaattttcgtacgttgttttttgggtatttcgtcgttggttagcgttttaaagcgtaatttgtttagtaaggtcgtatcgtcgatgttgataattttttgtttgtttatttgtcgtgtggtgttgtacggtggttttggtggcgtcgtattcgggtttaaattggcgtttggcgatcgtgtttacgggttgtaggtatgatagatttttataatgttttagcgtattacgtcgtaaatcgtcgagattaatagtatatcgcgtgtattataacggcggaaaagtttattatttagcgtaaagataatgattttcgttattacgtttagcgattataaatattttatcgtcgaggtcgagtagttagttgtttgttagtaaatggcgttaaaatcgtaataggtcgtatgtgttttttgtaataaataaacgtaggttagaaagcgttagttttggcgaattagcgttaattacgtagattaatcggtgtttttttgttggcgatttgttttttgtggttgaatcgtcggacggatgagaaagtcgagtagtatggatgttacgtttaacgttaatagcgcgaggattattcgataattaaatatagtgattagtttgttcgttagcgtcgagttaatgataaacgttatcgagttttatagtcg

SEQ ID NO: 22392 - DNA, 685 bp, Artificial Sequence
  chemically treated genomic DNA (Homo sapiens) CpG-island No: 22392
cgactataaaactcgataacgtttatcattaactcgacgctaacgaacaaactaatcactatatttaattatcgaataatcctcgcgctattaacgttaaacgtaacatccatactactcgactttctcatccgtccgacgattcaaccacaaaaaacaaatcgccaacaaaaaaacaccgattaatctacgtaattaacgctaattcgccaaaactaacgctttctaacctacgtttatttattacaaaaaacacatacgacctattacgattttaacgccatttactaacaaacaactaactactcgacctcgacgataaaatatttataatcgctaaacgtaataacgaaaatcattatctttacgctaaataataaacttttccgccgttataatacacgcgatatactattaatctcgacgatttacgacgtaatacgctaaaacattataaaaatctatcatacctacaacccgtaaacacgatcgccaaacgccaatttaaacccgaatacgacgccaccaaaaccaccgtacaacaccacacgacaaataaacaaacaaaaaattatcaacatcgacgatacgaccttactaaacaaattacgctttaaaacgctaaccaacgacgaaatacccaaaaaacaacgtacgaaaattttcgtcatcaataaaaaaacaa

SEQ ID NO: 22393 - DNA, 562 bp, Artificial Sequence
  chemically treated genomic DNA (Homo sapiens) CpG-island No: 22393
taatttcgtacgattgcgtgttttaagtcgacgtagcggtttattttcgtattgtagacggggaaattgaggtttgaggcggtcggggtggggtagatttttcggcgagttcgagttttcgttttcggttagtttcgttttggttcgtaagaagtattcggggcgcgaggcgaaggcgtatagcgcggggttaggttgggtttagtagcgcgatggtagtttagcggttgggtaagcgcgtgttgagtaagttgtagtttttatcgcgggttcgcgggttagggggtagtttcggggggttgtagaagcggtacgcgcgcgttatcgttaagtatgatcggcgggagttgtagcggcggttggacgtggagaagtggatcgacgggcgtttggaggagttgtatcgcggtatggtgagttcggggagggttcgggggtggtcggggatagatagagttcgggcgcggagattttacgtttttggggtttcggtgtatattcgttggtgtacggttagtttggtttgtataagaggacgagcgttttagggtcgggtatttat

SEQ ID NO: 22394 - DNA, 562 bp, Artificial Sequence
  chemically treated genomic DNA (Homo sapiens) CpG-island No: 22394
ataaatacccgaccctaaaacgctcgtcctcttatacaaaccaaactaaccgtacaccaacgaatatacaccgaaaccccaaaaacgtaaaatctccgcgcccgaactctatctatccccgaccacccccgaaccctccccgaactcaccataccgcgatacaactcctccaaacgcccgtcgatccacttctccacgtccaaccgccgctacaactcccgccgatcatacttaacgataacgcgcgcgtaccgcttctacaaccccccgaaactaccccctaacccgcgaacccgcgataaaaactacaacttactcaacacgcgcttacccaaccgctaaactaccatcgcgctactaaacccaacctaaccccgcgctatacgccttcgcctcgcgccccgaatacttcttacgaaccaaaacgaaactaaccgaaaacgaaaactcgaactcgccgaaaaatctaccccaccccgaccgcctcaaacctcaatttccccgtctacaatacgaaaataaaccgctacgtcgacttaaaacacgcaatcgtacgaaatta

SEQ ID NO: 22395 - DNA, 562 bp, Artificial Sequence
  chemically treated genomic DNA (Homo sapiens) CpG-island No: 22395
atgagtgttcggttttggggcgttcgtttttttgtgtagattaggttggtcgtgtattagcgagtgtgtatcgagattttaagggcgtggggttttcgcgttcgggttttatttgttttcgattattttcgagtttttttcgggtttattatgtcgcggtatagtttttttaggcgttcgtcgatttatttttttacgtttagtcgtcgttgtagttttcgtcggttatatttgacggtgacgcgcgcgtgtcgtttttgtagtttttcgggattgttttttggttcgcgggttcgcgatggagattgtagtttgtttagtacgcgtttgtttagtcgttgagttgttatcgcgttgttggatttagtttggtttcgcgttgtgcgttttcgtttcgcgtttcgggtgttttttacgggttagggcggggttagtcgggggcgggggttcgggttcgtcgggaggtttgttttatttcggtcgttttaggttttagttttttcgtttgtagtgcgagagtaggtcgttgcgtcggtttgaggtacgtagtcgtgcgaagttg

SEQ ID NO: 22396 - DNA, 562 bp, Artificial Sequence
  chemically treated genomic DNA (Homo sapiens) CpG-island No: 22396
caacttcgcacgactacgtacctcaaaccgacgcaacgacctactctcgcactacaaacgaaaaaactaaaacctaaaacgaccgaaataaaacaaacctcccgacgaacccgaacccccgcccccgactaaccccgccctaacccgtaaaaaacacccgaaacgcgaaacgaaaacgcacaacgcgaaaccaaactaaatccaacaacgcgataacaactcaacgactaaacaaacgcgtactaaacaaactacaatctccatcgcgaacccgcgaaccaaaaaacaatcccgaaaaactacaaaaacgacacgcgcgcgtcaccgtcaaatataaccgacgaaaactacaacgacgactaaacgtaaaaaaataaatcgacgaacgcctaaaaaaactataccgcgacataataaacccgaaaaaaactcgaaaataatcgaaaacaaataaaacccgaacgcgaaaaccccacgcccttaaaatctcgatacacactcgctaatacacgaccaacctaatctacacaaaaaaacgaacgccccaaaaccgaacactcat

SEQ ID NO: 22397 - DNA, 771 bp, Artificial Sequence
  chemically treated genomic DNA (Homo sapiens) CpG-island No: 22397
gttttttgcgtttcgtttttagtttattcgttcggtttttatcgtggatgttgcgttttcggtcggtcgttaggattttagagaggagtagcgattttagtagggcgagaaacgttcggtttcgttttagttcgtatagttgcgttatggttagtttagtcgagacgcgtaggcgacgttattagtcgttggggtttcgcgattaggtgcgggaagttttttaacgcgtacgcgtaatggagcgtttcgcgtttaggtgtcgacgtttcgggagggttcgttaggtgttaaagttttcggaagtcgttttttcggatttttagtgtggggacgttcggttttttcggcgcgcgatgtttgggtttgttttttattcgcgttttcgtcgtttgcgatatttaacggtttttagcgcgtttagagtcgcgttatattttttaacgcgcggaggtcgttagagttaatggcgaacgtttattggaagcggttttcgaaggtggtcgggtaggtagggggcggggcgtatttggttaggtagggcgagttgggcgtaggcgtaaagggtaggtatttgcgcggtcgtttttcggttttgggcgtatttgggttcgtttttggtgtcggggaagaggcggggtttgcgcgggtttcgtttttaatagaatttggcggggcggggcggggcgtttgttcgttgagtatttgttattttttttttgggtttggtgacgacgtcggaggagggttttcgttttaggattggttttaggg

SEQ ID NO: 22398 - DNA, 771 bp, Artificial Sequence
  chemically treated genomic DNA (Homo sapiens) CpG-island No: 22398
ccctaaaaccaatcctaaaacgaaaaccctcctccgacgtcgtcaccaaacccaaaaaaaaaataacaaatactcaacgaacaaacgccccgccccgccccgccaaattctattaaaaacgaaacccgcgcaaaccccgcctcttccccgacaccaaaaacgaacccaaatacgcccaaaaccgaaaaacgaccgcgcaaatacctaccctttacgcctacgcccaactcgccctacctaaccaaatacgccccgccccctacctacccgaccaccttcgaaaaccgcttccaataaacgttcgccattaactctaacgacctccgcgcgttaaaaaatataacgcgactctaaacgcgctaaaaaccgttaaatatcgcaaacgacgaaaacgcgaataaaaaacaaacccaaacatcgcgcgccgaaaaaaccgaacgtccccacactaaaaatccgaaaaaacgacttccgaaaactttaacacctaacgaaccctcccgaaacgtcgacacctaaacgcgaaacgctccattacgcgtacgcgttaaaaaacttcccgcacctaatcgcgaaaccccaacgactaataacgtcgcctacgcgtctcgactaaactaaccataacgcaactatacgaactaaaacgaaaccgaacgtttctcgccctactaaaatcgctactcctctctaaaatcctaacgaccgaccgaaaacgcaacatccacgataaaaaccgaacgaataaactaaaaacgaaacgcaaaaaac

SEQ ID NO: 22399 - DNA, 771 bp, Artificial Sequence
  chemically treated genomic DNA (Homo sapiens) CpG-island No: 22399
ttttgaggttagttttagagcgaaggttttttttcgacgtcgttattaagtttaagggaagggtggtaggtgtttagcgggtagacgtttcgtttcgtttcgttaggttttgttgggggcgaggttcgcgtaagtttcgtttttttttcggtattaggggcgggtttaggtgcgtttagggtcggggagcggtcgcgtaggtgtttgttttttgcgtttgcgtttagttcgttttgtttagttaggtgcgtttcgttttttgtttgttcggttattttcgggagtcgtttttaataggcgttcgttattggttttggcgattttcgcgcgttgggaggtgtagcgcggttttgaacgcgttgagggtcgttgagtgtcgtaggcggcgagggcgcgagtgaggagtagatttaggtatcgcgcgtcgagaaggtcgggcgtttttatattgaaggttcggaaaggcgattttcgggggttttggtatttggcggattttttcggagcgtcggtatttgaacgcgaggcgttttattgcgcgtgcgcgttgaggggtttttcgtatttgatcgcgagattttaacggttggtggcgtcgtttgcgcgtttcggttgagttggttatggcgtagttgtgcgggttgaggcggagtcgggcgtttttcgttttgttgggatcgttgtttttttttggggttttggcggtcgatcgagaacgtagtatttacggtgagggtcgggcgggtaggttggaggcggggcgtagggggt

SEQ ID NO: 22400 - DNA, 771 bp, Artificial Sequence
  chemically treated genomic DNA (Homo sapiens) CpG-island No: 22400
accccctacgccccgcctccaacctacccgcccgaccctcaccgtaaatactacgttctcgatcgaccgccaaaaccccaaaaaaaaacaacgatcccaacaaaacgaaaaacgcccgactccgcctcaacccgcacaactacgccataaccaactcaaccgaaacgcgcaaacgacgccaccaaccgttaaaatctcgcgatcaaatacgaaaaacccctcaacgcgcacgcgcaataaaacgcctcgcgttcaaataccgacgctccgaaaaaatccgccaaataccaaaacccccgaaaatcgcctttccgaaccttcaatataaaaacgcccgaccttctcgacgcgcgatacctaaatctactcctcactcgcgccctcgccgcctacgacactcaacgaccctcaacgcgttcaaaaccgcgctacacctcccaacgcgcgaaaatcgccaaaaccaataacgaacgcctattaaaaacgactcccgaaaataaccgaacaaacaaaaaacgaaacgcacctaactaaacaaaacgaactaaacgcaaacgcaaaaaacaaacacctacgcgaccgctccccgaccctaaacgcacctaaacccgcccctaataccgaaaaaaaaacgaaacttacgcgaacctcgcccccaacaaaacctaacgaaacgaaacgaaacgtctacccgctaaacacctaccacccttcccttaaacttaataacgacgtcgaaaaaaaaccttcgctctaaaactaacctcaaaa

SEQ ID NO: 22401 - DNA, 712 bp, Artificial Sequence
  chemically treated genomic DNA (Homo sapiens) CpG-island No: 22401
cgttcgtaagcgattgtggtggtttcggtttattggtttattcgtggaataggagtgatcgcgatggagacgtcgtttacgatttatgattttggtggtttttcgtaggcgttgtacgatacgtattattttgtttcgggttcgtttgcgttggtatagcgtttggttgagttgttagcgtcgatttcggggacgttggataaagaagtttggggtttttgatacggtttgggggggcgggttattaaaaaggattttgattttttgattcggtcggttcgacgttttttagattcggttttttatattaaaacgtaattttagttgcggatatcgtttcgttagcgttaataacgtcggagttattatttgtcgtttaaaattaaagttgttgataatacgtagtattttttgcggtatttgacgacgttagaaagttcgtttattatttgatcgatattttgtaaaattcgttgcgtttatttataaattcgtttttttttttcggtaatggtgacgcggcgggtggtgcggtgtaataatattacgtttagcgtttgttttagtaaggcgatgcgtttgttgacgaacgtcggtgaaacgtttagttttttcgttacggcggtaaaattagttcggcgagttattagtataaagacgcgtaaattatttagtagcggtaaattatttatgattcgtgttttatgtttta

SEQ ID NO: 22402 - DNA, 712 bp, Artificial Sequence
  chemically treated genomic DNA (Homo sapiens) CpG-island No: 22402
taaaacataaaacacgaatcataaataatttaccgctactaaataatttacgcgtctttatactaataactcgccgaactaattttaccgccgtaacgaaaaaactaaacgtttcaccgacgttcgtcaacaaacgcatcgccttactaaaacaaacgctaaacgtaatattattacaccgcaccacccgccgcgtcaccattaccgaaaaaaaaaaacgaatttataaataaacgcaacgaattttacaaaatatcgatcaaataataaacgaactttctaacgtcgtcaaataccgcaaaaaatactacgtattatcaacaactttaattttaaacgacaaataataactccgacgttattaacgctaacgaaacgatatccgcaactaaaattacgttttaatataaaaaaccgaatctaaaaaacgtcgaaccgaccgaatcaaaaaatcaaaatcctttttaataacccgcccccccaaaccgtatcaaaaaccccaaacttctttatccaacgtccccgaaatcgacgctaacaactcaaccaaacgctataccaacgcaaacgaacccgaaacaaaataatacgtatcgtacaacgcctacgaaaaaccaccaaaatcataaatcgtaaacgacgtctccatcgcgatcactcctattccacgaataaaccaataaaccgaaaccaccacaatcgcttacgaacg

SEQ ID NO: 22403 - DNA, 712 bp, Artificial Sequence
  chemically treated genomic DNA (Homo sapiens) CpG-island No: 22403
tgaaatataaaatacgaattatgaataatttatcgttgttgaatgatttgcgcgtttttatgttggtggttcgtcgggttggttttgtcgtcgtggcggaagaattgggcgttttatcggcgttcgttagtaagcgtatcgttttgttggagtaaacgttaaacgtggtgttgttatatcgtattattcgtcgcgttattattatcgaagaaggagagcggatttatgaatgggcgtagcggattttgtaggatgtcggttagatgatggacgaattttttgacgtcgttaggtgtcgtaggggatgttgcgtattattagtagttttggttttggacgataggtggtggtttcggcgttattagcgttggcgaagcggtattcgtaattggaattacgttttgatgtggaagatcgagtttagagaacgtcggatcggtcggattagagggttaagattttttttaataattcgtttttttaagtcgtgttaaaagttttaggtttttttatttagcgttttcgggatcggcgttaatagtttaattagacgttgtgttagcgtaggcgaattcggagtaggataatgcgtatcgtatagcgtttgcgggaagttattaaagttatgaatcgtgggcggcgtttttatcgcggttatttttgttttacgggtaaattagtgagtcgaaattattataatcgtttgcgggcg

SEQ ID NO: 22404 - DNA, 712 bp, Artificial Sequence
  chemically treated genomic DNA (Homo sapiens) CpG-island No: 22404
cgcccgcaaacgattataataatttcgactcactaatttacccgtaaaacaaaaataaccgcgataaaaacgccgcccacgattcataactttaataacttcccgcaaacgctatacgatacgcattatcctactccgaattcgcctacgctaacacaacgtctaattaaactattaacgccgatcccgaaaacgctaaataaaaaaacctaaaacttttaacacgacttaaaaaaacgaattattaaaaaaaatcttaaccctctaatccgaccgatccgacgttctctaaactcgatcttccacatcaaaacgtaattccaattacgaataccgcttcgccaacgctaataacgccgaaaccaccacctatcgtccaaaaccaaaactactaataatacgcaacatcccctacgacacctaacgacgtcaaaaaattcgtccatcatctaaccgacatcctacaaaatccgctacgcccattcataaatccgctctccttcttcgataataataacgcgacgaataatacgatataacaacaccacgtttaacgtttactccaacaaaacgatacgcttactaacgaacgccgataaaacgcccaattcttccgccacgacgacaaaaccaacccgacgaaccaccaacataaaaacgcgcaaatcattcaacaacgataaattattcataattcgtattttatatttca

SEQ ID NO: 22405 - DNA, 619 bp, Artificial Sequence
  chemically treated genomic DNA (Homo sapiens) CpG-island No: 22405
gacgaataggaataggatgttgagggtaaaaatgagcgcgatgtgtttcgtcggggtgacgaaaattagtaggttgattagcgagtaggcgacgatgatttatttgaaggcggtgacgcggttcgaagcggtttagtaggcgtgaggagtaaagcgggtcgaatatggtggcgaggttgtcgtaaagtaaaaattgggtcgttaatttcgggtgatttattacgtattttacgaagtagagcgtcgtttcgtcgcgtattacgttggagtaggtcgttattattttgaacgcgtatatgatgcgttattggttgttgtttagtagtagtttaaggtttttcgttatcgacgagttcggttgtattttaaaggtgtagcgttttttggtcgtgaagaagtagacgtagagtagtattacgtcgtttagttttagtacgtatatggcgtcgaagtagtttatttgttcgttttttttgtcgatgatgtttattagcggtagcgaatgttttgaatagcgagcgaagtcgtcggcggtaggaagaacggtaagattgaagggatggcgttatattagttgtatgtagtcgatttaaaaaatgagtttttgggcgtgtaaata

SEQ ID NO: 22406 - DNA, 619 bp, Artificial Sequence
  chemically treated genomic DNA (Homo sapiens) CpG-island No: 22406
tatttacacgcccaaaaactcattttttaaatcgactacatacaactaatataacgccatcccttcaatcttaccgttcttcctaccgccgacgacttcgctcgctattcaaaacattcgctaccgctaataaacatcatcgacaaaaaaaacgaacaaataaactacttcgacgccatatacgtactaaaactaaacgacgtaatactactctacgtctacttcttcacgaccaaaaaacgctacacctttaaaatacaaccgaactcgtcgataacgaaaaaccttaaactactactaaacaacaaccaataacgcatcatatacgcgttcaaaataataacgacctactccaacgtaatacgcgacgaaacgacgctctacttcgtaaaatacgtaataaatcacccgaaattaacgacccaatttttactttacgacaacctcgccaccatattcgacccgctttactcctcacgcctactaaaccgcttcgaaccgcgtcaccgccttcaaataaatcatcgtcgcctactcgctaatcaacctactaattttcgtcaccccgacgaaacacatcgcgctcatttttaccctcaacatcctattcctattcgtc

SEQ ID NO: 22407 - DNA, 619 bp, Artificial Sequence
  chemically treated genomic DNA (Homo sapiens) CpG-island No: 22407
tatttgtacgtttaaaaatttattttttagatcggttgtatgtagttaatatagcgttatttttttagttttgtcgttttttttgtcgtcggcggtttcgttcgttatttagggtattcgttgtcgttggtgagtattatcggtaaaggggacgagtaggtgggttatttcggcgttatgtgcgtgttggggttgagcggcgtggtgttgttttacgtttgtttttttacgattaaagagcgttatatttttgaggtgtagtcgggttcgtcggtggcgaaagattttaagttgttgttgggtaatagttagtggcgtattatgtgcgcgtttaagatgatggcgatttgttttaacgtggtgcgcggcggggcgacgttttatttcgtgaaatacgtgatggattattcggagttggcgatttagtttttattttacggtagtttcgttattatgttcggttcgttttgttttttacgtttgttgggtcgtttcgagtcgcgttatcgtttttaagtggattatcgtcgtttattcgttgattagtttgttgattttcgttatttcggcggagtatatcgcgtttatttttgtttttaatattttgtttttgttcgtt

SEQ ID NO: 22408 - DNA, 619 bp, Artificial Sequence
  chemically treated genomic DNA (Homo sapiens) CpG-island No: 22408
aacgaacaaaaacaaaatattaaaaacaaaaataaacgcgatatactccgccgaaataacgaaaatcaacaaactaatcaacgaataaacgacgataatccacttaaaaacgataacgcgactcgaaacgacccaacaaacgtaaaaaacaaaacgaaccgaacataataacgaaactaccgtaaaataaaaactaaatcgccaactccgaataatccatcacgtatttcacgaaataaaacgtcgccccgccgcgcaccacgttaaaacaaatcgccatcatcttaaacgcgcacataatacgccactaactattacccaacaacaacttaaaatctttcgccaccgacgaacccgactacacctcaaaaatataacgctctttaatcgtaaaaaaacaaacgtaaaacaacaccacgccgctcaaccccaacacgcacataacgccgaaataacccacctactcgtcccctttaccgataatactcaccaacgacaacgaataccctaaataacgaacgaaaccgccgacgacaaaaaaaacgacaaaactaaaaaaataacgctatattaactacatacaaccgatctaaaaaataaatttttaaacgtacaaata

SEQ ID NO: 22409 - DNA, 544 bp, Artificial Sequence
  chemically treated genomic DNA (Homo sapiens) CpG-island No: 22409
  misc_feature (148)..(148): n is either a, c, g or t
attgtttagcgtaagtacgtagttatcgttatgtttagcgttagttagataattaatagcgatcgcgaacgttattcgcgttagaattaacgtgtaattatgtttttttttgtaattgttcgtttattagtcgtaagtagcggtcgtnagtgtcgttagttgtaggtcgtgggttattataattaacgtggtgttatgtttacggttgagggaaaatagtaggtcggtaattttatcgttcgtttggcggttaaggttgtcggtgggttcgtcggtaaatagtatattaggtcgattattaaaggttcgtgttagcgttattcgttgttgtttatcgtcggaaagttgtgtcggaagatgatttagacgtttatttagttttaattgttcgagtaacgttttcgtttcgttacgatttttcgcgttatttttatcgcgtagtagagtcggaagttcgacgttttttagcgcgttaagggtaggaattaatataaatgattgaaaaataaagtcgacgtgttgcgcgtaattttgttcgcgtttt

SEQ ID NO: 22410 - DNA, 544 bp, Artificial Sequence
  chemically treated genomic DNA (Homo sapiens) CpG-island No: 22410
  misc_feature (397)..(397): n is either a, c, g or t
aaaacgcgaacaaaattacgcgcaacacgtcgactttatttttcaatcatttatattaattcctacccttaacgcgctaaaaaacgtcgaacttccgactctactacgcgataaaaataacgcgaaaaatcgtaacgaaacgaaaacgttactcgaacaattaaaactaaataaacgtctaaatcatcttccgacacaactttccgacgataaacaacaacgaataacgctaacacgaacctttaataatcgacctaatatactatttaccgacgaacccaccgacaaccttaaccgccaaacgaacgataaaattaccgacctactattttccctcaaccgtaaacataacaccacgttaattataataacccacgacctacaactaacgacactnacgaccgctacttacgactaataaacgaacaattacaaaaaaaaacataattacacgttaattctaacgcgaataacgttcgcgatcgctattaattatctaactaacgctaaacataacgataactacgtacttacgctaaacaat

SEQ ID NO: 22411 - DNA, 544 bp, Artificial Sequence
  chemically treated genomic DNA (Homo sapiens) CpG-island No: 22411
  misc_feature (397)..(397): n is either a, c, g or t
gaagcgcgggtaaagttgcgcgtaatacgtcggttttgttttttagttatttatgttaatttttatttttaacgcgttggaaaacgtcgagttttcggttttgttgcgcggtgagagtagcgcggaaagtcgtaacggggcgaaagcgttgttcgaatagttagggttgggtaaacgtttggattatttttcggtatagtttttcggcggtgaatagtaacgagtggcgttggtacgagtttttaatggtcgatttgatgtgttgtttgtcgacgaatttatcggtaattttgatcgttagacgggcgataaaattgtcgatttgttgtttttttttaatcgtgaatatggtattacgttgattatggtgatttacgatttgtaattggcggtattngcgatcgttgtttacggttggtgaacgggtagttgtaggaggaagtatgattgtacgttggttttggcgcgaatggcgttcgcgatcgttattaattgtttggttggcgttaagtatggcgatggttgcgtgtttgcgttgggtaat

SEQ ID NO: 22412 - DNA, 544 bp, Artificial Sequence
  chemically treated genomic DNA (Homo sapiens) CpG-island No: 22412
  misc_feature (148)..(148): n is either a, c, g or t
attacccaacgcaaacacgcaaccatcgccatacttaacgccaaccaaacaattaataacgatcgcgaacgccattcgcgccaaaaccaacgtacaatcatacttcctcctacaactacccgttcaccaaccgtaaacaacgatcgcnaataccgccaattacaaatcgtaaatcaccataatcaacgtaataccatattcacgattaaaaaaaaacaacaaatcgacaattttatcgcccgtctaacgatcaaaattaccgataaattcgtcgacaaacaacacatcaaatcgaccattaaaaactcgtaccaacgccactcgttactattcaccgccgaaaaactataccgaaaaataatccaaacgtttacccaaccctaactattcgaacaacgctttcgccccgttacgactttccgcgctactctcaccgcgcaacaaaaccgaaaactcgacgttttccaacgcgttaaaaataaaaattaacataaataactaaaaaacaaaaccgacgtattacgcgcaactttacccgcgcttc

SEQ ID NO: 22413 - DNA, 699 bp, Artificial Sequence
  chemically treated genomic DNA (Homo sapiens) CpG-island No: 22413
gttattacggttttgttttattggcgattattataatggttttattcgtattggcgtgggtttgtaacggtatagtgcgtaaagtatcggttttggcgggagaacgtttatcgttgtggagcgttgtcgggtttatttggaaattagggttaggtttggtattataaggcgttggttttgttgttatcgggattttcgtttcgttttattttgttagtaaaggatgggcgatggcgggttttatttttatcgcgtttggcggcgtatttgtcgtgatgcgcgttatgtttggttggatgtcggatcgttttggcggcgtgaaagtggcgattgtttttttgtttgtagaaacggtgggtttgttgttgttttggtaagttttaggtgtatgggtcgtattagcgggcgcggcgttaatcggagtcggatgttcgtttattttttttgcgttgggcgtggaggtggttaaacgcgtttttttataagttcgcggtatcgtattgggcggttacgtcgcgttttaggatatcgttttcggcgttttcgggtcgtttcgggaatggtggcgattacgtttggttatttttcggtattttttgtcggggcgatttttgcggtgttgggtattattgttacgatattgttatttcgtcggggttaggaaataggtatgattagtattaggataatcgcgtttaa

SEQ ID NO: 22414 - DNA, 699 bp, Artificial Sequence
  chemically treated genomic DNA (Homo sapiens) CpG-island No: 22414
ttaaacgcgattatcctaatactaatcatacctatttcctaaccccgacgaaataacaatatcgtaacaataatacccaacaccgcaaaaatcgccccgacaaaaaataccgaaaaataaccaaacgtaatcgccaccattcccgaaacgacccgaaaacgccgaaaacgatatcctaaaacgcgacgtaaccgcccaatacgataccgcgaacttataaaaaaacgcgtttaaccacctccacgcccaacgcaaaaaaaataaacgaacatccgactccgattaacgccgcgcccgctaatacgacccatacacctaaaacttaccaaaacaacaacaaacccaccgtttctacaaacaaaaaaacaatcgccactttcacgccgccaaaacgatccgacatccaaccaaacataacgcgcatcacgacaaatacgccgccaaacgcgataaaaataaaacccgccatcgcccatcctttactaacaaaataaaacgaaacgaaaatcccgataacaacaaaaccaacgccttataataccaaacctaaccctaatttccaaataaacccgacaacgctccacaacgataaacgttctcccgccaaaaccgatactttacgcactataccgttacaaacccacgccaatacgaataaaaccattataataatcgccaataaaacaaaaccgtaataac

SEQ ID NO: 22415 - DNA, 699 bp, Artificial Sequence
  chemically treated genomic DNA (Homo sapiens) CpG-island No: 22415
ttagacgcgattattttgatgttggttatatttgttttttgatttcgacgaaatgatagtatcgtgataataatatttagtatcgtagagatcgtttcggtaagaaatatcgaagagtaattaaacgtggtcgttattattttcggagcggttcggagacgtcgagggcgatattttgaaacgcggcgtaatcgtttagtgcggtgtcgcgaatttgtgaggggacgcgtttaattatttttacgtttagcgtaggaaagataagcgaatattcggtttcggttaacgtcgcgttcgttaatgcgatttatgtatttggggtttgttagagtagtaataagtttatcgtttttataagtagagagataatcgttatttttacgtcgttaaaacggttcggtatttagttaaatatgacgcgtattacgataaatgcgtcgttaaacgcggtaagagtaaagttcgttatcgtttattttttgttggtaaagtagagcgaaacgaaagtttcgataatagtaaaattaacgttttgtagtgttagatttaattttggtttttagataagttcgataacgttttatagcgatggacgttttttcgttagggtcggtattttgcgtattgtgtcgttataggtttacgttagtacgggtaagattattgtggtgatcgttagtggggtaaaatcgtaatggt

SEQ ID NO: 22416 - DNA, 699 bp, Artificial Sequence
  chemically treated genomic DNA (Homo sapiens) CpG-island No: 22416
accattacgattttaccccactaacgatcaccacaataatcttacccgtactaacgtaaacctataacgacacaatacgcaaaataccgaccctaacgaaaaaacgtccatcgctataaaacgttatcgaacttatctaaaaaccaaaattaaatctaacactacaaaacgttaattttactattatcgaaactttcgtttcgctctactttaccaacaaaaaataaacgataacgaactttactcttaccgcgtttaacgacgcatttatcgtaatacgcgtcatatttaactaaataccgaaccgttttaacgacgtaaaaataacgattatctctctacttataaaaacgataaacttattactactctaacaaaccccaaatacataaatcgcattaacgaacgcgacgttaaccgaaaccgaatattcgcttatctttcctacgctaaacgtaaaaataattaaacgcgtcccctcacaaattcgcgacaccgcactaaacgattacgccgcgtttcaaaatatcgccctcgacgtctccgaaccgctccgaaaataataacgaccacgtttaattactcttcgatatttcttaccgaaacgatctctacgatactaaatattattatcacgatactatcatttcgtcgaaatcaaaaaacaaatataaccaacatcaaaataatcgcgtctaa

SEQ ID NO: 22417 - DNA, 867 bp, Artificial Sequence
  chemically treated genomic DNA (Homo sapiens) CpG-island No: 22417
  misc_feature (793)..(794): n is either a, c, g or t
cgtattaattagattagtagcgcgtagtatacgatttgtagcgtagtaatcgtcgcgtttttttagtattattagtatcggtatgtcggtgtagcgacgtatatagtcggtgaaatattggtttgggttgtcgaggtggaatttacgtagtattacgtggtttatcgttagcgttattgtcgtatcggtgttttgtttcggtgttagttatagatcgtatagtttggcgattttagcgtagtttggtgtgacggtaatagttttggtttttttgtaacgtattttagtaaagaagtgagtattcggggtacgcgtttgcggtacgtttgatttttaggcgatgatgtagttggagttgtattagttagtagatttcggtacgttagtttgttcgttttaggtttgcggagacgtaggaggtaagtcgtagtattagtcgtagaagtttaagtaagtatcgttaattagcgagagatagcgtggtattcgatgcgtaagaaattatcgatattgtcggaattggcgagaaattagtaatacggttcgggtcgtagtttttgatggtgtaaacgttagatgcggcgattagttcgtttattttttgttaggaagaacgaataaatttatcgcgtttacgcgtttgtttaaagtttttcgttttatcggcgtttttaatgatagaagtttatgttttaatcggatcgttatgtagcgttttcgttttacgttatattcgtattaggcgttttatattaatcggtttgtaggtatgtaatatttgggtcgtttattnngttattttttttggttgtagttgaagtcgtatttaatgaaaaggcgttatttcgcgagaagattttcgaagta

SEQ ID NO: 22418 - DNA, 867 bp, Artificial Sequence
  chemically treated genomic DNA (Homo sapiens) CpG-island No: 22418
  misc_feature (74)..(75): n is either a, c, g or t
tacttcgaaaatcttctcgcgaaataacgccttttcattaaatacgacttcaactacaaccaaaaaaaataacnnaataaacgacccaaatattacatacctacaaaccgattaatataaaacgcctaatacgaatataacgtaaaacgaaaacgctacataacgatccgattaaaacataaacttctatcattaaaaacgccgataaaacgaaaaactttaaacaaacgcgtaaacgcgataaatttattcgttcttcctaacaaaaaataaacgaactaatcgccgcatctaacgtttacaccatcaaaaactacgacccgaaccgtattactaatttctcgccaattccgacaatatcgataatttcttacgcatcgaataccacgctatctctcgctaattaacgatacttacttaaacttctacgactaatactacgacttacctcctacgtctccgcaaacctaaaacgaacaaactaacgtaccgaaatctactaactaatacaactccaactacatcatcgcctaaaaatcaaacgtaccgcaaacgcgtaccccgaatactcacttctttactaaaatacgttacaaaaaaaccaaaactattaccgtcacaccaaactacgctaaaatcgccaaactatacgatctataactaacaccgaaacaaaacaccgatacgacaataacgctaacgataaaccacgtaatactacgtaaattccacctcgacaacccaaaccaatatttcaccgactatatacgtcgctacaccgacataccgatactaataatactaaaaaaacgcgacgattactacgctacaaatcgtatactacgcgctactaatctaattaatacg

SEQ ID NO: 22419 - DNA, 867 bp, Artificial Sequence
  chemically treated genomic DNA (Homo sapiens) CpG-island No: 22419
  misc_feature (74)..(75): n is either a, c, g or t
tgtttcgaaaattttttcgcgaggtagcgtttttttattggatacggttttaattatagttaaaaggagtggtnnggtgggcggtttaaatattgtatgtttgtaggtcgattgatataaaacgtttgatgcgaatgtggcgtgaagcgaaggcgttgtatagcgattcggttgaggtatgggtttttattattgaagacgtcgataaagcgaaaagttttaagtaggcgcgtggacgcggtggatttgttcgttttttttggtaggaggtgaacgaattgatcgtcgtatttaacgtttatattattaaaaattacggttcggatcgtgttgttggtttttcgttaatttcggtaatgtcgatggttttttacgtatcgggtgttacgttatttttcgttgattggcggtatttgtttaagtttttacgattggtattgcgatttgttttttgcgttttcgtaaatttggggcgagtaaattgacgtatcggaatttgttgattggtataattttagttatattatcgtttgggggttaaacgtgtcgtagacgcgtatttcggatgtttatttttttattgaagtgcgttataaagggattaaaattgttgtcgttatattagattacgttgaaatcgttaaattgtgcgatttgtggttggtatcgaaatagggtatcgatgcggtaatggcgttggcgatgggttacgtaatgttgcgtgaattttatttcgataatttaagttagtattttatcgattatgtgcgtcgttatatcgatatgtcgatgttggtgatgttggaagaacgcgacggttattacgttgtaggtcgtatgttgcgcgttgttgatttggttgatgcg

SEQ ID NO: 22420 - DNA, 867 bp, Artificial Sequence
  chemically treated genomic DNA (Homo sapiens) CpG-island No: 22420
  misc_feature (793)..(794): n is either a, c, g or t
cgcatcaaccaaatcaacaacgcgcaacatacgacctacaacgtaataaccgtcgcgttcttccaacatcaccaacatcgacatatcgatataacgacgcacataatcgataaaatactaacttaaattatcgaaataaaattcacgcaacattacgtaacccatcgccaacgccattaccgcatcgataccctatttcgataccaaccacaaatcgcacaatttaacgatttcaacgtaatctaatataacgacaacaattttaatccctttataacgcacttcaataaaaaaataaacatccgaaatacgcgtctacgacacgtttaacccccaaacgataatataactaaaattataccaatcaacaaattccgatacgtcaatttactcgccccaaatttacgaaaacgcaaaaaacaaatcgcaataccaatcgtaaaaacttaaacaaataccgccaatcaacgaaaaataacgtaacacccgatacgtaaaaaaccatcgacattaccgaaattaacgaaaaaccaacaacacgatccgaaccgtaatttttaataatataaacgttaaatacgacgatcaattcgttcacctcctaccaaaaaaaacgaacaaatccaccgcgtccacgcgcctacttaaaacttttcgctttatcgacgtcttcaataataaaaacccatacctcaaccgaatcgctatacaacgccttcgcttcacgccacattcgcatcaaacgttttatatcaatcgacctacaaacatacaatatttaaaccgcccaccnnaccactccttttaactataattaaaaccgtatccaataaaaaaacgctacctcgcgaaaaaattttcgaaaca

SEQ ID NO: 22421 - DNA, 506 bp, Artificial Sequence
  chemically treated genomic DNA (Homo sapiens) CpG-island No: 22421
tcgttagtatttcgttatcggtttgttgtagtatttgtttcggaacgttttggttgatgtgtaattttagtcggatgcgatttttttgtaatatcgtgggcgtgatttttatttttaggacggtttttttaaattttatcgacgtcgcgttatttttttcgttggaaatttgatatggaatttcgtttttttgtttaatgttggtaggttgaagatgtgaggttagtagacgcggattggcgataatatttagttgttgtttttgttcgagcgcggaaagtttaagatttagtaagcgttcgttgatgcgtttaatgttaaaatcgatatgcgttgtcgtcgtcgttacggagaggtcgttattaagcgtggtgatttgtttaacggtattagcgtgttgcgtatcggttagcgtttattttaacgttaatttacgtaaattttttttattaatggtgataatatgcgtcgatagtttaatttgttcgatcggtagatttatttgg

SEQ ID NO: 22422 - DNA, 506 bp, Artificial Sequence
  chemically treated genomic DNA (Homo sapiens) CpG-island No: 22422
ccaaataaatctaccgatcgaacaaattaaactatcgacgcatattatcaccattaataaaaaaaatttacgtaaattaacgttaaaataaacgctaaccgatacgcaacacgctaataccgttaaacaaatcaccacgcttaataacgacctctccgtaacgacgacgacaacgcatatcgattttaacattaaacgcatcaacgaacgcttactaaatcttaaactttccgcgctcgaacaaaaacaacaactaaatattatcgccaatccgcgtctactaacctcacatcttcaacctaccaacattaaacaaaaaaacgaaattccatatcaaatttccaacgaaaaaaataacgcgacgtcgataaaatttaaaaaaaccgtcctaaaaataaaaatcacgcccacgatattacaaaaaaatcgcatccgactaaaattacacatcaaccaaaacgttccgaaacaaatactacaacaaaccgataacgaaatactaacga

SEQ ID NO: 22423 - DNA, 506 bp, Artificial Sequence
  chemically treated genomic DNA (Homo sapiens) CpG-island No: 22423
ttaaatggatttgtcggtcgggtaggttgagttgtcggcgtatattgttattattaatgaaaaaagtttgcgtgagttagcgttgaaatggacgttggtcgatgcgtaatacgttggtgtcgttgggtaagttattacgtttggtagcgattttttcgtagcgacggcgataacgtatgtcggttttaatattgggcgtattaacggacgtttgttggattttgagtttttcgcgttcgaataaaaatagtagttggatattatcgttagttcgcgtttgttggttttatatttttagtttgttagtattaaataggggagcgaaattttatattaggtttttagcggggaaagtggcgcgacgtcggtggaatttaaagaggtcgttttggggatggaggttacgtttacggtgttataaaaaggtcgtattcggttgaaattatatattagttagaacgtttcggggtaggtgttatagtaggtcgatggcgaagtgttggcga

SEQ ID NO: 22424 - DNA, 506 bp, Artificial Sequence
  chemically treated genomic DNA (Homo sapiens) CpG-island No: 22424
tcgccaacacttcgccatcgacctactataacacctaccccgaaacgttctaactaatatataatttcaaccgaatacgacctttttataacaccgtaaacgtaacctccatccccaaaacgacctctttaaattccaccgacgtcgcgccactttccccgctaaaaacctaatataaaatttcgctcccctatttaatactaacaaactaaaaatataaaaccaacaaacgcgaactaacgataatatccaactactatttttattcgaacgcgaaaaactcaaaatccaacaaacgtccgttaatacgcccaatattaaaaccgacatacgttatcgccgtcgctacgaaaaaatcgctaccaaacgtaataacttacccaacgacaccaacgtattacgcatcgaccaacgtccatttcaacgctaactcacgcaaacttttttcattaataataacaatatacgccgacaactcaacctacccgaccgacaaatccatttaa

SEQ ID NO: 22425 - DNA, 567 bp, Artificial Sequence
  chemically treated genomic DNA (Homo sapiens) CpG-island No: 22425
tttttgttcgagaatttggtggatgtcgacgatcgtagtatttagcgtttgttgtaggaagtggatttcgaatcgttgttgatcgcgttgaaaggagtcgagtagttattgcgcgagaaatttttgcgtaatatgtcgtagcgtgtcgtcgatattttgcgcgacgatttcgttaatcgtggttcggtgcgtttgtcgtaggtggaaaacgaatagaaagcgattttgttgattgtgcgtcgttttgtcgaaattggcgagatggtaattggtagcggcgaagatatttattcgttaattatgtatgtatgcgcgttttgcgatgtaataatttatcggtatatcggtcgattaatttaaaatttagattatttaattggcgatcggcggttaataattgaacgttttcggtattagtggttcggttgttgcgtatagcgtttcggtaaatattggcgaattgattttgacgttgattagcgaagtgaataaataaattagcgtttttgcgtcgaacgtgttgatttttgattagaatatgattttattagtttttttttttagtag

SEQ ID NO: 22426 - DNA, 567 bp, Artificial Sequence
  chemically treated genomic DNA (Homo sapiens) CpG-island No: 22426
ctactaaaaaaaaaaactaataaaatcatattctaatcaaaaatcaacacgttcgacgcaaaaacgctaatttatttattcacttcgctaatcaacgtcaaaatcaattcgccaatatttaccgaaacgctatacgcaacaaccgaaccactaataccgaaaacgttcaattattaaccgccgatcgccaattaaataatctaaattttaaattaatcgaccgatataccgataaattattacatcgcaaaacgcgcatacatacataattaacgaataaatatcttcgccgctaccaattaccatctcgccaatttcgacaaaacgacgcacaatcaacaaaatcgctttctattcgttttccacctacgacaaacgcaccgaaccacgattaacgaaatcgtcgcgcaaaatatcgacgacacgctacgacatattacgcaaaaatttctcgcgcaataactactcgactcctttcaacgcgatcaacaacgattcgaaatccacttcctacaacaaacgctaaatactacgatcgtcgacatccaccaaattctcgaacaaaaa

SEQ ID NO: 22427 - DNA, 567 bp, Artificial Sequence
  chemically treated genomic DNA (Homo sapiens) CpG-island No: 22427
ttgttggggaagaaggttgatggggttatgttttgattaagaattagtacgttcggcgtaaaaacgttggtttgtttgtttatttcgttggttagcgttagggttagttcgttaatgtttgtcgggacgttgtacgtagtaatcggattattgatgtcgggaacgtttagttgttggtcgtcggtcgttagttgggtggtttgggttttagattgatcgatcggtgtgtcggtgagttgttgtatcgtaaaacgcgtatgtatgtataattagcgggtaggtattttcgtcgttgttaattattatttcgttagtttcggtaaggcggcgtataattagtagaatcgttttttgttcgttttttatttgcgatagacgtatcggattacggttggcgagatcgtcgcgtagaatatcggcggtacgttgcgatatattgcgtaagaatttttcgcgtagtggttgttcggttttttttagcgcgattaatagcgattcggaatttattttttgtaatagacgttgaatgttgcgatcgtcgatatttattagattttcgaataggaa

SEQ ID NO: 22428 - DNA, 567 bp, Artificial Sequence
  chemically treated genomic DNA (Homo sapiens) CpG-island No: 22428
ttcctattcgaaaatctaataaatatcgacgatcgcaacattcaacgtctattacaaaaaataaattccgaatcgctattaatcgcgctaaaaaaaaccgaacaaccactacgcgaaaaattcttacgcaatatatcgcaacgtaccgccgatattctacgcgacgatctcgccaaccgtaatccgatacgtctatcgcaaataaaaaacgaacaaaaaacgattctactaattatacgccgccttaccgaaactaacgaaataataattaacaacgacgaaaatacctacccgctaattatacatacatacgcgttttacgatacaacaactcaccgacacaccgatcgatcaatctaaaacccaaaccacccaactaacgaccgacgaccaacaactaaacgttcccgacatcaataatccgattactacgtacaacgtcccgacaaacattaacgaactaaccctaacgctaaccaacgaaataaacaaacaaaccaacgtttttacgccgaacgtactaattcttaatcaaaacataaccccatcaaccttcttccccaacaa

SEQ ID NO: 22429 - DNA, 716 bp, Artificial Sequence
  chemically treated genomic DNA (Homo sapiens) CpG-island No: 22429
  misc_feature (369)..(369): n is either a, c, g or t
tttcgaagtggtgacgtaggtttttacggttgtcggaacgatcgaagttattagtatttagtacgcggtagtcgttagtcggtacgtaagtacggatttgtttagcgaatagttttatatagtcggtagatgttattgtcggagcgtcgtttattatttgagcgatatacggaacgcgcggagtttttagcgggtgtagtatgttttagcgtttataattttgattattacgcgttagttcggtgaaggaggttacgttataaacgttagaatttacgtcgtaatttttcgttaggattttagttgttttacggatttgacgtaggatagtatcgaagggtttgtatgtatgtaagtattcgcgtttanttttaattcgcgttttatttgtatgtttgtaggtcgtaacgttttttcgcgtatcgttttttttagcggttgtttatttattatttttaggtaattttgtaatacggttaatggcgtacgtaatttatggtttacgttggtaaaaaagttacgtcgcgttttttttagttgatgtatttgcgtgatattacgcgttattattagtaattgtttgtgggtataaggtatgacgcgaatttttagatgtcgttcggtgttgagtattagattgagcgggcgagaaaaattacgcgtttttagatattgcgtaaatttcgggtaacgtagtaggttaaggatgttttgtt

SEQ ID NO: 22430 - DNA, 716 bp, Artificial Sequence
  chemically treated genomic DNA (Homo sapiens) CpG-island No: 22430
  misc_feature (348)..(348): n is either a, c, g or t
aacaaaacatccttaacctactacgttacccgaaatttacgcaatatctaaaaacgcgtaatttttctcgcccgctcaatctaatactcaacaccgaacgacatctaaaaattcgcgtcataccttatacccacaaacaattactaataataacgcgtaatatcacgcaaatacatcaactaaaaaaaacgcgacgtaacttttttaccaacgtaaaccataaattacgtacgccattaaccgtattacaaaattacctaaaaataataaataaacaaccgctaaaaaaaacgatacgcgaaaaaacgttacgacctacaaacatacaaataaaacgcgaattaaaantaaacgcgaatacttacatacatacaaacccttcgatactatcctacgtcaaatccgtaaaacaactaaaatcctaacgaaaaattacgacgtaaattctaacgtttataacgtaacctccttcaccgaactaacgcgtaataatcaaaattataaacgctaaaacatactacacccgctaaaaactccgcgcgttccgtatatcgctcaaataataaacgacgctccgacaataacatctaccgactatataaaactattcgctaaacaaatccgtacttacgtaccgactaacgactaccgcgtactaaatactaataacttcgatcgttccgacaaccgtaaaaacctacgtcaccacttcgaaa

SEQ ID NO: 22431 - DNA, 716 bp, Artificial Sequence
  chemically treated genomic DNA (Homo sapiens) CpG-island No: 22431
  misc_feature (348)..(348): n is either a, c, g or t
ggtagaatatttttaatttattgcgttattcggagtttacgtaatatttgaaaacgcgtgatttttttcgttcgtttaatttggtgtttaatatcgggcggtatttggaaattcgcgttatgttttatatttataaatagttgttgatggtggcgcgtgatgttacgtaaatgtattaattggaaggggcgcggcgtaatttttttgttaacgtgagttatgagttacgtacgttattgatcgtgttatagggttatttggagatgatgaatgagtagtcgttggaaggggcggtacgcgaaaaagcgttgcgatttgtaggtatgtaagtggggcgcggattggggntgggcgcggatatttgtatgtatgtaggtttttcggtattattttgcgttaggttcgtgaagtaattgagattttggcgaaagattacggcgtaggttttgacgtttatagcgtgattttttttatcgagttggcgcgtgatggttaggattgtgaacgttggaatatgttgtattcgttggaaatttcgcgcgtttcgtatatcgtttaggtgatgaacgacgtttcggtagtggtatttatcgattatatgaaattgttcgttgagtaggttcgtatttacgtatcggttgacgattatcgcgtattgggtattgatggtttcggtcgtttcgatagtcgtgagaatttgcgttattatttcgaag

SEQ ID NO: 22432 - DNA, 716 bp, Artificial Sequence
  chemically treated genomic DNA (Homo sapiens) CpG-island No: 22432
  misc_feature (369)..(369): n is either a, c, g or t
cttcgaaataataacgcaaattctcacgactatcgaaacgaccgaaaccatcaatacccaatacgcgataatcgtcaaccgatacgtaaatacgaacctactcaacgaacaatttcatataatcgataaataccactaccgaaacgtcgttcatcacctaaacgatatacgaaacgcgcgaaatttccaacgaatacaacatattccaacgttcacaatcctaaccatcacgcgccaactcgataaaaaaaatcacgctataaacgtcaaaacctacgccgtaatctttcgccaaaatctcaattacttcacgaacctaacgcaaaataataccgaaaaacctacatacatacaaatatccgcgcccanccccaatccgcgccccacttacatacctacaaatcgcaacgctttttcgcgtaccgccccttccaacgactactcattcatcatctccaaataaccctataacacgatcaataacgtacgtaactcataactcacgttaacaaaaaaattacgccgcgccccttccaattaatacatttacgtaacatcacgcgccaccatcaacaactatttataaatataaaacataacgcgaatttccaaataccgcccgatattaaacaccaaattaaacgaacgaaaaaaatcacgcgttttcaaatattacgtaaactccgaataacgcaataaattaaaaatattctacc

SEQ ID NO: 22433 - DNA, 703 bp, Artificial Sequence
  chemically treated genomic DNA (Homo sapiens) CpG-island No: 22433
acgttggcgggtaataatggttggttgggttatgaatagttcggtgttatggcgttttagggtcgtcggcggaggtttttgcggaggtcggagacggtggtgtcgggggaggcgatcgagacggatttcgagcgttttgcgttttcgtcggaggaggaggagttgtatttgggtttttcgggttcgacgcgcggtcgttttacggggttgcgggtggttggggaagtcgcggagatcgattcggagtcggagtcggagtcggaatcgacggtcgcgtcgagggatttgtttttattcgtggtgtagcgggaatcggcggaggaggtttggggtacggaggaggtttcggcgttcgttttcgcgcgttcgtttttgtaatttcggttggcggagagttaggcgcggttggattacgacgtggcggtcgtcgtgagcggtgtttatcgtcgtgtaggtcgcgacgtggtcgttttggttagtaggttggcggtagtttaggcggcggggttggcggcggtttatagcgtgcgtttggcgcgcggggatttttgtgcgttggtcgagcgtttggatatcgtggttggttgtcgtttgttgtcggatattcgcggcgtgttagggatcgagtttgagaaagattcggggtcgcgggtttagttatgattttattttttaatttgattgtaatttgggggtaggtttt

SEQ ID NO: 22434 - DNA, 703 bp, Artificial Sequence
  chemically treated genomic DNA (Homo sapiens) CpG-island No: 22434
aaaacctacccccaaattacaatcaaattaaaaaataaaatcataactaaacccgcgaccccgaatctttctcaaactcgatccctaacacgccgcgaatatccgacaacaaacgacaaccaaccacgatatccaaacgctcgaccaacgcacaaaaatccccgcgcgccaaacgcacgctataaaccgccgccaaccccgccgcctaaactaccgccaacctactaaccaaaacgaccacgtcgcgacctacacgacgataaacaccgctcacgacgaccgccacgtcgtaatccaaccgcgcctaactctccgccaaccgaaattacaaaaacgaacgcgcgaaaacgaacgccgaaacctcctccgtaccccaaacctcctccgccgattcccgctacaccacgaataaaaacaaatccctcgacgcgaccgtcgattccgactccgactccgactccgaatcgatctccgcgacttccccaaccacccgcaaccccgtaaaacgaccgcgcgtcgaacccgaaaaacccaaatacaactcctcctcctccgacgaaaacgcaaaacgctcgaaatccgtctcgatcgcctcccccgacaccaccgtctccgacctccgcaaaaacctccgccgacgaccctaaaacgccataacaccgaactattcataacccaaccaaccattattacccgccaacgt

SEQ ID NO: 22435 - DNA, 703 bp, Artificial Sequence
  chemically treated genomic DNA (Homo sapiens) CpG-island No: 22435
aaggtttatttttaaattgtagttaggttgggaagtagaattatggttaggttcgcggtttcgggttttttttaggttcggtttttggtacgtcgcggatgttcggtagtaggcggtagttagttacgatgtttagacgttcggttagcgtataaaggttttcgcgcgttaggcgtacgttgtgggtcgtcgttagtttcgtcgtttgggttgtcgttagtttattagttagggcggttacgtcgcggtttgtacggcggtagatatcgtttacggcggtcgttacgtcgtggtttagtcgcgtttggtttttcgttagtcgaagttgtaggagcgagcgcgcgggggcgggcgtcggggtttttttcgtgttttaggtttttttcgtcgattttcgttgtattacgagtggaggtaggtttttcggcgcggtcgtcggtttcggtttcggtttcggtttcgagtcggttttcgcggtttttttagttattcgtagtttcgtggggcggtcgcgcgtcgggttcgaaggatttaggtatagttttttttttttcgacgaggacgtagagcgttcggaattcgtttcggtcgtttttttcggtattatcgttttcggttttcgtaggggttttcgtcgacgattttgggacgttatggtatcgaattatttataatttagttagttattattgttcgttagcgt

SEQ ID NO: 22436 - DNA, 703 bp, Artificial Sequence
  chemically treated genomic DNA (Homo sapiens) CpG-island No: 22436
acgctaacgaacaataataactaactaaattataaataattcgataccataacgtcccaaaatcgtcgacgaaaacccctacgaaaaccgaaaacgataataccgaaaaaaacgaccgaaacgaattccgaacgctctacgtcctcgtcgaaaaaaaaaaaactatacctaaatccttcgaacccgacgcgcgaccgccccacgaaactacgaataactaaaaaaaccgcgaaaaccgactcgaaaccgaaaccgaaaccgaaaccgacgaccgcgccgaaaaacctacctccactcgtaatacaacgaaaatcgacgaaaaaaacctaaaacacgaaaaaaaccccgacgcccgcccccgcgcgctcgctcctacaacttcgactaacgaaaaaccaaacgcgactaaaccacgacgtaacgaccgccgtaaacgatatctaccgccgtacaaaccgcgacgtaaccgccctaactaataaactaacgacaacccaaacgacgaaactaacgacgacccacaacgtacgcctaacgcgcgaaaacctttatacgctaaccgaacgtctaaacatcgtaactaactaccgcctactaccgaacatccgcgacgtaccaaaaaccgaacctaaaaaaaacccgaaaccgcgaacctaaccataattctacttcccaacctaactacaatttaaaaataaacctt

SEQ ID NO: 22437 - DNA, 577 bp, Artificial Sequence
  chemically treated genomic DNA (Homo sapiens) CpG-island No: 22437
cgtgtcgttaaaattattatcggcggtaatttggagaatggcggtacggtttaaatgaatagcgaaggggggaaatcggggaatgtattgatcgttaacggtaattatatcggaaataatggtttgatgacgtttaacgcgacgttggggggtataattcgtttatcgataagatgaacgtgaaaggcgatatttaagggaatattcgcgttcgggttgataatattggcggcgtcggtgtataaacggttaacggtattgaatttattgaggttggcggtaattttgtaggtaatttcgcgttgattatcggaattgtcgaagttggggtttacgtttatacgttggttaaagggaaggggaatgacgagaaaaattggtatttgattagtaaatgggacggcgtaacgtagcggatatattcgattttattaataatttttttgttgtggattcggaagttttattagtttatcgttcggagtcggaagttatattagtaatattgtcgtagttaattcgttgtttagttatcgtttatacgatcggtatttatgtttgtagtttttgaaaatat

SEQ ID NO: 22438 - DNA, 577 bp, Artificial Sequence
  chemically treated genomic DNA (Homo sapiens) CpG-island No: 22438
atattttcaaaaactacaaacataaataccgatcgtataaacgataactaaacaacgaattaactacgacaatattactaatataacttccgactccgaacgataaactaataaaacttccgaatccacaacaaaaaaattattaataaaatcgaatatatccgctacgttacgccgtcccatttactaatcaaataccaatttttctcgtcattccccttccctttaaccaacgtataaacgtaaaccccaacttcgacaattccgataatcaacgcgaaattacctacaaaattaccgccaacctcaataaattcaataccgttaaccgtttatacaccgacgccgccaatattatcaacccgaacgcgaatattcccttaaatatcgcctttcacgttcatcttatcgataaacgaattataccccccaacgtcgcgttaaacgtcatcaaaccattatttccgatataattaccgttaacgatcaatacattccccgatttccccccttcgctattcatttaaaccgtaccgccattctccaaattaccgccgataataattttaacgacacg

SEQ ID NO: 22439 - DNA, 577 bp, Artificial Sequence
  chemically treated genomic DNA (Homo sapiens) CpG-island No: 22439
gtatttttaaaggttgtaggtatgaatgtcggtcgtgtaaacgatggttaaatagcgagttggttgcggtaatgttgttgatatagttttcggtttcgggcgataaattgatggggttttcggatttataatagggggattattgatgggatcgggtgtattcgttgcgttacgtcgttttatttattggttagatattagtttttttcgttattttttttttttttagttagcgtgtagacgtaagttttagtttcgatagtttcggtggttagcgcgaagttatttgtagaattatcgttaattttaatgagtttaatatcgttgatcgtttgtgtatcgacgtcgttaatgttattaattcgaacgcgagtgtttttttgggtatcgttttttacgtttattttatcggtgggcgaattatgttttttagcgtcgcgttgaacgttattaggttattgttttcggtatagttgtcgttaacggttagtatatttttcggtttttttttttcgttatttatttgaatcgtgtcgttattttttaggttgtcgtcgatagtggttttagcgatacg

SEQ ID NO: 22440 - DNA, 577 bp, Artificial Sequence
  chemically treated genomic DNA (Homo sapiens) CpG-island No: 22440
cgtatcgctaaaaccactatcgacgacaacctaaaaaataacgacacgattcaaataaataacgaaaaaaaaaaaccgaaaaatatactaaccgttaacgacaactataccgaaaacaataacctaataacgttcaacgcgacgctaaaaaacataattcgcccaccgataaaataaacgtaaaaaacgatacccaaaaaaacactcgcgttcgaattaataacattaacgacgtcgatacacaaacgatcaacgatattaaactcattaaaattaacgataattctacaaataacttcgcgctaaccaccgaaactatcgaaactaaaacttacgtctacacgctaactaaaaaaaaaaaaaataacgaaaaaaactaatatctaaccaataaataaaacgacgtaacgcaacgaatacacccgatcccatcaataatccccctattataaatccgaaaaccccatcaatttatcgcccgaaaccgaaaactatatcaacaacattaccgcaaccaactcgctatttaaccatcgtttacacgaccgacattcatacctacaacctttaaaaatac

SEQ ID NO: 22441 - DNA, 520 bp, Artificial Sequence
  chemically treated genomic DNA (Homo sapiens) CpG-island No: 22441
gtagttgggaatgcggttggtgttggacggcgtgtttaattatagtggcgatttttatgtttggtttgataggtataatcgtggtacgggtggtgtttgttataatttcgaatcgttttggcgcgattggtattcgtttagtgatgatggtacggcgttcgattggtttggttatgttagtttgtcgaagttggattattagtcggaaagtttggtgaatgaaatttatcgcggggaagatagtattgttcgttattggttgaaagcgtcgtggaatatggacggttggcggttggatgtggtgtatatgttgggggaggcgggtggggcgcgtaataatatgtagtacgttgtcgggattatcgaagcggcgaaagaaatttagtcggaagcgtatattgtcggcgaatattttggcgatgtacggtaatggttataggtcgatgtggaagatgtcgttatgaattatcgtggttttatattttcgttgtggggattttttgttaatatcgatattttt

SEQ ID NO: 22442 - DNA, 520 bp, Artificial Sequence
  chemically treated genomic DNA (Homo sapiens) CpG-island No: 22442
aaaaatatcgatattaacaaaaaatccccacaacgaaaatataaaaccacgataattcataacgacatcttccacatcgacctataaccattaccgtacatcgccaaaatattcgccgacaatatacgcttccgactaaatttctttcgccgcttcgataatcccgacaacgtactacatattattacgcgccccacccgcctcccccaacatatacaccacatccaaccgccaaccgtccatattccacgacgctttcaaccaataacgaacaatactatcttccccgcgataaatttcattcaccaaactttccgactaataatccaacttcgacaaactaacataaccaaaccaatcgaacgccgtaccatcatcactaaacgaataccaatcgcgccaaaacgattcgaaattataacaaacaccacccgtaccacgattatacctatcaaaccaaacataaaaatcgccactataattaaacacgccgtccaacaccaaccgcattcccaactac

SEQ ID NO: 22443 - DNA, 520 bp, Artificial Sequence
  chemically treated genomic DNA (Homo sapiens) CpG-island No: 22443
agagatatcggtattggtaagaaatttttataacgggaatgtgaagttacgatagtttatggcggtattttttatatcggtttgtaattattgtcgtgtatcgttaaaatgttcgtcgataatatacgttttcggttgggtttttttcgtcgtttcggtgatttcggtaacgtgttgtatattattgcgcgttttattcgttttttttagtatatgtattatatttagtcgttagtcgtttatattttacggcgtttttagttagtggcggataatattgtttttttcgcgataaattttatttattagatttttcgattgataatttagtttcggtaagttggtatagttaagttagtcgagcgtcgtgttattattattaaacgagtattagtcgcgttagggcgattcggggttgtgataagtattattcgtgttacgattatgtttgttaaattaggtatgggaatcgttattgtggttaaatacgtcgtttagtattagtcgtatttttagttgt

SEQ ID NO: 22444 - DNA, 520 bp, Artificial Sequence
  chemically treated genomic DNA (Homo sapiens) CpG-island No: 22444
acaactaaaaatacgactaatactaaacgacgtatttaaccacaataacgattcccatacctaatttaacaaacataatcgtaacacgaataatacttatcacaaccccgaatcgccctaacgcgactaatactcgtttaataataataacacgacgctcgactaacttaactataccaacttaccgaaactaaattatcaatcgaaaaatctaataaataaaatttatcgcgaaaaaaacaatattatccgccactaactaaaaacgccgtaaaatataaacgactaacgactaaatataatacatatactaaaaaaaacgaataaaacgcgcaataatatacaacacgttaccgaaatcaccgaaacgacgaaaaaaacccaaccgaaaacgtatattatcgacgaacattttaacgatacacgacaataattacaaaccgatataaaaaataccgccataaactatcgtaacttcacattcccgttataaaaatttcttaccaataccgatatctct

SEQ ID NO: 22445 - DNA, 559 bp, Artificial Sequence
  chemically treated genomic DNA (Homo sapiens) CpG-island No: 22445
attgttttggtttcgtattacgttttataaagttttagcggcggtggaaagtgaacggttttttttgcgtattagtattaattggcgtttaataatcggcgtaatgcgttttattattagtgggttatttttaggtaatggtagcgttagtgcgggaagaatattgatgtcgatgtttgcggttattatcgggaatagcgtcgtcggatgtttaattttttgtataatattcgtttgaatattattgcgcgttagcgttgcgttaattagcggtcggttgtttgacgcgtaattttgtaatattaatttcgttttttgtaatgtttgttagggtatataattttttacggttaaagcgttatcgcgatggtaaagtagaaagaaaggttcggaaagaatcgttttatattgtagatcgtttattgggtttggatcgatgacgatgttaaaatcgatatttttttggcgaatattttttattatttattgttgcggacgatcgtgtaggataaattgaatatttggatagcggcgatggtttttagtaatgtattgcgga

SEQ ID NO: 22446 - DNA, 559 bp, Artificial Sequence
  chemically treated genomic DNA (Homo sapiens) CpG-island No: 22446
tccgcaatacattactaaaaaccatcgccgctatccaaatattcaatttatcctacacgatcgtccgcaacaataaataataaaaaatattcgccaaaaaaatatcgattttaacatcgtcatcgatccaaacccaataaacgatctacaatataaaacgattctttccgaacctttctttctactttaccatcgcgataacgctttaaccgtaaaaaattatataccctaacaaacattacaaaaaacgaaattaatattacaaaattacgcgtcaaacaaccgaccgctaattaacgcaacgctaacgcgcaataatattcaaacgaatattatacaaaaaattaaacatccgacgacgctattcccgataataaccgcaaacatcgacatcaatattcttcccgcactaacgctaccattacctaaaaataacccactaataataaaacgcattacgccgattattaaacgccaattaatactaatacgcaaaaaaaaccgttcactttccaccgccgctaaaactttataaaacgtaatacgaaaccaaaacaat

SEQ ID NO: 22447 - DNA, 559 bp, Artificial Sequence
  chemically treated genomic DNA (Homo sapiens) CpG-island No: 22447
ttcgtaatgtattgttgaaagttatcgtcgttatttagatatttagtttgttttgtacgatcgttcgtagtagtgggtaatggaaagtattcgttagggagatgtcgattttggtatcgttatcgatttaggtttagtgggcgatttgtaatgtgaagcgatttttttcgagtttttttttttgttttgttatcgcgatagcgttttggtcgtggaagattatgtattttggtaggtattatagggagcgaaattggtgttgtaggattacgcgttaggtagtcgatcgttgattgacgtagcgttggcgcgtaatggtatttaggcgaatattgtgtaggagattggatattcggcgacgttgttttcgatggtagtcgtaggtatcggtattagtatttttttcgtattggcgttattattgtttgaaggtagtttattggtggtaaagcgtattacgtcggttgttgaacgttagttgatgttggtgcgtaggaagaatcgtttattttttatcgtcgttgaagttttatgggacgtggtacgagattagggtaat

SEQ ID NO: 22448 - DNA, 559 bp, Artificial Sequence
  chemically treated genomic DNA (Homo sapiens) CpG-island No: 22448
attaccctaatctcgtaccacgtcccataaaacttcaacgacgataaaaaataaacgattcttcctacgcaccaacatcaactaacgttcaacaaccgacgtaatacgctttaccaccaataaactaccttcaaacaataataacgccaatacgaaaaaaatactaataccgatacctacgactaccatcgaaaacaacgtcgccgaatatccaatctcctacacaatattcgcctaaataccattacgcgccaacgctacgtcaatcaacgatcgactacctaacgcgtaatcctacaacaccaatttcgctccctataatacctaccaaaatacataatcttccacgaccaaaacgctatcgcgataacaaaacaaaaaaaaaaactcgaaaaaaatcgcttcacattacaaatcgcccactaaacctaaatcgataacgataccaaaatcgacatctccctaacgaatactttccattacccactactacgaacgatcgtacaaaacaaactaaatatctaaataacgacgataactttcaacaatacattacgaa

SEQ ID NO: 22449 - DNA, 522 bp, Artificial Sequence
  chemically treated genomic DNA (Homo sapiens) CpG-island No: 22449
ggcgcgtacgtttcgattacgtgattttagtcgtggtttgatgggtttcgttttgagttatgattatgattttcggtattggtcgttgtttttattcgttggtttgtttgtaggttatgagagattcggcgagttaaacgtgacgatttgttcggcggtgattagttgcgttacgtcgcgttcggtattattaggattagagtggcgataaacggttgaattttgaggatcgttattagtatgtcgttttataatttcgttagatgtcggtgtttagggcgtttaataaaataatcggtaggttgaatttcgcgatcgttatcgtagtcgttgtggtttcggcgatatagttatcgtttttacggagagattaattttatcggtggcgattattagcgttatgttaatcgttagtaacgtaacgggagttgtacggttaagaatgtttatggggttatcgaataaacgtttattttgaagtattattttgtattgattttaaaaagttggatagttaaatat

SEQ ID NO: 22450 - DNA, 522 bp, Artificial Sequence
  chemically treated genomic DNA (Homo sapiens) CpG-island No: 22450
atatttaactatccaactttttaaaatcaatacaaaataatacttcaaaataaacgtttattcgataaccccataaacattcttaaccgtacaactcccgttacgttactaacgattaacataacgctaataatcgccaccgataaaattaatctctccgtaaaaacgataactatatcgccgaaaccacaacgactacgataacgatcgcgaaattcaacctaccgattattttattaaacgccctaaacaccgacatctaacgaaattataaaacgacatactaataacgatcctcaaaattcaaccgtttatcgccactctaatcctaataataccgaacgcgacgtaacgcaactaatcaccgccgaacaaatcgtcacgtttaactcgccgaatctctcataacctacaaacaaaccaacgaataaaaacaacgaccaataccgaaaatcataatcataactcaaaacgaaacccatcaaaccacgactaaaatcacgtaatcgaaacgtacgcgcc

SEQ ID NO: 22451 - DNA, 522 bp, Artificial Sequence
  chemically treated genomic DNA (Homo sapiens) CpG-island No: 22451
gtgtttaattgtttaattttttggggttagtataaggtggtgttttaggatgggcgtttgttcggtagttttatagatatttttaatcgtgtagttttcgttgcgttattggcgattggtatgacgttggtgatcgttatcggtgggattgattttttcgtaggggcggtgattgtatcgtcggagttataacggttgcgatgacggtcgcgggatttagtttgtcgattgttttgttaagcgttttgggtatcggtatttggcgggattgtggaacggtatattggtagcgatttttaaaatttagtcgtttgtcgttattttgattttgatggtgtcgggcgcggcgtggcgtaattgattatcgtcgggtagatcgttacgtttaattcgtcggattttttatgatttgtaggtagattagcgagtggagatagcgattagtatcggaagttatggttatgatttagaacgaagtttattagattacggttgggattacgtagtcgagacgtacgcgtt

SEQ ID NO: 22452 - DNA, 522 bp, Artificial Sequence
  chemically treated genomic DNA (Homo sapiens) CpG-island No: 22452
aacgcgtacgtctcgactacgtaatcccaaccgtaatctaataaacttcgttctaaatcataaccataacttccgatactaatcgctatctccactcgctaatctacctacaaatcataaaaaatccgacgaattaaacgtaacgatctacccgacgataatcaattacgccacgccgcgcccgacaccatcaaaatcaaaataacgacaaacgactaaattttaaaaatcgctaccaatataccgttccacaatcccgccaaataccgatacccaaaacgcttaacaaaacaatcgacaaactaaatcccgcgaccgtcatcgcaaccgttataactccgacgatacaatcaccgcccctacgaaaaaatcaatcccaccgataacgatcaccaacgtcataccaatcgccaataacgcaacgaaaactacacgattaaaaatatctataaaactaccgaacaaacgcccatcctaaaacaccaccttatactaaccccaaaaaattaaacaattaaacac

SEQ ID NO: 22453 - DNA, 569 bp, Artificial Sequence
  chemically treated genomic DNA (Homo sapiens) CpG-island No: 22453
cgtttttattgttcggggatggggagtaagtttagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattttattgttggcgggcgaaatattgtatgtttgtaggttattgttatatcgtttattcgttcgttttcggatattacgtttttgtgtgcgcgttttgcgttatttgatcga

SEQ ID NO: 22454 - DNA, 569 bp, Artificial Sequence
  chemically treated genomic DNA (Homo sapiens) CpG-island No: 22454
tcgatcaaataacgcaaaacgcgcacacaaaaacgtaatatccgaaaacgaacgaataaacgatataacaataacctacaaacatacaatatttcgcccgccaacaataaaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactaaacttactccccatccccgaacaataaaaacg

SEQ ID NO: 22455 - DNA, 569 bp, Artificial Sequence
  chemically treated genomic DNA (Homo sapiens) CpG-island No: 22455
tcgattaggtagcgtaaaacgcgtatataggaacgtaatgttcgagggcgaacgaataggcgatataataatggtttgtaggtatatagtatttcgttcgttaatagtgaagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattaagtttattttttattttcgggtaataagggcg

SEQ ID NO: 22456 - DNA, 569 bp, Artificial Sequence
  chemically treated genomic DNA (Homo sapiens) CpG-island No: 22456
cgcccttattacccgaaaataaaaaataaacttaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacacttcactattaacgaacgaaatactatatacctacaaaccattattatatcgcctattcgttcgccctcgaacattacgttcctatatacgcgttttacgctacctaatcga

SEQ ID NO: 22457 - DNA, 632 bp, Artificial Sequence
  chemically treated genomic DNA (Homo sapiens) CpG-island No: 22457
tgtatggtcgtgggttggataaataacgtttgatttaatattagagtaaattgggtgcggcgatggtgattgttgtcgtttggtgcgtggaagattattaggtgattcgtttggtaggtttatttatcgtacgggttatacgtttggtttacgaagcgtagttggatgtcgtttcgttggggaaaatttcgtatttgcgtacgtcgggtttgttggtgatggatatggattttatcgttatttagattgaatgtattgatgaaattgttaaattggtcggaacgggcgagatggtggcggaagtaatcgaacgggcgatgcgcggcgaattcgattttatcgttagtttgcgtagtcgtgtggcgacgttgaaaggcgttgacgttaatattttgtaataggtgcgtgaaaatttgtcgttgatgttaggtttaacgtaattggtgtttaagttggaaacgttgggttggaaagtggcgattgttttcggcggttttattttttttgttgaatatttgcgcgataagttgcgtttgatcgtcgtggtagttaatgaattggagattatggacgggtaaattaacgggtaatgtgattcggcgaataggcgtatgtttgtatcgttatatatt

SEQ ID NO: 22458 - DNA, 632 bp, Artificial Sequence
  chemically treated genomic DNA (Homo sapiens) CpG-island No: 22458
aatatataacgatacaaacatacgcctattcgccgaatcacattacccgttaatttacccgtccataatctccaattcattaactaccacgacgatcaaacgcaacttatcgcgcaaatattcaacaaaaaaaataaaaccgccgaaaacaatcgccactttccaacccaacgtttccaacttaaacaccaattacgttaaacctaacatcaacgacaaattttcacgcacctattacaaaatattaacgtcaacgcctttcaacgtcgccacacgactacgcaaactaacgataaaatcgaattcgccgcgcatcgcccgttcgattacttccgccaccatctcgcccgttccgaccaatttaacaatttcatcaatacattcaatctaaataacgataaaatccatatccatcaccaacaaacccgacgtacgcaaatacgaaattttccccaacgaaacgacatccaactacgcttcgtaaaccaaacgtataacccgtacgataaataaacctaccaaacgaatcacctaataatcttccacgcaccaaacgacaacaatcaccatcgccgcacccaatttactctaatattaaatcaaacgttatttatccaacccacgaccataca

SEQ ID NO: 22459 - DNA, 632 bp, Artificial Sequence
  chemically treated genomic DNA (Homo sapiens) CpG-island No: 22459
aatatgtagcgatgtaggtatgcgtttgttcgtcgaattatattgttcgttaatttattcgtttatgatttttagtttattggttattacggcggttaggcgtagtttgtcgcgtaggtatttagtaaagaaagtaaagtcgtcggaggtaatcgttattttttagtttagcgtttttagtttgagtattagttgcgttaagtttggtattagcggtagatttttacgtatttgttgtagaatattggcgttagcgttttttagcgtcgttatacggttgcgtaggttggcggtaaaatcgagttcgtcgcgtatcgttcgttcggttattttcgttattatttcgttcgtttcggttagtttggtaattttattaatatatttaatttggatggcggtggagtttatatttattattagtaaattcggcgtgcgtaggtgcgggattttttttagcggggcgatatttagttgcgtttcgtgggttaggcgtgtagttcgtgcggtgagtgaatttgttagacgaattatttgataattttttacgtattaggcggtaataattattatcgtcgtatttagtttgttttggtattgggttagacgttgtttatttagtttacgattatata

SEQ ID NO: 22460 - DNA, 632 bp, Artificial Sequence
  chemically treated genomic DNA (Homo sapiens) CpG-island No: 22460
tatataatcgtaaactaaataaacaacgtctaacccaataccaaaacaaactaaatacgacgataataattattaccgcctaatacgtaaaaaattatcaaataattcgtctaacaaattcactcaccgcacgaactacacgcctaacccacgaaacgcaactaaatatcgccccgctaaaaaaaatcccgcacctacgcacgccgaatttactaataataaatataaactccaccgccatccaaattaaatatattaataaaattaccaaactaaccgaaacgaacgaaataataacgaaaataaccgaacgaacgatacgcgacgaactcgattttaccgccaacctacgcaaccgtataacgacgctaaaaaacgctaacgccaatattctacaacaaatacgtaaaaatctaccgctaataccaaacttaacgcaactaatactcaaactaaaaacgctaaactaaaaaataacgattacctccgacgactttactttctttactaaatacctacgcgacaaactacgcctaaccgccgtaataaccaataaactaaaaatcataaacgaataaattaacgaacaatataattcgacgaacaaacgcatacctacatcgctacatatt

SEQ ID NO: 22461 - DNA, 595 bp, Artificial Sequence
  chemically treated genomic DNA (Homo sapiens) CpG-island No: 22461
attcggtttacgatttcgtagtaatttgtaggtcggataagatgcgttagtatcgtattcggtattgtgtattaattgtcggatgcggtatcggttgtaggtttgataagacgcgttaagcgtcgtattaggtataaatgtttaatgtttacgattatagcgaaatataggttttcgttcgttcgttagcgtttttttaattcgcgataacgttttaatttacgcgggtttattacggtttttgatataattatttatcgtcgttatattcggttttatcgaattatcggttttggtaaatggcgttaatttattcggtgtggtatggcgaatggtacgttgttgcggcgttttttagtttttatatatcgtattagtatcggtgaggattattagtttatttgtattaatttgttcggcgagtaacgtagcggcgagatttttattaattattgttttattttttgtttcgttattcgttataggtatatcgtcgtcgttattgtaaattattatatgtttttttttgagtaataattcgatgatttgtaggtatgtaagcggtttgtatgtttgtaggttattcgttgtcgtt

SEQ ID NO: 22462 - DNA, 595 bp, Artificial Sequence
  chemically treated genomic DNA (Homo sapiens) CpG-island No: 22462
aacgacaacgaataacctacaaacatacaaaccgcttacatacctacaaatcatcgaattattactcaaaaaaaaacatataataatttacaataacgacgacgatatacctataacgaataacgaaacaaaaaataaaacaataattaataaaaatctcgccgctacgttactcgccgaacaaattaatacaaataaactaataatcctcaccgatactaatacgatatataaaaactaaaaaacgccgcaacaacgtaccattcgccataccacaccgaataaattaacgccatttaccaaaaccgataattcgataaaaccgaatataacgacgataaataattatatcaaaaaccgtaataaacccgcgtaaattaaaacgttatcgcgaattaaaaaaacgctaacgaacgaacgaaaacctatatttcgctataatcgtaaacattaaacatttatacctaatacgacgcttaacgcgtcttatcaaacctacaaccgataccgcatccgacaattaatacacaataccgaatacgatactaacgcatcttatccgacctacaaattactacgaaatcgtaaaccgaat

SEQ ID NO: 22463 - DNA, 595 bp, Artificial Sequence
  chemically treated genomic DNA (Homo sapiens) CpG-island No: 22463
aacgatagcggatgatttgtaggtatgtaagtcgtttgtatgtttgtaggttatcgagttgttgtttaaagaggggtatgtggtgatttgtagtggcggcggcggtgtgtttgtgacggatgacggagtagggagtgaagtagtgattgataaagatttcgtcgttgcgttgttcgtcgagtagattaatgtagatggattggtgatttttatcgatgttgatgcggtatatgaaaattggggaacgtcgtagtaacgtgttattcgttatgttatatcggatgagttagcgttatttgttaaagtcgatggttcgatggggtcgaatgtaacggcggtgagtggttatgttagaagtcgtggtaaattcgcgtggattggggcgttatcgcgaattgaagagacgttggcgggcgaacggggatttgtatttcgttgtagtcgtaggtattagatatttgtgtttgatgcgacgtttgacgcgttttattaggtttataatcggtgtcgtattcggtaattggtgtataatgtcggatgcgatgttgacgtattttattcggtttatagattgttgcgaaatcgtaggtcggat

SEQ ID NO: 22464 - DNA, 595 bp, Artificial Sequence
  chemically treated genomic DNA (Homo sapiens) CpG-island No: 22464
atccgacctacgatttcgcaacaatctataaaccgaataaaatacgtcaacatcgcatccgacattatacaccaattaccgaatacgacaccgattataaacctaataaaacgcgtcaaacgtcgcatcaaacacaaatatctaatacctacgactacaacgaaatacaaatccccgttcgcccgccaacgtctcttcaattcgcgataacgccccaatccacgcgaatttaccacgacttctaacataaccactcaccgccgttacattcgaccccatcgaaccatcgactttaacaaataacgctaactcatccgatataacataacgaataacacgttactacgacgttccccaattttcatataccgcatcaacatcgataaaaatcaccaatccatctacattaatctactcgacgaacaacgcaacgacgaaatctttatcaatcactacttcactccctactccgtcatccgtcacaaacacaccgccgccgccactacaaatcaccacatacccctctttaaacaacaactcgataacctacaaacatacaaacgacttacatacctacaaatcatccgctatcgtt

SEQ ID NO: 22465 - DNA, 707 bp, Artificial Sequence
  chemically treated genomic DNA (Homo sapiens) CpG-island No: 22465
tttgtcgggaaagtgatcggtttgattggttataacggttttggtaaatttattttgtttaaaatgtttggtcgttattagtcgtcgtcggaaggggagattttttttgatgtttaatcgttggaaagttggagtagtaaagcgtttgttcgtaaagtggtttatttgtcgtagtagtttttttcggtagaagggatgatcgtgcgtgaattggtggcgattggtcgttattcgtggtatggcgcgttggcgttattgggggcggtagatcgcgaaaaagtcgaggaagttatttcgttggttggtttaaaatcgttggcgtatcggttggtcgatagtttttttggcggcgaacgttagcgggcgtggatcgtatgttggtggcgtaggatagtcgttgtttgttgttcgacgaatcgatttcggcgttggatatcgtttattaggttgatgtgttgtcgttggtgtatcgtttaagttaggagcgtggtttgacggttattgtcgtgttgtacgatattaatatggcggtacgttattgtgattatttggtcgttttgcgcggcggtgaaatgattgtttagggaacgtttgcggaaattatgcgcggcgaaattttcgaaatgatttatggtatttcgatgggtattttgtcgtattcggcgggtgttgtatttgtgagttttgtttattgatgagcggtttat

SEQ ID NO: 22466 - DNA, 707 bp, Artificial Sequence
  chemically treated genomic DNA (Homo sapiens) CpG-island No: 22466
ataaaccgctcatcaataaacaaaactcacaaatacaacacccgccgaatacgacaaaatacccatcgaaataccataaatcatttcgaaaatttcgccgcgcataatttccgcaaacgttccctaaacaatcatttcaccgccgcgcaaaacgaccaaataatcacaataacgtaccgccatattaatatcgtacaacacgacaataaccgtcaaaccacgctcctaacttaaacgatacaccaacgacaacacatcaacctaataaacgatatccaacgccgaaatcgattcgtcgaacaacaaacaacgactatcctacgccaccaacatacgatccacgcccgctaacgttcgccgccaaaaaaactatcgaccaaccgatacgccaacgattttaaaccaaccaacgaaataacttcctcgactttttcgcgatctaccgcccccaataacgccaacgcgccataccacgaataacgaccaatcgccaccaattcacgcacgatcatcccttctaccgaaaaaaactactacgacaaataaaccactttacgaacaaacgctttactactccaactttccaacgattaaacatcaaaaaaaatctccccttccgacgacgactaataacgaccaaacattttaaacaaaataaatttaccaaaaccgttataaccaatcaaaccgatcactttcccgacaaa

SEQ ID NO: 22467 - DNA, 707 bp, Artificial Sequence
  chemically treated genomic DNA (Homo sapiens) CpG-island No: 22467
gtaagtcgtttattaataaataaaatttataggtgtagtattcgtcggatgcggtaaaatatttatcgggatgttataaattatttcgagggtttcgtcgcgtataattttcgtaggcgttttttgagtaattattttatcgtcgcgtagggcgattagataattatagtagcgtgtcgttatattgatatcgtgtaatacggtaatgatcgttaggttacgtttttgatttaaacggtgtattagcgatagtatattaatttggtgggcgatatttagcgtcgaggtcggttcgtcgagtaatagataacggttattttgcgttattagtatgcgatttacgttcgttgacgttcgtcgttagagagattatcgattagtcgatgcgttagcggttttaagttaattagcgagatagttttttcgattttttcgcgatttgtcgtttttagtagcgttagcgcgttatgttacgggtaacgattaatcgttattagtttacgtacggttattttttttgtcggaggaagttgttgcggtaaataagttattttgcgggtaaacgttttgttgttttagttttttagcggttgggtattaagaagaattttttttttcgacggcggttgatgacggttaagtattttgagtagagtggatttattagaatcgttgtgattaattagatcggttattttttcggtagg

SEQ ID NO: 22468 - DNA, 707 bp, Artificial Sequence
  chemically treated genomic DNA (Homo sapiens) CpG-island No: 22468
cctaccgaaaaaataaccgatctaattaatcacaacgattctaataaatccactctactcaaaatacttaaccgtcatcaaccgccgtcgaaaaaaaaaattcttcttaatacccaaccgctaaaaaactaaaacaacaaaacgtttacccgcaaaataacttatttaccgcaacaacttcctccgacaaaaaaaataaccgtacgtaaactaataacgattaatcgttacccgtaacataacgcgctaacgctactaaaaacgacaaatcgcgaaaaaatcgaaaaaactatctcgctaattaacttaaaaccgctaacgcatcgactaatcgataatctctctaacgacgaacgtcaacgaacgtaaatcgcatactaataacgcaaaataaccgttatctattactcgacgaaccgacctcgacgctaaatatcgcccaccaaattaatatactatcgctaatacaccgtttaaatcaaaaacgtaacctaacgatcattaccgtattacacgatatcaatataacgacacgctactataattatctaatcgccctacgcgacgataaaataattactcaaaaaacgcctacgaaaattatacgcgacgaaaccctcgaaataatttataacatcccgataaatattttaccgcatccgacgaatactacacctataaattttatttattaataaacgacttac

SEQ ID NO: 22469 - DNA, 546 bp, Artificial Sequence
  chemically treated genomic DNA (Homo sapiens) CpG-island No: 22469
taattgttacggtttttttaggttcgtttcgtttaatttattgatagaggcggtttttttcgcggtagataatgtgtacgtgcgttttttagtcggtagagggcgcgcgtgtaggacggggtcggggcgcgcgcgggggtcgggggggttcgcgggggtcggtatcggaagcgtgcggttgttatgtaatattttggtcgcgcgggtagtcggttaggagggcggcgcgggtattggcggtagttgttaagcgggtggcggagcggcgtcgacggggattgttgaggcgcgtagagggtcgcggcgttcgggagtttgtcgttggcgcggttcgggcgggaggttcggcggcgggcggtagtatgtcggtggcggggttgaagaagtagttttataaggcgagttaggtgagcgtaggtttaggcgggagtcgagtatcgggtttcgggttgttcggatgagggagttaggttcgatttggttcgggagggggtcggggggatcgaggtggggacgttggcgcgtgttttttgttaggtgggaaga

SEQ ID NO: 22470 - DNA, 546 bp, Artificial Sequence
  chemically treated genomic DNA (Homo sapiens) CpG-island No: 22470
tcttcccacctaacaaaaaacacgcgccaacgtccccacctcgatccccccgaccccctcccgaaccaaatcgaacctaactccctcatccgaacaacccgaaacccgatactcgactcccgcctaaacctacgctcacctaactcgccttataaaactacttcttcaaccccgccaccgacatactaccgcccgccgccgaacctcccgcccgaaccgcgccaacgacaaactcccgaacgccgcgaccctctacgcgcctcaacaatccccgtcgacgccgctccgccacccgcttaacaactaccgccaatacccgcgccgccctcctaaccgactacccgcgcgaccaaaatattacataacaaccgcacgcttccgataccgacccccgcgaacccccccgacccccgcgcgcgccccgaccccgtcctacacgcgcgccctctaccgactaaaaaacgcacgtacacattatctaccgcgaaaaaaaccgcctctatcaataaattaaacgaaacgaacctaaaaaaaccgtaacaatta

SEQ ID NO: 22471 - DNA, 546 bp, Artificial Sequence
  chemically treated genomic DNA (Homo sapiens) CpG-island No: 22471
tttttttatttggtaggggatacgcgttaacgtttttatttcggttttttcggttttttttcgggttaggtcgggtttggtttttttattcgggtagttcggggttcggtattcggttttcgtttgggtttgcgtttatttggttcgttttgtagaattgtttttttagtttcgttatcgatatgttgtcgttcgtcgtcgagtttttcgttcggatcgcgttagcgataggttttcgggcgtcgcgattttttgcgcgttttagtagttttcgtcggcgtcgtttcgttattcgtttgatagttgtcgttagtgttcgcgtcgtttttttagtcgattgttcgcgcggttaggatattatatggtaatcgtacgttttcggtgtcggttttcgcgagttttttcggttttcgcgcgcgtttcggtttcgttttgtacgcgcgttttttgtcggttgaagagcgtacgtgtatattgtttatcgcgggagaggtcgtttttgttagtgagttgagcggggcgagtttagaggggtcgtagtagttg

SEQ ID NO: 22472 - DNA, 546 bp, Artificial Sequence
  chemically treated genomic DNA (Homo sapiens) CpG-island No: 22472
caactactacgacccctctaaactcgccccgctcaactcactaacaaaaacgacctctcccgcgataaacaatatacacgtacgctcttcaaccgacaaaaaacgcgcgtacaaaacgaaaccgaaacgcgcgcgaaaaccgaaaaaactcgcgaaaaccgacaccgaaaacgtacgattaccatataatatcctaaccgcgcgaacaatcgactaaaaaaacgacgcgaacactaacgacaactatcaaacgaataacgaaacgacgccgacgaaaactactaaaacgcgcaaaaaatcgcgacgcccgaaaacctatcgctaacgcgatccgaacgaaaaactcgacgacgaacgacaacatatcgataacgaaactaaaaaaacaattctacaaaacgaaccaaataaacgcaaacccaaacgaaaaccgaataccgaaccccgaactacccgaataaaaaaaccaaacccgacctaacccgaaaaaaaaccgaaaaaaccgaaataaaaacgttaacgcgtatcccctaccaaataaaaaaa

SEQ ID NO: 22473 - DNA, 530 bp, Artificial Sequence
  chemically treated genomic DNA (Homo sapiens) CpG-island No: 22473
ttttcgattaattgaggatggaatttttaatattttagcgtcgaggtttcgtcggttatagatgtttttttatttagagcgcgcgttagatagttatgtaatagtttacgaaggaaaaattgtagcgttagtacgtgttataagtcgttgcgattaacggtatgagtaatggtatttttgttcggttcggtacgttttatagtatcgcgtattggtgcggcgaggatttttttcgtgcggttggtttcgtttaacgttaataatcgcgcgaggttattttgatgtaaataaggataatcggcgttatgtattaattattattgcgcgtcgttagtagtttttagatttgttagtacggaatttgtacgtttattatcgttatttataacggtgatttgcggatgatttttagacgtacgtgtgtaaaatcgttatcgttaggatttatggtaatgacgatatttttattcggggatgcgtagtatcgtagtatcgagtgtttattatggttttatgacgatgagaaatat

SEQ ID NO: 22474 - DNA, 530 bp, Artificial Sequence
  chemically treated genomic DNA (Homo sapiens) CpG-island No: 22474
atatttctcatcgtcataaaaccataataaacactcgatactacgatactacgcatccccgaataaaaatatcgtcattaccataaatcctaacgataacgattttacacacgtacgtctaaaaatcatccgcaaatcaccgttataaataacgataataaacgtacaaattccgtactaacaaatctaaaaactactaacgacgcgcaataataattaatacataacgccgattatccttatttacatcaaaataacctcgcgcgattattaacgttaaacgaaaccaaccgcacgaaaaaaatcctcgccgcaccaatacgcgatactataaaacgtaccgaaccgaacaaaaataccattactcataccgttaatcgcaacgacttataacacgtactaacgctacaatttttccttcgtaaactattacataactatctaacgcgcgctctaaataaaaaaacatctataaccgacgaaacctcgacgctaaaatattaaaaattccatcctcaattaatcgaaaa

SEQ ID NO: 22475 - DNA, 530 bp, Artificial Sequence
  chemically treated genomic DNA (Homo sapiens) CpG-island No: 22475
atattttttatcgttataaaattatagtgaatattcggtgttgcgatgttgcgtattttcgggtgaaggtgtcgttattgttataagttttggcgatagcggttttgtatacgtgcgtttggagattattcgtaaattatcgttgtagatggcggtgatgagcgtgtagatttcgtgttggtaggtttgaaagttgttggcgacgcgtagtggtgattggtgtatgacgtcggttgtttttgtttgtattaggatgatttcgcgcgattgttggcgttgagcgaaattagtcgtacgggggggattttcgtcgtattagtgcgcgatattatgaaacgtgtcgagtcgggtaaaaatgttattgtttatatcgttgatcgtaacggtttatggtacgtgttgacgttgtaatttttttttcgtgagttgttatatgattgtttgacgcgcgttttaaatgaaggggtatttatgatcgacgaagtttcggcgttggaatattggggattttatttttagttggtcgaagg

SEQ ID NO: 22476 - DNA, 530 bp, Artificial Sequence
  chemically treated genomic DNA (Homo sapiens) CpG-island No: 22476
ccttcgaccaactaaaaataaaatccccaatattccaacgccgaaacttcgtcgatcataaataccccttcatttaaaacgcgcgtcaaacaatcatataacaactcacgaaaaaaaaattacaacgtcaacacgtaccataaaccgttacgatcaacgatataaacaataacatttttacccgactcgacacgtttcataatatcgcgcactaatacgacgaaaatcccccccgtacgactaatttcgctcaacgccaacaatcgcgcgaaatcatcctaatacaaacaaaaacaaccgacgtcatacaccaatcaccactacgcgtcgccaacaactttcaaacctaccaacacgaaatctacacgctcatcaccgccatctacaacgataatttacgaataatctccaaacgcacgtatacaaaaccgctatcgccaaaacttataacaataacgacaccttcacccgaaaatacgcaacatcgcaacaccgaatattcactataattttataacgataaaaaatat

SEQ ID NO: 22477 - DNA, 1115 bp, Artificial Sequence
  chemically treated genomic DNA (Homo sapiens) CpG-island No: 22477
gtaggtttgttggaattggaaatcgcgaatcgttttttatagggtgacgtcgatttcgtttgcgtcgattatgtcgacgacggtcgtcgagcggacgttggattcgaagcgatagagggagtaggagattagtagtggtattatttgtggtagtacgtcgtagaggattttttcgagtttgttggtatcggtggcgcgaatgttttttatcgggtcgggtttaatcgtttttatcgtttcggaaagtagtttggagagtacgtcggtggtgtggataaatagcgttagtacgttagtacgttagcgaacgggtcgaggtcgacggcgattacgaatagtatggcgaagattatttcgttaatggcgcggtaggcgtttattaggcggcgaacgggttggtaaatttattacggtattaggttttcggcgtttattaggttaaaggggatggagagaattatcgttagcgcggtgttttagacggcgatttgtagcgtgacggttatttcggtgaggtaattttgttattggttgaaatcgggcgggaagaagtcggcggcgaacgtcgttatgttgtcgtcgtttttgattagcgtaagcggggttattttcgcgttttgttacgagacgattaatacggcgagtataacggtttagtttagaagcgagaattagttgcgtttgggtggggcgatggtgatggtttgtatgtttggtttcggtttgtaggtcggataaggtgtttgtatcgtattcggtattaacgtttgtatattgtcggatgcgacgcggggcggggtgggggttaaaattgtgtatgttgtttgttatgtagaagaaatggggtagacgattcgaaaattatcgacggcgaagattttttgtcgtagtatcgtgaaaagtatcgtgttggtgggggtttgtttcgatttgaatttgaaaatcgattttattttgcgggatattaacgaatgtttttttgcgtagcgagtgaagttggcgtagttgttggattcgatggtcgaggcgaaatatatttttatttcggggttggggaaagtatttttttcgatatgcgaaaaaaaattaggcgcgcggtaacggtttcggttatg

SEQ ID NO: 22478 - DNA, 1115 bp, Artificial Sequence
  chemically treated genomic DNA (Homo sapiens) CpG-island No: 22478
cataaccgaaaccgttaccgcgcgcctaattttttttcgcatatcgaaaaaaatactttccccaaccccgaaataaaaatatatttcgcctcgaccatcgaatccaacaactacgccaacttcactcgctacgcaaaaaaacattcgttaatatcccgcaaaataaaatcgattttcaaattcaaatcgaaacaaacccccaccaacacgatacttttcacgatactacgacaaaaaatcttcgccgtcgataattttcgaatcgtctaccccatttcttctacataacaaacaacatacacaattttaacccccaccccgccccgcgtcgcatccgacaatatacaaacgttaataccgaatacgatacaaacaccttatccgacctacaaaccgaaaccaaacatacaaaccatcaccatcgccccacccaaacgcaactaattctcgcttctaaactaaaccgttatactcgccgtattaatcgtctcgtaacaaaacgcgaaaataaccccgcttacgctaatcaaaaacgacgacaacataacgacgttcgccgccgacttcttcccgcccgatttcaaccaataacaaaattacctcaccgaaataaccgtcacgctacaaatcgccgtctaaaacaccgcgctaacgataattctctccatcccctttaacctaataaacgccgaaaacctaataccgtaataaatttaccaacccgttcgccgcctaataaacgcctaccgcgccattaacgaaataatcttcgccatactattcgtaatcgccgtcgacctcgacccgttcgctaacgtactaacgtactaacgctatttatccacaccaccgacgtactctccaaactactttccgaaacgataaaaacgattaaacccgacccgataaaaaacattcgcgccaccgataccaacaaactcgaaaaaatcctctacgacgtactaccacaaataataccactactaatctcctactccctctatcgcttcgaatccaacgtccgctcgacgaccgtcgtcgacataatcgacgcaaacgaaatcgacgtcaccctataaaaaacgattcgcgatttccaattccaacaaacctac

SEQ ID NO: 22479 - DNA, 1115 bp, Artificial Sequence
  chemically treated genomic DNA (Homo sapiens) CpG-island No: 22479
tataatcgaagtcgttatcgcgcgtttgattttttttcgtatatcgaaagaggtattttttttagtttcggggtaaagatatatttcgtttcgattatcgggtttaatagttgcgttagttttattcgttgcgtagggaaatattcgttgatatttcgtagggtaaaatcggtttttagatttagatcgggataaatttttattagtacgatgttttttacggtgttgcggtagaaaattttcgtcgtcgatgattttcggatcgtttgttttattttttttgtatgataagtagtatgtatagttttggtttttatttcgtttcgcgtcgtattcgataatgtgtaggcgttgatgtcggatgcggtgtaagtattttattcggtttatagatcggagttaaatatgtaaattattattatcgttttatttaagcgtagttggttttcgtttttgagttgggtcgttgtattcgtcgtgttggtcgtttcgtggtagggcgcggaaatggtttcgtttacgttgattaaagacggcggtaatatggcgacgttcgtcgtcgattttttttcgttcgattttagttagtggtaggattattttatcgaaatggtcgttacgttgtaaatcgtcgtttggggtatcgcgttggcggtggttttttttattttttttggtttgatgagcgtcgaaaatttggtgtcgtggtgggtttattagttcgttcgtcgtttgatggacgtttgtcgcgttattaacgaaatggttttcgttatgttgttcgtggtcgtcgtcggtttcggttcgttcgttggcgtgttggcgtgttggcgttgtttatttatattatcggcgtgttttttaagttgtttttcgaagcggtggaagcgattgagttcggttcggtggaaggtattcgcgttatcggtgttaataagttcgaagagattttttacggcgtgttgttataggtgatgttattgttgattttttattttttttatcgtttcgaatttaacgttcgttcggcgatcgtcgtcggtatggtcggcgtaggcgggatcggcgttattttgtgggaagcgattcgcggtttttagttttaataaatttgt

SEQ ID NO: 22480 - DNA, 1115 bp, Artificial Sequence
  chemically treated genomic DNA (Homo sapiens) CpG-island No: 22480
acaaatttattaaaactaaaaaccgcgaatcgcttcccacaaaataacgccgatcccgcctacgccgaccataccgacgacgatcgccgaacgaacgttaaattcgaaacgataaaaaaaataaaaaatcaacaataacatcacctataacaacacgccgtaaaaaatctcttcgaacttattaacaccgataacgcgaataccttccaccgaaccgaactcaatcgcttccaccgcttcgaaaaacaacttaaaaaacacgccgataatataaataaacaacgccaacacgccaacacgccaacgaacgaaccgaaaccgacgacgaccacgaacaacataacgaaaaccatttcgttaataacgcgacaaacgtccatcaaacgacgaacgaactaataaacccaccacgacaccaaattttcgacgctcatcaaaccaaaaaaaataaaaaaaaccaccgccaacgcgataccccaaacgacgatttacaacgtaacgaccatttcgataaaataatcctaccactaactaaaatcgaacgaaaaaaaatcgacgacgaacgtcgccatattaccgccgtctttaatcaacgtaaacgaaaccatttccgcgccctaccacgaaacgaccaacacgacgaatacaacgacccaactcaaaaacgaaaaccaactacgcttaaataaaacgataataataatttacatatttaactccgatctataaaccgaataaaatacttacaccgcatccgacatcaacgcctacacattatcgaatacgacgcgaaacgaaataaaaaccaaaactatacatactacttatcatacaaaaaaaataaaacaaacgatccgaaaatcatcgacgacgaaaattttctaccgcaacaccgtaaaaaacatcgtactaataaaaatttatcccgatctaaatctaaaaaccgattttaccctacgaaatatcaacgaatatttccctacgcaacgaataaaactaacgcaactattaaacccgataatcgaaacgaaatatatctttaccccgaaactaaaaaaaatacctctttcgatatacgaaaaaaaatcaaacgcgcgataacgacttcgattata

SEQ ID NO: 22481 - DNA, 508 bp, Artificial Sequence
  chemically treated genomic DNA (Homo sapiens) CpG-island No: 22481
atcgcgatcgttataattattagtgcgacgtttaataatcgttagtttatttaaacgattaaatatcgtaggttattcgttgcgttcggtaagtaattgttacggtgtagtcggtaggtggagtttatcgaaaagttgtttttgagttagacggttagtaataatcgggaatatatcgcggtttataaaggtcggatggcgcgttagttcgcgggttaatgcggttttcggttagcgttttattttagcggtaattacgttttgttgaaaaggtatcgtcgtcggtttagcgtttagttcgattggttagatagtaatgtttaacggttcgtttgtttgacgtagtatacggtttaattgttcgttatcgaggacgtaaatttgttttatgtcgtatttcgcgggttcgggttttttagtatttcgtcggtttgggttttgtatgggtaatttttgtatgttttttgggttaatgttaacgggaatttttttttaatcgtttttttat

SEQ ID NO: 22482 - DNA, 508 bp, Artificial Sequence
  chemically treated genomic DNA (Homo sapiens) CpG-island No: 22482
ataaaaaaacgattaaaaaaaaattcccgttaacattaacccaaaaaacatacaaaaattacccatacaaaacccaaaccgacgaaatactaaaaaacccgaacccgcgaaatacgacataaaacaaatttacgtcctcgataacgaacaattaaaccgtatactacgtcaaacaaacgaaccgttaaacattactatctaaccaatcgaactaaacgctaaaccgacgacgataccttttcaacaaaacgtaattaccgctaaaataaaacgctaaccgaaaaccgcattaacccgcgaactaacgcgccatccgacctttataaaccgcgatatattcccgattattactaaccgtctaactcaaaaacaacttttcgataaactccacctaccgactacaccgtaacaattacttaccgaacgcaacgaataacctacgatatttaatcgtttaaataaactaacgattattaaacgtcgcactaataattataacgatcgcgat

SEQ ID NO: 22483 - DNA, 508 bp, Artificial Sequence
  chemically treated genomic DNA (Homo sapiens) CpG-island No: 22483
ataaagaggcgattaagaaaaagttttcgttagtattggtttaggaggtatgtaagagttgtttatgtaaagtttagatcgacgaagtgttggaaaattcggattcgcgaggtgcggtatgaaataggtttgcgttttcggtaacgggtagttaggtcgtatgttgcgttaggtaggcgaatcgttaggtattgttgtttggttagtcgggttggacgttgaatcggcggcggtgtttttttaataaagcgtgattatcgttgagatagaacgttggtcggaaatcgtattaattcgcgagttggcgcgttattcggtttttgtgaatcgcgatgtgttttcgattattgttgatcgtttgatttagaagtagtttttcgataagttttatttgtcgattgtatcgtggtagttatttgtcgaacgtagcgagtggtttgcggtgtttgatcgtttaggtgagttggcgattgttaagcgtcgtattggtggttatgacggtcgcggt

SEQ ID NO: 22484 - DNA, 508 bp, Artificial Sequence
  chemically treated genomic DNA (Homo sapiens) CpG-island No: 22484
accgcgaccgtcataaccaccaatacgacgcttaacaatcgccaactcacctaaacgatcaaacaccgcaaaccactcgctacgttcgacaaataactaccacgatacaatcgacaaataaaacttatcgaaaaactacttctaaatcaaacgatcaacaataatcgaaaacacatcgcgattcacaaaaaccgaataacgcgccaactcgcgaattaatacgatttccgaccaacgttctatctcaacgataatcacgctttattaaaaaaacaccgccgccgattcaacgtccaacccgactaaccaaacaacaatacctaacgattcgcctacctaacgcaacatacgacctaactacccgttaccgaaaacgcaaacctatttcataccgcacctcgcgaatccgaattttccaacacttcgtcgatctaaactttacataaacaactcttacatacctcctaaaccaatactaacgaaaactttttcttaatcgcctctttat

SEQ ID NO: 22485 - DNA, 1004 bp, Artificial Sequence
  chemically treated genomic DNA (Homo sapiens) CpG-island No: 22485
  misc_feature (922)..(922): n is either a, c, g or t
ggagatttgcggttacgcgttgtaatcggcggggattattttgttggtgattggtgcgggcggcgtgtttaaataagtgttggttgattttggcggaaggttcgtttttggtcgaatcgttaatcggtatgggtttgtcgattgttattatttgtttcgtcggaatttgttatatggattaggttaacggtcgcggtgagtcgtatttaaatcgaagtcgtagtcggacgtgaaacgggcggttcggtggatttgttttgggtgaacggcgaaaattttcgtattttaaaagaggttaatttattataaacgggttgggcggagattttgtttaattggcgttatgtcgatatatagttgtcggtgcgggaagatttttttgtgtcgatataaggtgcggaatcgttttggggcggcgtataattgacgtttatcgttcgtcgcgatgttacgttatagttattataaacgtcgtaagttttattggagtttgttaaagttaatttcggtacggttatttattcgcgtttatcggattttatcggtacggcgttttttgaatagttgttgattatgttgacgttcgatttcgtcgtattaaaagaagcgtcggacgatgcgattttcgttcgtgttattgtttttttgtggtaatattttgatgtgttgtattcgtatttgtggcgcgaaggaaaggatttttcgtttttattcgcgcggatggatgttttgttgaaagtcggtatattgcgtttgtcgttgatttttaatttcgcgtatgcgtagtaaaaaatcgttagcggcgatttgtttgtaagtagttatagttttggttttcgcgaggggatgattggtaacgtgtatttcgttattatttttgttaacgcgaatgttagtgttgcggcgaaggtagttgttaatnttttgtttttattcgatgcgtaattgcgtaaagtagatttcgttgtttgtaaatgttttgacgggataatcgttttggaaaa

SEQ ID NO: 22486 - DNA, 1004 bp, Artificial Sequence
  chemically treated genomic DNA (Homo sapiens) CpG-island No: 22486
  misc_feature (83)..(83): n is either a, c, g or t
ttttccaaaacgattatcccgtcaaaacatttacaaacaacgaaatctactttacgcaattacgcatcgaataaaaacaaaanattaacaactaccttcgccgcaacactaacattcgcgttaacaaaaataataacgaaatacacgttaccaatcatcccctcgcgaaaaccaaaactataactacttacaaacaaatcgccgctaacgattttttactacgcatacgcgaaattaaaaatcaacgacaaacgcaatataccgactttcaacaaaacatccatccgcgcgaataaaaacgaaaaatcctttccttcgcgccacaaatacgaatacaacacatcaaaatattaccacaaaaaaacaataacacgaacgaaaatcgcatcgtccgacgcttcttttaatacgacgaaatcgaacgtcaacataatcaacaactattcaaaaaacgccgtaccgataaaatccgataaacgcgaataaataaccgtaccgaaattaactttaacaaactccaataaaacttacgacgtttataataactataacgtaacatcgcgacgaacgataaacgtcaattatacgccgccccaaaacgattccgcaccttatatcgacacaaaaaaatcttcccgcaccgacaactatatatcgacataacgccaattaaacaaaatctccgcccaacccgtttataataaattaacctcttttaaaatacgaaaattttcgccgttcacccaaaacaaatccaccgaaccgcccgtttcacgtccgactacgacttcgatttaaatacgactcaccgcgaccgttaacctaatccatataacaaattccgacgaaacaaataataacaatcgacaaacccataccgattaacgattcgaccaaaaacgaaccttccgccaaaatcaaccaacacttatttaaacacgccgcccgcaccaatcaccaacaaaataatccccgccgattacaacgcgtaaccgcaaatctcc

SEQ ID NO: 22487 - DNA, 1004 bp, Artificial Sequence
  chemically treated genomic DNA (Homo sapiens) CpG-island No: 22487
  misc_feature (83)..(83): n is either a, c, g or t
ttttttagaacggttgtttcgttaaagtatttgtagatagcgggatttgttttacgtagttgcgtatcgggtgagagtagaanattggtaattattttcgtcgtagtattggtattcgcgttggtaggaatggtgacgaaatgtacgttgttaattattttttcgcgaaagttaaaattgtaattgtttgtaggtaaatcgtcgttggcgattttttgttgcgtatgcgcggggttaaaggttagcgataggcgtaatgtgtcggtttttagtagagtatttattcgcgcgggtgaaggcgggaaattttttttttcgcgttataaatacggatgtagtatattaagatattgttataagggagtagtgatacgggcgaaagtcgtatcgttcggcgttttttttaatgcggcgggatcgggcgttagtataattagtaattgtttaagaaacgtcgtgtcggtaaagttcggtgggcgcggataggtaatcgtgtcgggattggttttagtaaattttagtaaggtttgcggcgtttgtggtggttgtggcgtaatatcgcggcgggcgataaacgttagttgtgcgtcgttttagggcgatttcgtattttgtgtcggtatagaaaaattttttcgtatcggtagttgtgtgtcgatatagcgttagttgggtagagttttcgtttagttcgtttgtaataaattggttttttttaaggtgcggaagttttcgtcgtttatttagagtagatttatcgagtcgttcgttttacgttcggttgcggtttcggtttgaatgcggtttatcgcggtcgttgatttagtttatgtagtaaatttcgacgaagtaggtgatagtaatcggtaggtttatgtcggttaacggttcggttaagggcgggtttttcgttagagttaattagtatttgtttgaatacgtcgttcgtattaattattagtagaatgattttcgtcggttgtagcgcgtgatcgtaaattttt

SEQ ID NO: 22488 - DNA, 1004 bp, Artificial Sequence
  chemically treated genomic DNA (Homo sapiens) CpG-island No: 22488
  misc_feature (922)..(922): n is either a, c, g or t
aaaaatttacgatcacgcgctacaaccgacgaaaatcattctactaataattaatacgaacgacgtattcaaacaaatactaattaactctaacgaaaaacccgcccttaaccgaaccgttaaccgacataaacctaccgattactatcacctacttcgtcgaaatttactacataaactaaatcaacgaccgcgataaaccgcattcaaaccgaaaccgcaaccgaacgtaaaacgaacgactcgataaatctactctaaataaacgacgaaaacttccgcaccttaaaaaaaaccaatttattacaaacgaactaaacgaaaactctacccaactaacgctatatcgacacacaactaccgatacgaaaaaatttttctataccgacacaaaatacgaaatcgccctaaaacgacgcacaactaacgtttatcgcccgccgcgatattacgccacaaccaccacaaacgccgcaaaccttactaaaatttactaaaaccaatcccgacacgattacctatccgcgcccaccgaactttaccgacacgacgtttcttaaacaattactaattatactaacgcccgatcccgccgcattaaaaaaaacgccgaacgatacgactttcgcccgtatcactactcccttataacaatatcttaatatactacatccgtatttataacgcgaaaaaaaaaatttcccgccttcacccgcgcgaataaatactctactaaaaaccgacacattacgcctatcgctaacctttaaccccgcgcatacgcaacaaaaaatcgccaacgacgatttacctacaaacaattacaattttaactttcgcgaaaaaataattaacaacgtacatttcgtcaccattcctaccaacgcgaataccaatactacgacgaaaataattaccaatnttctactctcacccgatacgcaactacgtaaaacaaatcccgctatctacaaatactttaacgaaacaaccgttctaaaaaa

SEQ ID NO: 22489 - DNA, 812 bp, Artificial Sequence
  chemically treated genomic DNA (Homo sapiens) CpG-island No: 22489
  misc_feature (443)..(443): n is either a, c, g or t
ggttaggtatgaattacggttttgattagcgtcgttaacggaatggcgaagaatacgttttagaatttttataaattatcgaagattattatcgataaaataattattagcggatgtaggttaatcgtttcggagaataatatcggtattaataggttgtcgtttagcgtttgaataattagatatatcgcgaagtagttttagaatttagtatttgcgttaaattggaatagcgttacgttaattatcggaatggttattataaatgcgttaatgtacggaataagaatcgagaagtcgattagtattgttagtagtagcgaatagtttagttcgaagagtaagaattttagttaggtggcgatttttattacgattatttttagtattttgtcgttagcgtgcgttggttgtcgacgttaatatttcgtaggttgtcgatnttattattaaagaattaaagacgataaggtagtttattttttatcgggaagagatttagtaacgcgtcgcgcgtggcgtattcgtcgtgttttattatttggttaatatggcgataatcggcgttgtttagttgggttcgtaatgtatttcgtgataggcgttgatttttttttattattagcgtatgatcgtggagaaaattgtgtgggtaaacgcgttgtataagcgtatttatcggaataattagtacgttacgttgtatcgtcggtagttggtaaagggtggaaaggcgcgaggagataatgttttgatgaggcgaaaaattgtcgtagggaagagttttttagttcgttagatttattattatt

SEQ ID NO: 22490 - DNA, 812 bp, Artificial Sequence
  chemically treated genomic DNA (Homo sapiens) CpG-island No: 22490
  misc_feature (370)..(370): n is either a, c, g or t
aataataataaatctaacgaactaaaaaactcttccctacgacaatttttcgcctcatcaaaacattatctcctcgcgcctttccaccctttaccaactaccgacgatacaacgtaacgtactaattattccgataaatacgcttatacaacgcgtttacccacacaattttctccacgatcatacgctaataataaaaaaaaatcaacgcctatcacgaaatacattacgaacccaactaaacaacgccgattatcgccatattaaccaaataataaaacacgacgaatacgccacgcgcgacgcgttactaaatctcttcccgataaaaaataaactaccttatcgtctttaattctttaataataanatcgacaacctacgaaatattaacgtcgacaaccaacgcacgctaacgacaaaatactaaaaataatcgtaataaaaatcgccacctaactaaaattcttactcttcgaactaaactattcgctactactaacaatactaatcgacttctcgattcttattccgtacattaacgcatttataataaccattccgataattaacgtaacgctattccaatttaacgcaaatactaaattctaaaactacttcgcgatatatctaattattcaaacgctaaacgacaacctattaataccgatattattctccgaaacgattaacctacatccgctaataattattttatcgataataatcttcgataatttataaaaattctaaaacgtattcttcgccattccgttaacgacgctaatcaaaaccgtaattcatacctaacc

SEQ ID NO: 22491 - DNA, 812 bp, Artificial Sequence
  chemically treated genomic DNA (Homo sapiens) CpG-island No: 22491
  misc_feature (370)..(370): n is either a, c, g or t
aatggtgatgaatttggcggattgggaaatttttttttacgatagtttttcgttttattaggatattattttttcgcgtttttttattttttattagttatcgacgatgtagcgtggcgtattgattgtttcggtgaatacgtttatgtagcgcgtttgtttatatagttttttttacggttatgcgttggtgatgaaaaaaggttagcgtttgttacgagatgtattacgaatttaattggatagcgtcggttatcgttatgttgattaggtgatggagtacggcgaatacgttacgcgcggcgcgttgttggattttttttcgatggggagtgagttgttttatcgtttttgattttttgatgatganatcgatagtttgcggggtgttgacgtcgatagttagcgtacgttggcggtaaagtgttggagatgatcgtggtggggatcgttatttggttggggtttttgtttttcgggttgaattattcgttgttgttggtagtgttggtcggtttttcggtttttatttcgtatattggcgtatttgtggtgattatttcggtggttggcgtggcgttattttagtttggcgtaggtattgaattttggagttgtttcgcggtgtatttgattatttaggcgttggacggtaatttgttagtgtcggtgttgtttttcgaagcggttaatttgtattcgttggtgattattttatcggtggtgattttcggtggtttgtggggattttggggcgtatttttcgttatttcgttggcgacgttgattaaagtcgtgatttatgtttggtt

SEQ ID NO: 22492 - DNA, 812 bp, Artificial Sequence
  chemically treated genomic DNA (Homo sapiens) CpG-island No: 22492
  misc_feature (443)..(443): n is either a, c, g or t
aaccaaacataaatcacgactttaatcaacgtcgccaacgaaataacgaaaaatacgccccaaaatccccacaaaccaccgaaaatcaccaccgataaaataatcaccaacgaatacaaattaaccgcttcgaaaaacaacaccgacactaacaaattaccgtccaacgcctaaataatcaaatacaccgcgaaacaactccaaaattcaatacctacgccaaactaaaataacgccacgccaaccaccgaaataatcaccacaaatacgccaatatacgaaataaaaaccgaaaaaccgaccaacactaccaacaacaacgaataattcaacccgaaaaacaaaaaccccaaccaaataacgatccccaccacgatcatctccaacactttaccgccaacgtacgctaactatcgacgtcaacaccccgcaaactatcgatntcatcatcaaaaaatcaaaaacgataaaacaactcactccccatcgaaaaaaaatccaacaacgcgccgcgcgtaacgtattcgccgtactccatcacctaatcaacataacgataaccgacgctatccaattaaattcgtaatacatctcgtaacaaacgctaaccttttttcatcaccaacgcataaccgtaaaaaaaactatataaacaaacgcgctacataaacgtattcaccgaaacaatcaatacgccacgctacatcgtcgataactaataaaaaataaaaaaacgcgaaaaaataatatcctaataaaacgaaaaactatcgtaaaaaaaaatttcccaatccgccaaattcatcaccatt

SEQ ID NO: 22493 - DNA, 867 bp, Artificial Sequence
  chemically treated genomic DNA (Homo sapiens) CpG-island No: 22493
gttgatacgaaaaacggtattatttcgtaagtcggaatacgggtattgttataggtcggatgtggtacgcgtttgtatggtagcgtaaaaacgttgtttattttttcggtagaaagcggaatagtaggcgggttgatttatatatagcggtcgtcgtgtttttgtattaatgcgcgggtatagtttgggttggtttcgtggtgtagaatacgcgaagtatgggcgtatagtattttatcgttttttattttttcgaaagaaggtagtaatacgtaggtttttttttacggtttcgggcgcggtggttgtacggttacggttttggttttttgttttttcggtgttatcggtttgttattcgcgtacggtaaatttttattatacggatgcgggattgggtcgatttttttaggggtattaagacgggtggaatttacgtcgttttagttaggtagcgttttttttacgataatcgcggtattacgtatatcgcggattttattaattggttcgtttatcgttagacgatgcgttatttttattatcggacgtttatcgttattaaatattagtatgtcggttttcgaatttattattacggaacggcgtacggtatcggattagtaattataatgcgcggtacggcgtatattagttttaatatcgtcgaggattatcggtatatttttttacgtttttttataacgttgggtataaattagtgtggcgcgattcgcgcgtttatacgcgacgttattcggcgtgtatgtatcgttatgacgtatacggcgatcggcggtataacggttgattatcgaatttatgttggtagtagtgatatcgaaaaatagatcggtgtattagacg

SEQ ID NO: 22494 - DNA, 867 bp, Artificial Sequence
  chemically treated genomic DNA (Homo sapiens) CpG-island No: 22494
cgtctaatacaccgatctatttttcgatatcactactaccaacataaattcgataatcaaccgttataccgccgatcgccgtatacgtcataacgatacatacacgccgaataacgtcgcgtataaacgcgcgaatcgcgccacactaatttatacccaacgttataaaaaaacgtaaaaaaatataccgataatcctcgacgatattaaaactaatatacgccgtaccgcgcattataattactaatccgataccgtacgccgttccgtaataataaattcgaaaaccgacatactaatatttaataacgataaacgtccgataataaaaataacgcatcgtctaacgataaacgaaccaattaataaaatccgcgatatacgtaataccgcgattatcgtaaaaaaaacgctacctaactaaaacgacgtaaattccacccgtcttaatacccctaaaaaaatcgacccaatcccgcatccgtataataaaaatttaccgtacgcgaataacaaaccgataacaccgaaaaaacaaaaaaccaaaaccgtaaccgtacaaccaccgcgcccgaaaccgtaaaaaaaaacctacgtattactaccttctttcgaaaaaataaaaaacgataaaatactatacgcccatacttcgcgtattctacaccacgaaaccaacccaaactatacccgcgcattaatacaaaaacacgacgaccgctatatataaatcaacccgcctactattccgctttctaccgaaaaaataaacaacgtttttacgctaccatacaaacgcgtaccacatccgacctataacaatacccgtattccgacttacgaaataataccgtttttcgtatcaac

SEQ ID NO: 22495 - DNA, 867 bp, Artificial Sequence
  chemically treated genomic DNA (Homo sapiens) CpG-island No: 22495
cgtttggtatatcgatttgtttttcggtgttattgttgttaatatggattcgatgattaatcgttatatcgtcgatcgtcgtatacgttatgacgatgtatatacgtcggataacgtcgcgtgtaagcgcgcggatcgcgttatattggtttatatttagcgttgtaaagaggcgtggaaagatgtatcggtgattttcggcggtattgaggttagtatgcgtcgtatcgcgtattatgattattggttcgatatcgtgcgtcgtttcgtgatggtggattcgaaagtcgatatgttgatgtttggtaacggtgagcgttcgatggtggaagtggcgtatcgtttggcgatgggcgagttaattagtgaaattcgcgatgtgcgtaatatcgcgattatcgtgaaagaggcgttgtttggttggagcggcgtggattttattcgttttgatatttttggaaaaatcgatttaatttcgtattcgtatggtgaagatttgtcgtgcgcggataataaatcggtggtatcgaaaaagtaggaagttaaagtcgtaatcgtgtagttatcgcgttcgaaatcgtgggaaaaaatttacgtgttgttgttttttttcgagaaagtgaagggcgataaagtgttgtacgtttatgtttcgcgtattttgtattacgaaattaatttaggttgtgttcgcgtattgatgtaaaaatacggcgatcgttatgtgtggattaattcgtttgttatttcgttttttatcgaagagatggatagcgtttttgcgttgttatataagcgcgtgttatattcggtttatggtaatgttcgtatttcggtttacgaaatggtatcgtttttcgtgttaat

SEQ ID NO: 22496 - DNA, 867 bp, Artificial Sequence
  chemically treated genomic DNA (Homo sapiens) CpG-island No: 22496
attaacacgaaaaacgataccatttcgtaaaccgaaatacgaacattaccataaaccgaatataacacgcgcttatataacaacgcaaaaacgctatccatctcttcgataaaaaacgaaataacaaacgaattaatccacacataacgatcgccgtatttttacatcaatacgcgaacacaacctaaattaatttcgtaatacaaaatacgcgaaacataaacgtacaacactttatcgcccttcactttctcgaaaaaaaacaacaacacgtaaattttttcccacgatttcgaacgcgataactacacgattacgactttaacttcctactttttcgataccaccgatttattatccgcgcacgacaaatcttcaccatacgaatacgaaattaaatcgatttttccaaaaatatcaaaacgaataaaatccacgccgctccaaccaaacaacgcctctttcacgataatcgcgatattacgcacatcgcgaatttcactaattaactcgcccatcgccaaacgatacgccacttccaccatcgaacgctcaccgttaccaaacatcaacatatcgactttcgaatccaccatcacgaaacgacgcacgatatcgaaccaataatcataatacgcgatacgacgcatactaacctcaataccgccgaaaatcaccgatacatctttccacgcctctttacaacgctaaatataaaccaatataacgcgatccgcgcgcttacacgcgacgttatccgacgtatatacatcgtcataacgtatacgacgatcgacgatataacgattaatcatcgaatccatattaacaacaataacaccgaaaaacaaatcgatataccaaacg

SEQ ID NO: 22497 - DNA, 604 bp, Artificial Sequence
  chemically treated genomic DNA (Homo sapiens) CpG-island No: 22497
tagggttattggtatttgtcggtattatcgatattaatattgaagacgattagggtagttacgttcgtttgatagttcgtgatattgaaggtcggatggtttggcgggtatggaattttgagtcggatgtcggtgaaggttttaatcgttatattcgtattttaggtattcgtatagatacggttattcgttgatcgcgaagtatttattcgtatttattttttcgaatatattttatatttttatacgttagttatcgtcgttggcgtttttattgacggagatatatttatgataatatagacgtagtacgatttcgtattcgttaattaattcgaatttgaattgatcgttacgtcggttttcgatgaatagcgtatcgatttttggttatagtattttggcgttatttcgtagtggttatttttggagtcgtatattttcgtttggatggatcgtttttgtgagggttatagcggtggtatttggtcgttttatatttttagtaatggcggcgtatttatgtttttcgagtttgatatcgatgagatagtcgtttgtttaattgtttgaaaagtgatttgtaggtatgtatattttgtta

SEQ ID NO: 22498 - DNA, 604 bp, Artificial Sequence
  chemically treated genomic DNA (Homo sapiens) CpG-island No: 22498
taacaaaatatacatacctacaaatcacttttcaaacaattaaacaaacgactatctcatcgatatcaaactcgaaaaacataaatacgccgccattactaaaaatataaaacgaccaaataccaccgctataaccctcacaaaaacgatccatccaaacgaaaatatacgactccaaaaataaccactacgaaataacgccaaaatactataaccaaaaatcgatacgctattcatcgaaaaccgacgtaacgatcaattcaaattcgaattaattaacgaatacgaaatcgtactacgtctatattatcataaatatatctccgtcaataaaaacgccaacgacgataactaacgtataaaaatataaaatatattcgaaaaaataaatacgaataaatacttcgcgatcaacgaataaccgtatctatacgaatacctaaaatacgaatataacgattaaaaccttcaccgacatccgactcaaaattccatacccgccaaaccatccgaccttcaatatcacgaactatcaaacgaacgtaactaccctaatcgtcttcaatattaatatcgataataccgacaaataccaataacccta

SEQ ID NO: 22499 - DNA, 604 bp, Artificial Sequence
  chemically treated genomic DNA (Homo sapiens) CpG-island No: 22499
tggtagaatatgtatgtttgtaggttattttttaagtagttaaatagacggttgttttatcgatgttaggttcgggggatataaatgcgtcgttattgttgagggtgtagaacgattagatattatcgttgtagtttttatagaagcggtttatttaggcgaagatatgcggttttaggagtagttattgcgggatagcgttaaagtattgtggttagaaatcgatacgttgtttatcggggatcggcgtgacggttagtttaaattcgggttggttagcgggtgcgaggtcgtgttgcgtttgtgttgttatgggtatgttttcgttaataaaaacgttagcggcgatggttggcgtatggggatataaagtgtgttcggggaggtgaatgcgggtaaatgtttcgcgattagcgggtggtcgtgtttgtacggatgtttgaggtgcggatatagcggttaagatttttatcggtattcggtttaaagttttatgttcgttagattattcggtttttagtattacgaattattaggcggacgtgattgttttggtcgtttttaatgttaatgtcggtgatatcggtagatattagtggttttg

SEQ ID NO: 22500 - DNA, 604 bp, Artificial Sequence
  chemically treated genomic DNA (Homo sapiens) CpG-island No: 22500
caaaaccactaatatctaccgatatcaccgacattaacattaaaaacgaccaaaacaatcacgtccgcctaataattcgtaatactaaaaaccgaataatctaacgaacataaaactttaaaccgaataccgataaaaatcttaaccgctatatccgcacctcaaacatccgtacaaacacgaccacccgctaatcgcgaaacatttacccgcattcacctccccgaacacactttatatccccatacgccaaccatcgccgctaacgtttttattaacgaaaacatacccataacaacacaaacgcaacacgacctcgcacccgctaaccaacccgaatttaaactaaccgtcacgccgatccccgataaacaacgtatcgatttctaaccacaatactttaacgctatcccgcaataactactcctaaaaccgcatatcttcgcctaaataaaccgcttctataaaaactacaacgataatatctaatcgttctacaccctcaacaataacgacgcatttatatcccccgaacctaacatcgataaaacaaccgtctatttaactacttaaaaaataacctacaaacatacatattctacca

SEQ ID NO: 22501 - DNA, 878 bp, Artificial Sequence
  chemically treated genomic DNA (Homo sapiens) CpG-island No: 22501
ggtggtgttggcggtagtcggtagtaggttagagacgttagtttgttgtgttgcggtggtttgtacgcggcgaacggggcgttaggtggggtgttcgattcggtcgggaatatttttagtcggtcgaggagcggcgaggagaaggtgagtgcgtggtcggtgtgcgttagtgtcggcgttagtgttggtggcggttcggggtggttcggggtgaaggcgggtgtaggtatcgtgtcggtggggtgggtgggcggagtaggtttttttagcgtgttgtcgaagtggttgatagcgttagacggtttcgttttcggttaggtagtcgagggtagtgtagtaaacggaatggcggtgtcggtggaggaggattagtcggatttaaatacggcggtatagggttgtagtttcgttgattattggcggtatacgggtaattagtttatcgaggtacggtatcggaatattgattatttatttatatagcgcgttatttgatgcgaattgggttttaaacggcgggatattttatagtgttacggtagttgttaggaatatgaacggtgtttaggtacgtattatttgattcgtagagtaatcggtgtgggttagcgttatattaatttgtgacgtttttaaattattaaaacggaatatacgtattggttgttagcgtttgacgaatagcgttaggtagagtagtgatattagcgaagagataatgttcggtagtttcggtttaatgaagttagagtttaggtattgaacgatggtaaatgattcgttcgtaaatacgatcgtagggtacgtttttttgattacgcgttcgaagggttttataggacgttatacgaaacgaaaaatttttttgcgtaataatt

SEQ ID NO: 22502 - DNA, 878 bp, Artificial Sequence
  chemically treated genomic DNA (Homo sapiens) CpG-island No: 22502
aattattacgcaaaaaaatttttcgtttcgtataacgtcctataaaacccttcgaacgcgtaatcaaaaaaacgtaccctacgatcgtatttacgaacgaatcatttaccatcgttcaatacctaaactctaacttcattaaaccgaaactaccgaacattatctcttcgctaatatcactactctacctaacgctattcgtcaaacgctaacaaccaatacgtatattccgttttaataatttaaaaacgtcacaaattaatataacgctaacccacaccgattactctacgaatcaaataatacgtacctaaacaccgttcatattcctaacaactaccgtaacactataaaatatcccgccgtttaaaacccaattcgcatcaaataacgcgctatataaataaataatcaatattccgataccgtacctcgataaactaattacccgtataccgccaataatcaacgaaactacaaccctataccgccgtatttaaatccgactaatcctcctccaccgacaccgccattccgtttactacactaccctcgactacctaaccgaaaacgaaaccgtctaacgctatcaaccacttcgacaacacgctaaaaaaacctactccgcccacccaccccaccgacacgatacctacacccgccttcaccccgaaccaccccgaaccgccaccaacactaacgccgacactaacgcacaccgaccacgcactcaccttctcctcgccgctcctcgaccgactaaaaatattcccgaccgaatcgaacaccccacctaacgccccgttcgccgcgtacaaaccaccgcaacacaacaaactaacgtctctaacctactaccgactaccgccaacaccacc

SEQ ID NO: 22503 - DNA, 878 bp, Artificial Sequence
  chemically treated genomic DNA (Homo sapiens) CpG-island No: 22503
aattattgcgtaaagggatttttcgtttcgtatgacgttttataaggtttttcgggcgcgtaattaaagagacgtgttttgcggtcgtgtttgcgggcggattatttgttatcgtttagtatttgagttttaattttattgggtcggagttgtcggatattattttttcgttggtattattgttttgtttgacgttgttcgttaaacgttggtagttagtgcgtgtatttcgttttggtgatttgggggcgttataggttgatatgacgttggtttatatcggttattttgcgggttaggtgatgcgtgtttggatatcgtttatgtttttgatagttatcgtaatattgtggagtatttcgtcgtttaaagtttagttcgtattaggtggcgcgttgtatgagtgggtgattaatatttcggtgtcgtatttcgataaattggttgttcgtatgtcgttagtggttagcgaggttatagttttatgtcgtcgtgtttaagttcgattggtttttttttatcggtatcgttatttcgtttgttgtattgttttcgattgtttggtcgaagacgaaatcgtttgacgttattagttatttcggtagtacgttgaaagaatttgtttcgtttatttattttatcggtacggtgtttgtattcgtttttatttcgaattatttcggatcgttattaatattggcgtcggtattggcgtatatcggttacgtatttatttttttttcgtcgtttttcggtcggttgggggtattttcgatcgggtcggatattttatttaacgtttcgttcgtcgcgtgtaagttatcgtagtataataaattggcgtttttgatttgttgtcggttgtcgttaatattatt

SEQ ID NO: 22504 - DNA, 878 bp, Artificial Sequence
  chemically treated genomic DNA (Homo sapiens) CpG-island No: 22504
aataatattaacgacaaccgacaacaaatcaaaaacgccaatttattatactacgataacttacacgcgacgaacgaaacgttaaataaaatatccgacccgatcgaaaatacccccaaccgaccgaaaaacgacgaaaaaaaaataaatacgtaaccgatatacgccaataccgacgccaatattaataacgatccgaaataattcgaaataaaaacgaatacaaacaccgtaccgataaaataaataaacgaaacaaattctttcaacgtactaccgaaataactaataacgtcaaacgatttcgtcttcgaccaaacaatcgaaaacaatacaacaaacgaaataacgataccgataaaaaaaaaccaatcgaacttaaacacgacgacataaaactataacctcgctaaccactaacgacatacgaacaaccaatttatcgaaatacgacaccgaaatattaatcacccactcatacaacgcgccacctaatacgaactaaactttaaacgacgaaatactccacaatattacgataactatcaaaaacataaacgatatccaaacacgcatcacctaacccgcaaaataaccgatataaaccaacgtcatatcaacctataacgcccccaaatcaccaaaacgaaatacacgcactaactaccaacgtttaacgaacaacgtcaaacaaaacaataataccaacgaaaaaataatatccgacaactccgacccaataaaattaaaactcaaatactaaacgataacaaataatccgcccgcaaacacgaccgcaaaacacgtctctttaattacgcgcccgaaaaaccttataaaacgtcatacgaaacgaaaaatccctttacgcaataatt

SEQ ID NO: 22505 - DNA, 513 bp, Artificial Sequence
  chemically treated genomic DNA (Homo sapiens) CpG-island No: 22505
  misc_feature (426)..(426): n is either a, c, g or t
atcggtcgcgacggtcgcgtggcgtacgaatgtattttcgatattcgttcgttgaaagaagaaatcggtattagcgagttggatattgttaagcgtttgatcgattacggtttttacgcgtcgacgatgtcgttttcggtggcgggtacgttgatggttgaatcgattgaatttgaaagtaaagtggaattggatcgttttatcgacgcgatgttggttattcgcgtagaaattgattaggtgaaagtcggtgtttggtcgttggaagataattcgttggtgaacgcgtcgtatatttagagcgaattggtcgtcgagtgggcgtattcgtatagtcgtgaaattgcggtattttcggtaggtgtcgggcgaatatggggtgggagagggtagatagaattagtatcgtgcggtggtcgcgaaaanaaatcggggacgggagtgaaaaagaatttgaaatcgtgtacgtataagtagtgggagtatgtttaggcgtgtgattgcgtatttttt

SEQ ID NO: 22506 - DNA, 513 bp, Artificial Sequence
  chemically treated genomic DNA (Homo sapiens) CpG-island No: 22506
  misc_feature (88)..(88): n is either a, c, g or t
aaaaaatacgcaatcacacgcctaaacatactcccactacttatacgtacacgatttcaaattctttttcactcccgtccccgatttnttttcgcgaccaccgcacgatactaattctatctaccctctcccaccccatattcgcccgacacctaccgaaaataccgcaatttcacgactatacgaatacgcccactcgacgaccaattcgctctaaatatacgacgcgttcaccaacgaattatcttccaacgaccaaacaccgactttcacctaatcaatttctacgcgaataaccaacatcgcgtcgataaaacgatccaattccactttactttcaaattcaatcgattcaaccatcaacgtacccgccaccgaaaacgacatcgtcgacgcgtaaaaaccgtaatcgatcaaacgcttaacaatatccaactcgctaataccgatttcttctttcaacgaacgaatatcgaaaatacattcgtacgccacgcgaccgtcgcgaccgat

SEQ ID NO: 22507 - DNA, 513 bp, Artificial Sequence
  chemically treated genomic DNA (Homo sapiens) CpG-island No: 22507
  misc_feature (88)..(88): n is either a, c, g or t
aaaaggtacgtagttatacgtttaagtatgtttttattgtttgtacgtatacggttttaggtttttttttattttcgttttcggtttnttttcgcggttatcgtacggtattggttttatttgtttttttttattttatattcgttcgatatttgtcgggaatatcgtaattttacggttgtacggatgcgtttattcggcgattagttcgttttgaatgtgcggcgcgtttattagcgggttattttttagcggttagatatcggtttttatttggttaatttttgcgcggatagttagtatcgcgtcgataaagcgatttagttttattttgtttttagatttagtcggtttaattattagcgtattcgttatcgggaacgatatcgtcggcgcgtggaaatcgtagtcgattaggcgtttggtaatatttagttcgttgatgtcggtttttttttttagcgggcgaatatcgagaatatattcgtgcgttacgcgatcgtcgcgatcggt

SEQ ID NO: 22508 - DNA, 513 bp, Artificial Sequence
  chemically treated genomic DNA (Homo sapiens) CpG-island No: 22508
  misc_feature (426)..(426): n is either a, c, g or t
accgatcgcgacgatcgcgtaacgcacgaatatattctcgatattcgcccgctaaaaaaaaaaaccgacatcaacgaactaaatattaccaaacgcctaatcgactacgatttccacgcgccgacgatatcgttcccgataacgaatacgctaataattaaaccgactaaatctaaaaacaaaataaaactaaatcgctttatcgacgcgatactaactatccgcgcaaaaattaaccaaataaaaaccgatatctaaccgctaaaaaataacccgctaataaacgcgccgcacattcaaaacgaactaatcgccgaataaacgcatccgtacaaccgtaaaattacgatattcccgacaaatatcgaacgaatataaaataaaaaaaaacaaataaaaccaataccgtacgataaccgcgaaaanaaaccgaaaacgaaaataaaaaaaaacctaaaaccgtatacgtacaaacaataaaaacatacttaaacgtataactacgtacctttt

SEQ ID NO: 22509 - DNA, 621 bp, Artificial Sequence
  chemically treated genomic DNA (Homo sapiens) CpG-island No: 22509
  misc_feature (506)..(506): n is either a, c, g or t
  misc_feature (567)..(567): n is either a, c, g or t
gcgcggcgaataggtaatgttcgtggttttgcgcgttagtattattatttcggaagttcgtgaagtggcggatttattgggttttattattatcgaatgtgatgaatcgatttcggtaacggcgttcgtgttcgttagcgtgttagtcgataaaatcgaaagttagcgtattcgcgaaattattattgtttagttgtcggaaggttagtttatcgaaagtttggtcgtatagttgatggaaaaagtgatgaaggaaaaatagtcgttggagtagggcgtaatgtagtcgagttttaaatcggtgatcggtaaaggcggtattaaagtgattgatggtagtagcgttaagtttggtcgtttcgacggcgtagaagcgtattgcgtgggtttgattgattttgtgatcggagacgacggtagtagtatgggcgtcggttttatgtagtgggagaacgtatttttttcgtggattttgaattacgacgaaatcgatatggtgttggaangggagttgtatgttcgttacgaaggttaaatatgatcgttaaattagcgagtgatgttatntcgaaagttttagttttaacgggggggtattggggggattattgtttgtatgtt

SEQ ID NO: 22510 - DNA, 621 bp, Artificial Sequence
  chemically treated genomic DNA (Homo sapiens) CpG-island No: 22510
  misc_feature (55)..(55): n is either a, c, g or t
  misc_feature (116)..(116): n is either a, c, g or t
aacatacaaacaataatccccccaatacccccccgttaaaactaaaactttcganataacatcactcgctaatttaacgatcatatttaaccttcgtaacgaacatacaactcccnttccaacaccatatcgatttcgtcgtaattcaaaatccacgaaaaaaatacgttctcccactacataaaaccgacgcccatactactaccgtcgtctccgatcacaaaatcaatcaaacccacgcaatacgcttctacgccgtcgaaacgaccaaacttaacgctactaccatcaatcactttaataccgcctttaccgatcaccgatttaaaactcgactacattacgccctactccaacgactatttttccttcatcactttttccatcaactatacgaccaaactttcgataaactaaccttccgacaactaaacaataataatttcgcgaatacgctaactttcgattttatcgactaacacgctaacgaacacgaacgccgttaccgaaatcgattcatcacattcgataataataaaacccaataaatccgccacttcacgaacttccgaaataataatactaacgcgcaaaaccacgaacattacctattcgccgcgc

SEQ ID NO: 22511 - DNA, 621 bp, Artificial Sequence
  chemically treated genomic DNA (Homo sapiens) CpG-island No: 22511
  misc_feature (55)..(55): n is either a, c, g or t
  misc_feature (116)..(116): n is either a, c, g or t
ggtatgtaaatagtagtttttttagtattttttcgttgaagttggagttttcggnataatattattcgttggtttggcgattatgtttggttttcgtggcgaatatgtagtttttnttttagtattatgtcgatttcgtcgtagtttagggtttacgggaagaatgcgtttttttattgtataaaatcggcgtttatgttgttgtcgtcgttttcggttataagattagttaagtttacgtaatgcgtttttgcgtcgtcgaaacgattaaatttgacgttattgttattaattattttgatgtcgtttttgtcggttatcgatttgaagttcggttgtattgcgttttgttttagcgattgttttttttttattattttttttattagttgtgcgattaggttttcggtaaattggtttttcggtagttgggtaatgatggtttcgcggatgcgttggttttcggttttgtcggttggtacgttggcgggtacggacgtcgttatcgggatcgatttattatattcggtgatggtaaaatttagtagattcgttattttacgggttttcggggtaataatgttggcgcgtagaattacggatattgtttgttcgtcgcgt

SEQ ID NO: 22512 - DNA, 621 bp, Artificial Sequence
  chemically treated genomic DNA (Homo sapiens) CpG-island No: 22512
  misc_feature (506)..(506): n is either a, c, g or t
  misc_feature (567)..(567): n is either a, c, g or t
acgcgacgaacaaacaatatccgtaattctacgcgccaacattattaccccgaaaacccgtaaaataacgaatctactaaattttaccatcaccgaatataataaatcgatcccgataacgacgtccgtacccgccaacgtaccaaccgacaaaaccgaaaaccaacgcatccgcgaaaccatcattacccaactaccgaaaaaccaatttaccgaaaacctaatcgcacaactaataaaaaaaataataaaaaaaaaacaatcgctaaaacaaaacgcaatacaaccgaacttcaaatcgataaccgacaaaaacgacatcaaaataattaataacaataacgtcaaatttaatcgtttcgacgacgcaaaaacgcattacgtaaacttaactaatcttataaccgaaaacgacgacaacaacataaacgccgattttatacaataaaaaaacgcattcttcccgtaaaccctaaactacgacgaaatcgacataatactaaaanaaaaactacatattcgccacgaaaaccaaacataatcgccaaaccaacgaataatattatnccgaaaactccaacttcaacgaaaaaatactaaaaaaactactatttacatacc

SEQ ID NO: 22513 - DNA, 572 bp, Artificial Sequence
  chemically treated genomic DNA (Homo sapiens) CpG-island No: 22513
gttttgttgtagggttattaaatgtagggtagtgaaaatacgttttatttggcggtaggttaacggttggcgttagttatattaagtgaagaaggtattaaggcgtttattgtaaacggggaatggtaggttgacgaatacggtaattaatggcgttaggcgtttttatagggtgcgtttatcgatttcgtattagcggatcgtaaatcgttatggtaatacgttgaaaaatttgacgatatttattgcgttggttgttatgtttttattgtcgtcgattattatatcgttaatgcgtggtcgtttattgttaaaggaatgggggtacgaattagtatgagcgaaaacgaattggatattttaatttcgatttttcgtcggggggggtaattggggtatgttaattttgttttcgcgtatttatgtagtcggttttcgaaggtatcggtattatcgtcggtggtgtaatgcgcgtcgttttggaagtcgttggggtttataacgttttggttaaagtttatggttttattaattcgattaacgtggttcgtgtaattattgatggtttggaa

SEQ ID NO: 22514 - DNA, 572 bp, Artificial Sequence
  chemically treated genomic DNA (Homo sapiens) CpG-island No: 22514
ttccaaaccatcaataattacacgaaccacgttaatcgaattaataaaaccataaactttaaccaaaacgttataaaccccaacgacttccaaaacgacgcgcattacaccaccgacgataataccgataccttcgaaaaccgactacataaatacgcgaaaacaaaattaacataccccaattaccccccccgacgaaaaatcgaaattaaaatatccaattcgttttcgctcatactaattcgtacccccattcctttaacaataaacgaccacgcattaacgatataataatcgacgacaataaaaacataacaaccaacgcaataaatatcgtcaaatttttcaacgtattaccataacgatttacgatccgctaatacgaaatcgataaacgcaccctataaaaacgcctaacgccattaattaccgtattcgtcaacctaccattccccgtttacaataaacgccttaataccttcttcacttaatataactaacgccaaccgttaacctaccgccaaataaaacgtattttcactaccctacatttaataaccctacaacaaaac

SEQ ID NO: 22515 - DNA, 572 bp, Artificial Sequence
  chemically treated genomic DNA (Homo sapiens) CpG-island No: 22515
ttttaggttattaatagttgtacgaattacgttgatcgggttggtggaattataggttttagttagaacgttatgaattttagcgatttttagaacggcgcgtattgtattatcggcgatgatatcggtattttcggaagtcggttgtatgaatacgcgaggataagattagtatgttttagttatttttttcgacgggaaatcggggttaaaatgtttagttcgttttcgtttatgttggttcgtgtttttatttttttggtaatggacggttacgtattgacggtgtaatggtcggcggtaataggggtatgataattagcgtaataggtatcgttaagttttttagcgtattgttatagcggtttacggttcgttaatgcgggatcggtaagcgtattttgtaaagacgtttgacgttattgattgtcgtattcgttagtttgttatttttcgtttatagtgagcgttttgatattttttttatttaatgtggttagcgttagtcgttgatttgtcgttaggtagagcgtgtttttattgttttgtatttgataattttgtaatagaat

SEQ ID NO: 22516 - DNA, 572 bp, Artificial Sequence
  chemically treated genomic DNA (Homo sapiens) CpG-island No: 22516
attctattacaaaattatcaaatacaaaacaataaaaacacgctctacctaacgacaaatcaacgactaacgctaaccacattaaataaaaaaaatatcaaaacgctcactataaacgaaaaataacaaactaacgaatacgacaatcaataacgtcaaacgtctttacaaaatacgcttaccgatcccgcattaacgaaccgtaaaccgctataacaatacgctaaaaaacttaacgatacctattacgctaattatcatacccctattaccgccgaccattacaccgtcaatacgtaaccgtccattaccaaaaaaataaaaacacgaaccaacataaacgaaaacgaactaaacattttaaccccgatttcccgtcgaaaaaaataactaaaacatactaatcttatcctcgcgtattcatacaaccgacttccgaaaataccgatatcatcgccgataatacaatacgcgccgttctaaaaatcgctaaaattcataacgttctaactaaaacctataattccaccaacccgatcaacgtaattcgtacaactattaataacctaaaa

SEQ ID NO: 22517 - DNA, 545 bp, Artificial Sequence
  chemically treated genomic DNA (Homo sapiens) CpG-island No: 22517
ggtcgtttggttgcgggaaatcgacgttgttgcgtatggttgtcgggttggagcgggtgatagaaggcgatatttggattaacgattagcgcgtgattgaaatggagttaaaagatcgcgggattgcgatggtgttttagaattacgcgttttattcgtatatgagtgtcgaagaaaatatggcgtgggggttgaaaattcgcggtatgggtaagtagtaaattgtcgagcgcgttaaagaagcggcgcgtattttggagttggacggtttgtttaaacgtcgttcgcgcgagtttttcggcggttagcgttagcgtgtggcgatgggtcgcgcgattgtgcgcgattcggcggtgtttttgtttgatgagtcgttttttaatttcgatgttaagttgcgcgtgtagatgcgttttgaattgtaatagttgtatcgtcggtttgaaacgattttattttacgttatttacgattaggttgaagcgatgacgttgtttagcgagtaatgtgatgaacggcggtgttgtcgaattttttaatgttta

SEQ ID NO: 22518 - DNA, 545 bp, Artificial Sequence
  chemically treated genomic DNA (Homo sapiens) CpG-island No: 22518
taaacattaaaaaattcgacaacaccgccgttcatcacattactcgctaaacaacgtcatcgcttcaacctaatcgtaaataacgtaaaataaaatcgtttcaaaccgacgatacaactattacaattcaaaacgcatctacacgcgcaacttaacatcgaaattaaaaaacgactcatcaaacaaaaacaccgccgaatcgcgcacaatcgcgcgacccatcgccacacgctaacgctaaccgccgaaaaactcgcgcgaacgacgtttaaacaaaccgtccaactccaaaatacgcgccgcttctttaacgcgctcgacaatttactacttacccataccgcgaattttcaacccccacgccatattttcttcgacactcatatacgaataaaacgcgtaattctaaaacaccatcgcaatcccgcgatcttttaactccatttcaatcacgcgctaatcgttaatccaaatatcgccttctatcacccgctccaacccgacaaccatacgcaacaacgtcgatttcccgcaaccaaacgacc

SEQ ID NO: 22519 - DNA, 545 bp, Artificial Sequence
  chemically treated genomic DNA (Homo sapiens) CpG-island No: 22519
tgaatattaaggggttcggtaatatcgtcgtttattatattattcgttgggtagcgttatcgttttaatttgatcgtgagtaacgtagagtgaagtcgttttaggtcgacggtgtaattgttgtagtttaagacgtatttgtacgcgtagtttggtatcgaggttagagagcggtttattaaataggaatatcgtcggatcgcgtataatcgcgcggtttatcgttatacgttggcgttgatcgtcggaaagttcgcgcgggcgacgtttgagtagatcgtttagttttagaatgcgcgtcgtttttttaacgcgttcggtaatttgttgtttgtttatgtcgcgaatttttagtttttacgttatgtttttttcgatatttatatgcggataaagcgcgtagttttggaatattatcgtaatttcgcgattttttggttttattttagttacgcgttggtcgttgatttagatatcgttttttgttattcgttttagttcggtaattatgcgtagtagcgtcgatttttcgtagttagacggtt

SEQ ID NO: 22520 - DNA, 545 bp, Artificial Sequence
  chemically treated genomic DNA (Homo sapiens) CpG-island No: 22520
aaccgtctaactacgaaaaatcgacgctactacgcataattaccgaactaaaacgaataacaaaaaacgatatctaaatcaacgaccaacgcgtaactaaaataaaaccaaaaaatcgcgaaattacgataatattccaaaactacgcgctttatccgcatataaatatcgaaaaaaacataacgtaaaaactaaaaattcgcgacataaacaaacaacaaattaccgaacgcgttaaaaaaacgacgcgcattctaaaactaaacgatctactcaaacgtcgcccgcgcgaactttccgacgatcaacgccaacgtataacgataaaccgcgcgattatacgcgatccgacgatattcctatttaataaaccgctctctaacctcgataccaaactacgcgtacaaatacgtcttaaactacaacaattacaccgtcgacctaaaacgacttcactctacgttactcacgatcaaattaaaacgataacgctacccaacgaataatataataaacgacgatattaccgaaccccttaatattca

SEQ ID NO: 22521 - DNA, 793 bp, Artificial Sequence
  chemically treated genomic DNA (Homo sapiens) CpG-island No: 22521
  misc_feature (631)..(631): n is either a, c, g or t
gttttatcgatttgagcgtggaaacgcgttttgatgtagaagtgaaaagttggtttgttttcgttttataaaaatgttatgaattggtattgttgcgcgatgcgttgaatagtggtgatacggtagttttggtagagtggagcgtttcgatttaggtacgtcgttattttattcgcgtatataattcggcggtagaaaagcgtttggcggcgattatcgtttaggatagttagcgtgcgaatgtttatgaagtgcgtgttgaagtttagcgtgcgcgttttaaattgttagcgtggtcgattattacgattggttttttttcgtaaattacggaaattcgtattttgcgtttggattttaaaaagggtaatttcgacgttaataattatcgtacgggtattgcggaatatattaagtaggttattgttgagtaggaacgtttgggattggatgtgttggtatatggcgaggtcgagcgtaatgatatggtggaatattttggcgagtatttcgacggatttgtttttacgtaaaacggttgggtatagagttacggttttcgttgcgtgaagttatcgattgttattggtgatattagtcgttcggtatttattacgtggagtggcgaagntattttattttttattataaatcgtaaagggatttttagggttcgtgattattattttcgtgtggttttcgcggagagtgtattcgtaattttcgggggggtaatgggggggagtaatttttgtatgttttttggttttttagtttattgttgacgttaatt

SEQ ID NO: 22522 - DNA, 793 bp, Artificial Sequence
  chemically treated genomic DNA (Homo sapiens) CpG-island No: 22522
  misc_feature (163)..(163): n is either a, c, g or t
aattaacgtcaacaataaactaaaaaaccaaaaaacatacaaaaattactcccccccattacccccccgaaaattacgaatacactctccgcgaaaaccacacgaaaataataatcacgaaccctaaaaatccctttacgatttataataaaaaataaaatancttcgccactccacgtaataaataccgaacgactaatatcaccaataacaatcgataacttcacgcaacgaaaaccgtaactctatacccaaccgttttacgtaaaaacaaatccgtcgaaatactcgccaaaatattccaccatatcattacgctcgacctcgccatataccaacacatccaatcccaaacgttcctactcaacaataacctacttaatatattccgcaatacccgtacgataattattaacgtcgaaattaccctttttaaaatccaaacgcaaaatacgaatttccgtaatttacgaaaaaaaaccaatcgtaataatcgaccacgctaacaatttaaaacgcgcacgctaaacttcaacacgcacttcataaacattcgcacgctaactatcctaaacgataatcgccgccaaacgcttttctaccgccgaattatatacgcgaataaaataacgacgtacctaaatcgaaacgctccactctaccaaaactaccgtatcaccactattcaacgcatcgcgcaacaataccaattcataacatttttataaaacgaaaacaaaccaacttttcacttctacatcaaaacgcgtttccacgctcaaatcgataaaac

SEQ ID NO: 22523 - DNA, 793 bp, Artificial Sequence
  chemically treated genomic DNA (Homo sapiens) CpG-island No: 22523
  misc_feature (163)..(163): n is either a, c, g or t
aattaacgttagtaataaattgaaagattaagaggtatgtaaaagttatttttttttattattttttcgagggttacgggtatatttttcgcgggaattatacgagagtaatggttacgggttttagagatttttttacggtttgtggtaaagaatgggatantttcgttattttacgtaatgggtgtcgggcggttaatgttattaatgataatcggtggttttacgtagcgggaatcgtagttttgtatttaatcgttttgcgtaaagataaattcgtcgaggtgttcgttaaagtattttattatgttattacgttcggtttcgttatgtattagtatatttagttttaaacgtttttgtttaataatggtttgtttgatatgtttcgtaatgttcgtgcggtagttgttggcgtcgagattgttttttttgaaatttagacgtagggtacgaattttcgtggtttgcgggaaggaattaatcgtggtggtcggttacgttggtagtttaaaacgcgtacgttgggttttagtacgtattttatagatattcgtacgttggttgttttgggcggtgatcgtcgttagacgtttttttatcgtcggattatgtacgcgggtagagtgacgacgtgtttgaatcggggcgttttattttgttagagttgtcgtgttattattgtttagcgtatcgcgtagtagtgttagtttatggtatttttgtagggcgaaggtaaattagttttttatttttgtattaagacgcgtttttacgtttaggtcgatggggt

SEQ ID NO: 22524 - DNA, 793 bp, Artificial Sequence
  chemically treated genomic DNA (Homo sapiens) CpG-island No: 22524
  misc_feature (631)..(631): n is either a, c, g or t
accccatcgacctaaacgtaaaaacgcgtcttaatacaaaaataaaaaactaatttaccttcgccctacaaaaataccataaactaacactactacgcgatacgctaaacaataataacacgacaactctaacaaaataaaacgccccgattcaaacacgtcgtcactctacccgcgtacataatccgacgataaaaaaacgtctaacgacgatcaccgcccaaaacaaccaacgtacgaatatctataaaatacgtactaaaacccaacgtacgcgttttaaactaccaacgtaaccgaccaccacgattaattccttcccgcaaaccacgaaaattcgtaccctacgtctaaatttcaaaaaaaacaatctcgacgccaacaactaccgcacgaacattacgaaacatatcaaacaaaccattattaaacaaaaacgtttaaaactaaatatactaatacataacgaaaccgaacgtaataacataataaaatactttaacgaacacctcgacgaatttatctttacgcaaaacgattaaatacaaaactacgattcccgctacgtaaaaccaccgattatcattaataacattaaccgcccgacacccattacgtaaaataacgaaantatcccattctttaccacaaaccgtaaaaaaatctctaaaacccgtaaccattactctcgtataattcccgcgaaaaatatacccgtaaccctcgaaaaaataataaaaaaaaataacttttacatacctcttaatctttcaatttattactaacgttaatt

SEQ ID NO: 22525 - DNA, 521 bp, Artificial Sequence
  chemically treated genomic DNA (Homo sapiens) CpG-island No: 22525
  misc_feature (386)..(387): n is either a, c, g or t
  misc_feature (392)..(393): n is either a, c, g or t
  misc_feature (395)..(395): n is either a, c, g or t
taggcgtacgatattttggcgcgtggtgtcgtcggttgtggcggttagcgttataaacggtagcgtcgggaatcgttggcgtaattgatcgagcgcggtatatttcgggcggaaatcgtggttttattgggagatatagtgcgttttattaacggttaataatatcggattttagtgcgttagatgtttaagaaagttatttagtattaggcgtttcggggcgatataaagtagacgaatttgttcggtgcggtagtttgttattattttaagttgttgttcgcgggtttgcgtcgagttaaggtacgtcgtcgttacgtcgttggtttgtagttgatcgatttgatttatatcgattaagagatagtaagtattttcgttttatnnttttnntntttcgacgttatggttttgttatggtggtgtacgggtttggtcgttttttatgaacggacggggtagtacgtagtgcggcgaaaatgattagtttggttggaatgcgtaataattcgcggttttta

SEQ ID NO: 22526 - DNA, 521 bp, Artificial Sequence
  chemically treated genomic DNA (Homo sapiens) CpG-island No: 22526
  misc_feature (127)..(127): n is either a, c, g or t
  misc_feature (129)..(130): n is either a, c, g or t
  misc_feature (135)..(136): n is either a, c, g or t
taaaaaccgcgaattattacgcattccaaccaaactaatcattttcgccgcactacgtactaccccgtccgttcataaaaaacgaccaaacccgtacaccaccataacaaaaccataacgtcgaaanannaaaannataaaacgaaaatacttactatctcttaatcgatataaatcaaatcgatcaactacaaaccaacgacgtaacgacgacgtaccttaactcgacgcaaacccgcgaacaacaacttaaaataataacaaactaccgcaccgaacaaattcgtctactttatatcgccccgaaacgcctaatactaaataactttcttaaacatctaacgcactaaaatccgatattattaaccgttaataaaacgcactatatctcccaataaaaccacgatttccgcccgaaatataccgcgctcgatcaattacgccaacgattcccgacgctaccgtttataacgctaaccgccacaaccgacgacaccacgcgccaaaatatcgtacgccta

SEQ ID NO: 22527 - DNA, 521 bp, Artificial Sequence
  chemically treated genomic DNA (Homo sapiens) CpG-island No: 22527
  misc_feature (127)..(127): n is either a, c, g or t
  misc_feature (129)..(130): n is either a, c, g or t
  misc_feature (135)..(136): n is either a, c, g or t
tgaaaatcgcggattattgcgtattttaattaaattggttattttcgtcgtattgcgtattatttcgttcgtttatagagaacgattaaattcgtatattattatggtaaaattatgacgtcggggnannggggnnatggggcggaaatgtttgttattttttggtcgatgtaagttaggtcgattaattgtaagttaacggcgtggcggcggcgtgttttaattcgacgtaaattcgcgaatagtaatttgaagtgatgataggttgtcgtatcgggtaaattcgtttgttttatatcgtttcggaacgtttgatgttggataatttttttgagtatttggcgtattggaattcggtgttattagtcgttgatgaagcgtattgtattttttaatggggttacgattttcgttcggaatatgtcgcgttcggttagttgcgttagcggttttcgacgttgtcgtttatggcgttgatcgttatagtcgacgatattacgcgttaggatatcgtgcgtttg

SEQ ID NO: 22528 - DNA, 521 bp, Artificial Sequence
  chemically treated genomic DNA (Homo sapiens) CpG-island No: 22528
  misc_feature (386)..(387): n is either a, c, g or t
  misc_feature (392)..(393): n is either a, c, g or t
  misc_feature (395)..(395): n is either a, c, g or t
caaacgcacgatatcctaacgcgtaatatcgtcgactataacgatcaacgccataaacgacaacgtcgaaaaccgctaacgcaactaaccgaacgcgacatattccgaacgaaaatcgtaaccccattaaaaaatacaatacgcttcatcaacgactaataacaccgaattccaatacgccaaatactcaaaaaaattatccaacatcaaacgttccgaaacgatataaaacaaacgaatttacccgatacgacaacctatcatcacttcaaattactattcgcgaatttacgtcgaattaaaacacgccgccgccacgccgttaacttacaattaatcgacctaacttacatcgaccaaaaaataacaaacatttccgccccatnnccccnntnccccgacgtcataattttaccataataatatacgaatttaatcgttctctataaacgaacgaaataatacgcaatacgacgaaaataaccaatttaattaaaatacgcaataatccgcgattttca

SEQ ID NO: 22529 - DNA, 572 bp, Artificial Sequence
  chemically treated genomic DNA (Homo sapiens) CpG-island No: 22529
ttaggtcgtagtcggtaatttcgcgtatataatcgggtagtgatgtgattgtttgcgttgaaatggacgaatagtggggttacgtcggtgttaaattacgttagcgttggttgttttacgcgtatgataggatacggaggacggttgtggcgtacgttttcggtgaacgtattttggttatattggagcgttttttgagttcgttgtcggtttttaaggtttggtatagatgacggatggttggtcgttgtatgaattacgtttgaagggaaagtcgtattttatcgtaagcgttattttagcgtattgagcgttataattcgaattcgggataatagttggaaagtttggacgaatttattgtttttcgaatatatgcgggggttgggcggttttttaagtattcggttagggatgttttaaaaacgtgttaagtagtaggcgttggggttggaagtcgatatttttgtcgtcgggttaaagcgtaaagagagttacggtaaagtggtatttggtagcgtgtagtttgtcgttcgtaattttgatgttttttagggtgaattttcgttgtt

SEQ ID NO: 22530 - DNA, 572 bp, Artificial Sequence
  chemically treated genomic DNA (Homo sapiens) CpG-island No: 22530
aacaacgaaaattcaccctaaaaaacatcaaaattacgaacgacaaactacacgctaccaaataccactttaccgtaactctctttacgctttaacccgacgacaaaaatatcgacttccaaccccaacgcctactacttaacacgtttttaaaacatccctaaccgaatacttaaaaaaccgcccaacccccgcatatattcgaaaaacaataaattcgtccaaactttccaactattatcccgaattcgaattataacgctcaatacgctaaaataacgcttacgataaaatacgactttcccttcaaacgtaattcatacaacgaccaaccatccgtcatctataccaaaccttaaaaaccgacaacgaactcaaaaaacgctccaatataaccaaaatacgttcaccgaaaacgtacgccacaaccgtcctccgtatcctatcatacgcgtaaaacaaccaacgctaacgtaatttaacaccgacgtaaccccactattcgtccatttcaacgcaaacaatcacatcactacccgattatatacgcgaaattaccgactacgacctaa

SEQ ID NO: 22531 - DNA, 572 bp, Artificial Sequence
  chemically treated genomic DNA (Homo sapiens) CpG-island No: 22531
aatagcgaaaatttattttgaaaggtattaagattacgggcgatagattgtacgttgttaaatattattttatcgtggttttttttgcgttttagttcggcggtaaaaatatcggtttttagttttagcgtttgttatttagtacgtttttgaggtatttttagtcgaatgtttgagaaatcgtttaattttcgtatgtgttcggaaggtagtaaattcgtttaggttttttagttgttgtttcggattcggattatggcgtttaatgcgttgaggtaacgtttgcgataaagtgcggttttttttttaggcgtgatttatatagcggttagttattcgttatttatattagattttaaaggtcgatagcgggtttagaagacgttttagtgtggttagagtgcgtttatcgaagacgtgcgttataatcgtttttcgtattttgttatacgcgtaaaatagttagcgttgacgtgatttagtatcgacgtagttttattgttcgtttattttagcgtagataattatattattgttcggttgtatgcgcgaggttatcgattgcggtttga

SEQ ID NO: 22532 - DNA, 572 bp, Artificial Sequence
  chemically treated genomic DNA (Homo sapiens) CpG-island No: 22532
tcaaaccgcaatcgataacctcgcgcatacaaccgaacaataatataattatctacgctaaaataaacgaacaataaaactacgtcgatactaaatcacgtcaacgctaactattttacgcgtataacaaaatacgaaaaacgattataacgcacgtcttcgataaacgcactctaaccacactaaaacgtcttctaaacccgctatcgacctttaaaatctaatataaataacgaataactaaccgctatataaatcacgcctaaaaaaaaaaccgcactttatcgcaaacgttacctcaacgcattaaacgccataatccgaatccgaaacaacaactaaaaaacctaaacgaatttactaccttccgaacacatacgaaaattaaacgatttctcaaacattcgactaaaaatacctcaaaaacgtactaaataacaaacgctaaaactaaaaaccgatatttttaccgccgaactaaaacgcaaaaaaaaccacgataaaataatatttaacaacgtacaatctatcgcccgtaatcttaatacctttcaaaataaattttcgctatt

SEQ ID NO: 22533 - DNA, 1157 bp, Artificial Sequence
  chemically treated genomic DNA (Homo sapiens) CpG-island No: 22533
ttatcggggggggggggaagggggtaatgtttgtatgtttgttgattttgggggcgtatcgttatattacgcgcgatgttagcgtcggaagtgaaaattatatcgttttgagcgagtaggagttttttattcgcgcggggtaaaatttgttggttttaagttggtacgttaacggtttgtattatggcgtcggcgtcgagattgatttttggttgtacgtcggattcgacgtgttggttaacggtttacgcgtttatttgtcgtaggcgcgggcgcgttattaatcggcgttgttgttcgtttgtttataggtttcgtcggagatttttcgttagcgtttggaaaatcgtggtcgtgaaaacgttagtgaaattaacgttcgtttggcgcgcgtcgttcgttatattttataggattgttatacgtttaataatgacggtagtttgcgttagtcggtcgatacgttgttgacgttgatttattagaaggagaaatattatgtttgtttgtgagtttcgttcggttacgtagtacgatatcgacgcggtttacgcgttgatttgtgagttaaaataggcggagtttgattattacgcgtttcgcgtgggttttaacgttaatttgcgcgatttaaatatgcgttattatttggcgttgtttgatggcgaagttgtcggtatgatcggtttgtatttgtagttttatttgtattatgttaattggatcggcgaaatttaggagttggtggtaatgtcgtaggcgcgcggtttgaacgtcggtagtaagttattggcgtgggtagaagaagaagttcgttaggtcggggtcgaaatgatcgaattttcgattaacgtgaagcgttacgacgcgtatcgtttttatttgcgcgaaggttacgagtagagttattttcgttttattaaggcgttgtaatatgagtttgatttttacgtttatcggtatcggcggcgtatagggcgtttcggtatggggttgcgagtgtgcggtttgcgttagaacgcggcgttcgtcgtagtatcgtcgttaatcgtgtagcggcgtagtgaagtttaacgacgtaattattttgatcgacgtcgggttgtacgatttattcgatcgtttgtcggtcggattgttttaataattttttttta

SEQ ID NO: 22534 - DNA, 1157 bp, Artificial Sequence
  chemically treated genomic DNA (Homo sapiens) CpG-island No: 22534
taaaaaaaaattattaaaacaatccgaccgacaaacgatcgaataaatcgtacaacccgacgtcgatcaaaataattacgtcgttaaacttcactacgccgctacacgattaacgacgatactacgacgaacgccgcgttctaacgcaaaccgcacactcgcaaccccataccgaaacgccctatacgccgccgataccgataaacgtaaaaatcaaactcatattacaacgccttaataaaacgaaaataactctactcgtaaccttcgcgcaaataaaaacgatacgcgtcgtaacgcttcacgttaatcgaaaattcgatcatttcgaccccgacctaacgaacttcttcttctacccacgccaataacttactaccgacgttcaaaccgcgcgcctacgacattaccaccaactcctaaatttcgccgatccaattaacataatacaaataaaactacaaatacaaaccgatcataccgacaacttcgccatcaaacaacgccaaataataacgcatatttaaatcgcgcaaattaacgttaaaacccacgcgaaacgcgtaataatcaaactccgcctattttaactcacaaatcaacgcgtaaaccgcgtcgatatcgtactacgtaaccgaacgaaactcacaaacaaacataatatttctccttctaataaatcaacgtcaacaacgtatcgaccgactaacgcaaactaccgtcattattaaacgtataacaatcctataaaatataacgaacgacgcgcgccaaacgaacgttaatttcactaacgttttcacgaccacgattttccaaacgctaacgaaaaatctccgacgaaacctataaacaaacgaacaacaacgccgattaataacgcgcccgcgcctacgacaaataaacgcgtaaaccgttaaccaacacgtcgaatccgacgtacaaccaaaaatcaatctcgacgccgacgccataatacaaaccgttaacgtaccaacttaaaaccaacaaattttaccccgcgcgaataaaaaactcctactcgctcaaaacgatataattttcacttccgacgctaacatcgcgcgtaatataacgatacgcccccaaaatcaacaaacatacaaacattacccccttccccccccccccgataa

SEQ ID NO: 22535 - DNA, 1157 bp, Artificial Sequence
  chemically treated genomic DNA (Homo sapiens) CpG-island No: 22535
taagaaaaaattgttgaaataattcggtcgataagcgatcgggtagatcgtgtagttcggcgtcgattagggtgattgcgtcgttaaattttattacgtcgttgtacggttggcggcgatattgcggcgagcgtcgcgttttggcgtaggtcgtatattcgtagttttatgtcggaacgttttgtgcgtcgtcggtgtcggtgagcgtgagggttaggtttatgttatagcgttttggtgaagcggaagtggttttgttcgtagttttcgcgtagatagaaacggtgcgcgtcgtggcgttttacgttggtcgaaagttcggttatttcggtttcggtttggcgggtttttttttttgtttacgttagtaatttattgtcgacgtttagatcgcgcgtttgcggtattattattaatttttgaatttcgtcgatttagttgatatgatgtagatgaaattgtaaatgtaggtcgattatgtcgataatttcgttattaagtagcgttagatggtagcgtatgtttgggtcgcgtagattggcgttaaaatttacgcgaaacgcgtggtggttaaatttcgtttgttttagtttataaattagcgcgtaaatcgcgtcggtgtcgtattgcgtggtcgggcgaagtttataagtaggtatggtgtttttttttttgatggattagcgttagtagcgtgtcgatcgattggcgtaggttgtcgttattgttgagcgtatggtaattttgtggagtatagcgggcggcgcgcgttaggcgggcgttaattttattggcgtttttacggttacggttttttaggcgttggcggaggattttcggcgaaatttgtaaatagacgggtagtagcgtcgattgatagcgcgttcgcgtttgcggtagatgggcgcgtgagtcgttgattagtacgtcgaattcggcgtgtagttagagattaatttcgacgtcgacgttataatatagatcgttagcgtgttagtttaaggttaatagattttgtttcgcgcgggtaaaaaatttttgttcgtttagggcgatatggtttttattttcggcgttggtatcgcgcgtgatgtagcgatgcgtttttaggattagtaggtatataagtattgttttttttttttttttttcgatgg

SEQ ID NO: 22536 - DNA, 1157 bp, Artificial Sequence
  chemically treated genomic DNA (Homo sapiens) CpG-island No: 22536
ccatcgaaaaaaaaaaaaaaaaaacaatacttatatacctactaatcctaaaaacgcatcgctacatcacgcgcgataccaacgccgaaaataaaaaccatatcgccctaaacgaacaaaaattttttacccgcgcgaaacaaaatctattaaccttaaactaacacgctaacgatctatattataacgtcgacgtcgaaattaatctctaactacacgccgaattcgacgtactaatcaacgactcacgcgcccatctaccgcaaacgcgaacgcgctatcaatcgacgctactacccgtctatttacaaatttcgccgaaaatcctccgccaacgcctaaaaaaccgtaaccgtaaaaacgccaataaaattaacgcccgcctaacgcgcgccgcccgctatactccacaaaattaccatacgctcaacaataacgacaacctacgccaatcgatcgacacgctactaacgctaatccatcaaaaaaaaaaacaccatacctacttataaacttcgcccgaccacgcaatacgacaccgacgcgatttacgcgctaatttataaactaaaacaaacgaaatttaaccaccacgcgtttcgcgtaaattttaacgccaatctacgcgacccaaacatacgctaccatctaacgctacttaataacgaaattatcgacataatcgacctacatttacaatttcatctacatcatatcaactaaatcgacgaaattcaaaaattaataataataccgcaaacgcgcgatctaaacgtcgacaataaattactaacgtaaacaaaaaaaaaaacccgccaaaccgaaaccgaaataaccgaactttcgaccaacgtaaaacgccacgacgcgcaccgtttctatctacgcgaaaactacgaacaaaaccacttccgcttcaccaaaacgctataacataaacctaaccctcacgctcaccgacaccgacgacgcacaaaacgttccgacataaaactacgaatatacgacctacgccaaaacgcgacgctcgccgcaatatcgccgccaaccgtacaacgacgtaataaaatttaacgacgcaatcaccctaatcgacgccgaactacacgatctacccgatcgcttatcgaccgaattatttcaacaattttttctta

SEQ ID NO: 22537 - DNA, 767 bp, Artificial Sequence
  chemically treated genomic DNA (Homo sapiens) CpG-island No: 22537
tcgattagcgttcgttgtggattcggcggtgggaatggcgagtttagtaatttgtgtttcgcgtacgatggtttgcggtagtggatgcgtcgcgttttgttcgatcgtcgtcgttagtgttagtagtttagatttattaatattcgttgtcggatgaatcgcggtaacgcgcggtttatcgacggttagcgtatcggttttattaaacgttatttgagtaatacgatttagttgttttagcgtcgtttcgtttttaattaacgttttacgacgcgttgtcgtcgttagttcggaggtaatcgtcgtaggcgttgagataattaacgtatacgggtagttaattagtagtagcgttagttttttataaatttatttttgttagttggcggtaaatagtagcggtggtattagcgttattagtagagcgacggttataatcgcgggcgtatagatacggttgaaacggtcgataaatcgtttaatgggagcgcgacgtttttcggttttttcgattagttttagaattcggttaatggcgttggttttcggttttgatagtatttttaacgttattagacggtttacgttggtggtattagtagggattttatcgttcgttgcgcgttttatcggaatggattcgtcggttagggcgtttttattaaagagcgattagtaggatttatatagttgtttttttttttttgcgttaagtgtcgtggagtaaatagttttattgaggacgatataatgtttcggttagttaa

SEQ ID NO: 22538 - DNA, 767 bp, Artificial Sequence
  chemically treated genomic DNA (Homo sapiens) CpG-island No: 22538
ttaactaaccgaaacattatatcgtcctcaataaaactatttactccacgacacttaacgcaaaaaaaaaaaaacaactatataaatcctactaatcgctctttaataaaaacgccctaaccgacgaatccattccgataaaacgcgcaacgaacgataaaatccctactaataccaccaacgtaaaccgtctaataacgttaaaaatactatcaaaaccgaaaaccaacgccattaaccgaattctaaaactaatcgaaaaaaccgaaaaacgtcgcgctcccattaaacgatttatcgaccgtttcaaccgtatctatacgcccgcgattataaccgtcgctctactaataacgctaataccaccgctactatttaccgccaactaacaaaaataaatttataaaaaactaacgctactactaattaactacccgtatacgttaattatctcaacgcctacgacgattacctccgaactaacgacgacaacgcgtcgtaaaacgttaattaaaaacgaaacgacgctaaaacaactaaatcgtattactcaaataacgtttaataaaaccgatacgctaaccgtcgataaaccgcgcgttaccgcgattcatccgacaacgaatattaataaatctaaactactaacactaacgacgacgatcgaacaaaacgcgacgcatccactaccgcaaaccatcgtacgcgaaacacaaattactaaactcgccattcccaccgccgaatccacaacgaacgctaatcga

SEQ ID NO: 22539 - DNA, 767 bp, Artificial Sequence
  chemically treated genomic DNA (Homo sapiens) CpG-island No: 22539
ttaattggtcggaatattatgtcgtttttaataaagttatttgttttacggtatttagcgtaggggggggggggtaattgtgtgaattttgttggtcgttttttgatgaaagcgttttggtcggcgaatttatttcggtggagcgcgtaacgggcgataaagtttttgttggtgttattagcgtagatcgtttggtgacgttggaagtgttgttagaatcgggagttagcgttattgatcggattttgaaattgatcgaagaagtcgaagagcgtcgcgtttttattgagcggtttatcgatcgttttagtcgtatttatacgttcgcgattatggtcgtcgttttgttggtgacgttggtgttatcgttgttgtttgtcgttagttggtaggagtggatttataaagggttgacgttgttgttgattggttgttcgtgtgcgttagttattttaacgtttgcggcgattattttcgggttggcggcggtagcgcgtcgtggggcgttgattaaaggcggagcggcgttggaatagttgggtcgtgttatttaggtggcgtttgataaaatcggtacgttgatcgtcggtaaatcgcgcgttatcgcgatttattcggtaacgggtattagtgaatttgaattgttgatattggcggcggcggtcgagtaaggcgcgacgtatttattgtcgtaagttatcgtacgcgaagtataggttgttgaattcgttatttttatcgtcgaatttatagcgggcgttggtcgg

SEQ ID NO: 22540 - DNA, 767 bp, Artificial Sequence
  chemically treated genomic DNA (Homo sapiens) CpG-island No: 22540
ccgaccaacgcccgctataaattcgacgataaaaataacgaattcaacaacctatacttcgcgtacgataacttacgacaataaatacgtcgcgccttactcgaccgccgccgccaatatcaacaattcaaattcactaatacccgttaccgaataaatcgcgataacgcgcgatttaccgacgatcaacgtaccgattttatcaaacgccacctaaataacacgacccaactattccaacgccgctccgcctttaatcaacgccccacgacgcgctaccgccgccaacccgaaaataatcgccgcaaacgttaaaataactaacgcacacgaacaaccaatcaacaacaacgtcaaccctttataaatccactcctaccaactaacgacaaacaacaacgataacaccaacgtcaccaacaaaacgacgaccataatcgcgaacgtataaatacgactaaaacgatcgataaaccgctcaataaaaacgcgacgctcttcgacttcttcgatcaatttcaaaatccgatcaataacgctaactcccgattctaacaacacttccaacgtcaccaaacgatctacgctaataacaccaacaaaaactttatcgcccgttacgcgctccaccgaaataaattcgccgaccaaaacgctttcatcaaaaaacgaccaacaaaattcacacaattacccccccccccctacgctaaataccgtaaaacaaataactttattaaaaacgacataatattccgaccaattaa

SEQ ID NO: 22541 - DNA, 746 bp, Artificial Sequence
  chemically treated genomic DNA (Homo sapiens) CpG-island No: 22541
ggatatcgtacgttgtttttcggttatgcggtgatgtttttcgagttgatttcgtattgtaatatcgtttaattcgcgcgtggtgcgggattatttattttattattcgtaatttgttatcgttttattaattataattaaacgatagtagttcgcgtagtattgggttcgtatattatgtggatggggattgttgtcgattgcgtgattagcgttatttttttgacggcgatggtattaaatttgttgttaattggattgatgaaaagcgtattttacgttacgttgagttggggcgattggtttttcgggatgttgtcgtttagtattttattggttttgttggttttttggttggtttacgtgttgtattcgtcggtattgaagtttggcgattaggtgtcgcgttgggtagagacggaattgtaggtaatgggttcgttttgttcgcgtgaaaaacggatgttggggttgatggtaggcgcgttggtgttgtggattttcggcggtgattatatcgatgtcgcgatggtcggttatagcgtggtggtattgatgttgtttttgcgtattattagttgggacgatattgttagtaataaagcggcgtggaacgtttttttttggttggtttcgtttattattttcgttatcggatttaataatatcggttttattagttggtttggtaaattgttagtaggtagtttaagcggttattcgttaacgatggtgatggtggcgtt

SEQ ID NO: 22542 - DNA, 746 bp, Artificial Sequence
  chemically treated genomic DNA (Homo sapiens) CpG-island No: 22542
aacgccaccatcaccatcgttaacgaataaccgcttaaactacctactaacaatttaccaaaccaactaataaaaccgatattattaaatccgataacgaaaataataaacgaaaccaaccaaaaaaaaacgttccacgccgctttattactaacaatatcgtcccaactaataatacgcaaaaacaacatcaataccaccacgctataaccgaccatcgcgacatcgatataatcaccgccgaaaatccacaacaccaacgcgcctaccatcaaccccaacatccgtttttcacgcgaacaaaacgaacccattacctacaattccgtctctacccaacgcgacacctaatcgccaaacttcaataccgacgaatacaacacgtaaaccaaccaaaaaaccaacaaaaccaataaaatactaaacgacaacatcccgaaaaaccaatcgccccaactcaacgtaacgtaaaatacgcttttcatcaatccaattaacaacaaatttaataccatcgccgtcaaaaaaataacgctaatcacgcaatcgacaacaatccccatccacataatatacgaacccaatactacgcgaactactatcgtttaattataattaataaaacgataacaaattacgaataataaaataaataatcccgcaccacgcgcgaattaaacgatattacaatacgaaatcaactcgaaaaacatcaccgcataaccgaaaaacaacgtacgatatcc

SEQ ID NO: 22543 - DNA, 746 bp, Artificial Sequence
  chemically treated genomic DNA (Homo sapiens) CpG-island No: 22543
aacgttattattattatcgttggcgaataatcgtttaagttgtttgttaatagtttgttaaattagttaataaaatcggtgttgttgagttcggtggcgagggtgataagcgaggttagttagaagaaaacgttttacgtcgttttattattgataatgtcgttttaattgataatgcgtagaagtagtattagtgttattacgttgtaatcgattatcgcggtatcgatataattatcgtcgaaaatttatagtattagcgcgtttattattagttttagtattcgttttttacgcgaatagagcgggtttattgtttgtagtttcgtttttgtttagcgcggtatttgatcgttagattttagtatcggcgggtatagtacgtaagttagttagggaattagtagaattagtaaaatgttgagcggtaatatttcgaggaattagtcgttttaatttagcgtggcgtgagatgcgttttttattagtttaattaatagtaagtttggtgttatcgtcgttaagaaaatggcgttggttacgtagtcggtaataatttttatttatatgatgtacgagtttaatgttgcgcgaattgttgtcgtttggttgtgattgatagagcggtggtaggttacggatgatgggatagataatttcgtattacgcgcgagttggacggtgttatagtgcgagattagttcggagaatattatcgtatagtcgagaaatagcgtgcgatgttt

SEQ ID NO: 22544 - DNA, 746 bp, Artificial Sequence
  chemically treated genomic DNA (Homo sapiens) CpG-island No: 22544
aaacatcgcacgctatttctcgactatacgataatattctccgaactaatctcgcactataacaccgtccaactcgcgcgtaatacgaaattatctatcccatcatccgtaacctaccaccgctctatcaatcacaaccaaacgacaacaattcgcgcaacattaaactcgtacatcatataaataaaaattattaccgactacgtaaccaacgccattttcttaacgacgataacaccaaacttactattaattaaactaataaaaaacgcatctcacgccacgctaaattaaaacgactaattcctcgaaatattaccgctcaacattttactaattctactaattccctaactaacttacgtactatacccgccgatactaaaatctaacgatcaaataccgcgctaaacaaaaacgaaactacaaacaataaacccgctctattcgcgtaaaaaacgaatactaaaactaataataaacgcgctaatactataaattttcgacgataattatatcgataccgcgataatcgattacaacgtaataacactaatactacttctacgcattatcaattaaaacgacattatcaataataaaacgacgtaaaacgttttcttctaactaacctcgcttatcaccctcgccaccgaactcaacaacaccgattttattaactaatttaacaaactattaacaaacaacttaaacgattattcgccaacgataataataataacgtt

SEQ ID NO: 22545 - DNA, 685 bp, Artificial Sequence
  chemically treated genomic DNA (Homo sapiens) CpG-island No: 22545
gtcggataatcgtatcgttcgtgacgcgtattatttttatcggtatgatcgttacggtaggttgatagagaaaatcgattttatttcggaaggggttattcgtacggatgatgagcggatttatcggtattattacgatagttagtatcggttggtgtattatacgcggatataatatgaagagtcgttggtcgaaagtcgttatttttacgattcgttgggtcgtagggtggtaaaacgggtgtggcggcgtgaacgggatttgacgggttggatgtcgttgttacggaaatcgtaagtgatttggtacggttgggacggcgatcggttgattacgatatagaacgataggagtcgtatttagacgatttattagtcggggagttttacgttatttattagggtcgaaattgttatcggtgagttggcgaaaacgtagcgtcgtagtttggcggatgttttttagtagttcggcggcgaagacggtggtagtgggggattttcgtcggtacggtgtagatgttcgatcggttggaaagtgaaattttggttgatcgggtgagtgaggaaagtcgtcgttggttggtatcgtgcggtttgatcgtggagtagatgaaaaagattagtatatatgtaagtatagttcgttataagtgtacggttatgtttgtatgtttgtaggtta

SEQ ID NO: 22546 - DNA, 685 bp, Artificial Sequence
  chemically treated genomic DNA (Homo sapiens) CpG-island No: 22546
taacctacaaacatacaaacataaccgtacacttataacgaactatacttacatatatactaatctttttcatctactccacgatcaaaccgcacgataccaaccaacgacgactttcctcactcacccgatcaaccaaaatttcactttccaaccgatcgaacatctacaccgtaccgacgaaaatcccccactaccaccgtcttcgccgccgaactactaaaaaacatccgccaaactacgacgctacgttttcgccaactcaccgataacaatttcgaccctaataaataacgtaaaactccccgactaataaatcgtctaaatacgactcctatcgttctatatcgtaatcaaccgatcgccgtcccaaccgtaccaaatcacttacgatttccgtaacaacgacatccaacccgtcaaatcccgttcacgccgccacacccgttttaccaccctacgacccaacgaatcgtaaaaataacgactttcgaccaacgactcttcatattatatccgcgtataatacaccaaccgatactaactatcgtaataataccgataaatccgctcatcatccgtacgaataaccccttccgaaataaaatcgattttctctatcaacctaccgtaacgatcataccgataaaaataatacgcgtcacgaacgatacgattatccgac

SEQ ID NO: 22547 - DNA, 685 bp, Artificial Sequence
  chemically treated genomic DNA (Homo sapiens) CpG-island No: 22547
tgatttgtaggtatgtaagtatagtcgtatatttgtggcggattatgtttgtatgtatgttggttttttttatttgttttacggttaggtcgtacgatgttagttagcggcggttttttttatttattcggttagttaggattttattttttagtcggtcgagtatttgtatcgtgtcggcgggaattttttattgttatcgttttcgtcgtcggattgttgaagggtattcgttaggttgcggcgttgcgttttcgttagtttatcggtggtagtttcgattttgatgagtggcgtgaagtttttcggttgataaatcgtttggatgcggtttttgtcgttttgtatcgtggttagtcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggttttttatattgtgttcgcgtgtagtgtattagtcggtgttgattgtcgtaatggtatcggtgagttcgtttattattcgtgcggataatttttttcgggatgaggtcggttttttttgttagtttgtcgtgacggttatatcggtaaagatagtgcgcgttacgggcgatacggttattcggt

SEQ ID NO: 22548 - DNA, 685 bp, Artificial Sequence
  chemically treated genomic DNA (Homo sapiens) CpG-island No: 22548
accgaataaccgtatcgcccgtaacgcgcactatctttaccgatataaccgtcacgacaaactaacaaaaaaaaccgacctcatcccgaaaaaaattatccgcacgaataataaacgaactcaccgataccattacgacaatcaacaccgactaatacactacacgcgaacacaatataaaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgactaaccacgatacaaaacgacaaaaaccgcatccaaacgatttatcaaccgaaaaacttcacgccactcatcaaaatcgaaactaccaccgataaactaacgaaaacgcaacgccgcaacctaacgaatacccttcaacaatccgacgacgaaaacgataacaataaaaaattcccgccgacacgatacaaatactcgaccgactaaaaaataaaatcctaactaaccgaataaataaaaaaaaccgccgctaactaacatcgtacgacctaaccgtaaaacaaataaaaaaaaccaacatacatacaaacataatccgccacaaatatacgactatacttacatacctacaaatca

SEQ ID NO: 22549 - DNA, 857 bp, Artificial Sequence
  chemically treated genomic DNA (Homo sapiens) CpG-island No: 22549
  misc_feature (722)..(722): n is either a, c, g or t
  misc_feature (789)..(789): n is either a, c, g or t
gcgtagacgttggtatagttgttttattaatttaatattcgtcgggttatgattatgatgacgcggttagagttttggcggcgttagttttttatcgagatcgtggtataaagttgcgaaacggatatcgatttgcggatttagtatcgtcgttattgagagcgttattaaggtatgaatattcgtatcgattttcggatgttatttggtaggggtcggaacgttaaatagtgcgttaattttcgggaataaaacgcgtagtgcgtcgtaatcgcgtagtatttggaagaatatttgtggattgcgggtggtgagggcgtttttcgtttttttttatattcgtttaggcgttaggtgttttagtttattcgtatgggttatttcgcgtattaacgttagagttttatcggtaatacgaaaatcgaggtgggtataacgcgtagtaaaacgcgttacgcgtaatacgcgtaacggattttcgttaaaagcgggggaaatatggcgtaatagacgattttgtagatcgtttagatcgttgtacgggtcgataatttcgtcgttatcgttttgggttagcgtattaatggttagatcgcgacgtttaagattattttttagcgtgatattcggtgcggtatagtaagtaaaatcggtgtaatcggaatcggattttcgttcggtacgtgttagcgtatattttttatgcgtttgcggatataganatatagggaaatcgcggttttattgttggtaggtcgcgtcgagtattttttgtggcgtattgtcgantatttatttatttttgttttgaacggtaggttttatatgtatttcggtgtaagtttgttttggaggtt

SEQ ID NO: 22550 - DNA, 857 bp, Artificial Sequence
  chemically treated genomic DNA (Homo sapiens) CpG-island No: 22550
  misc_feature (69)..(69): n is either a, c, g or t
  misc_feature (136)..(136): n is either a, c, g or t
aacctccaaaacaaacttacaccgaaatacatataaaacctaccgttcaaaacaaaaataaataaatantcgacaatacgccacaaaaaatactcgacgcgacctaccaacaataaaaccgcgatttccctatatntctatatccgcaaacgcataaaaaatatacgctaacacgtaccgaacgaaaatccgattccgattacaccgattttacttactataccgcaccgaatatcacgctaaaaaataatcttaaacgtcgcgatctaaccattaatacgctaacccaaaacgataacgacgaaattatcgacccgtacaacgatctaaacgatctacaaaatcgtctattacgccatatttcccccgcttttaacgaaaatccgttacgcgtattacgcgtaacgcgttttactacgcgttatacccacctcgattttcgtattaccgataaaactctaacgttaatacgcgaaataacccatacgaataaactaaaacacctaacgcctaaacgaatataaaaaaaaacgaaaaacgccctcaccacccgcaatccacaaatattcttccaaatactacgcgattacgacgcactacgcgttttattcccgaaaattaacgcactatttaacgttccgacccctaccaaataacatccgaaaatcgatacgaatattcataccttaataacgctctcaataacgacgatactaaatccgcaaatcgatatccgtttcgcaactttataccacgatctcgataaaaaactaacgccgccaaaactctaaccgcgtcatcataatcataacccgacgaatattaaattaataaaacaactataccaacgtctacgc

SEQ ID NO: 22551 - DNA, 857 bp, Artificial Sequence
  chemically treated genomic DNA (Homo sapiens) CpG-island No: 22551
  misc_feature (69)..(69): n is either a, c, g or t
  misc_feature (136)..(136): n is either a, c, g or t
agtttttaaggtaggtttgtatcggaatgtatgtgaggtttatcgtttaagatagagatgggtgggtgntcggtagtacgttatagaagatgttcgacgcggtttattagtagtagggtcgcgatttttttgtgtntttgtattcgtaaacgtatgaagagtatgcgttggtacgtatcgaacggaaattcggtttcggttatatcggttttatttgttatgtcgtatcggatgttacgttggaagatgattttaagcgtcgcgatttgattattaatgcgttggtttaggacgataacggcgagattatcgattcgtataacggtttgggcgatttgtaaaatcgtttgttgcgttatgtttttttcgtttttggcgaagattcgttacgcgtattgcgcgtggcgcgttttgttgcgcgttatgtttatttcggttttcgtattgtcgatgaaattttggcgttgatgcgcgagatgatttatgcgggtgaattggaatatttgacgtttgaacgggtatggaaagagacggaaagcgtttttattattcgtaatttataggtgtttttttaggtattgcgcgattgcggcgtattgcgcgttttattttcggaaattgacgtattgtttggcgtttcggtttttgttaagtggtattcggaaatcgatacgggtatttatattttaatgacgtttttaatggcggcgatgttgagttcgtaggtcgatgttcgtttcgtaattttatgttacgatttcggtaaagggttgacgtcgttagaattttggtcgcgttattatggttatggttcggcgggtgttgagttagtggaataattatgttagcgtttgcgt

SEQ ID NO: 22552 - DNA, 857 bp, Artificial Sequence
  chemically treated genomic DNA (Homo sapiens) CpG-island No: 22552
  misc_feature (722)..(722): n is either a, c, g or t
  misc_feature (789)..(789): n is either a, c, g or t
acgcaaacgctaacataattattccactaactcaacacccgccgaaccataaccataataacgcgaccaaaattctaacgacgtcaaccctttaccgaaatcgtaacataaaattacgaaacgaacatcgacctacgaactcaacatcgccgccattaaaaacgtcattaaaatataaatacccgtatcgatttccgaataccacttaacaaaaaccgaaacgccaaacaatacgtcaatttccgaaaataaaacgcgcaatacgccgcaatcgcgcaatacctaaaaaaacacctataaattacgaataataaaaacgctttccgtctctttccatacccgttcaaacgtcaaatattccaattcacccgcataaatcatctcgcgcatcaacgccaaaatttcatcgacaatacgaaaaccgaaataaacataacgcgcaacaaaacgcgccacgcgcaatacgcgtaacgaatcttcgccaaaaacgaaaaaaacataacgcaacaaacgattttacaaatcgcccaaaccgttatacgaatcgataatctcgccgttatcgtcctaaaccaacgcattaataatcaaatcgcgacgcttaaaatcatcttccaacgtaacatccgatacgacataacaaataaaaccgatataaccgaaaccgaatttccgttcgatacgtaccaacgcatactcttcatacgtttacgaatacaaanacacaaaaaaatcgcgaccctactactaataaaccgcgtcgaacatcttctataacgtactaccgancacccacccatctctatcttaaacgataaacctcacatacattccgatacaaacctaccttaaaaact

SEQ ID NO: 22553 - DNA, 525 bp, Artificial Sequence
  chemically treated genomic DNA (Homo sapiens) CpG-island No: 22553
ggttacggcggcgtacgtggattagtaagagcgtagcgtcggttacgttcgcggttacgagtagttttagagtcggaggtaaaaggtagcgttgagggttttcgggtttgaggttcggcggggtcgcgggtaaggcgtttgcgtcgtcggggtgtattgggaatttatatcgcgtttttatgtagtcgggagcgtaagcgtagacgaggtcggagaagtgggcgtagtagcggtcgtcgtgagtataggggcgcgcggcgtacgggttcgcgcgttcgcggtagtcgcggtcgtcgaagtttagcgcgtaggagtagcggtgcgcgtcgtcgttttttatatacgtgtcgtcgttagcgtaggcgcggttcgcgtagtcgtttaggtcgtgttcgtagcgaggattcgcgaagtcggcgcggtagcggtagcgtagggcgtggtttaggtttaggtagagttcgtttgtggggaagggaatattagagggcgtagttcgggagtcggggatttatttgttcgcgt

SEQ ID NO: 22554 - DNA, 525 bp, Artificial Sequence
  chemically treated genomic DNA (Homo sapiens) CpG-island No: 22554
acgcgaacaaataaatccccgactcccgaactacgccctctaatattcccttccccacaaacgaactctacctaaacctaaaccacgccctacgctaccgctaccgcgccgacttcgcgaatcctcgctacgaacacgacctaaacgactacgcgaaccgcgcctacgctaacgacgacacgtatataaaaaacgacgacgcgcaccgctactcctacgcgctaaacttcgacgaccgcgactaccgcgaacgcgcgaacccgtacgccgcgcgcccctatactcacgacgaccgctactacgcccacttctccgacctcgtctacgcttacgctcccgactacataaaaacgcgatataaattcccaatacaccccgacgacgcaaacgccttacccgcgaccccgccgaacctcaaacccgaaaaccctcaacgctaccttttacctccgactctaaaactactcgtaaccgcgaacgtaaccgacgctacgctcttactaatccacgtacgccgccgtaacc

SEQ ID NO: 22555 - DNA, 525 bp, Artificial Sequence
  chemically treated genomic DNA (Homo sapiens) CpG-island No: 22555
gcgcgggtaggtgggttttcggttttcggattgcgttttttgatgtttttttttttataggcggattttgtttggatttgggttacgttttgcgttgtcgttgtcgcgtcggtttcgcgggttttcgttgcgagtacgatttggacgattgcgcgggtcgcgtttgcgttaacggcggtacgtgtgtggagggcggcggcgcgtatcgttgtttttgcgcgttgggtttcggcggtcgcgattgtcgcgagcgcgcggattcgtgcgtcgcgcgtttttgtgtttacggcggtcgttgttacgtttattttttcggtttcgtttgcgtttgcgttttcggttatatgggagcgcggtgtgagtttttagtgtatttcgacggcgtaagcgttttgttcgcggtttcgtcgggttttaggttcggggatttttagcgttattttttgttttcggttttgggattgttcgtggtcgcgggcgtggtcggcgttgcgtttttgttggtttacgtgcgtcgtcgtggtt

SEQ ID NO: 22556 - DNA, 525 bp, Artificial Sequence
  chemically treated genomic DNA (Homo sapiens) CpG-island No: 22556
aaccacgacgacgcacgtaaaccaacaaaaacgcaacgccgaccacgcccgcgaccacgaacaatcccaaaaccgaaaacaaaaaataacgctaaaaatccccgaacctaaaacccgacgaaaccgcgaacaaaacgcttacgccgtcgaaatacactaaaaactcacaccgcgctcccatataaccgaaaacgcaaacgcaaacgaaaccgaaaaaataaacgtaacaacgaccgccgtaaacacaaaaacgcgcgacgcacgaatccgcgcgctcgcgacaatcgcgaccgccgaaacccaacgcgcaaaaacaacgatacgcgccgccgccctccacacacgtaccgccgttaacgcaaacgcgacccgcgcaatcgtccaaatcgtactcgcaacgaaaacccgcgaaaccgacgcgacaacgacaacgcaaaacgtaacccaaatccaaacaaaatccgcctataaaaaaaaaaacatcaaaaaacgcaatccgaaaaccgaaaacccacctacccgcgc

SEQ ID NO: 22557 - DNA, 504 bp, Artificial Sequence
  chemically treated genomic DNA (Homo sapiens) CpG-island No: 22557
gggggtttggcgcggaggttaggttcgggacgttgttggggatgggttcgggtatagggttcggtattcgcgttatggatcgcgtagtttcggttattgggttttttcgagttttttgtattcgaatttcgtcgtcgattgtttttcgtagtacgtcgttgacgttattcgcggtgtttatttgtgggatattgttattttcggggagttcggatatttttaatagtttagtcggtttcgttatagttttagcgtttttacggagattggaataacggtattgtattgttgtatgcgagatttgcgtatgcgcgagttttagtgagcgcgtaaacgttgtgcgtgttagagtgtgcgtatgcgtaagtacggtggttaattttttagcgttttttagcggttttgagtagttattacgtttgtagtcgtttttggttttttgagcgtttgaggatttgcggattgcgcggtattttaaattataattattttagtattaatgta

SEQ ID NO: 22558 - DNA, 504 bp, Artificial Sequence
  chemically treated genomic DNA (Homo sapiens) CpG-island No: 22558
tacattaatactaaaataattataatttaaaataccgcgcaatccgcaaatcctcaaacgctcaaaaaaccaaaaacgactacaaacgtaataactactcaaaaccgctaaaaaacgctaaaaaattaaccaccgtacttacgcatacgcacactctaacacgcacaacgtttacgcgctcactaaaactcgcgcatacgcaaatctcgcatacaacaatacaataccgttattccaatctccgtaaaaacgctaaaactataacgaaaccgactaaactattaaaaatatccgaactccccgaaaataacaatatcccacaaataaacaccgcgaataacgtcaacgacgtactacgaaaaacaatcgacgacgaaattcgaatacaaaaaactcgaaaaaacccaataaccgaaactacgcgatccataacgcgaataccgaaccctatacccgaacccatccccaacaacgtcccgaacctaacctccgcgccaaaccccc

SEQ ID NO: 22559 - DNA, 504 bp, Artificial Sequence
  chemically treated genomic DNA (Homo sapiens) CpG-island No: 22559
tatattaatattgaagtggttgtaatttaagatatcgcgtagttcgtaggtttttaggcgtttagaggattagaggcggttatagacgtaatggttatttaggatcgttagggaacgttagaggattggttatcgtgtttacgtatgcgtatattttggtacgtatagcgtttacgcgtttattgagattcgcgtatgcgtaggtttcgtatatagtagtgtagtgtcgttattttagttttcgtagaaacgttgggattatggcggagtcgattgggttgttggagatgttcgagtttttcggagatagtagtgttttataggtgggtatcgcgagtggcgttagcgacgtattgcggggggtagtcggcggcggggttcgggtgtaggaggttcgggaaggtttagtggtcgaagttgcgcggtttatggcgcggatgtcgggttttgtgttcgggtttatttttagtagcgtttcgggtttggttttcgcgttagattttt

SEQ ID NO: 22560 - DNA, 504 bp, Artificial Sequence
  chemically treated genomic DNA (Homo sapiens) CpG-island No: 22560
aaaaatctaacgcgaaaaccaaacccgaaacgctactaaaaataaacccgaacacaaaacccgacatccgcgccataaaccgcgcaacttcgaccactaaaccttcccgaacctcctacacccgaaccccgccgccgactaccccccgcaatacgtcgctaacgccactcgcgatacccacctataaaacactactatctccgaaaaactcgaacatctccaacaacccaatcgactccgccataatcccaacgtttctacgaaaactaaaataacgacactacactactatatacgaaacctacgcatacgcgaatctcaataaacgcgtaaacgctatacgtaccaaaatatacgcatacgtaaacacgataaccaatcctctaacgttccctaacgatcctaaataaccattacgtctataaccgcctctaatcctctaaacgcctaaaaacctacgaactacgcgatatcttaaattacaaccacttcaatattaatata

SEQ ID NO: 22561 - DNA, 1175 bp, Artificial Sequence
  chemically treated genomic DNA (Homo sapiens) CpG-island No: 22561
  misc_feature (89)..(89): n is either a, c, g or t
  misc_feature (115)..(115): n is either a, c, g or t
  misc_feature (182)..(182): n is either a, c, g or t
  misc_feature (192)..(192): n is either a, c, g or t
  misc_feature (405)..(405): n is either a, c, g or t
  misc_feature (469)..(469): n is either a, c, g or t
  misc_feature (482)..(482): n is either a, c, g or t
  misc_feature (640)..(640): n is either a, c, g or t
  misc_feature (650)..(650): n is either a, c, g or t
  misc_feature (664)..(664): n is either a, c, g or t
  misc_feature (678)..(678): n is either a, c, g or t
  misc_feature (691)..(691): n is either a, c, g or t
  misc_feature (697)..(697): n is either a, c, g or t
  misc_feature (713)..(713): n is either a, c, g or t
  misc_feature (738)..(738): n is either a, c, g or t
  misc_feature (782)..(782): n is either a, c, g or t
  misc_feature (1115)..(1115): n is either a, c, g or t
tttcgatttcggcgggtttagcgttattcggtttttcggggtgtggaatattgagcgaggtaggtgcggcgggagtatgcgcgcggggncgggtagggggcggttttcgcgtttnttatttcgcgcgtgtattttcgcgtttttttcgtcgggtatcgcggggtagcggcgtcgtagtttgnggttggcggnaatttcgcgtttcgattcgtttttcgtttgtagttcggtcggcgttgcgggtaggcgtcgtttcgttgggggtaagaaggacgtcgtcgttcgcgtgggatggtcgcgagttcgcgtgggtgtttacggtcgtcgtcgcgcggggtggttttattttcgggtaggtagaggggtttgtacgattttcgcggcgagggtcgggtcggtgggggncggtggcggttggggatagtttcggtttcggtttaggttttttttttttttttttcgtcgtcgngggcgcgcgtcgnggtttttcgcgagaggcgttgttttatttgtcgtttattttggacgggcgcggtcgtcgtagagttcggcgtttcggttagtcgcgagggtagggtcggggtgttaggcgcggttatttgggcgttttggagttagcgtagtttgggatcgggggagncgggacgggnacgggatttttgangggtttttaggtangtttttcggttantcgagncgttcggcggtgggtnatttggtttttgttttttttggggnttaacgttttcgtttgttcgcgtgttttttttagtcgataagtngtcgtgtgttcggacgggcgagcgttgtttttttttattcgttttttgtttttgtttttttttgcgagttttgtttagtttcgggagcgggagtttagggagtgcgcgtagggcgggcgggcgtttggttagtttgggacggcggtttttaggtttttgttatcgtttggaattgcggggggcgcgtcggttatagtcgttttcgtttgtttttcgggtttttttgggttcgtttggttttaggtggacgcgagtcgagttgggtatatttgggttagcgtcgtatttatttgcgggattggtgagagcgttttcgcgaggtcgtaaattttngggtgggtattgttttttgtttttgattttttttagttattggttaaagtgcgaagtgtg

SEQ ID NO: 22562 - DNA, 1175 bp, Artificial Sequence
  chemically treated genomic DNA (Homo sapiens) CpG-island No: 22562
  misc_feature (61)..(61): n is either a, c, g or t
  misc_feature (394)..(394): n is either a, c, g or t
  misc_feature (438)..(438): n is either a, c, g or t
  misc_feature (463)..(463): n is either a, c, g or t
  misc_feature (479)..(479): n is either a, c, g or t
  misc_feature (485)..(485): n is either a, c, g or t
  misc_feature (498)..(498): n is either a, c, g or t
  misc_feature (512)..(512): n is either a, c, g or t
  misc_feature (526)..(526): n is either a, c, g or t
  misc_feature (536)..(536): n is either a, c, g or t
  misc_feature (694)..(694): n is either a, c, g or t
  misc_feature (707)..(707): n is either a, c, g or t
  misc_feature (771)..(771): n is either a, c, g or t
  misc_feature (984)..(984): n is either a, c, g or t
  misc_feature (994)..(994): n is either a, c, g or t
  misc_feature (1061)..(1061): n is either a, c, g or t
  misc_feature (1087)..(1087): n is either a, c, g or t
cacacttcgcactttaaccaataactaaaaaaaatcaaaaacaaaaaacaatacccacccnaaaatttacgacctcgcgaaaacgctctcaccaatcccgcaaataaatacgacgctaacccaaatatacccaactcgactcgcgtccacctaaaaccaaacgaacccaaaaaaacccgaaaaacaaacgaaaacgactataaccgacgcgccccccgcaattccaaacgataacaaaaacctaaaaaccgccgtcccaaactaaccaaacgcccgcccgccctacgcgcactccctaaactcccgctcccgaaactaaacaaaactcgcaaaaaaaaacaaaaacaaaaaacgaataaaaaaaaacaacgctcgcccgtccgaacacacgacnacttatcgactaaaaaaaacacgcgaacaaacgaaaacgttaanccccaaaaaaaacaaaaaccaaatnacccaccgccgaacgnctcgantaaccgaaaaacntacctaaaaacccntcaaaaatcccgtncccgtcccgnctcccccgatcccaaactacgctaactccaaaacgcccaaataaccgcgcctaacaccccgaccctaccctcgcgactaaccgaaacgccgaactctacgacgaccgcgcccgtccaaaataaacgacaaataaaacaacgcctctcgcgaaaaaccncgacgcgcgcccncgacgacgaaaaaaaaaaaaaaaaaacctaaaccgaaaccgaaactatccccaaccgccaccgncccccaccgacccgaccctcgccgcgaaaatcgtacaaacccctctacctacccgaaaataaaaccaccccgcgcgacgacgaccgtaaacacccacgcgaactcgcgaccatcccacgcgaacgacgacgtccttcttacccccaacgaaacgacgcctacccgcaacgccgaccgaactacaaacgaaaaacgaatcgaaacgcgaaattnccgccaaccncaaactacgacgccgctaccccgcgatacccgacgaaaaaaacgcgaaaatacacgcgcgaaataanaaacgcgaaaaccgccccctacccgnccccgcgcgcatactcccgccgcacctacctcgctcaatattccacaccccgaaaaaccgaataacgctaaacccgccgaaatcgaaa

SEQ ID NO: 22563 - DNA, 1175 bp, Artificial Sequence
  chemically treated genomic DNA (Homo sapiens) CpG-island No: 22563
  misc_feature (61)..(61): n is either a, c, g or t
  misc_feature (394)..(394): n is either a, c, g or t
  misc_feature (438)..(438): n is either a, c, g or t
  misc_feature (463)..(463): n is either a, c, g or t
  misc_feature (479)..(479): n is either a, c, g or t
  misc_feature (485)..(485): n is either a, c, g or t
  misc_feature (498)..(498): n is either a, c, g or t
  misc_feature (512)..(512): n is either a, c, g or t
  misc_feature (526)..(526): n is either a, c, g or t
  misc_feature (536)..(536): n is either a, c, g or t
  misc_feature (694)..(694): n is either a, c, g or t
  misc_feature (707)..(707): n is either a, c, g or t
  misc_feature (771)..(771): n is either a, c, g or t
  misc_feature (984)..(984): n is either a, c, g or t
  misc_feature (994)..(994): n is either a, c, g or t
  misc_feature (1061)..(1061): n is either a, c, g or t
  misc_feature (1087)..(1087): n is either a, c, g or t
tatatttcgtattttaattagtgattaagggagattaaaagtaggggataatatttatttnggaatttgcgatttcgcgaaaacgtttttattaatttcgtaggtaagtgcggcgttggtttaggtgtgtttagttcgattcgcgtttatttgggattaagcgggtttaagaaggttcggagagtaggcgagggcgattgtggtcggcgcgtttttcgtagttttaggcggtggtaggagtttgagagtcgtcgttttaggttggttaggcgttcgttcgttttgcgcgtattttttgggttttcgttttcgaggttgggtagaattcgtagaggaagataagggtagaaagcgggtggagggaggtagcgttcgttcgttcgggtatacgatnatttgtcggttgagggggatacgcgggtagacgggggcgttagnttttagaggaaataaaagttaaatngtttatcgtcgggcgnttcgantggtcggaggatntgtttgggggtttnttaggagtttcgtnttcgtttcgnttttttcggttttaggttgcgttggttttagggcgtttaggtagtcgcgtttggtatttcgattttgttttcgcggttgatcgaggcgtcgggttttgcggcggtcgcgttcgtttaaagtaggcgataagtgaggtagcgtttttcgcggggagttncggcgcgcgtttncggcggcgaaagagaaagagaaagagtttgggtcgggatcggggttatttttaatcgttatcgntttttatcggttcggttttcgtcgcgggagtcgtgtaggtttttttatttgttcggggatggggttatttcgcgcggcggcggtcgtgggtatttacgcgggttcgcgattattttacgcgggcggcggcgttttttttatttttagcggagcggcgtttgttcgtaacgtcgatcgagttataggcggggggcgagtcggagcgcgaggttntcgttagttntaggttgcggcgtcgttgtttcgcggtgttcggcgggaggggcgcgagggtgtacgcgcggggtggngggcgcgggagtcgttttttgttcgntttcgcgcgtatgttttcgtcgtatttgtttcgtttagtgttttatatttcggggagtcgggtggcgttgggttcgtcgaggtcgggg

SEQ ID NO: 22564 - DNA, 1175 bp, Artificial Sequence
  chemically treated genomic DNA (Homo sapiens) CpG-island No: 22564
  misc_feature (89)..(89): n is either a, c, g or t
  misc_feature (115)..(115): n is either a, c, g or t
  misc_feature (182)..(182): n is either a, c, g or t
  misc_feature (192)..(192): n is either a, c, g or t
  misc_feature (405)..(405): n is either a, c, g or t
  misc_feature (469)..(469): n is either a, c, g or t
  misc_feature (482)..(482): n is either a, c, g or t
  misc_feature (640)..(640): n is either a, c, g or t
  misc_feature (650)..(650): n is either a, c, g or t
  misc_feature (664)..(664): n is either a, c, g or t
  misc_feature (678)..(678): n is either a, c, g or t
  misc_feature (691)..(691): n is either a, c, g or t
  misc_feature (697)..(697): n is either a, c, g or t
  misc_feature (713)..(713): n is either a, c, g or t
  misc_feature (738)..(738): n is either a, c, g or t
  misc_feature (782)..(782): n is either a, c, g or t
  misc_feature (1115)..(1115): n is either a, c, g or t
ccccgacctcgacgaacccaacgccacccgactccccgaaatataaaacactaaacgaaacaaatacgacgaaaacatacgcgcgaaancgaacaaaaaacgactcccgcgcccnccaccccgcgcgtacaccctcgcgcccctcccgccgaacaccgcgaaacaacgacgccgcaacctanaactaacganaacctcgcgctccgactcgccccccgcctataactcgatcgacgttacgaacaaacgccgctccgctaaaaataaaaaaaacgccgccgcccgcgtaaaataatcgcgaacccgcgtaaatacccacgaccgccgccgcgcgaaataaccccatccccgaacaaataaaaaaacctacacgactcccgcgacgaaaaccgaaccgataaaaancgataacgattaaaaataaccccgatcccgacccaaactctttctctttctctttcgccgccgnaaacgcgcgccgnaactccccgcgaaaaacgctacctcacttatcgcctactttaaacgaacgcgaccgccgcaaaacccgacgcctcgatcaaccgcgaaaacaaaatcgaaataccaaacgcgactacctaaacgccctaaaaccaacgcaacctaaaaccgaaaaaancgaaacgaanacgaaactcctaanaaacccccaaacanatcctccgaccantcgaancgcccgacgataaacnatttaacttttatttcctctaaaanctaacgcccccgtctacccgcgtatccccctcaaccgacaaatnatcgtatacccgaacgaacgaacgctacctccctccacccgctttctacccttatcttcctctacgaattctacccaacctcgaaaacgaaaacccaaaaaatacgcgcaaaacgaacgaacgcctaaccaacctaaaacgacgactctcaaactcctaccaccgcctaaaactacgaaaaacgcgccgaccacaatcgccctcgcctactctccgaaccttcttaaacccgcttaatcccaaataaacgcgaatcgaactaaacacacctaaaccaacgccgcacttacctacgaaattaataaaaacgttttcgcgaaatcgcaaattccnaaataaatattatcccctacttttaatctcccttaatcactaattaaaatacgaaatata

SEQ ID NO: 22565 - DNA, 588 bp, Artificial Sequence
  chemically treated genomic DNA (Homo sapiens) CpG-island No: 22565
gagagagggtacgaatttcgggcgtcgttcggggttcgggtttggatttcgcggacgtcgggacgaggggcggggcggggtggtagtttgtaggttttttagcgttcgttcgtttaggagaagttttagcgtcgtttttcgtcgtaggttgggggttaggggagggttcgaatatcggttttgtttttgttattttagcgggtatttggcgtttcggcgcggtagtttgcgaggttagggtcgagcgcgcggagtcgaatgttgggttcggggattcgcggtcgtcgtttttaattcgtttttaagtagttttcgtttgcgttacgttaggtcggcggaggggagtagagcgcgtcgtgcggttgtcgttgcgcgtcggagttcgaggggtcggggacgcgcgcggggggagaggggtaagagttttggaggttcggcggggagcggggcgatttcgaaaggaaggattgtagcgtttttcggggtttttcggggagtttaggtaattttatttgatcgttagatttaagtaggcggagggggagtcgggagcggacgcgtgggtgagtggggaggggagtgagtagg

SEQ ID NO: 22566 - DNA, 588 bp, Artificial Sequence
  chemically treated genomic DNA (Homo sapiens) CpG-island No: 22566
cctactcactcccctccccactcacccacgcgtccgctcccgactccccctccgcctacttaaatctaacgatcaaataaaattacctaaactccccgaaaaaccccgaaaaacgctacaatccttcctttcgaaatcgccccgctccccgccgaacctccaaaactcttacccctctccccccgcgcgcgtccccgacccctcgaactccgacgcgcaacgacaaccgcacgacgcgctctactcccctccgccgacctaacgtaacgcaaacgaaaactacttaaaaacgaattaaaaacgacgaccgcgaatccccgaacccaacattcgactccgcgcgctcgaccctaacctcgcaaactaccgcgccgaaacgccaaatacccgctaaaataacaaaaacaaaaccgatattcgaaccctcccctaacccccaacctacgacgaaaaacgacgctaaaacttctcctaaacgaacgaacgctaaaaaacctacaaactaccaccccgccccgcccctcgtcccgacgtccgcgaaatccaaacccgaaccccgaacgacgcccgaaattcgtaccctctctc

SEQ ID NO: 22567 - DNA, 588 bp, Artificial Sequence
  chemically treated genomic DNA (Homo sapiens) CpG-island No: 22567
tttatttatttttttttttatttatttacgcgttcgttttcggtttttttttcgtttgtttgggtttggcggttaggtgaggttatttgggtttttcgagaagtttcgaggggcgttgtagttttttttttcgaaatcgtttcgtttttcgtcgggtttttaggatttttgttttttttttttcgcgcgcgttttcggtttttcgggtttcgacgcgtagcgatagtcgtacggcgcgttttgttttttttcgtcgatttggcgtgacgtaggcggagattatttaagggcggattagaggcggcggtcgcggattttcgagtttagtattcggtttcgcgcgttcggttttggtttcgtaggttgtcgcgtcggagcgttaggtgttcgttgaagtagtaggaatagagtcggtgttcggatttttttttggtttttaatttgcggcggagagcggcgttgagattttttttgggcgggcgagcgttggaggatttgtaggttgttatttcgtttcgtttttcgtttcggcgttcgcgggatttagattcgaatttcggacggcgttcgaggttcgtgttttttttt

SEQ ID NO: 22568 - DNA, 588 bp, Artificial Sequence
  chemically treated genomic DNA (Homo sapiens) CpG-island No: 22568
aaaaaaaaacacgaacctcgaacgccgtccgaaattcgaatctaaatcccgcgaacgccgaaacgaaaaacgaaacgaaataacaacctacaaatcctccaacgctcgcccgcccaaaaaaaatctcaacgccgctctccgccgcaaattaaaaaccaaaaaaaaatccgaacaccgactctattcctactacttcaacgaacacctaacgctccgacgcgacaacctacgaaaccaaaaccgaacgcgcgaaaccgaatactaaactcgaaaatccgcgaccgccgcctctaatccgcccttaaataatctccgcctacgtcacgccaaatcgacgaaaaaaaacaaaacgcgccgtacgactatcgctacgcgtcgaaacccgaaaaaccgaaaacgcgcgcgaaaaaaaaaaaacaaaaatcctaaaaacccgacgaaaaacgaaacgatttcgaaaaaaaaaactacaacgcccctcgaaacttctcgaaaaacccaaataacctcacctaaccgccaaacccaaacaaacgaaaaaaaaaccgaaaacgaacgcgtaaataaataaaaaaaaaaataaataaa

SEQ ID NO: 22569 - DNA, 542 bp, Artificial Sequence
  chemically treated genomic DNA (Homo sapiens) CpG-island No: 22569
atttagcgattgttttgtcgtcgtcgttttcgcgtcgggacgagtgcgtttaggggttgggcgaggcggtcgcgttttggattcgttataaggaggaggattagattttgggtttcggtgttcgtttgcgtttagacgtatttattcgttggtcgcggtatcgtttcgcgtcgtattcggttttttgttatcggtttttcgtcgtttcgtgtatgaggttttcgttatttcgtttcgatcgtcgatttttttttttttttttttttttttttgttttttattcgtttttcgtttgtttttttgtttttttcgtagtttcgtcgtcgttgggtcgtcgtgtttatagcgattgattgattgatgtttaattttttgttaggcggggttttttttttataagcgttaatttaagggttgaattatttgaagaatgcgacgtttcggtgtttcgttaagacgatgtttcgcgttttttaattgcgttttgtaggttgttagggatattgttttacgaatggttatttgtaagttttagatgatta

SEQ ID NO: 22570 - DNA, 542 bp, Artificial Sequence
  chemically treated genomic DNA (Homo sapiens) CpG-island No: 22570
taatcatctaaaacttacaaataaccattcgtaaaacaatatccctaacaacctacaaaacgcaattaaaaaacgcgaaacatcgtcttaacgaaacaccgaaacgtcgcattcttcaaataattcaacccttaaattaacgcttataaaaaaaaaaccccgcctaacaaaaaattaaacatcaatcaatcaatcgctataaacacgacgacccaacgacgacgaaactacgaaaaaaacaaaaaaacaaacgaaaaacgaataaaaaacaaaaaaaaaaaaaaaaaaaaaaaaaaatcgacgatcgaaacgaaataacgaaaacctcatacacgaaacgacgaaaaaccgataacaaaaaaccgaatacgacgcgaaacgataccgcgaccaacgaataaatacgtctaaacgcaaacgaacaccgaaacccaaaatctaatcctcctccttataacgaatccaaaacgcgaccgcctcgcccaacccctaaacgcactcgtcccgacgcgaaaacgacgacgacaaaacaatcgctaaat

SEQ ID NO: 22571 - DNA, 542 bp, Artificial Sequence
  chemically treated genomic DNA (Homo sapiens) CpG-island No: 22571
tggttatttggagtttataggtggttattcgtgggatagtatttttgatagtttataaaacgtaattgaagaacgcgaggtatcgttttaacgaggtatcgaggcgtcgtattttttagatggtttaatttttaagttagcgtttatgggaggggggtttcgtttggtaggaaattaaatattaattaattaatcgttgtgagtacggcgatttaacggcggcggggttgcgaaggaggtagagggataggcgaggggcgggtgggaggtagggaggagggaagaggaaggggagagtcggcggtcggagcggggtgacgaggattttatgtacgaggcggcgaaggatcgatggtagagaatcgagtgcggcgcgaggcggtgtcgcggttagcgggtgggtgcgtttgggcgtaggcgggtatcggggtttagggtttggtttttttttttgtggcgggtttagagcgcggtcgtttcgtttagtttttaggcgtattcgtttcggcgcggaggcggcggcgataaggtagtcgttgggt

SEQ ID NO: 22572 - DNA, 542 bp, Artificial Sequence
  chemically treated genomic DNA (Homo sapiens) CpG-island No: 22572
acccaacgactaccttatcgccgccgcctccgcgccgaaacgaatacgcctaaaaactaaacgaaacgaccgcgctctaaacccgccacaaaaaaaaaaaccaaaccctaaaccccgatacccgcctacgcccaaacgcacccacccgctaaccgcgacaccgcctcgcgccgcactcgattctctaccatcgatccttcgccgcctcgtacataaaatcctcgtcaccccgctccgaccgccgactctccccttcctcttccctcctccctacctcccacccgcccctcgcctatccctctacctccttcgcaaccccgccgccgttaaatcgccgtactcacaacgattaattaattaatatttaatttcctaccaaacgaaacccccctcccataaacgctaacttaaaaattaaaccatctaaaaaatacgacgcctcgatacctcgttaaaacgatacctcgcgttcttcaattacgttttataaactatcaaaaatactatcccacgaataaccacctataaactccaaataacca

SEQ ID NO: 22573 - DNA, 521 bp, Artificial Sequence
  chemically treated genomic DNA (Homo sapiens) CpG-island No: 22573
tgggttcggttttatcgatttcgcgtagttgtttattgtgggtgtttttgattcggacgtagttcgtggtggggcggttttattttacgtttcgtttggttacgtcgcgtttatttttagggcgcgttttttaggcgttatagtgggtttggcgttcgtcgagggtatgtgtcgcgtcgagagttcgggaggcgtgagtacggtgatgacgcgggcgggggcgagggagagataggaggttttacggtcgtagtgatcgtttttttacggttttttaggattattcggagttttttatcggcgtcgtagttattatggtttatgagatcggttatagtttcggttttagttacgatttcgacggttgttgcgtggaggttgcggtcgagttcggaggttgcgttatggttgcggttatcgggtacgcgggtggggggtcggggttgcggcggggcggttagttttggggatttttttcgttgcgtttttttggtcgttttttagtttttttttttgtaaaa

SEQ ID NO: 22574 - DNA, 521 bp, Artificial Sequence
  chemically treated genomic DNA (Homo sapiens) CpG-island No: 22574
ttttacaaaaaaaaaaactaaaaaacgaccaaaaaaacgcaacgaaaaaaatccccaaaactaaccgccccgccgcaaccccgaccccccacccgcgtacccgataaccgcaaccataacgcaacctccgaactcgaccgcaacctccacgcaacaaccgtcgaaatcgtaactaaaaccgaaactataaccgatctcataaaccataataactacgacgccgataaaaaactccgaataatcctaaaaaaccgtaaaaaaacgatcactacgaccgtaaaacctcctatctctccctcgcccccgcccgcgtcatcaccgtactcacgcctcccgaactctcgacgcgacacataccctcgacgaacgccaaacccactataacgcctaaaaaacgcgccctaaaaataaacgcgacgtaaccaaacgaaacgtaaaataaaaccgccccaccacgaactacgtccgaatcaaaaacacccacaataaacaactacgcgaaatcgataaaaccgaaccca

SEQ ID NO: 22575 - DNA, 521 bp, Artificial Sequence
  chemically treated genomic DNA (Homo sapiens) CpG-island No: 22575
ttttatagaagaggaaattgagggacgattaaagaaacgtagcggaggaagtttttaggattagtcgtttcgtcgtagtttcgattttttattcgcgtattcggtggtcgtagttatgacgtagttttcggattcggtcgtagtttttacgtagtagtcgtcggggtcgtggttgaggtcgaggttgtggtcgattttatgggttatggtggttgcggcgtcgatggggagtttcgagtggttttggggggtcgtgggagggcggttattgcggtcgtagagttttttgtttttttttcgttttcgttcgcgttattatcgtgtttacgtttttcgagttttcggcgcggtatatgttttcgacgggcgttaggtttattgtggcgtttggaaagcgcgttttgggggtgagcgcggcgtgattaggcggggcgtgaggtgaggtcgttttattacgggttgcgttcgggttagaggtatttatagtgagtagttgcgcggagtcgatggggtcgggttta

SEQ ID NO: 22576 - DNA, 521 bp, Artificial Sequence
  chemically treated genomic DNA (Homo sapiens) CpG-island No: 22576
taaacccgaccccatcgactccgcgcaactactcactataaatacctctaacccgaacgcaacccgtaataaaacgacctcacctcacgccccgcctaatcacgccgcgctcacccccaaaacgcgctttccaaacgccacaataaacctaacgcccgtcgaaaacatataccgcgccgaaaactcgaaaaacgtaaacacgataataacgcgaacgaaaacgaaaaaaaaacaaaaaactctacgaccgcaataaccgccctcccacgaccccccaaaaccactcgaaactccccatcgacgccgcaaccaccataacccataaaatcgaccacaacctcgacctcaaccacgaccccgacgactactacgtaaaaactacgaccgaatccgaaaactacgtcataactacgaccaccgaatacgcgaataaaaaatcgaaactacgacgaaacgactaatcctaaaaacttcctccgctacgtttctttaatcgtccctcaatttcctcttctataaaa

SEQ ID NO: 22577 - DNA, 737 bp, Artificial Sequence
  chemically treated genomic DNA (Homo sapiens) CpG-island No: 22577
ttcgcgtcgttgtcgggtttcggaggtcgtagtacgggtaggtttagtaggtcgtagcgttttttcgcggtatgtttcggcggcgggaagggggtgggcgcggagggcggggaggaggcgtcggggttttcgcgtttttcgcgagatttcgtttcgttcgtttcgtttcgttcgtcgcgtttttagtttttcgcgcgcgtattttttgtttttcgcgttcggtcgttcgttttcgtttgcgttcgtcgttgtcgttcgtcgtcggatcgcgttcgtcgcgttttcggaggtgttttcggtcgggtgcgttcgtttcgtcgtcggttcggagtcgttttgtttcgggcgggggcgcggatgtaggtcgttaggtgtttttcgttacggttcgggttttcgtttcggcgcggcggcggtcgtttcgagatatagggtattatatagaacggtcgtattacgttgatcggtttttcgcggtagaaagttacgggattatttagggaggtgtaggagaattcgtatttgcgtaagggtaagatttatcggcgtttaatattcggtcgtttacgttgagtacgattttgaagaataagcgcgttattttgggtcgggagtttaattacgcggatcgtttttatttgtcggtaagattaataagttgtttttttacgataatttcgagggtttgattattgtatgtttttaaaaaattcgattacgcggatgtagtttaaagg

SEQ ID NO: 22578 - DNA, 737 bp, Artificial Sequence
  chemically treated genomic DNA (Homo sapiens) CpG-island No: 22578
cctttaaactacatccgcgtaatcgaattttttaaaaacatacaataatcaaaccctcgaaattatcgtaaaaaaacaacttattaatcttaccgacaaataaaaacgatccgcgtaattaaactcccgacccaaaataacgcgcttattcttcaaaatcgtactcaacgtaaacgaccgaatattaaacgccgataaatcttacccttacgcaaatacgaattctcctacacctccctaaataatcccgtaactttctaccgcgaaaaaccgatcaacgtaatacgaccgttctatataataccctatatctcgaaacgaccgccgccgcgccgaaacgaaaacccgaaccgtaacgaaaaacacctaacgacctacatccgcgcccccgcccgaaacaaaacgactccgaaccgacgacgaaacgaacgcacccgaccgaaaacacctccgaaaacgcgacgaacgcgatccgacgacgaacgacaacgacgaacgcaaacgaaaacgaacgaccgaacgcgaaaaacaaaaaatacgcgcgcgaaaaactaaaaacgcgacgaacgaaacgaaacgaacgaaacgaaatctcgcgaaaaacgcgaaaaccccgacgcctcctccccgccctccgcgcccacccccttcccgccgccgaaacataccgcgaaaaaacgctacgacctactaaacctacccgtactacgacctccgaaacccgacaacgacgcgaa

SEQ ID NO: 22579 - DNA, 737 bp, Artificial Sequence
  chemically treated genomic DNA (Homo sapiens) CpG-island No: 22579
tttttggattatattcgcgtggtcgaattttttgaaggtatgtaatgattaagttttcgaggttgtcgtagggagatagtttattggttttgtcggtaggtggaggcgattcgcgtagttgggttttcgatttaggatggcgcgtttgttttttaggatcgtgtttagcgtggacggtcggatgttgaacgtcggtggattttgtttttgcgtaggtgcggatttttttatatttttttggatgatttcgtgattttttgtcgcgagaaatcggttaacgtggtacgatcgttttatgtggtgttttatatttcggggcggtcgtcgtcgcgtcggggcgggggttcgggtcgtggcggggggtatttggcggtttatattcgcgttttcgttcgagataaagcggtttcgggtcggcggcggggcgaacgtattcggtcgggggtattttcggggacgcggcgggcgcgattcggcggcgggcggtagcgacgggcgtagacgagggcgggcggtcgggcgcggaaggtaggaagtgcgcgcgcggggagttgggagcgcggcgagcggggcggagcgggcggagcgggatttcgcgggaagcgcggggatttcggcgtttttttttcgtttttcgcgtttatttttttttcgtcgtcgggatatatcgcgggggggcgttgcggtttgttggatttgttcgtgttgcggttttcgggattcggtagcgacgcggg

SEQ ID NO: 22580 - DNA, 737 bp, Artificial Sequence
  chemically treated genomic DNA (Homo sapiens) CpG-island No: 22580
cccgcgtcgctaccgaatcccgaaaaccgcaacacgaacaaatccaacaaaccgcaacgcccccccgcgatatatcccgacgacgaaaaaaaaataaacgcgaaaaacgaaaaaaaaacgccgaaatccccgcgcttcccgcgaaatcccgctccgcccgctccgccccgctcgccgcgctcccaactccccgcgcgcgcacttcctaccttccgcgcccgaccgcccgccctcgtctacgcccgtcgctaccgcccgccgccgaatcgcgcccgccgcgtccccgaaaatacccccgaccgaatacgttcgccccgccgccgacccgaaaccgctttatctcgaacgaaaacgcgaatataaaccgccaaataccccccgccacgacccgaacccccgccccgacgcgacgacgaccgccccgaaatataaaacaccacataaaacgatcgtaccacgttaaccgatttctcgcgacaaaaaatcacgaaatcatccaaaaaaatataaaaaaatccgcacctacgcaaaaacaaaatccaccgacgttcaacatccgaccgtccacgctaaacacgatcctaaaaaacaaacgcgccatcctaaatcgaaaacccaactacgcgaatcgcctccacctaccgacaaaaccaataaactatctccctacgacaacctcgaaaacttaatcattacataccttcaaaaaattcgaccacgcgaatataatccaaaaa

SEQ ID NO: 22581 - DNA, 780 bp, Artificial Sequence
  chemically treated genomic DNA (Homo sapiens) CpG-island No: 22581
tttacgtcggttttcgttggtttcgtagtcgtattagggcgttacgcgcgtttacgttgtttacgtagttaggggtgacggcggtgttgcggggattttgagggcgaagttatcggtttattcggcggagatattttttggagaattttcgttttcgttcggatttcggtcgcgcgtatttacgaggttcgcgtagggcgtaggtagcgggcgtttttggtttagtaggtagtcgtcgggggcgttgggcgttggggtgtacgagatttgaaaggttaggaggcgaggttgcgcggcgggagggcggtgagtcggagagaggtttcgtttttattttcgttagcggtcgcgtcgtcggggattttgtagtttcgtcgttcgtagaagtttaagggtttaaggtaggagggcgggcggtcgggtttcgaaaaggcgtaggagggtacgaagggtgtttcgacgttcggcgtagtcgggcggcgtacgggtagaagagtagtgcgtgggtgagcgcgggcgttcgcgggcgaagaagcggcgtagggttcggcggtagcgggcgcgggatagtttttttgcgtagttcggtttaggtattgcgttatatattcggagcgtaaacgttggtatcgcgcgttcgtcgtgtaggtttcggtcgcgtttatatatcggtttttttcgatcgagttcgtcgattttgggaaaggcgcggggaggttgtaggttttagtgcgtttcgtatgtatattttatttagtttatttacgtttttggaaggtg

SEQ ID NO: 22582 - DNA, 780 bp, Artificial Sequence
  chemically treated genomic DNA (Homo sapiens) CpG-island No: 22582
caccttccaaaaacgtaaataaactaaataaaatatacatacgaaacgcactaaaacctacaacctccccgcgcctttcccaaaatcgacgaactcgatcgaaaaaaaccgatatataaacgcgaccgaaacctacacgacgaacgcgcgataccaacgtttacgctccgaatatataacgcaatacctaaaccgaactacgcaaaaaaactatcccgcgcccgctaccgccgaaccctacgccgcttcttcgcccgcgaacgcccgcgctcacccacgcactactcttctacccgtacgccgcccgactacgccgaacgtcgaaacacccttcgtaccctcctacgccttttcgaaacccgaccgcccgccctcctaccttaaacccttaaacttctacgaacgacgaaactacaaaatccccgacgacgcgaccgctaacgaaaataaaaacgaaacctctctccgactcaccgccctcccgccgcgcaacctcgcctcctaacctttcaaatctcgtacaccccaacgcccaacgcccccgacgactacctactaaaccaaaaacgcccgctacctacgccctacgcgaacctcgtaaatacgcgcgaccgaaatccgaacgaaaacgaaaattctccaaaaaatatctccgccgaataaaccgataacttcgccctcaaaatccccgcaacaccgccgtcacccctaactacgtaaacaacgtaaacgcgcgtaacgccctaatacgactacgaaaccaacgaaaaccgacgtaaa

SEQ ID NO: 22583 - DNA, 780 bp, Artificial Sequence
  chemically treated genomic DNA (Homo sapiens) CpG-island No: 22583
tattttttaggggcgtggatgggttgggtgaagtgtgtatgcggggcgtattgagatttgtagttttttcgcgttttttttagggtcggcgagttcggtcggagggaatcgatgtgtggacgcggtcgaagtttgtacggcggacgcgcggtgttagcgtttgcgtttcgagtatgtggcgtagtgtttgggtcgggttgcgtaggggggttgtttcgcgttcgttgtcgtcgggttttgcgtcgttttttcgttcgcgggcgttcgcgtttatttacgtattgtttttttgttcgtgcgtcgttcggttgcgtcgagcgtcggagtatttttcgtgtttttttgcgttttttcggggttcggtcgttcgtttttttgttttgagtttttaaatttttgcgagcgacggaattgtaggattttcggcggcgcggtcgttggcgagggtggggacggggttttttttcggtttatcgttttttcgtcgcgtagtttcgttttttggttttttaggtttcgtgtattttagcgtttagcgttttcgacggttgtttgttggattagaggcgttcgttgtttgcgttttacgcgggtttcgtgggtacgcgcggtcgggattcgggcgagggcgggggttttttaggggatattttcgtcgggtgggtcgatgatttcgtttttagggttttcgtagtatcgtcgttatttttaattacgtggataacgtgagcgcgcgtggcgttttggtgcgattgcggagttagcgggaatcggcgtgag

SEQ ID NO: 22584 - DNA, 780 bp, Artificial Sequence
  chemically treated genomic DNA (Homo sapiens) CpG-island No: 22584
ctcacgccgattcccgctaactccgcaatcgcaccaaaacgccacgcgcgctcacgttatccacgtaattaaaaataacgacgatactacgaaaaccctaaaaacgaaatcatcgacccacccgacgaaaatatcccctaaaaaacccccgccctcgcccgaatcccgaccgcgcgtacccacgaaacccgcgtaaaacgcaaacaacgaacgcctctaatccaacaaacaaccgtcgaaaacgctaaacgctaaaatacacgaaacctaaaaaaccaaaaaacgaaactacgcgacgaaaaaacgataaaccgaaaaaaaaccccgtccccaccctcgccaacgaccgcgccgccgaaaatcctacaattccgtcgctcgcaaaaatttaaaaactcaaaacaaaaaaacgaacgaccgaaccccgaaaaaacgcaaaaaaacacgaaaaatactccgacgctcgacgcaaccgaacgacgcacgaacaaaaaaacaatacgtaaataaacgcgaacgcccgcgaacgaaaaaacgacgcaaaacccgacgacaacgaacgcgaaacaacccccctacgcaacccgacccaaacactacgccacatactcgaaacgcaaacgctaacaccgcgcgtccgccgtacaaacttcgaccgcgtccacacatcgattccctccgaccgaactcgccgaccctaaaaaaaacgcgaaaaaactacaaatctcaatacgccccgcatacacacttcacccaacccatccacgcccctaaaaaata

SEQ ID NO: 22585 - DNA, 757 bp, Artificial Sequence
  chemically treated genomic DNA (Homo sapiens) CpG-island No: 22585
gtttcgtcgagttagcggtgttgtagtacgcggtgtaggcggcgttgggcgttcgcggtttgcgtgtcgtggtttcgtacgacgtgggttttattatttttaaaggcgcggtgttgttcggttaggcgtcgggcgtggtgcgggttcgtcgttcgtcgtttatttatggcgtgggcgtgtttaatcgttttgtgtttgggcgttattcgttcgaaaagttgttggttcgcgacggtcgtcgttggtgtatcgacgttttcgagcgtttcgtggtcgtcgagtagtcggtggttttgggcgaggaggtgcggcgtattattgttcggcgcgtttcggttagcggcgcgtatttattaatttgtattgttgcgcggtagaggatgcgcgttttattatcgatttcggcgtgcgtaaatgtggcgcgtttagtttcgagtttgagttcgtcgattgcgttaggatatcgtcggcgcgtttttcggtcgtcgcgagattcgcgtcgttatgtagtttggcgatatcgaaattaaggttatcgtcgtcgacgttagtattaatcgtttcgtgcgcgcgtttatcgattttttttttaattgagggcgcgcgcgcgtgttaggttcgtttgttcggtttcgttttttttcggtttaggggtttgcggagcgggttggggcgggggaaacgatagttttgtagtttgcgtttttttacgttttttagtttcgggggagataaggttatgggagagtgggtgggg

SEQ ID NO: 22586 - DNA, 757 bp, Artificial Sequence
  chemically treated genomic DNA (Homo sapiens) CpG-island No: 22586
ccccacccactctcccataaccttatctcccccgaaactaaaaaacgtaaaaaaacgcaaactacaaaactatcgtttcccccgccccaacccgctccgcaaacccctaaaccgaaaaaaaacgaaaccgaacaaacgaacctaacacgcgcgcgcgccctcaattaaaaaaaaaatcgataaacgcgcgcacgaaacgattaatactaacgtcgacgacgataaccttaatttcgatatcgccaaactacataacgacgcgaatctcgcgacgaccgaaaaacgcgccgacgatatcctaacgcaatcgacgaactcaaactcgaaactaaacgcgccacatttacgcacgccgaaatcgataataaaacgcgcatcctctaccgcgcaacaatacaaattaataaatacgcgccgctaaccgaaacgcgccgaacaataatacgccgcacctcctcgcccaaaaccaccgactactcgacgaccacgaaacgctcgaaaacgtcgatacaccaacgacgaccgtcgcgaaccaacaacttttcgaacgaataacgcccaaacacaaaacgattaaacacgcccacgccataaataaacgacgaacgacgaacccgcaccacgcccgacgcctaaccgaacaacaccgcgcctttaaaaataataaaacccacgtcgtacgaaaccacgacacgcaaaccgcgaacgcccaacgccgcctacaccgcgtactacaacaccgctaactcgacgaaac

SEQ ID NO: 22587 - DNA, 757 bp, Artificial Sequence
  chemically treated genomic DNA (Homo sapiens) CpG-island No: 22587
ttttatttatttttttatgattttatttttttcggggttggagggcgtggaaaggcgtagattgtagaattatcgtttttttcgttttaattcgtttcgtaggtttttgaatcgaaagagggcggggtcgggtagacgggtttggtacgcgcgcgcgtttttagttggaaagaaagtcgatggacgcgcgtacggagcgattggtgttgacgtcgacggcggtgattttaatttcggtgtcgttaaattgtatggcggcgcggatttcgcggcggtcgggaggcgcgtcggcggtgttttggcgtagtcggcgggtttaagttcgaggttgagcgcgttatatttgcgtacgtcggggtcggtgatgaagcgcgtattttttgtcgcgtagtagtataggttgatgagtacgcgtcgttggtcgggacgcgtcgggtagtagtgcgtcgtattttttcgtttagggttatcgattgttcggcggttacgaagcgttcgaagacgtcggtgtattagcggcggtcgtcgcgaattagtagtttttcgggcgggtggcgtttaggtataaagcggttgagtacgtttacgttataggtgagcggcgagcggcggattcgtattacgttcggcgtttggtcgaatagtatcgcgtttttgaggatggtgaggtttacgtcgtgcgggattacgatacgtagatcgcgggcgtttagcgtcgtttgtatcgcgtgttgtagtatcgttgattcggcgaagt

SEQ ID NO: 22588 - DNA, 757 bp, Artificial Sequence
  chemically treated genomic DNA (Homo sapiens) CpG-island No: 22588
acttcgccgaatcaacgatactacaacacgcgatacaaacgacgctaaacgcccgcgatctacgtatcgtaatcccgcacgacgtaaacctcaccatcctcaaaaacgcgatactattcgaccaaacgccgaacgtaatacgaatccgccgctcgccgctcacctataacgtaaacgtactcaaccgctttatacctaaacgccacccgcccgaaaaactactaattcgcgacgaccgccgctaatacaccgacgtcttcgaacgcttcgtaaccgccgaacaatcgataaccctaaacgaaaaaatacgacgcactactacccgacgcgtcccgaccaacgacgcgtactcatcaacctatactactacgcgacaaaaaatacgcgcttcatcaccgaccccgacgtacgcaaatataacgcgctcaacctcgaacttaaacccgccgactacgccaaaacaccgccgacgcgcctcccgaccgccgcgaaatccgcgccgccatacaatttaacgacaccgaaattaaaatcaccgccgtcgacgtcaacaccaatcgctccgtacgcgcgtccatcgactttctttccaactaaaaacgcgcgcgcgtaccaaacccgtctacccgaccccgccctctttcgattcaaaaacctacgaaacgaattaaaacgaaaaaaacgataattctacaatctacgcctttccacgccctccaaccccgaaaaaaataaaatcataaaaaaataaataaaa

SEQ ID NO: 22589 - DNA, 640 bp, Artificial Sequence
  chemically treated genomic DNA (Homo sapiens) CpG-island No: 22589
ttcgttttcgtttcgttttcggagtcgtagtttcgttcgttatcgtcgtcgttatgttgtggttttcgtagtcggcgttggggacgcgcgcggtcgagattttggtttgtagtcgtcgtcgtcgtcgttaggtaagcgtttttcgcgggtcgggtcgagcggggtttgcgggtcggggtagttttattttgggttcgggaggatcgtagtcgggatcgagttcgagttcgagtcggggttcggttttgtagtttggcggattttggtcgtcgttagaggcggtagttatttttttcgatcgtcgtttggcgggttcgggtcgttattttatttcgttttcggtcgtcgggcgtcggtttttttcgtcgttgcgatcgtcgttgcgatcgtcgttttttggtaggtcgggtacgttgttgtttttcgcgttgggcgggacgtgcggtcgttttcggcgatagtcggcggtttttagttcgggtacggataacggtgttattttttttttttgggacggtttgttagttcgatcgttttcgtcgttcgaagagttgtcgtcgttatagggtagatatttcggggaacgattttttttggcgttttttagtattttttttttttgagtttaagttttgatttt

SEQ ID NO: 22590 - DNA, 640 bp, Artificial Sequence
  chemically treated genomic DNA (Homo sapiens) CpG-island No: 22590
aaaatcaaaacttaaactcaaaaaaaaaaaatactaaaaaacgccaaaaaaaatcgttccccgaaatatctaccctataacgacgacaactcttcgaacgacgaaaacgatcgaactaacaaaccgtcccaaaaaaaaaaaataacaccgttatccgtacccgaactaaaaaccgccgactatcgccgaaaacgaccgcacgtcccgcccaacgcgaaaaacaacaacgtacccgacctaccaaaaaacgacgatcgcaacgacgatcgcaacgacgaaaaaaaccgacgcccgacgaccgaaaacgaaataaaataacgacccgaacccgccaaacgacgatcgaaaaaaataactaccgcctctaacgacgaccaaaatccgccaaactacaaaaccgaaccccgactcgaactcgaactcgatcccgactacgatcctcccgaacccaaaataaaactaccccgacccgcaaaccccgctcgacccgacccgcgaaaaacgcttacctaacgacgacgacgacgactacaaaccaaaatctcgaccgcgcgcgtccccaacgccgactacgaaaaccacaacataacgacgacgataacgaacgaaactacgactccgaaaacgaaacgaaaacgaa

SEQ ID NO: 22591 - DNA, 640 bp, Artificial Sequence
  chemically treated genomic DNA (Homo sapiens) CpG-island No: 22591
agggttagaatttgggtttaggggaggggagtattgaggagcgttaaagagggtcgtttttcgaagtgtttgttttgtgacggcgatagtttttcgggcggcggggacggtcgggttgataggtcgttttagagggagaaagtggtatcgttattcgtgttcgggttgggggtcgtcggttatcgtcgagggcggtcgtacgtttcgtttagcgcggaggatagtagcgtgttcggtttgttaaggagcggcggtcgtagcggcggtcgtagcggcggaaggggtcggcgttcgacggtcgggggcggggtggggtggcggttcgggttcgttaggcggcggtcgggggaagtggttgtcgtttttggcggcggttagggttcgttaggttgtagggtcgggtttcggttcgggttcggattcggtttcggttgcgattttttcgggtttaggatggggttgtttcggttcgtaggtttcgttcggttcggttcgcggggggcgtttatttggcggcggcggcggcgattgtaggttagagtttcggtcgcgcgcgtttttagcgtcggttgcgggagttataatatggcgacggcgatggcgggcggggttgcggtttcgggggcggagcgggggcggg

SEQ ID NO: 22592 - DNA, 640 bp, Artificial Sequence
  chemically treated genomic DNA (Homo sapiens) CpG-island No: 22592
cccgcccccgctccgcccccgaaaccgcaaccccgcccgccatcgccgtcgccatattataactcccgcaaccgacgctaaaaacgcgcgcgaccgaaactctaacctacaatcgccgccgccgccgccaaataaacgccccccgcgaaccgaaccgaacgaaacctacgaaccgaaacaaccccatcctaaacccgaaaaaatcgcaaccgaaaccgaatccgaacccgaaccgaaacccgaccctacaacctaacgaaccctaaccgccgccaaaaacgacaaccacttcccccgaccgccgcctaacgaacccgaaccgccaccccaccccgcccccgaccgtcgaacgccgaccccttccgccgctacgaccgccgctacgaccgccgctccttaacaaaccgaacacgctactatcctccgcgctaaacgaaacgtacgaccgccctcgacgataaccgacgacccccaacccgaacacgaataacgataccactttctccctctaaaacgacctatcaacccgaccgtccccgccgcccgaaaaactatcgccgtcacaaaacaaacacttcgaaaaacgaccctctttaacgctcctcaatactcccctcccctaaacccaaattctaaccct

SEQ ID NO: 22593 - DNA, 557 bp, Artificial Sequence
  chemically treated genomic DNA (Homo sapiens) CpG-island No: 22593
tcgtacgttgagtaggtagtttcggttggttgggttggggatttatacggggtcgtcgtttttatcgtcgtttttcgttttcgatcgtttattcgcgttttagtttcggttgggggtttttcgcgattttatggtatcgtttttttcgatcgtcggtttcgtattcgtcgttgtttcgtttgttttttaggtttcggttttcgggtttttgttcgtcgtcgtcgttttcgttcgcggttgacgcgcgtttttatttatagtcggtggtcgggtcgtcgttatttgttgttgttttttttttggtttggttcgattcgggtagcgcggtttggagacgtcggggggcgtcggggtttatgtgttcgttttagggtcggtttcgagttcgtttttttggcggttttggtgtttgtagtagcgtcgcgtttggagaggttcgggaggtttcgggaggaaggcgtagcgggtgttttggttatggaggataggttttttcgtggagttttcgggattcggttttcggtcggtttgtttatgtttcgtgtggtatatgaggg

SEQ ID NO: 22594 - DNA, 557 bp, Artificial Sequence
  chemically treated genomic DNA (Homo sapiens) CpG-island No: 22594
ccctcatataccacacgaaacataaacaaaccgaccgaaaaccgaatcccgaaaactccacgaaaaaacctatcctccataaccaaaacacccgctacgccttcctcccgaaacctcccgaacctctccaaacgcgacgctactacaaacaccaaaaccgccaaaaaaacgaactcgaaaccgaccctaaaacgaacacataaaccccgacgccccccgacgtctccaaaccgcgctacccgaatcgaaccaaaccaaaaaaaaaacaacaacaaataacgacgacccgaccaccgactataaataaaaacgcgcgtcaaccgcgaacgaaaacgacgacgacgaacaaaaacccgaaaaccgaaacctaaaaaacaaacgaaacaacgacgaatacgaaaccgacgatcgaaaaaaacgataccataaaatcgcgaaaaacccccaaccgaaactaaaacgcgaataaacgatcgaaaacgaaaaacgacgataaaaacgacgaccccgtataaatccccaacccaaccaaccgaaactacctactcaacgtacga

SEQ ID NO: 22595 - DNA, 557 bp, Artificial Sequence
  chemically treated genomic DNA (Homo sapiens) CpG-island No: 22595
tttttatatgttatacgggatatgagtaggtcggtcgggagtcgggtttcgggagttttacgaaggggtttgttttttatgattaggatattcgttgcgtttttttttcgaggtttttcgggtttttttagacgcggcgttattgtagatattagggtcgttaagggagcggattcggagtcggttttggggcgggtatatgggtttcggcgtttttcggcgtttttaagtcgcgttgttcgggtcgggttaggttaggggagggatagtagtaggtgacgacggttcggttatcggttataaataggggcgcgcgttagtcgcgggcgggagcggcggcggcgggtaggggttcgggggtcggggtttggaggataggcgaggtagcggcgagtgcggggtcggcggtcggggagggcggtgttatggggtcgcggagggtttttagtcggggttggggcgcgggtgggcggtcgggggcggggggcgacggtgaggacgacggtttcgtgtggatttttagtttagttagtcggagttatttgtttagcgtgcgg

SEQ ID NO: 22596 - DNA, 557 bp, Artificial Sequence
  chemically treated genomic DNA (Homo sapiens) CpG-island No: 22596
ccgcacgctaaacaaataactccgactaactaaactaaaaatccacacgaaaccgtcgtcctcaccgtcgccccccgcccccgaccgcccacccgcgccccaaccccgactaaaaaccctccgcgaccccataacaccgccctccccgaccgccgaccccgcactcgccgctacctcgcctatcctccaaaccccgacccccgaacccctacccgccgccgccgctcccgcccgcgactaacgcgcgcccctatttataaccgataaccgaaccgtcgtcacctactactatccctcccctaacctaacccgacccgaacaacgcgacttaaaaacgccgaaaaacgccgaaacccatatacccgccccaaaaccgactccgaatccgctcccttaacgaccctaatatctacaataacgccgcgtctaaaaaaacccgaaaaacctcgaaaaaaaaacgcaacgaatatcctaatcataaaaaacaaaccccttcgtaaaactcccgaaacccgactcccgaccgacctactcatatcccgtataacatataaaaa

SEQ ID NO: 22597 - DNA, 670 bp, Artificial Sequence
  chemically treated genomic DNA (Homo sapiens) CpG-island No: 22597
aattgatcgggtagcgcgagggaggagcgcgtacgcgatcgcgagggcgggcgtgtattttcggttggaagtttgtgtcgggtttcgagcgcgcgtcggttgggagtttcgggtagagatttaggtcgttggatcgcgatgagcgcgtcgagttttcgtgcgcgcgtcgcggggttggggttgttgttgtgcgcggtgttggggcgcgttggtcggttagatagcggcggtcgcggggaattcgggtagttttttggggtagtcgtcgagcgtttatgttttattatttgtcgttgtttcggggatttgttggattgtagtcgtaagcggttagcgcgttttttcgagttattttcgttttgggtcgttcggttgtaagtatttttttcgcggggggagggggttcgggtcgttggagattcgagaaaataggagtcggcggggaatggggttcggcgtgtagttttttttttgtcgtatagttttttttggtttaggtcgcgatcggcgtttcgtgggcgtggaaaaagaattgttcgggttttagttttttttttacgtgttttgcgggcggcgtaggtgggtttttggcgcgttttaattggttgtaggtagattagggttgggggttagtaacgacgttagagattggggatgaagttttgcgttt

SEQ ID NO: 22598 - DNA, 670 bp, Artificial Sequence
  chemically treated genomic DNA (Homo sapiens) CpG-island No: 22598
aaacgcaaaacttcatccccaatctctaacgtcgttactaacccccaaccctaatctacctacaaccaattaaaacgcgccaaaaacccacctacgccgcccgcaaaacacgtaaaaaaaaaactaaaacccgaacaattctttttccacgcccacgaaacgccgatcgcgacctaaaccaaaaaaaactatacgacaaaaaaaaaactacacgccgaaccccattccccgccgactcctattttctcgaatctccaacgacccgaaccccctccccccgcgaaaaaaatacttacaaccgaacgacccaaaacgaaaataactcgaaaaaacgcgctaaccgcttacgactacaatccaacaaatccccgaaacaacgacaaataataaaacataaacgctcgacgactaccccaaaaaactacccgaattccccgcgaccgccgctatctaaccgaccaacgcgccccaacaccgcgcacaacaacaaccccaaccccgcgacgcgcgcacgaaaactcgacgcgctcatcgcgatccaacgacctaaatctctacccgaaactcccaaccgacgcgcgctcgaaacccgacacaaacttccaaccgaaaatacacgcccgccctcgcgatcgcgtacgcgctcctccctcgcgctacccgatcaatt

SEQ ID NO: 22599 - DNA, 670 bp, Artificial Sequence
  chemically treated genomic DNA (Homo sapiens) CpG-island No: 22599
gggcgtaggattttatttttaatttttggcgtcgttattggtttttaattttggtttatttgtagttagttaggacgcgttaagagtttatttgcgtcgttcgtaaagtacgtgggagggaaattgaggttcggatagttttttttttacgtttacggagcgtcgatcgcggtttgggttagaaggagttatacggtaaaaaggggattgtacgtcgaattttatttttcgtcggtttttgttttttcgaatttttagcggttcgggtttttttttttcgcgggaagaatatttatagtcgagcgatttaggacgggagtggttcgggaagacgcgttagtcgtttacgattgtagtttagtaggttttcgaggtagcggtaggtagtggggtatgggcgttcggcggttattttagagggttgttcgagtttttcgcgatcgtcgttgtttgatcggttagcgcgttttagtatcgcgtatagtagtagttttaatttcgcggcgcgcgtacggaggttcggcgcgtttatcgcggtttagcggtttaggtttttattcgaagtttttagtcggcgcgcgttcggggttcggtataaatttttagtcgagggtgtacgttcgttttcgcggtcgcgtgcgcgtttttttttcgcgttgttcggttaatt

SEQ ID NO: 22600 - DNA, 670 bp, Artificial Sequence
  chemically treated genomic DNA (Homo sapiens) CpG-island No: 22600
aattaaccgaacaacgcgaaaaaaaaacgcgcacgcgaccgcgaaaacgaacgtacaccctcgactaaaaatttataccgaaccccgaacgcgcgccgactaaaaacttcgaataaaaacctaaaccgctaaaccgcgataaacgcgccgaacctccgtacgcgcgccgcgaaattaaaactactactatacgcgatactaaaacgcgctaaccgatcaaacaacgacgatcgcgaaaaactcgaacaaccctctaaaataaccgccgaacgcccataccccactacctaccgctacctcgaaaacctactaaactacaatcgtaaacgactaacgcgtcttcccgaaccactcccgtcctaaatcgctcgactataaatattcttcccgcgaaaaaaaaaaacccgaaccgctaaaaattcgaaaaaacaaaaaccgacgaaaaataaaattcgacgtacaatcccctttttaccgtataactccttctaacccaaaccgcgatcgacgctccgtaaacgtaaaaaaaaaactatccgaacctcaatttccctcccacgtactttacgaacgacgcaaataaactcttaacgcgtcctaactaactacaaataaaccaaaattaaaaaccaataacgacgccaaaaattaaaaataaaatcctacgccc

SEQ ID NO: 22601 - DNA, 1158 bp, Artificial Sequence
  chemically treated genomic DNA (Homo sapiens) CpG-island No: 22601
tttacgtcggcggttttttttttacggatttcgcgttgggtgtttacgtcggcggttttttttttacggatttcgcgttgggtttttacgtcggcggttttttttttatcgatttcgcgttgggtttttacgtcggcggttttttttttatcgatttcgcgttgggtttttacgtcggcggtttttgttttatcgatttcgcgttgggtttttacgtcggcggtttttgttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggttgttttagtaggcgaaatttttgtttgaaggcgttttcgtgtggattttttttgataaggttttgtt

SEQ ID NO: 22602 - DNA, 1158 bp, Artificial Sequence
  chemically treated genomic DNA (Homo sapiens) CpG-island No: 22602
aacaaaaccttatcaaaaaaaatccacacgaaaacgccttcaaacaaaaatttcgcctactaaaacaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaacaaaaaccgccgacgtaaaaacccaacgcgaaatcgataaaacaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatccgtaaaaaaaaaaccgccgacgtaaacacccaacgcgaaatccgtaaaaaaaaaaccgccgacgtaaa

SEQ ID NO: 22603 - DNA, 1158 bp, Artificial Sequence
  chemically treated genomic DNA (Homo sapiens) CpG-island No: 22603
agtaagattttgttaaggggagtttatacgaaggcgtttttaaatagaaatttcgtttgttggggtaatttagcgcggggtcggtggagaaaaggtcgtcgacgtggggatttagcgcggggtcggtggagaaaaggtcgtcgacgtggggatttagcgcggggtcggtggagaaaaggtcgtcgacgtggggatttagcgcggggtcggtggagaaaaggtcgtcgacgtggagatttagcgcggggtcggtggagaaaaggtcgtcgacgtggggatttagcgcggggtcggtggagaaaaggtcgtcgacgtggggatttagcgcggggtcggtggagaaaaggtcgtcgacgtggggatttagcgcggggtcggtggagaaaaggtcgtcgacgtggggatttagcgcggggtcggtggagaaaaggtcgtcgacgtggggatttagcgcggggtcggtggagaaaaggtcgtcgacgtggagatttagcgcggggtcggtggagaaaaggtcgtcgacgtggagatttagcgcggggtcggtggagaaaaggtcgtcgacgtggggatttagcgcggggtcggtggagaaaaggtcgtcgacgtggggatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggggatttagcgcggggtcggtggagtaaaggtcgtcgacgtggagatttagcgcggggtcggtggagtaaaggtcgtcgacgtggagatttagcgcggggtcggtggagaaaaggtcgtcgacgtggagatttagcgcggggtcggtggagaaaaggtcgtcgacgtggggatttagcgcggggttcgtggagaaaaggtcgtcgacgtggatatttagcgcggggttcgtggagaaaaggtcgtcgacgtgga

SEQ ID NO: 22604 - DNA, 1158 bp, Artificial Sequence
  chemically treated genomic DNA (Homo sapiens) CpG-island No: 22604
tccacgtcgacgaccttttctccacgaaccccgcgctaaatatccacgtcgacgaccttttctccacgaaccccgcgctaaatccccacgtcgacgaccttttctccaccgaccccgcgctaaatctccacgtcgacgaccttttctccaccgaccccgcgctaaatctccacgtcgacgacctttactccaccgaccccgcgctaaatctccacgtcgacgacctttactccaccgaccccgcgctaaatccccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatccccacgtcgacgaccttttctccaccgaccccgcgctaaatccccacgtcgacgaccttttctccaccgaccccgcgctaaatctccacgtcgacgaccttttctccaccgaccccgcgctaaatctccacgtcgacgaccttttctccaccgaccccgcgctaaatccccacgtcgacgaccttttctccaccgaccccgcgctaaatccccacgtcgacgaccttttctccaccgaccccgcgctaaatccccacgtcgacgaccttttctccaccgaccccgcgctaaatccccacgtcgacgaccttttctccaccgaccccgcgctaaatccccacgtcgacgaccttttctccaccgaccccgcgctaaatctccacgtcgacgaccttttctccaccgaccccgcgctaaatccccacgtcgacgaccttttctccaccgaccccgcgctaaatccccacgtcgacgaccttttctccaccgaccccgcgctaaatccccacgtcgacgaccttttctccaccgaccccgcgctaaattaccccaacaaacgaaatttctatttaaaaacgccttcgtataaactccccttaacaaaatcttact

SEQ ID NO: 22605 - DNA, 846 bp, Artificial Sequence
  chemically treated genomic DNA (Homo sapiens) CpG-island No: 22605
tcgggtcggttgttcgggttttattttaaaataaggttcgaattgtagtagtcggagtcgatttttggagtttagcgtttagggcggattcgcgggagcgttttttggtaatcgttgttaaggagacgaagttcgggaaggagttttcgcgtttgcgtcgcggggtcgttcgcgtttgcgtttgcgcgtaagagaggcggggttagcgttcggtatggcggagttagatttggagtgcgagtagattcgtttgaagtgtattcgtaaggagggtttttttacggtgttttcggaatatagggtgcgcggggtgttattcgggtagttttgttcgtttcgttagcggtattgttcggttgggtttggggagtttcgtgtcgcgttgtcgcgtcgaggttttcggtacgggcgggaacgatagttttagagtttttcgcggcgggggcggaagtcggggcggggcgggtttaggattttcgatagtcggtttttggagatttgaggggtcggggcgggtttagggatgtttcgcgttcgcggagagacgggttcgggatttgggaagagtaggtttcgggatttagttcgggcgttgttgggtttagcgttcgagttgggttttgtaggttgagtcgcgagttatttgtttgtggggagaatttatattcgcgacgagttcgagtttgaaggttttcgttgggtttgggttgtatggagcggggtttagcgttgtttggcggttttacgcgaattttgggcgcgttttttgcggaggtgtcggtgtttttttttgtagagattaggagagagtttttgggcgttgggcggtgttgtttaggtgtacgg

SEQ ID NO: 22606 - DNA, 846 bp, Artificial Sequence
  chemically treated genomic DNA (Homo sapiens) CpG-island No: 22606
ccgtacacctaaacaacaccgcccaacgcccaaaaactctctcctaatctctacaaaaaaaaacaccgacacctccgcaaaaaacgcgcccaaaattcgcgtaaaaccgccaaacaacgctaaaccccgctccatacaacccaaacccaacgaaaaccttcaaactcgaactcgtcgcgaatataaattctccccacaaacaaataactcgcgactcaacctacaaaacccaactcgaacgctaaacccaacaacgcccgaactaaatcccgaaacctactcttcccaaatcccgaacccgtctctccgcgaacgcgaaacatccctaaacccgccccgacccctcaaatctccaaaaaccgactatcgaaaatcctaaacccgccccgccccgacttccgcccccgccgcgaaaaactctaaaactatcgttcccgcccgtaccgaaaacctcgacgcgacaacgcgacacgaaactccccaaacccaaccgaacaataccgctaacgaaacgaacaaaactacccgaataacaccccgcgcaccctatattccgaaaacaccgtaaaaaaaccctccttacgaatacacttcaaacgaatctactcgcactccaaatctaactccgccataccgaacgctaaccccgcctctcttacgcgcaaacgcaaacgcgaacgaccccgcgacgcaaacgcgaaaactccttcccgaacttcgtctccttaacaacgattaccaaaaaacgctcccgcgaatccgccctaaacgctaaactccaaaaatcgactccgactactacaattcgaaccttattttaaaataaaacccgaacaaccgacccga

SEQ ID NO: 22607 - DNA, 846 bp, Artificial Sequence
  chemically treated genomic DNA (Homo sapiens) CpG-island No: 22607
tcgtgtatttgggtaatatcgtttaacgtttagaggtttttttttggtttttgtagagggaggtatcggtattttcgtaagggacgcgtttagggttcgcgtgaagtcgttaggtagcgttggatttcgttttatgtagtttaagtttagcgggagtttttaagttcgaattcgtcgcgggtgtaaattttttttataaataagtggttcgcggtttagtttgtaaagtttagttcgggcgttgaatttagtagcgttcgagttggatttcggagtttgttttttttaagtttcgggttcgttttttcgcgggcgcgaggtatttttgagttcgtttcggttttttagatttttagggatcggttgtcgggggttttgagttcgtttcgtttcggttttcgttttcgtcgcggggaattttgggattgtcgttttcgttcgtgtcggaagtttcggcgcggtagcgcgatacgaggttttttagatttagtcgggtagtgtcgttagcgaggcgggtagagttgttcgggtggtatttcgcgtattttgtgtttcggaggtatcgtgaagaagttttttttacgaatatattttagacggatttgttcgtattttagatttggtttcgttatgtcgagcgttggtttcgttttttttgcgcgtaggcgtagacgcggacggtttcgcggcgtaggcgcgaaagttttttttcgggtttcgtttttttagtaacggttattaagagacgttttcgcgggttcgttttaggcgttgggttttagggatcggtttcgattgttgtagttcgggttttattttagggtgaagttcgggtagtcgattcgg

SEQ ID NO: 22608 - DNA, 846 bp, Artificial Sequence
  chemically treated genomic DNA (Homo sapiens) CpG-island No: 22608
ccgaatcgactacccgaacttcaccctaaaataaaacccgaactacaacaatcgaaaccgatccctaaaacccaacgcctaaaacgaacccgcgaaaacgtctcttaataaccgttactaaaaaaacgaaacccgaaaaaaaactttcgcgcctacgccgcgaaaccgtccgcgtctacgcctacgcgcaaaaaaaacgaaaccaacgctcgacataacgaaaccaaatctaaaatacgaacaaatccgtctaaaatatattcgtaaaaaaaacttcttcacgatacctccgaaacacaaaatacgcgaaataccacccgaacaactctacccgcctcgctaacgacactacccgactaaatctaaaaaacctcgtatcgcgctaccgcgccgaaacttccgacacgaacgaaaacgacaatcccaaaattccccgcgacgaaaacgaaaaccgaaacgaaacgaactcaaaacccccgacaaccgatccctaaaaatctaaaaaaccgaaacgaactcaaaaatacctcgcgcccgcgaaaaaacgaacccgaaacttaaaaaaaacaaactccgaaatccaactcgaacgctactaaattcaacgcccgaactaaactttacaaactaaaccgcgaaccacttatttataaaaaaaatttacacccgcgacgaattcgaacttaaaaactcccgctaaacttaaactacataaaacgaaatccaacgctacctaacgacttcacgcgaaccctaaacgcgtcccttacgaaaataccgatacctccctctacaaaaaccaaaaaaaaacctctaaacgttaaacgatattacccaaatacacga

SEQ ID NO: 22609 - DNA, 1234 bp, Artificial Sequence
  chemically treated genomic DNA (Homo sapiens) CpG-island No: 22609
ttcgaatcgggggtcggggatcgaggtttggggggaggggtttcgggtcgagggtcgaggttcggggtaaaggatttcgggttgggggtcgggggtttgggaagggtttcggtcggtggtcgggggtcgaggttcgggagaaggggtttcgggtcggtggtagaggttttggggaaggggtttcgggtcggggatcgagggtcgaggttcgggaaaaggggtttcgggttggtggtttaggttttggggaaggggtttcgggtcgggtatcgggggacgaggttcgggaaaaggggttttaggtcggtggtcgaggttttggggatggggttcgggtcggggatcgggggacgacgatcgggaaaaggggttttaggtcggtggtcgaggttttggggatggggtttcgggggatcgacggtcgaggttcgagtttttttgagttttgttcgcggttttaggtgggcggagtttacgttagtgggagaagcggtttcgtttcgcgcgcgagttttcggaggacggtcgcgattttttatcgtttatggttataatgataggagtagtattcggagagggagaagggacgttaatttcgggcggtgttaggtttcggcggcgatcgaatcgattaagttgtattcggcggggattttcggggtcgtcgttttattttcggtcgtacgggatgttttcgcgagaggatggtggtcggtttcgttagaggggcggggcgcggttgcgcggcgcgcggtcgttatggtgacgtacgtcgttggcgcgaggattttttgtgagtcgttttcggtttcgcggtcgcggaggtgtggggattcgggtttgcgtcggagggggcggtgggtttatttatgggtttttttaaaagtaaagagaaatttcggaaaggtaaaggaggcgtaggcgttgggtttttcgcgttttcgtttttgggcgcgggtttagggcggggttgggttgggcggggcggtgtgagcgtaggcgttaggttcggttcggtgcgaatcgtttttgtcgtcgagttcgttacggacggcgcgtttttcgtttgaggcggttacggaaacgcggagattcgagatttgaagttagtttattttggatttacgtaggcgattgaagacgatgggatttattgttttgtattcggtaagtttcgggtttaacggatgatttatatattttaggtgaggagtaaaagaagggatttatttat

SEQ ID NO: 22610 - DNA, 1234 bp, Artificial Sequence
  chemically treated genomic DNA (Homo sapiens) CpG-island No: 22610
ataaataaatcccttcttttactcctcacctaaaatatataaatcatccgttaaacccgaaacttaccgaatacaaaacaataaatcccatcgtcttcaatcgcctacgtaaatccaaaataaactaacttcaaatctcgaatctccgcgtttccgtaaccgcctcaaacgaaaaacgcgccgtccgtaacgaactcgacgacaaaaacgattcgcaccgaaccgaacctaacgcctacgctcacaccgccccgcccaacccaaccccgccctaaacccgcgcccaaaaacgaaaacgcgaaaaacccaacgcctacgcctcctttacctttccgaaatttctctttacttttaaaaaaacccataaataaacccaccgccccctccgacgcaaacccgaatccccacacctccgcgaccgcgaaaccgaaaacgactcacaaaaaatcctcgcgccaacgacgtacgtcaccataacgaccgcgcgccgcgcaaccgcgccccgcccctctaacgaaaccgaccaccatcctctcgcgaaaacatcccgtacgaccgaaaataaaacgacgaccccgaaaatccccgccgaatacaacttaatcgattcgatcgccgccgaaacctaacaccgcccgaaattaacgtcccttctccctctccgaatactactcctatcattataaccataaacgataaaaaatcgcgaccgtcctccgaaaactcgcgcgcgaaacgaaaccgcttctcccactaacgtaaactccgcccacctaaaaccgcgaacaaaactcaaaaaaactcgaacctcgaccgtcgatcccccgaaaccccatccccaaaacctcgaccaccgacctaaaaccccttttcccgatcgtcgtcccccgatccccgacccgaaccccatccccaaaacctcgaccaccgacctaaaaccccttttcccgaacctcgtcccccgatacccgacccgaaaccccttccccaaaacctaaaccaccaacccgaaaccccttttcccgaacctcgaccctcgatccccgacccgaaaccccttccccaaaacctctaccaccgacccgaaaccccttctcccgaacctcgacccccgaccaccgaccgaaacccttcccaaacccccgacccccaacccgaaatcctttaccccgaacctcgaccctcgacccgaaacccctccccccaaacctcgatccccgacccccgattcgaa

SEQ ID NO: 22611 - DNA, 1234 bp, Artificial Sequence
  chemically treated genomic DNA (Homo sapiens) CpG-island No: 22611
ataggtggatttttttttttgttttttatttgaaatatatggattattcgttagattcgggatttatcgaatgtagggtagtgggttttatcgtttttagtcgtttgcgtgggtttagaataagttggttttaagtttcgagttttcgcgttttcgtaatcgttttaggcgggaaacgcgtcgttcgtggcggattcggcggtaggaacggttcgtatcgggtcgagtttggcgtttgcgtttatatcgtttcgtttagtttagtttcgttttgggttcgcgtttaggggcggagacgcggggagtttagcgtttgcgttttttttattttttcggggtttttttttgtttttggaaaggtttatgggtgagtttatcgtttttttcgacgtaagttcgggtttttatattttcgcggtcgcggagtcgggagcgatttataaaaggttttcgcgttagcggcgtgcgttattatggcgatcgcgcgtcgcgtagtcgcgtttcgtttttttggcgggatcggttattattttttcgcgagagtatttcgtgcgatcggaagtggggcggcgatttcggaagttttcgtcgggtgtagtttggtcggttcgatcgtcgtcgggatttgatatcgttcggagttggcgtttttttttttttttcgagtgttgtttttgttattgtggttatggacggtaagaggtcgcggtcgtttttcggggattcgcgcgcggggcggggtcgttttttttattggcgtgggtttcgtttatttggggtcgcgggtaggatttaggagagttcgggtttcgatcgtcgatttttcgggattttatttttagggtttcgattatcgatttgggattttttttttcggtcgtcgtttttcgattttcgattcggattttatttttagggtttcgattatcgatttgggattttttttttcgagtttcgtttttcgatattcgattcggaattttttttttagggtttagattattaattcgggattttttttttcgggtttcgattttcgattttcgattcggaattttttttttagggtttttattatcgattcgggattttttttttcgggtttcgattttcgattatcgatcgggattttttttaggttttcgatttttaattcgagattttttatttcgggtttcgattttcgattcgggatttttttttttaggtttcgattttcgattttcgattcggg

SEQ ID NO: 22612 - DNA, 1234 bp, Artificial Sequence
  chemically treated genomic DNA (Homo sapiens) CpG-island No: 22612
cccgaatcgaaaatcgaaaatcgaaacctaaaaaaaaaaatcccgaatcgaaaatcgaaacccgaaataaaaaatctcgaattaaaaatcgaaaacctaaaaaaaatcccgatcgataatcgaaaatcgaaacccgaaaaaaaaaatcccgaatcgataataaaaaccctaaaaaaaaaattccgaatcgaaaatcgaaaatcgaaacccgaaaaaaaaaatcccgaattaataatctaaaccctaaaaaaaaaattccgaatcgaatatcgaaaaacgaaactcgaaaaaaaaaatcccaaatcgataatcgaaaccctaaaaataaaatccgaatcgaaaatcgaaaaacgacgaccgaaaaaaaaaatcccaaatcgataatcgaaaccctaaaaataaaatcccgaaaaatcgacgatcgaaacccgaactctcctaaatcctacccgcgaccccaaataaacgaaacccacgccaataaaaaaaacgaccccgccccgcgcgcgaatccccgaaaaacgaccgcgacctcttaccgtccataaccacaataacaaaaacaacactcgaaaaaaaaaaaaaaacgccaactccgaacgatatcaaatcccgacgacgatcgaaccgaccaaactacacccgacgaaaacttccgaaatcgccgccccacttccgatcgcacgaaatactctcgcgaaaaaataataaccgatcccgccaaaaaaacgaaacgcgactacgcgacgcgcgatcgccataataacgcacgccgctaacgcgaaaaccttttataaatcgctcccgactccgcgaccgcgaaaatataaaaacccgaacttacgtcgaaaaaaacgataaactcacccataaacctttccaaaaacaaaaaaaaaccccgaaaaaataaaaaaaacgcaaacgctaaactccccgcgtctccgcccctaaacgcgaacccaaaacgaaactaaactaaacgaaacgatataaacgcaaacgccaaactcgacccgatacgaaccgttcctaccgccgaatccgccacgaacgacgcgtttcccgcctaaaacgattacgaaaacgcgaaaactcgaaacttaaaaccaacttattctaaacccacgcaaacgactaaaaacgataaaacccactaccctacattcgataaatcccgaatctaacgaataatccatatatttcaaataaaaaacaaaaaaaaaaatccacctat

SEQ ID NO: 22613 - DNA, 595 bp, Artificial Sequence
  chemically treated genomic DNA (Homo sapiens) CpG-island No: 22613
tttttcgcggtcgggtcgtttggggttgggtttttgtttcgtggggaggagcggtttaggtataacgttttttgagcgtttgttatgagttcgtagttttcggtttagcggcgtcgtgaacgatatcggtttcgcgaggagacgggcgacgcggtgataggaggttttcggggtgtttcgcgtaggggttcggtcgggttgatatttttttttttttttttattaggtttcgttttttttaaattattcggaggcggggtttgcgttaagtttcgtttcgtttttagcgttacggtcgcggatttcgggcggagtcgattttcggcggaagcgcgcggcgcgcggggaggttcgaattgattcgcggcggtcgtagatcgttggggatagataggtagcgtcgttattcgcgggattcgtagttttatttgtcgggcgaaggggttttggtcgggagagggtttagcgggcggaagcgcgtttttagagaagggtgcggtcgataatcgggggcgtttttggaaggtcgaggtatttaggttggagggaggggttggaggtgcgggggcgtttaattggaggggtttggatcgtt

SEQ ID NO: 22614 - DNA, 595 bp, Artificial Sequence
  chemically treated genomic DNA (Homo sapiens) CpG-island No: 22614
aacgatccaaacccctccaattaaacgcccccgcacctccaacccctccctccaacctaaatacctcgaccttccaaaaacgcccccgattatcgaccgcacccttctctaaaaacgcgcttccgcccgctaaaccctctcccgaccaaaaccccttcgcccgacaaataaaactacgaatcccgcgaataacgacgctacctatctatccccaacgatctacgaccgccgcgaatcaattcgaacctccccgcgcgccgcgcgcttccgccgaaaatcgactccgcccgaaatccgcgaccgtaacgctaaaaacgaaacgaaacttaacgcaaaccccgcctccgaataatttaaaaaaaacgaaacctaataaaaaaaaaaaaaaaaatatcaacccgaccgaacccctacgcgaaacaccccgaaaacctcctatcaccgcgtcgcccgtctcctcgcgaaaccgatatcgttcacgacgccgctaaaccgaaaactacgaactcataacaaacgctcaaaaaacgttatacctaaaccgctcctccccacgaaacaaaaacccaaccccaaacgacccgaccgcgaaaaa

SEQ ID NO: 22615 - DNA, 595 bp, Artificial Sequence
  chemically treated genomic DNA (Homo sapiens) CpG-island No: 22615
agcgatttaggtttttttagttgagcgttttcgtatttttagtttttttttttagtttgggtatttcggttttttaggggcgttttcggttatcgatcgtatttttttttagagacgcgttttcgttcgttgagttttttttcgattagagttttttcgttcggtagatggagttgcggatttcgcgggtgacggcgttatttgtttgtttttagcggtttgcggtcgtcgcggattagttcgggttttttcgcgcgtcgcgcgttttcgtcgggagtcggtttcgttcggggttcgcggtcgtgacgttgggggcggggcggggtttggcgtaggtttcgttttcgaataatttaggaggggcggggtttggtgaaaggggaggaggaggtgttagttcggtcgagtttttgcgcgaggtatttcgagagttttttgttatcgcgtcgttcgttttttcgcgggatcggtatcgtttacgacgtcgttgggtcgagggttgcgggtttatggtaggcgtttagggaacgttgtgtttgggtcgtttttttttacgagatagggatttagttttaggcgattcggtcgcggggaa

SEQ ID NO: 22616 - DNA, 595 bp, Artificial Sequence
  chemically treated genomic DNA (Homo sapiens) CpG-island No: 22616
ttccccgcgaccgaatcgcctaaaactaaatccctatctcgtaaaaaaaaacgacccaaacacaacgttccctaaacgcctaccataaacccgcaaccctcgacccaacgacgtcgtaaacgataccgatcccgcgaaaaaacgaacgacgcgataacaaaaaactctcgaaatacctcgcgcaaaaactcgaccgaactaacacctcctcctcccctttcaccaaaccccgcccctcctaaattattcgaaaacgaaacctacgccaaaccccgccccgcccccaacgtcacgaccgcgaaccccgaacgaaaccgactcccgacgaaaacgcgcgacgcgcgaaaaaacccgaactaatccgcgacgaccgcaaaccgctaaaaacaaacaaataacgccgtcacccgcgaaatccgcaactccatctaccgaacgaaaaaactctaatcgaaaaaaaactcaacgaacgaaaacgcgtctctaaaaaaaaatacgatcgataaccgaaaacgcccctaaaaaaccgaaatacccaaactaaaaaaaaaaactaaaaatacgaaaacgctcaactaaaaaaacctaaatcgct

SEQ ID NO: 22617 - DNA, 503 bp, Artificial Sequence
  chemically treated genomic DNA (Homo sapiens) CpG-island No: 22617
tcgggtgatcgcgttttttttatcgttcgagtagtcgttcgggttcgcgttggagtttggagagatttttgcgtcggggaaaagcgttggcgtttcgcgcggattggggttcgagtttcggttttttcgttcgttgcggtttcgcgttatgcgtttttcgttttttcgaggtgaagttacgcgttttacgcgagatggtgatcgaggaagcgttcgtttggcgtcggtttcgtgttttttcggattttaatcgcgattatagcgggttcgtttgagatttacgttggagcgggagtttcggacgtttggaggttcgtattttagcgcgcgttttttcgtcggtttgttttcgtttagtttttcgtttttcgtcggtcggcgttttttattttttaatttttttgcgttttttggtcgagttttttgttcgcgttttatgtttgggcgttttattttggttcggggtttttttttcgaattttgggtcgtattttttattgcgg

SEQ ID NO: 22618 - DNA, 503 bp, Artificial Sequence
  chemically treated genomic DNA (Homo sapiens) CpG-island No: 22618
ccgcaataaaaaatacgacccaaaattcgaaaaaaaaaccccgaaccaaaataaaacgcccaaacataaaacgcgaacaaaaaactcgaccaaaaaacgcaaaaaaattaaaaaataaaaaacgccgaccgacgaaaaacgaaaaactaaacgaaaacaaaccgacgaaaaaacgcgcgctaaaatacgaacctccaaacgtccgaaactcccgctccaacgtaaatctcaaacgaacccgctataatcgcgattaaaatccgaaaaaacacgaaaccgacgccaaacgaacgcttcctcgatcaccatctcgcgtaaaacgcgtaacttcacctcgaaaaaacgaaaaacgcataacgcgaaaccgcaacgaacgaaaaaaccgaaactcgaaccccaatccgcgcgaaacgccaacgcttttccccgacgcaaaaatctctccaaactccaacgcgaacccgaacgactactcgaacgataaaaaaaacgcgatcacccga

SEQ ID NO: 22619 - DNA, 503 bp, Artificial Sequence
  chemically treated genomic DNA (Homo sapiens) CpG-island No: 22619
tcgtagtgaggggtgcggtttagggttcggggagggggtttcgggttagagtgaagcgtttaggtatgaggcgcgggtagggggttcgattaagaggcgtaaggagattgaggggtgaggggcgtcggtcgacggggggcgggaggttgggcgggagtaggtcggcgagggagcgcgcgttggggtgcggatttttaggcgttcggggttttcgttttaacgtgggttttaagcgaattcgttgtgatcgcggttggggttcgaaggggtacggggtcggcgttagacgggcgttttttcggttattatttcgcgtgaaacgcgtggttttatttcgaaagggcgagaaacgtatggcgcgaagtcgtagcgggcggaggagtcggaattcgaattttagttcgcgcggggcgttagcgttttttttcggcgtaggggtttttttaggttttagcgcgggttcgggcggttgttcgggcggtggaagggacgcggttattcgg

SEQ ID NO: 22620 - DNA, 503 bp, Artificial Sequence
  chemically treated genomic DNA (Homo sapiens) CpG-island No: 22620
ccgaataaccgcgtcccttccaccgcccgaacaaccgcccgaacccgcgctaaaacctaaaaaaacccctacgccgaaaaaaaacgctaacgccccgcgcgaactaaaattcgaattccgactcctccgcccgctacgacttcgcgccatacgtttctcgccctttcgaaataaaaccacgcgtttcacgcgaaataataaccgaaaaaacgcccgtctaacgccgaccccgtaccccttcgaaccccaaccgcgatcacaacgaattcgcttaaaacccacgttaaaacgaaaaccccgaacgcctaaaaatccgcaccccaacgcgcgctccctcgccgacctactcccgcccaacctcccgccccccgtcgaccgacgcccctcacccctcaatctccttacgcctcttaatcgaaccccctacccgcgcctcatacctaaacgcttcactctaacccgaaaccccctccccgaaccctaaaccgcacccctcactacga

SEQ ID NO: 22621 - DNA, 533 bp, Artificial Sequence
  chemically treated genomic DNA (Homo sapiens) CpG-island No: 22621
ttcgtatttttagttcggcgttagtttcggttcggtgggttttttggttttttacgtttcggttttatttgtatttattggttttgcgtttgttgtagtaacgttacgttggggtcggatttggtgagcgggtcgcggtttagtaggtgtcggtagttgagtcgtagttttattttcgaggcgtagggcgcgggtaaattttcgggggttgtcgtcgtttcgcgtttcgagttcgcgtttatgttttcggcgttcgggggttcggttgggcgtattgaggggtcgttgttcgcgagtcggcgtcgtcgcggcgttcgggaaatggtggtcggtttaggcgtggtcgcgtttttttgaacgtttgtcgggcgcgggcgtacgtggttcgggcggtcgcggcgcggggattgtagggggtggggcgcggtcggggggcggggtcggggaggggcgcggcgggaaatgagggtagggggtaaggtaggggtgtttttcggagatgttcgggaggagatagtttttaatttttcggg

SEQ ID NO: 22622 - DNA, 533 bp, Artificial Sequence
  chemically treated genomic DNA (Homo sapiens) CpG-island No: 22622
cccgaaaaattaaaaactatctcctcccgaacatctccgaaaaacacccctaccttaccccctaccctcatttcccgccgcgcccctccccgaccccgccccccgaccgcgccccaccccctacaatccccgcgccgcgaccgcccgaaccacgtacgcccgcgcccgacaaacgttcaaaaaaacgcgaccacgcctaaaccgaccaccatttcccgaacgccgcgacgacgccgactcgcgaacaacgacccctcaatacgcccaaccgaacccccgaacgccgaaaacataaacgcgaactcgaaacgcgaaacgacgacaacccccgaaaatttacccgcgccctacgcctcgaaaataaaactacgactcaactaccgacacctactaaaccgcgacccgctcaccaaatccgaccccaacgtaacgttactacaacaaacgcaaaaccaataaatacaaataaaaccgaaacgtaaaaaaccaaaaaacccaccgaaccgaaactaacgccgaactaaaaatacgaa

SEQ ID NO: 22623 - DNA, 533 bp, Artificial Sequence
  chemically treated genomic DNA (Homo sapiens) CpG-island No: 22623
ttcggggaattagaagttgttttttttcgggtattttcgaggggtatttttgttttgttttttgtttttatttttcgtcgcgttttttttcggtttcgtttttcggtcgcgttttattttttgtagttttcgcgtcgcggtcgttcgagttacgtgcgttcgcgttcggtaggcgtttagggaagcgcggttacgtttgggtcggttattatttttcgggcgtcgcggcggcgtcgattcgcgggtagcggttttttagtgcgtttagtcgggttttcgaacgtcgggagtatgagcgcgggttcggagcgcggggcggcggtaattttcgggggtttgttcgcgttttgcgtttcgaaggtggagttgcggtttagttgtcggtatttgttggatcgcgattcgtttattaagttcgattttagcgtggcgttgttgtagtaggcgtagggttagtgggtgtaggtagggtcggggcgtgggagattaaaaggtttatcgggtcggggttggcgtcgagttggggatgcgga

SEQ ID NO: 22624 - DNA, 533 bp, Artificial Sequence
  chemically treated genomic DNA (Homo sapiens) CpG-island No: 22624
tccgcatccccaactcgacgccaaccccgacccgataaaccttttaatctcccacgccccgaccctacctacacccactaaccctacgcctactacaacaacgccacgctaaaatcgaacttaataaacgaatcgcgatccaacaaataccgacaactaaaccgcaactccaccttcgaaacgcaaaacgcgaacaaacccccgaaaattaccgccgccccgcgctccgaacccgcgctcatactcccgacgttcgaaaacccgactaaacgcactaaaaaaccgctacccgcgaatcgacgccgccgcgacgcccgaaaaataataaccgacccaaacgtaaccgcgcttccctaaacgcctaccgaacgcgaacgcacgtaactcgaacgaccgcgacgcgaaaactacaaaaaataaaacgcgaccgaaaaacgaaaccgaaaaaaaacgcgacgaaaaataaaaacaaaaaacaaaacaaaaatacccctcgaaaatacccgaaaaaaaacaacttctaattccccgaa

SEQ ID NO: 22625 - DNA, 513 bp, Artificial Sequence
  chemically treated genomic DNA (Homo sapiens) CpG-island No: 22625
acgcgtttttggggacgtcgtcgcgcggacgcgagttgtcgttcgagcggggcggtgtttgtttagtttcggttaattttgagttcggtgggcgggagaattttcggtttcgtttttttttaattttttttaaagttttttgattcgttttcgtttaaatacgcgtcgtagttagagtaggcgggttcgtgtggacgttcggttagtttttagtttggtgggcgggaggatgttagggttcgtttcgtttcgttttattcgaagtttttcgggtcgttttcgtttaaatacgcgttgtatttcgagttgggtggtgttcgtcgagttttggttagtcggtgggcgggaggacgttcgggttcgtttcgtttcgtttcgttttaaagttttttgggacgtttttatttatgcgcgtgtcgtatcgggtttagtagtgtcggtttagttttagttaattttgagtcgagtgggtcgcgaggatttagtgttaagtttgttgtttttggtttcgtt

SEQ ID NO: 22626 - DNA, 513 bp, Artificial Sequence
  chemically treated genomic DNA (Homo sapiens) CpG-island No: 22626
aacgaaaccaaaaacaacaaacttaacactaaatcctcgcgacccactcgactcaaaattaactaaaactaaaccgacactactaaacccgatacgacacgcgcataaataaaaacgtcccaaaaaactttaaaacgaaacgaaacgaaacgaacccgaacgtcctcccgcccaccgactaaccaaaactcgacgaacaccacccaactcgaaatacaacgcgtatttaaacgaaaacgacccgaaaaacttcgaataaaacgaaacgaaacgaaccctaacatcctcccgcccaccaaactaaaaactaaccgaacgtccacacgaacccgcctactctaactacgacgcgtatttaaacgaaaacgaatcaaaaaactttaaaaaaaattaaaaaaaaacgaaaccgaaaattctcccgcccaccgaactcaaaattaaccgaaactaaacaaacaccgccccgctcgaacgacaactcgcgtccgcgcgacgacgtccccaaaaacgcgt

SEQ ID NO: 22627 - DNA, 513 bp, Artificial Sequence
  chemically treated genomic DNA (Homo sapiens) CpG-island No: 22627
agcggggttaggaataatagatttagtattgagttttcgcggtttattcggtttaggattggttgaagttgggtcggtattgttgggttcggtgcggtacgcgtatgggtgggggcgttttaagaggttttagggcggagcgaggcggggcgagttcgggcgttttttcgtttatcgattagttaaggttcggcgggtattatttagttcgggatgtagcgcgtgtttgggcgggggcgattcgggaggtttcggatggaacgaggcggagcgagttttggtattttttcgtttattaggttaaggattggtcgaacgtttatacgggttcgtttgttttggttgcggcgcgtgtttgggcgggggcgagttaggaggttttaaggaggattgaggggaggcggggtcgggagttttttcgtttatcgggtttaggattggtcgaagttaggtaggtatcgtttcgttcgggcggtagttcgcgttcgcgcggcggcgtttttagaggcgcgt

SEQ ID NO: 22628 - DNA, 513 bp, Artificial Sequence
  chemically treated genomic DNA (Homo sapiens) CpG-island No: 22628
acgcgcctctaaaaacgccgccgcgcgaacgcgaactaccgcccgaacgaaacgatacctacctaacttcgaccaatcctaaacccgataaacgaaaaaactcccgaccccgcctcccctcaatcctccttaaaacctcctaactcgcccccgcccaaacacgcgccgcaaccaaaacaaacgaacccgtataaacgttcgaccaatccttaacctaataaacgaaaaaataccaaaactcgctccgcctcgttccatccgaaacctcccgaatcgcccccgcccaaacacgcgctacatcccgaactaaataatacccgccgaaccttaactaatcgataaacgaaaaaacgcccgaactcgccccgcctcgctccgccctaaaacctcttaaaacgcccccacccatacgcgtaccgcaccgaacccaacaataccgacccaacttcaaccaatcctaaaccgaataaaccgcgaaaactcaatactaaatctattattcctaaccccgct

SEQ ID NO: 22629 - DNA, 749 bp, Artificial Sequence
  chemically treated genomic DNA (Homo sapiens) CpG-island No: 22629
gtgcgcgcgcgtcgcggggaggtgttgtcgagggcggagcgggagggggcgtggtttcgcgcgggcggtcgttgacggcgaggtttcgtttcggatgtcgcgtgtcgttgaaagggcggcggcgattggtcggcgtcgcgggggcgggcggggcggaaggttttggagggggttggcgggttttggaagttttcgtcggacgggtatatagagttcgggattggtcggcggcggagtcgggggacggcgatagcgggtcggcgggtcgtaggagggggttatgggtaaagattattattagacgttgggtttggttcgcggcgcgtcggacgaggagattaagcgggtttatcgtcgttaggcgttgcgttattattcggataagaataaggagttcggcgtcgaggagaagtttaaggagatcgttgaggtttacgacgtgtttagcgattcgcgtaagcgcgagattttcgatcgttacggggaggaaggtgtgtgttcgcggttaggggcgcggtttcgttttttgatagatagggaaattgaggtacgttggtttttttcggcggattttcgggaaggacgtttcgggtcgtggggtcgagttgtttcgattttcggtttcgcgggttttcgatttcggattggcggacgcgcggtgggagtttaaaatataaagggtaggtgttattttattttgagttattaggggagtcgtagatagattcgtttagaaatcggtaaggttg

SEQ ID NO: 22630 - DNA, 749 bp, Artificial Sequence
  chemically treated genomic DNA (Homo sapiens) CpG-island No: 22630
caaccttaccgatttctaaacgaatctatctacgactcccctaataactcaaaataaaataacacctaccctttatattttaaactcccaccgcgcgtccgccaatccgaaatcgaaaacccgcgaaaccgaaaatcgaaacaactcgaccccacgacccgaaacgtccttcccgaaaatccgccgaaaaaaaccaacgtacctcaatttccctatctatcaaaaaacgaaaccgcgcccctaaccgcgaacacacaccttcctccccgtaacgatcgaaaatctcgcgcttacgcgaatcgctaaacacgtcgtaaacctcaacgatctccttaaacttctcctcgacgccgaactccttattcttatccgaataataacgcaacgcctaacgacgataaacccgcttaatctcctcgtccgacgcgccgcgaaccaaacccaacgtctaataataatctttacccataaccccctcctacgacccgccgacccgctatcgccgtcccccgactccgccgccgaccaatcccgaactctatatacccgtccgacgaaaacttccaaaacccgccaaccccctccaaaaccttccgccccgcccgcccccgcgacgccgaccaatcgccgccgccctttcaacgacacgcgacatccgaaacgaaacctcgccgtcaacgaccgcccgcgcgaaaccacgccccctcccgctccgccctcgacaacacctccccgcgacgcgcgcgcac

SEQ ID NO: 22631 - DNA, 749 bp, Artificial Sequence
  chemically treated genomic DNA (Homo sapiens) CpG-island No: 22631
tagttttatcgatttttgaacgagtttatttgcggtttttttggtggtttaagatggaatagtatttgttttttgtgttttgggtttttatcgcgcgttcgttaattcgaggtcggaggttcgcgaggtcggaggtcggggtagttcggttttacggttcggggcgtttttttcgggggttcgtcgagaggggttagcgtgttttagtttttttgtttgttaaaaggcggggtcgcgtttttggtcgcgagtatatattttttttttcgtagcggtcgaagatttcgcgtttgcgcgggtcgttgagtacgtcgtaggttttagcgatttttttgaattttttttcggcgtcgggttttttgtttttgttcgggtggtagcgtagcgtttggcggcggtaggttcgtttgattttttcgttcgacgcgtcgcgggttaggtttaacgtttggtagtagtttttatttatgatttttttttgcggttcgtcgattcgttgtcgtcgtttttcggtttcgtcgtcgattagtttcggattttatatattcgttcggcggaagtttttagagttcgttagttttttttagaatttttcgtttcgttcgttttcgcggcgtcggttaatcgtcgtcgtttttttagcgatacgcgatattcggggcggggtttcgtcgttaacggtcgttcgcgcggggttacgttttttttcgtttcgttttcggtaatattttttcgcggcgcgcgcgtat

SEQ ID NO: 22632 - DNA, 749 bp, Artificial Sequence
  chemically treated genomic DNA (Homo sapiens) CpG-island No: 22632
atacgcgcgcgccgcgaaaaaatattaccgaaaacgaaacgaaaaaaaacgtaaccccgcgcgaacgaccgttaacgacgaaaccccgccccgaatatcgcgtatcgctaaaaaaacgacgacgattaaccgacgccgcgaaaacgaacgaaacgaaaaattctaaaaaaaactaacgaactctaaaaacttccgccgaacgaatatataaaatccgaaactaatcgacgacgaaaccgaaaaacgacgacaacgaatcgacgaaccgcaaaaaaaaatcataaataaaaactactaccaaacgttaaacctaacccgcgacgcgtcgaacgaaaaaatcaaacgaacctaccgccgccaaacgctacgctaccacccgaacaaaaacaaaaaacccgacgccgaaaaaaaattcaaaaaaatcgctaaaacctacgacgtactcaacgacccgcgcaaacgcgaaatcttcgaccgctacgaaaaaaaaaatatatactcgcgaccaaaaacgcgaccccgccttttaacaaacaaaaaaactaaaacacgctaacccctctcgacgaacccccgaaaaaaacgccccgaaccgtaaaaccgaactaccccgacctccgacctcgcgaacctccgacctcgaattaacgaacgcgcgataaaaacccaaaacacaaaaaacaaatactattccatcttaaaccaccaaaaaaaccgcaaataaactcgttcaaaaatcgataaaacta

SEQ ID NO: 22633 - DNA, 616 bp, Artificial Sequence
  chemically treated genomic DNA (Homo sapiens) CpG-island No: 22633
ttattcgtgatgatgtcgtcgtaatcgtcgcgttgaacgttttgatttacgtcgtatagtataacgaaaatttgttggttgtcgttgttaatgtcgttcgcgttcgcgttattttgggtgaaattttcgatgcgttggaagtcgttttcgatcgttatttggtgttaagttagtgtgttatcggcgtgattgcgtaaagttattattagtttgagaaatcggttttcgagttcgatgttattgttgcgtaaacggagtagttttttgtcgataatggtcgtcgttcgcgtattttgatcgttaagatgggttaggatggatacgatcgcggcgcgaaagtgatcgttagcgtttatttcgatttcggtttcgacgtagatttaagttcgatgttttttatatttgaagagatcgttcgtttggtcgtagaaaacgacgtttacgtagtgggcgttatttttattggttgtcggttttaaacgttgatttcggattgtcgagcgttgaaaaatgggacggagatattgttgttcgggtgggtatacgcgagataagtttttgaaatcgggtggggattaggttagttttatgttaagtggcgatttgattgtatcga

SEQ ID NO: 22634 - DNA, 616 bp, Artificial Sequence
  chemically treated genomic DNA (Homo sapiens) CpG-island No: 22634
tcgatacaatcaaatcgccacttaacataaaactaacctaatccccacccgatttcaaaaacttatctcgcgtatacccacccgaacaacaatatctccgtcccatttttcaacgctcgacaatccgaaatcaacgtttaaaaccgacaaccaataaaaataacgcccactacgtaaacgtcgttttctacgaccaaacgaacgatctcttcaaatataaaaaacatcgaacttaaatctacgtcgaaaccgaaatcgaaataaacgctaacgatcactttcgcgccgcgatcgtatccatcctaacccatcttaacgatcaaaatacgcgaacgacgaccattatcgacaaaaaactactccgtttacgcaacaataacatcgaactcgaaaaccgatttctcaaactaataataactttacgcaatcacgccgataacacactaacttaacaccaaataacgatcgaaaacgacttccaacgcatcgaaaatttcacccaaaataacgcgaacgcgaacgacattaacaacgacaaccaacaaattttcgttatactatacgacgtaaatcaaaacgttcaacgcgacgattacgacgacatcatcacgaataa

SEQ ID NO: 22635 - DNA, 616 bp, Artificial Sequence
  chemically treated genomic DNA (Homo sapiens) CpG-island No: 22635
tcggtataattaaatcgttatttggtataggattgatttaatttttattcggttttagaagtttatttcgcgtatatttattcggatagtaatattttcgttttattttttagcgttcgatagttcgggattagcgtttaggatcggtagttagtgaggatggcgtttattacgtgaacgtcgttttttacggttaggcgggcgatttttttaggtgtagagaatatcgggtttaaatttacgtcgaaatcgagatcggaataggcgttggcgattattttcgcgtcgcgatcgtgtttattttggtttattttagcgattagaatgcgcgggcgacgattattgtcggtaaggaattgtttcgtttgcgtaataatggtatcgaattcggaggtcgattttttagattgatgatagttttgcgtaattacgtcggtaatatattggtttggtattagataacggtcgaaagcgatttttagcgtatcggaaattttatttagggtggcgcgaacgcgagcggtattaatagcggtagttagtaggttttcgttatgttgtgcggcgtgagttagggcgtttaacgcggcggttacggcggtattattacgggtgg

SEQ ID NO: 22636 - DNA, 616 bp, Artificial Sequence
  chemically treated genomic DNA (Homo sapiens) CpG-island No: 22636
ccacccgtaataataccgccgtaaccgccgcgttaaacgccctaactcacgccgcacaacataacgaaaacctactaactaccgctattaataccgctcgcgttcgcgccaccctaaataaaatttccgatacgctaaaaatcgctttcgaccgttatctaataccaaaccaatatattaccgacgtaattacgcaaaactatcatcaatctaaaaaatcgacctccgaattcgataccattattacgcaaacgaaacaattccttaccgacaataatcgtcgcccgcgcattctaatcgctaaaataaaccaaaataaacacgatcgcgacgcgaaaataatcgccaacgcctattccgatctcgatttcgacgtaaatttaaacccgatattctctacacctaaaaaaatcgcccgcctaaccgtaaaaaacgacgttcacgtaataaacgccatcctcactaactaccgatcctaaacgctaatcccgaactatcgaacgctaaaaaataaaacgaaaatattactatccgaataaatatacgcgaaataaacttctaaaaccgaataaaaattaaatcaatcctataccaaataacgatttaattataccga

SEQ ID NO: 22637 - DNA, 611 bp, Artificial Sequence
  chemically treated genomic DNA (Homo sapiens) CpG-island No: 22637
aatacgcgcggaatgtttttttagaagtcgtcgtcggttaagtgcgtaatggtatgtatatcgatttttttaattaattttagtattgattttacgtaaatgcgggtcggtgttagtagatgatcggttaatggtttattattaagttcggtggtttgcggattataatcgttgattttaagaattttgcgtattagcgaatagtcgttcgagtgtggatcgttggaatcgagtgtaattagtatatcgtcgtcgttgattttagagtcgtcgatgatttttgatttttttattacgttaacgtagaaattcgcgatatcgtaatttttatcgtgatatattttcggtatttttgtcgtttttttatttattagtgaataatttgattgtatatattagtcgtaatatttatcgcggcgatcgcggttttaatttgtttttttggaagtatatggcgtttgtattagtatggcgattttgtaaggacgaggatacgtttggtatttaaaacgaacggcgtgtgtaatggcgcgataaatgttttgttttataatttgtaaagatatcgtcgcgtagtttttatttatggtttgcgttgagtaatagtaatt

SEQ ID NO: 22638 - DNA, 611 bp, Artificial Sequence
  chemically treated genomic DNA (Homo sapiens) CpG-island No: 22638
aattactattactcaacgcaaaccataaataaaaactacgcgacgatatctttacaaattataaaacaaaacatttatcgcgccattacacacgccgttcgttttaaataccaaacgtatcctcgtccttacaaaatcgccatactaatacaaacgccatatacttccaaaaaaacaaattaaaaccgcgatcgccgcgataaatattacgactaatatatacaatcaaattattcactaataaataaaaaaacgacaaaaataccgaaaatatatcacgataaaaattacgatatcgcgaatttctacgttaacgtaataaaaaaatcaaaaatcatcgacgactctaaaatcaacgacgacgatatactaattacactcgattccaacgatccacactcgaacgactattcgctaatacgcaaaattcttaaaatcaacgattataatccgcaaaccaccgaacttaataataaaccattaaccgatcatctactaacaccgacccgcatttacgtaaaatcaatactaaaattaattaaaaaaatcgatatacataccattacgcacttaaccgacgacgacttctaaaaaaacattccgcgcgtatt

SEQ ID NO: 22639 - DNA, 611 bp, Artificial Sequence
  chemically treated genomic DNA (Homo sapiens) CpG-island No: 22639
gattattattatttaacgtaggttatgagtgaaaattacgcggcgatgtttttgtaagttgtggagtaggatatttgtcgcgttattgtatacgtcgttcgttttgagtgttagacgtattttcgtttttataaagtcgttatgttgatgtaagcgttatatatttttaggaaggtagattgaagtcgcgatcgtcgcgatggatgttgcggttgatgtatgtaattaggttgtttattggtgggtggggaaacggtagaaatgtcggggatgtattacggtgaggattacgatgtcgcgggtttttgcgttggcgtggtagaaaaattagaaattatcgacggttttaaagttagcgacggcgatgtgttgattgtattcggttttagcggtttatattcgaacggttattcgttggtgcgtaaaatttttgaagttagcggttgtgattcgtaaattatcgaatttgatggtaagttattagtcgattatttgttggtatcgattcgtatttacgtgaagttagtgttggagttgattgaaaaggtcgatgtgtatgttattgcgtatttgatcggcggcggtttttgggaaaatatttcgcgcgtatt

SEQ ID NO: 22640 - DNA, 611 bp, Artificial Sequence
  chemically treated genomic DNA (Homo sapiens) CpG-island No: 22640
aatacgcgcgaaatattttcccaaaaaccgccgccgatcaaatacgcaataacatacacatcgaccttttcaatcaactccaacactaacttcacgtaaatacgaatcgataccaacaaataatcgactaataacttaccatcaaattcgataatttacgaatcacaaccgctaacttcaaaaattttacgcaccaacgaataaccgttcgaatataaaccgctaaaaccgaatacaatcaacacatcgccgtcgctaactttaaaaccgtcgataatttctaatttttctaccacgccaacgcaaaaacccgcgacatcgtaatcctcaccgtaatacatccccgacatttctaccgtttccccacccaccaataaacaacctaattacatacatcaaccgcaacatccatcgcgacgatcgcgacttcaatctaccttcctaaaaatatataacgcttacatcaacataacgactttataaaaacgaaaatacgtctaacactcaaaacgaacgacgtatacaataacgcgacaaatatcctactccacaacttacaaaaacatcgccgcgtaattttcactcataacctacgttaaataataataatc

SEQ ID NO: 22641 - DNA, 868 bp, Artificial Sequence
  chemically treated genomic DNA (Homo sapiens) CpG-island No: 22641
atgattattgatcgtttcgggtagatgacggcggtgtatcgcgaggaagggttgagttagtatcgcgtatacgatagtcgtggatagttaattgtcgtgaaagatacgtagggttatgaaacgcggtatgaatataatatcgtcggtgatttgatcgtcgttattgtttcggacggtagtagaaacgggatatagtacgatgcgtggggaaaggtcgttcgtattacgtagggcgggttgacgcgtagtatggaatacgatgttgtcggacgggttattcgtttgattagtgaaaacggtagttatattatttttcgttacgatgtatttgatcggttgatataggaaatcggttttgacggtcgtatatagcgttattattacgatttgatcggtaaatttattcgtagcgaggatgagggtttggtgcgggttgttgatgcggatgagttcgtcgttgtcgttttaggtgtaatcgcggttagatagtaggttgtttaggtgttggttttgtaattgttcggtaggggtataagcggtggtgagtttataacggtcgaagttgcgtagcgtttttcggtgtaggcggtcgcgggtgtattttattagcggtgtgtcgtcgagttttatgtttgttaggtaatcgttgtcgtaggttagttattttacggcgggtaggttgttcggtatatagcggttcgttagtttttgcgcgttgtacgtatgtttggttttatgttgttagagtagtgttttcgtttgcgggtgatgtatcgtttgacgtttatcggttagtcggttttttttattatatttgtaatgtatcgttattcggtgtttttcgttgatatggttgatgtttgttagt

SEQ ID NO: 22642 - DNA, 868 bp, Artificial Sequence
  chemically treated genomic DNA (Homo sapiens) CpG-island No: 22642
actaacaaacatcaaccatatcaacgaaaaacaccgaataacgatacattacaaatataataaaaaaaaccgactaaccgataaacgtcaaacgatacatcacccgcaaacgaaaacactactctaacaacataaaaccaaacatacgtacaacgcgcaaaaactaacgaaccgctatataccgaacaacctacccgccgtaaaataactaacctacgacaacgattacctaacaaacataaaactcgacgacacaccgctaataaaatacacccgcgaccgcctacaccgaaaaacgctacgcaacttcgaccgttataaactcaccaccgcttatacccctaccgaacaattacaaaaccaacacctaaacaacctactatctaaccgcgattacacctaaaacgacaacgacgaactcatccgcatcaacaacccgcaccaaaccctcatcctcgctacgaataaatttaccgatcaaatcgtaataataacgctatatacgaccgtcaaaaccgatttcctatatcaaccgatcaaatacatcgtaacgaaaaataatataactaccgttttcactaatcaaacgaataacccgtccgacaacatcgtattccatactacgcgtcaacccgccctacgtaatacgaacgacctttccccacgcatcgtactatatcccgtttctactaccgtccgaaacaataacgacgatcaaatcaccgacgatattatattcataccgcgtttcataaccctacgtatctttcacgacaattaactatccacgactatcgtatacgcgatactaactcaacccttcctcgcgatacaccgccgtcatctacccgaaacgatcaataatcat

SEQ ID NO: 22643 - DNA, 868 bp, Artificial Sequence
  chemically treated genomic DNA (Homo sapiens) CpG-island No: 22643
gttgatagatattagttatattagcgaagggtatcgggtggcggtgtattataggtatgatgagaaaggtcggttgatcggtgagcgttagacggtgtattattcgtagacggaagtattgttttggtagtatgagattagatatgcgtataacgcgtaggggttggcgaatcgttgtatatcggatagtttgttcgtcgtggaatggttgatttacggtagcggttatttggtaggtatgaaattcggcgatatatcgttggtggagtatattcgcgatcgtttgtatcgggaaacgttgcgtagtttcggtcgttatgaatttattatcgtttatatttttgtcgggtagttatagagttagtatttgaatagtttgttgtttgatcgcgattatatttggaacgataacggcgaatttattcgtattagtagttcgtattagatttttattttcgttgcggataagtttgtcggttaggtcgtggtgataacgttgtgtgcggtcgttaaagtcggttttttgtattagtcggttaagtatatcgtaacggaaggtggtgtggttgtcgtttttattggttaggcggatgattcgttcggtagtatcgtattttatattgcgcgttagttcgttttgcgtggtacggacggtttttttttacgtatcgtattgtgtttcgtttttgttgtcgttcggggtaatgacggcggttaggttatcggcgatgttgtatttatatcgcgttttatggttttgcgtgttttttacggtaattaattgtttacggttgtcgtatgcgcggtattgatttagttttttttcgcggtgtatcgtcgttatttgttcgaagcggttagtggttat

SEQ ID NO: 22644 - DNA, 868 bp, Artificial Sequence
  chemically treated genomic DNA (Homo sapiens) CpG-island No: 22644
ataaccactaaccgcttcgaacaaataacgacgatacaccgcgaaaaaaaactaaatcaataccgcgcatacgacaaccgtaaacaattaattaccgtaaaaaacacgcaaaaccataaaacgcgatataaatacaacatcgccgataacctaaccgccgtcattaccccgaacgacaacaaaaacgaaacacaatacgatacgtaaaaaaaaaccgtccgtaccacgcaaaacgaactaacgcgcaatataaaatacgatactaccgaacgaatcatccgcctaaccaataaaaacgacaaccacaccaccttccgttacgatatacttaaccgactaatacaaaaaaccgactttaacgaccgcacacaacgttatcaccacgacctaaccgacaaacttatccgcaacgaaaataaaaatctaatacgaactactaatacgaataaattcgccgttatcgttccaaatataatcgcgatcaaacaacaaactattcaaatactaactctataactacccgacaaaaatataaacgataataaattcataacgaccgaaactacgcaacgtttcccgatacaaacgatcgcgaatatactccaccaacgatatatcgccgaatttcatacctaccaaataaccgctaccgtaaatcaaccattccacgacgaacaaactatccgatatacaacgattcgccaacccctacgcgttatacgcatatctaatctcatactaccaaaacaatacttccgtctacgaataatacaccgtctaacgctcaccgatcaaccgacctttctcatcatacctataatacaccgccacccgatacccttcgctaatataactaatatctatcaac

SEQ ID NO: 22645 - DNA, 526 bp, Artificial Sequence
  chemically treated genomic DNA (Homo sapiens) CpG-island No: 22645
gagcggagcggggcgggggtgaagggtcggagaggaggggtgggaatcgggagaggaatcggaaaggtgggagaggttcggtcgtcggtcgtcgtgggtttgtggatacgcgggaatgtgttcggagagggagtgcggagtcgtgaggtcgtttggaaatttttggaaggggtttacgaagaagtagtggtcgggaaaaggtgaagttcgtcgagggggcgtggacgtttgaatcgtttcgaagtgtgcgtggtcgcggtcggaagtgcgttttttttggacggatggatcgtttcggaagggaggtcgcgcgttaggtgaggttgcggatcggaatgagaggcggaaggggagggtgacgtaagggaagggagtcggaaggcgaggtgaggaggggagttgaaggggggcggagagggaggaaggacgcggaaagttgcgaagtgaaggggggggcgaggggtggggaaagggaaggtcgtgaaagaaatagtagttggtaattttatttatattgttttgtggt

SEQ ID NO: 22646 - DNA, 526 bp, Artificial Sequence
  chemically treated genomic DNA (Homo sapiens) CpG-island No: 22646
accacaaaacaatataaataaaattaccaactactatttctttcacgaccttccctttccccacccctcgccccccccttcacttcgcaactttccgcgtccttcctccctctccgccccccttcaactcccctcctcacctcgccttccgactcccttcccttacgtcaccctccccttccgcctctcattccgatccgcaacctcacctaacgcgcgacctcccttccgaaacgatccatccgtccaaaaaaaacgcacttccgaccgcgaccacgcacacttcgaaacgattcaaacgtccacgccccctcgacgaacttcaccttttcccgaccactacttcttcgtaaaccccttccaaaaatttccaaacgacctcacgactccgcactccctctccgaacacattcccgcgtatccacaaacccacgacgaccgacgaccgaacctctcccacctttccgattcctctcccgattcccacccctcctctccgacccttcacccccgccccgctccgctc

SEQ ID NO: 22647 - DNA, 526 bp, Artificial Sequence
  chemically treated genomic DNA (Homo sapiens) CpG-island No: 22647
gttataagataatatagatgaggttattagttattattttttttacggttttttttttttttatttttcgtttttttttttatttcgtaatttttcgcgtttttttttttttttcgtttttttttagtttttttttttatttcgtttttcgattttttttttttgcgttatttttttttttcgttttttatttcggttcgtagttttatttggcgcgcggtttttttttcggagcggtttattcgtttaggggaggcgtattttcggtcgcgattacgtatatttcggggcggtttaggcgtttacgttttttcggcggattttattttttttcggttattattttttcgtgagttttttttaggggtttttaggcggttttacgatttcgtatttttttttcggatatattttcgcgtgtttatagatttacggcggtcggcggtcggattttttttattttttcggtttttttttcggtttttatttttttttttcggttttttattttcgtttcgtttcgttt

SEQ ID NO: 22648 - DNA, 526 bp, Artificial Sequence
  chemically treated genomic DNA (Homo sapiens) CpG-island No: 22648
aaacgaaacgaaacgaaaataaaaaaccgaaaaaaaaaaataaaaaccgaaaaaaaaaccgaaaaaataaaaaaaatccgaccgccgaccgccgtaaatctataaacacgcgaaaatatatccgaaaaaaaaatacgaaatcgtaaaaccgcctaaaaacccctaaaaaaaactcacgaaaaaataataaccgaaaaaaaataaaatccgccgaaaaaacgtaaacgcctaaaccgccccgaaatatacgtaatcgcgaccgaaaatacgcctcccctaaacgaataaaccgctccgaaaaaaaaaccgcgcgccaaataaaactacgaaccgaaataaaaaacgaaaaaaaaaaataacgcaaaaaaaaaaaatcgaaaaacgaaataaaaaaaaaaactaaaaaaaaacgaaaaaaaaaaaaaaacgcgaaaaattacgaaataaaaaaaaaaacgaaaaataaaaaaaaaaaaaaccgtaaaaaaaataataactaataacctcatctatattatcttataac

SEQ ID NO: 22649 - DNA, 975 bp, Artificial Sequence
  chemically treated genomic DNA (Homo sapiens) CpG-island No: 22649
agcggttagttgtcggtacgtgcgtatggtgtgagttcggtggtcggcgttacgttagtggttaatatttcgcgggtgaattgcgggattatcgtttgaattttattttgcgggttaattatcgtcgtaatgtcgttgttggtgttgcgtaatagtgggcgcgttagttttagcgtacgtattcgcgttatttggaagtgttgttatggattaatagatttattaaattacgtatcgttggagatagttagtagatagtcggtattcgggcggaagtatcgcgtatttgttcgtcgagaatgatttcgtagtaaatagcgcgtagtttaatattattgcgatagggggtggatattggttcggtgacgagattggcgattaagacgggtacgagcgattaattcggggaaatcgtaaaggtttaggtttggttacgacgtgatcgacgtaggttttttcggtttggcggatttataataatagtattatgtaagcgcgttaatgatgaagtcggtattggcggggagatagttttgtttaatttgtgatatcgcggcgttggtgggggatatagtcgtgtcgttggtgatgttaatgagtatgtcgcgaaatgttaatatgttcgcgagggtgataataaatgaagggattttacggtacgcgatttattattcgttttaggtatcgagaagtagttttagaattagcgttataatgatggtaagtggtaaaggttagtttaattagacgttataaatcgtcgcgacgttatttaatagttttattattgagtcgacggaaaggtcgattttagtagaaattatgacgaatattatttttatcgcgaggatgtcggtaatcgcggtttggcgtaataggttggagacgttacgggcgtttaagtaggtattatcggtggtttaggtaaagaatagtatgattgcgatgatagttgtaattattacgaagatttgt

SEQ ID NO: 22650 - DNA, 975 bp, Artificial Sequence
  chemically treated genomic DNA (Homo sapiens) CpG-island No: 22650
acaaatcttcgtaataattacaactatcatcgcaatcatactattctttacctaaaccaccgataatacctacttaaacgcccgtaacgtctccaacctattacgccaaaccgcgattaccgacatcctcgcgataaaaataatattcgtcataatttctactaaaatcgacctttccgtcgactcaataataaaactattaaataacgtcgcgacgatttataacgtctaattaaactaacctttaccacttaccatcattataacgctaattctaaaactacttctcgatacctaaaacgaataataaatcgcgtaccgtaaaatcccttcatttattatcaccctcgcgaacatattaacatttcgcgacatactcattaacatcaccaacgacacgactatatcccccaccaacgccgcgatatcacaaattaaacaaaactatctccccgccaataccgacttcatcattaacgcgcttacataatactattattataaatccgccaaaccgaaaaaacctacgtcgatcacgtcgtaaccaaacctaaacctttacgatttccccgaattaatcgctcgtacccgtcttaatcgccaatctcgtcaccgaaccaatatccaccccctatcgcaataatattaaactacgcgctatttactacgaaatcattctcgacgaacaaatacgcgatacttccgcccgaataccgactatctactaactatctccaacgatacgtaatttaataaatctattaatccataacaacacttccaaataacgcgaatacgtacgctaaaactaacgcgcccactattacgcaacaccaacaacgacattacgacgataattaacccgcaaaataaaattcaaacgataatcccgcaattcacccgcgaaatattaaccactaacgtaacgccgaccaccgaactcacaccatacgcacgtaccgacaactaaccgct

SEQ ID NO: 22651 - DNA, 975 bp, Artificial Sequence
  chemically treated genomic DNA (Homo sapiens) CpG-island No: 22651
gtaggttttcgtgatgattgtagttattatcgtaattatgttgttttttatttggattatcgatggtgtttatttaagcgttcgtaacgtttttaatttgttacgttagatcgcgattatcggtattttcgcggtaggaatggtgttcgttataatttttgttgaaatcgattttttcgtcggtttaatgatggggttgttaggtggcgtcgcggcgatttgtgacgtttggttaggttggtttttgttatttattattattgtgacgttggttttgggattgtttttcggtgtttggaacggatggtgggtcgcgtatcgtaaagtttttttatttattgttattttcgcgggtatgttggtatttcgcggtatatttattggtattattaacggtacgattgtattttttattagcgtcgcgatgttataaattgggtaaagttattttttcgttagtatcggttttattattggcgcgtttgtataatgttattgttgtggattcgttaaatcggaagggtttacgtcgattacgtcgtaattaaatttgggtttttgcgattttttcggattaatcgttcgtattcgttttgatcgttagtttcgttatcgggttaatatttattttttgtcgtaatggtattgagttacgcgttatttgttacgagattattttcggcgagtaagtgcgcgatattttcgttcggatatcgattatttgttgattatttttaacgatgcgtggtttggtaaatttattggtttatggtaatatttttagatggcgcgaatgcgtgcgttggagttggcgcgtttattgttgcgtagtattaataacggtattacggcggtgattggttcgtagggtgagatttaggcgatgatttcgtagtttattcgcgaggtgttaattattaacgtgacgtcgattatcggatttatattatacgtacgtatcggtaattggtcgtt

SEQ ID NO: 22652 - DNA, 975 bp, Artificial Sequence
  chemically treated genomic DNA (Homo sapiens) CpG-island No: 22652
aacgaccaattaccgatacgtacgtataatataaatccgataatcgacgtcacgttaataattaacacctcgcgaataaactacgaaatcatcgcctaaatctcaccctacgaaccaatcaccgccgtaataccgttattaatactacgcaacaataaacgcgccaactccaacgcacgcattcgcgccatctaaaaatattaccataaaccaataaatttaccaaaccacgcatcgttaaaaataatcaacaaataatcgatatccgaacgaaaatatcgcgcacttactcgccgaaaataatctcgtaacaaataacgcgtaactcaataccattacgacaaaaaataaatattaacccgataacgaaactaacgatcaaaacgaatacgaacgattaatccgaaaaaatcgcaaaaacccaaatttaattacgacgtaatcgacgtaaacccttccgatttaacgaatccacaacaataacattatacaaacgcgccaataataaaaccgatactaacgaaaaaataactttacccaatttataacatcgcgacgctaataaaaaatacaatcgtaccgttaataataccaataaatataccgcgaaataccaacatacccgcgaaaataacaataaataaaaaaactttacgatacgcgacccaccatccgttccaaacaccgaaaaacaatcccaaaaccaacgtcacaataataataaataacaaaaaccaacctaaccaaacgtcacaaatcgccgcgacgccacctaacaaccccatcattaaaccgacgaaaaaatcgatttcaacaaaaattataacgaacaccattcctaccgcgaaaataccgataatcgcgatctaacgtaacaaattaaaaacgttacgaacgcttaaataaacaccatcgataatccaaataaaaaacaacataattacgataataactacaatcatcacgaaaacctac

SEQ ID NO: 22653 - DNA, 508 bp, Artificial Sequence
  chemically treated genomic DNA (Homo sapiens) CpG-island No: 22653
tttttgagtttttatcggatcgatatcggatttttagatgttaatttcgcgtttaataattttagttagtttcgggttgggcgcgtttgtttgttagttttatagcgcgcgttttcgtcgagtcgcggcgggttatttatttgcggcggtggttgggtttttcgtgcggtcggacggcggtttaggtttcgcgtcgttgttggcgtcgttaggggacggcggcggcggttttttttttttgcgtcgggtagtggagggttgggtgtttttacggggtatggtcgttggggtcgggggatagtcgggagtaagttagttcgcgggtcgttatatcgcgttcgttttattcggggaaatttcggtttatcggttttcgagagtttcgtttaatatttcgtttagaggtagcgggatttcgggaagggagttatcgaaagatacgagtggtaagaaggtaggattggttttttaataagatttatgtaagtgggaaaatttagacgtgttt

SEQ ID NO: 22654 - DNA, 508 bp, Artificial Sequence
  chemically treated genomic DNA (Homo sapiens) CpG-island No: 22654
aaacacgtctaaattttcccacttacataaatcttattaaaaaaccaatcctaccttcttaccactcgtatctttcgataactcccttcccgaaatcccgctacctctaaacgaaatattaaacgaaactctcgaaaaccgataaaccgaaatttccccgaataaaacgaacgcgatataacgacccgcgaactaacttactcccgactatcccccgaccccaacgaccataccccgtaaaaacacccaaccctccactacccgacgcaaaaaaaaaaaaccgccgccgccgtcccctaacgacgccaacaacgacgcgaaacctaaaccgccgtccgaccgcacgaaaaacccaaccaccgccgcaaataaataacccgccgcgactcgacgaaaacgcgcgctataaaactaacaaacaaacgcgcccaacccgaaactaactaaaattattaaacgcgaaattaacatctaaaaatccgatatcgatccgataaaaactcaaaaa

SEQ ID NO: 22655 - DNA, 508 bp, Artificial Sequence
  chemically treated genomic DNA (Homo sapiens) CpG-island No: 22655
aggtacgtttagatttttttatttatataggttttgttaagaaattagttttgtttttttgttattcgtgtttttcgatggtttttttttcgaagtttcgttgtttttaagcggagtgttaagcggggttttcggaagtcggtggatcgagattttttcgggtggggcgggcgcggtgtagcggttcgcgggttgatttgttttcggttgtttttcggttttagcgattatgtttcgtaaaggtatttagttttttattgttcggcgtagagaggaagggtcgtcgtcgtcgttttttgacggcgttagtagcgacgcggagtttgagtcgtcgttcggtcgtacggagagtttagttatcgtcgtaggtgagtgattcgtcgcgattcggcgggaacgcgcgttgtgggattggtaggtaaacgcgtttagttcgaggttggttggggttgttgagcgcggagttgatatttgaaggttcggtgtcggttcggtagaggtttaggaa

SEQ ID NO: 22656 - DNA, 508 bp, Artificial Sequence
  chemically treated genomic DNA (Homo sapiens) CpG-island No: 22656
ttcctaaacctctaccgaaccgacaccgaaccttcaaatatcaactccgcgctcaacaaccccaaccaacctcgaactaaacgcgtttacctaccaatcccacaacgcgcgttcccgccgaatcgcgacgaatcactcacctacgacgataactaaactctccgtacgaccgaacgacgactcaaactccgcgtcgctactaacgccgtcaaaaaacgacgacgacgacccttcctctctacgccgaacaataaaaaactaaatacctttacgaaacataatcgctaaaaccgaaaaacaaccgaaaacaaatcaacccgcgaaccgctacaccgcgcccgccccacccgaaaaaatctcgatccaccgacttccgaaaaccccgcttaacactccgcttaaaaacaacgaaacttcgaaaaaaaaaccatcgaaaaacacgaataacaaaaaaacaaaactaatttcttaacaaaacctatataaataaaaaaatctaaacgtacct

SEQ ID NO: 22657 - DNA, 644 bp, Artificial Sequence
  chemically treated genomic DNA (Homo sapiens) CpG-island No: 22657
cggttgtcgagttttgcgtttcggaaggcgttttttcggttcgtggggttcggaagatagaagggtttatggatgggtaggggaaggaagaagatgcgggtttttaaaggcgcgtggtggcgaggtgaggcgcggcgcggcgcggggttgtgaggtttcggaggtgttttagtttaaggtggttagaggtttaatgtgacgttacggtaatttcgggtcgttagacgggatttcgggtttcgggattttgggttattaagcgtgttaagcgtagttagttcgtgcgcgcgcgcgtatttttatttatatttatatttgtttcgggaggtttgtgtagttggcgaggaacgttaaaaattttgattttttttgttcggcgttgaattttattttttttcgtttggagtttacgcgcgcgcgtatatatatataatttttttaaattattcgggagaagtaggagaaacgtttttttttgagtcgcgtaggtttcgggcgtagcgcgtttatttttttttttgcggttcggaggaggcgagaggtaatcggggcggcgagggaggagagaatataaaagaagagataggagaaaagtgggggagaaaggtaagagggagaaggaggaggggagaggggagatagga

SEQ ID NO: 22658 - DNA, 644 bp, Artificial Sequence
  chemically treated genomic DNA (Homo sapiens) CpG-island No: 22658
tcctatctcccctctcccctcctccttctccctcttacctttctcccccacttttctcctatctcttcttttatattctctcctccctcgccgccccgattacctctcgcctcctccgaaccgcaaaaaaaaaaataaacgcgctacgcccgaaacctacgcgactcaaaaaaaaacgtttctcctacttctcccgaataatttaaaaaaattatatatatatacgcgcgcgcgtaaactccaaacgaaaaaaaataaaattcaacgccgaacaaaaaaaatcaaaatttttaacgttcctcgccaactacacaaacctcccgaaacaaatataaatataaataaaaatacgcgcgcgcgcacgaactaactacgcttaacacgcttaataacccaaaatcccgaaacccgaaatcccgtctaacgacccgaaattaccgtaacgtcacattaaacctctaaccaccttaaactaaaacacctccgaaacctcacaaccccgcgccgcgccgcgcctcacctcgccaccacgcgcctttaaaaacccgcatcttcttccttcccctacccatccataaacccttctatcttccgaaccccacgaaccgaaaaaacgccttccgaaacgcaaaactcgacaaccg

SEQ ID NO: 22659 - DNA, 644 bp, Artificial Sequence
  chemically treated genomic DNA (Homo sapiens) CpG-island No: 22659
ttttgtttttttttttttttttttttttttttttttgttttttttttttattttttttttgtttttttttttgtatttttttttttttcgtcgtttcggttgtttttcgtttttttcgggtcgtaggggaggaggtgagcgcgttgcgttcggggtttgcgcggtttagagggaggcgttttttttatttttttcgggtaatttggagaggttgtgtgtgtgtgcgcgcgcgcgtgagttttaggcgaaaaggggtaggatttagcgtcgagtagagagggttagggtttttgacgtttttcgttagttgtataaatttttcggagtaagtgtgagtgtgggtgagagtgcgcgcgcgcgtacgggttggttgcgtttggtacgtttggtggtttagggtttcggggttcggggtttcgtttggcggttcgggattatcgtgacgttatattgagtttttggttattttggattgggatattttcggagttttatagtttcgcgtcgcgtcgcgttttatttcgttattacgcgtttttgggaattcgtattttttttttttttttgtttatttatgggtttttttgtttttcggattttacgggtcggaggggcgtttttcggagcgtagggttcggtagtcg

SEQ ID NO: 22660 - DNA, 644 bp, Artificial Sequence
  chemically treated genomic DNA (Homo sapiens) CpG-island No: 22660
cgactaccgaaccctacgctccgaaaaacgcccctccgacccgtaaaatccgaaaaacaaaaaaacccataaataaacaaaaaaaaaaaaaaaatacgaattcccaaaaacgcgtaataacgaaataaaacgcgacgcgacgcgaaactataaaactccgaaaatatcccaatccaaaataaccaaaaactcaatataacgtcacgataatcccgaaccgccaaacgaaaccccgaaccccgaaaccctaaaccaccaaacgtaccaaacgcaaccaacccgtacgcgcgcgcgcactctcacccacactcacacttactccgaaaaatttatacaactaacgaaaaacgtcaaaaaccctaaccctctctactcgacgctaaatcctaccccttttcgcctaaaactcacgcgcgcgcgcacacacacacaacctctccaaattacccgaaaaaaataaaaaaaacgcctccctctaaaccgcgcaaaccccgaacgcaacgcgctcacctcctcccctacgacccgaaaaaaacgaaaaacaaccgaaacgacgaaaaaaaaaaaaatacaaaaaaaaaaacaaaaaaaaaataaaaaaaaaaaacaaaaaaaaaaaaaaaaaaaaaaaaaaaaaaacaaaa

SEQ ID NO: 22661 - DNA, 975 bp, Artificial Sequence
  chemically treated genomic DNA (Homo sapiens) CpG-island No: 22661
ggggcggcgagaacgatttcggtttaggcgggaaaggaaagatggaaagggggcgtaggaaatgggcgttaaagaaagaagtgagaaattgcggaggaggaagtcgtttttggaagaggcggggtaaaggggaagcgagaatggagtgtttgtattttcgagagggaagggttagagtttttttcgattagggtcggcggggcggacgtttggggaaggggcgttcgggcgggttgagggggcggcgcggtgtttaaggttttcggggtttttatttgaatcgtttttgtttcgtcgtgttttagagttgtagtttgatttttttgttcggttcgatttttagtaggcgggagaagaagtttacgtcgacggtggggtcgtaggcgggggagcgtagttcggggaagcggttttgggtgaagcggtgtaggaggtaggatttgtttacggtggagttttcgattacgatgaggcggaattggtagatttagatggtttttatcgtttacgtgtttcgttggttttcgggtcgttttattcgcgggttaagttcggcggcgggaattgtttttttagtatttcgcgggcgttcgttcgtcgttttttagtatatttttgcggttgcggtcgtcgtttggtgttcgttttttcgggagagagaggcggggttaggttcggttaggggcggggtttttggacgggggcggggcgggggcggtggcgcgtgggagggggaagtaggtttgttgtcgcgaattttcgtttttgatcggttgtaaattatttttttttaacgtttattgggcgtcggtaggaaagtgggcgtggcgggaagacgtgatagtagtaataattaaggaaaatgaagtaaggttttaatttcgggagggttagttaatgaaaagtgagagtcgtttttttataggcgttagggcgggttggttagattagggttttgattttggaagtttttga

SEQ ID NO: 22662 - DNA, 975 bp, Artificial Sequence
  chemically treated genomic DNA (Homo sapiens) CpG-island No: 22662
tcaaaaacttccaaaatcaaaaccctaatctaaccaacccgccctaacgcctataaaaaaacgactctcacttttcattaactaaccctcccgaaattaaaaccttacttcattttccttaattattactactatcacgtcttcccgccacgcccactttcctaccgacgcccaataaacgttaaaaaaaaataatttacaaccgatcaaaaacgaaaattcgcgacaacaaacctacttccccctcccacgcgccaccgcccccgccccgcccccgtccaaaaaccccgcccctaaccgaacctaaccccgcctctctctcccgaaaaaacgaacaccaaacgacgaccgcaaccgcaaaaatatactaaaaaacgacgaacgaacgcccgcgaaatactaaaaaaacaattcccgccgccgaacttaacccgcgaataaaacgacccgaaaaccaacgaaacacgtaaacgataaaaaccatctaaatctaccaattccgcctcatcgtaatcgaaaactccaccgtaaacaaatcctacctcctacaccgcttcacccaaaaccgcttccccgaactacgctcccccgcctacgaccccaccgtcgacgtaaacttcttctcccgcctactaaaaatcgaaccgaacaaaaaaatcaaactacaactctaaaacacgacgaaacaaaaacgattcaaataaaaaccccgaaaaccttaaacaccgcgccgccccctcaacccgcccgaacgccccttccccaaacgtccgccccgccgaccctaatcgaaaaaaactctaacccttccctctcgaaaatacaaacactccattctcgcttcccctttaccccgcctcttccaaaaacgacttcctcctccgcaatttctcacttctttctttaacgcccatttcctacgccccctttccatctttcctttcccgcctaaaccgaaatcgttctcgccgcccc

SEQ ID NO: 22663 - DNA, 975 bp, Artificial Sequence
  chemically treated genomic DNA (Homo sapiens) CpG-island No: 22663
ttagggatttttaaaattagagttttaatttgattaattcgttttgacgtttgtaagaaaacgatttttattttttattggttgattttttcggagttgagattttgttttattttttttggttgttgttgttgttacgttttttcgttacgtttatttttttgtcggcgtttagtgagcgttgagggagagtgatttgtagtcggttaggggcgggagttcgcggtagtaaatttgttttttttttttacgcgttatcgttttcgtttcgttttcgtttagaggtttcgtttttagtcgggtttggtttcgtttttttttttcgagagggcgggtattaggcggcggtcgtagtcgtaggaatatgttggaaggcggcgggcgggcgttcgcgaggtgttgaaaggatagttttcgtcgtcgaatttagttcgcgggtggggcggttcgggagttagcggggtacgtgagcgatggagattatttggatttattagtttcgttttatcgtgatcggggattttatcgtgggtaagttttgttttttgtatcgttttatttagggtcgttttttcgggttgcgttttttcgtttgcgattttatcgtcggcgtggattttttttttcgtttgttggagatcgagtcgggtaagaggattaagttatagttttgggatacggcgggataggagcggtttaggtagggatttcggggattttgggtatcgcgtcgtttttttagttcgttcggacgttttttttttaggcgttcgtttcgtcggttttggtcgggagaggttttggtttttttttttcgaaagtgtaaatattttattttcgttttttttttgtttcgttttttttagggacgattttttttttcgtaattttttatttttttttttggcgtttattttttgcgttttttttttattttttttttttcgtttgaatcggggtcgttttcgtcgtttt

SEQ ID NO: 22664 - DNA, 975 bp, Artificial Sequence
  chemically treated genomic DNA (Homo sapiens) CpG-island No: 22664
aaaacgacgaaaacgaccccgattcaaacgaaaaaaaaaaaataaaaaaaaaacgcaaaaaataaacgccaaaaaaaaaaataaaaaattacgaaaaaaaaaatcgtccctaaaaaaaacgaaacaaaaaaaaaacgaaaataaaatatttacactttcgaaaaaaaaaaaccaaaacctctcccgaccaaaaccgacgaaacgaacgcctaaaaaaaaaacgtccgaacgaactaaaaaaacgacgcgatacccaaaatccccgaaatccctacctaaaccgctcctatcccgccgtatcccaaaactataacttaatcctcttacccgactcgatctccaacaaacgaaaaaaaaaatccacgccgacgataaaatcgcaaacgaaaaaacgcaacccgaaaaaacgaccctaaataaaacgatacaaaaaacaaaacttacccacgataaaatccccgatcacgataaaacgaaactaataaatccaaataatctccatcgctcacgtaccccgctaactcccgaaccgccccacccgcgaactaaattcgacgacgaaaactatcctttcaacacctcgcgaacgcccgcccgccgccttccaacatattcctacgactacgaccgccgcctaatacccgccctctcgaaaaaaaaaaacgaaaccaaacccgactaaaaacgaaacctctaaacgaaaacgaaacgaaaacgataacgcgtaaaaaaaaaaaacaaatttactaccgcgaactcccgcccctaaccgactacaaatcactctccctcaacgctcactaaacgccgacaaaaaaataaacgtaacgaaaaaacgtaacaacaacaacaaccaaaaaaaataaaacaaaatctcaactccgaaaaaatcaaccaataaaaaataaaaatcgttttcttacaaacgtcaaaacgaattaatcaaattaaaactctaattttaaaaatccctaa

SEQ ID NO: 22665 - DNA, 1067 bp, Artificial Sequence
  chemically treated genomic DNA (Homo sapiens) CpG-island No: 22665
gggggttgggcgggggtgatttttgggggataaggggcggtggagtttagggaatgttaaagttttgtcgcggttttcgacgcgcgtttttcgtttttcgtttttttttcgttttcgattgaggtcgggtttttcgtcggattgatgtcgcgcgtttgcgtgttgtggtcgaatcgtcgaatttagaggtcggttttagaaaattcgagcgagtagggggcggcgcgtaggagggaggagaattgggggcgcgggaggttggtgggtgtcgggggtggagatgtagaagatgtgacgtcgcggttcggcgggtgttagattagcggacgcggtgttcgcggttgtaacgggatttcgggcgttgtagtttgggaggcggttttttttaggcggcgttcgcggagatatttattcgtgaattttaggtttcgggtcgtcggttcgtcgcgtattaggggtcggcggatagaagagcggtcgagcggttcgaggttgggggatcgcgggcgcggtcgcgcgttgtcgggcgggaggttggggggtcggggtcggggtcgtgtttcggagcgggtcggaggtcggggtcggggtcgggggacggcggtttttcgcgcggttttagcggttcggggatttcggtcgggtttcgtagggattatggtagtcgggagtattattacgttgttcgttttgttcgaggatggcggtagcggcgttttttcgttcggttattttaaggattttaagcggttgtattgtaaaaacgggggtttttttttgcgtatttatttcgacggtcgagttgacggggttcgggagaagagcgatttttatagtgagtgtcgattcgtttttttcgttttatttttatttcgtgggttttcgttcgtttttttttttttagtttgtatttttttttcggatttttattgcgattttagcggttcgtgtggtttttggtcgcgcggttttcggcggtttcgggtttattatttattttttttttttcgggttgcggcgtaggttcgggtgttttttggggttttggggtgtgttaatttgttttg

SEQ ID NO: 22666 - DNA, 1067 bp, Artificial Sequence
  chemically treated genomic DNA (Homo sapiens) CpG-island No: 22666
caaaacaaattaacacaccccaaaaccccaaaaaacacccgaacctacgccgcaacccgaaaaaaaaaaaataaataataaacccgaaaccgccgaaaaccgcgcgaccaaaaaccacacgaaccgctaaaatcgcaataaaaatccgaaaaaaaaatacaaactaaaaaaaaaaaaacgaacgaaaacccacgaaataaaaataaaacgaaaaaaacgaatcgacactcactataaaaatcgctcttctcccgaaccccgtcaactcgaccgtcgaaataaatacgcaaaaaaaaacccccgtttttacaatacaaccgcttaaaatccttaaaataaccgaacgaaaaaacgccgctaccgccatcctcgaacaaaacgaacaacgtaataatactcccgactaccataatccctacgaaacccgaccgaaatccccgaaccgctaaaaccgcgcgaaaaaccgccgtcccccgaccccgaccccgacctccgacccgctccgaaacacgaccccgaccccgaccccccaacctcccgcccgacaacgcgcgaccgcgcccgcgatcccccaacctcgaaccgctcgaccgctcttctatccgccgacccctaatacgcgacgaaccgacgacccgaaacctaaaattcacgaataaatatctccgcgaacgccgcctaaaaaaaaccgcctcccaaactacaacgcccgaaatcccgttacaaccgcgaacaccgcgtccgctaatctaacacccgccgaaccgcgacgtcacatcttctacatctccacccccgacacccaccaacctcccgcgcccccaattctcctccctcctacgcgccgccccctactcgctcgaattttctaaaaccgacctctaaattcgacgattcgaccacaacacgcaaacgcgcgacatcaatccgacgaaaaacccgacctcaatcgaaaacgaaaaaaaaacgaaaaacgaaaaacgcgcgtcgaaaaccgcgacaaaactttaacattccctaaactccaccgccccttatcccccaaaaatcacccccgcccaaccccc

SEQ ID NO: 22667 - DNA, 1067 bp, Artificial Sequence
  chemically treated genomic DNA (Homo sapiens) CpG-island No: 22667
tagggtaaattggtatattttaaagttttaggggatattcgggtttacgtcgtagttcggaaaggagggggtgagtggtgaattcgaaatcgtcgagggtcgcgcggttagaaattatacggatcgttagggtcgtagtgaagattcgggaggagggtgtaggttggaggggagagagcgggcgagaatttacgaaatggaaatgaggcggagagagcgggtcggtatttattgtgagggtcgtttttttttcggatttcgttaattcggtcgtcggggtggatgcgtaggaagaagttttcgtttttgtagtatagtcgtttggggtttttgaagtggtcgggcgggaaggcgtcgttgtcgttattttcgggtaaggcgggtagcgtggtgatgttttcggttgttatggtttttgcggggttcggtcgggattttcgagtcgttggagtcgcgcggggagtcgtcgtttttcggtttcggtttcggttttcgattcgtttcggggtacggtttcggtttcggttttttagtttttcgttcggtagcgcgcggtcgcgttcgcggttttttagtttcgagtcgttcggtcgtttttttgttcgtcggtttttggtgcgcggcgagtcggcggttcgggatttggggtttacggatgggtgttttcgcggacgtcgtttggggagagtcgttttttaagttgtagcgttcgggatttcgttgtaatcgcgggtatcgcgttcgttaatttggtattcgtcgggtcgcggcgttatattttttatatttttattttcgatatttattagtttttcgcgtttttagttttttttttttttgcgcgtcgttttttattcgttcgggttttttggggtcggtttttgagttcggcggttcggttataatacgtaagcgcgcgatattagttcggcggggagttcggttttagtcgggggcgggggagaggcgaggggcggggggcgcgcgtcggaggtcgcggtagggttttggtattttttgggttttatcgttttttattttttaaaagttattttcgtttaattttt

SEQ ID NO: 22668 - DNA, 1067 bp, Artificial Sequence
  chemically treated genomic DNA (Homo sapiens) CpG-island No: 22668
aaaaattaaacgaaaataacttttaaaaaataaaaaacgataaaacccaaaaaataccaaaaccctaccgcgacctccgacgcgcgccccccgcccctcgcctctcccccgcccccgactaaaaccgaactccccgccgaactaatatcgcgcgcttacgtattataaccgaaccgccgaactcaaaaaccgaccccaaaaaacccgaacgaataaaaaacgacgcgcaaaaaaaaaaaaaactaaaaacgcgaaaaactaataaatatcgaaaataaaaatataaaaaatataacgccgcgacccgacgaataccaaattaacgaacgcgatacccgcgattacaacgaaatcccgaacgctacaacttaaaaaacgactctccccaaacgacgtccgcgaaaacacccatccgtaaaccccaaatcccgaaccgccgactcgccgcgcaccaaaaaccgacgaacaaaaaaacgaccgaacgactcgaaactaaaaaaccgcgaacgcgaccgcgcgctaccgaacgaaaaactaaaaaaccgaaaccgaaaccgtaccccgaaacgaatcgaaaaccgaaaccgaaaccgaaaaacgacgactccccgcgcgactccaacgactcgaaaatcccgaccgaaccccgcaaaaaccataacaaccgaaaacatcaccacgctacccgccttacccgaaaataacgacaacgacgccttcccgcccgaccacttcaaaaaccccaaacgactatactacaaaaacgaaaacttcttcctacgcatccaccccgacgaccgaattaacgaaatccgaaaaaaaaacgaccctcacaataaataccgacccgctctctccgcctcatttccatttcgtaaattctcgcccgctctctcccctccaacctacaccctcctcccgaatcttcactacgaccctaacgatccgtataatttctaaccgcgcgaccctcgacgatttcgaattcaccactcaccccctcctttccgaactacgacgtaaacccgaatatcccctaaaactttaaaatataccaatttacccta

SEQ ID NO: 22669 - DNA, 1063 bp, Artificial Sequence
  chemically treated genomic DNA (Homo sapiens) CpG-island No: 22669
tttattacgtcgcgcgttttcggttttaacgtatttttaggatttagggttttttaagttgtaatttagtagggtttttttgtttgtttttattttgtgttttcggtaacgatttcgcgcgtttatattttcgtgtcgttttagttattagttcgtaatttttagttttaaaacgttggagtttagaatttagtttaggtgcgttcgtcggttttttagggagattggggttgattgtaggtacgcgggggcgggaagatagttttttgtttttggttgcgatggaggcggatttgggcggggtcgaaacgggggcggggttaagtgtgggggcgtagttaggcgtgggggcgggtcggcgtcggcgtcgcggtcggcggtagcgtttttttaagttttcgcggttgcgtttcggtttcggattcgggttatttacggggtagtgggtgtttttcggtttcggatattgtaagttttagaaggtaaatttgcgtgggagtcgcgtatttggagcgcgagggtatttatgatgagggcgggaggttggatggcgatagaagggagcgtttcgcggcgagttttttaagaaagttgaattcgttttaagttttttgtgtttcggtttgtatttagtgaatgggtggcgggtttatttgttgcgggtggttttttggcgcgggagggacgcggaggtgattggattaattcgtttgggcggtagtttagatttttgtcgggaatcgcgtatcgtagtggtgtagtttttgttcgagaaaggttggtatgtgcggtgtagtcgtgttttgcgtagtagtagggggatcgtcggtttgggagtacgcgagtcggttaggcgttttcggttgtttagaggtatagttttttaattttttttttttttaggtaagattaattcggtgttgtttttttcggcgttgatttcgaggttcggttatggacggcgagagcgaggtggatttttttagtaatagtataatttttttgtggcggaggcggtcgattttttagttttattaggttttgggtcggagtaagtcgaggt

SEQ ID NO: 22670 - DNA, 1063 bp, Artificial Sequence
  chemically treated genomic DNA (Homo sapiens) CpG-island No: 22670
acctcgacttactccgacccaaaacctaataaaactaaaaaatcgaccgcctccgccacaaaaaaattatactattactaaaaaaatccacctcgctctcgccgtccataaccgaacctcgaaatcaacgccgaaaaaaacaacaccgaattaatcttacctaaaaaaaaaaaaaattaaaaaactatacctctaaacaaccgaaaacgcctaaccgactcgcgtactcccaaaccgacgatccccctactactacgcaaaacacgactacaccgcacataccaacctttctcgaacaaaaactacaccactacgatacgcgattcccgacaaaaatctaaactaccgcccaaacgaattaatccaatcacctccgcgtccctcccgcgccaaaaaaccacccgcaacaaataaacccgccacccattcactaaatacaaaccgaaacacaaaaaacttaaaacgaattcaactttcttaaaaaactcgccgcgaaacgctcccttctatcgccatccaacctcccgccctcatcataaataccctcgcgctccaaatacgcgactcccacgcaaatttaccttctaaaacttacaatatccgaaaccgaaaaacacccactaccccgtaaataacccgaatccgaaaccgaaacgcaaccgcgaaaacttaaaaaaacgctaccgccgaccgcgacgccgacgccgacccgcccccacgcctaactacgcccccacacttaaccccgcccccgtttcgaccccgcccaaatccgcctccatcgcaaccaaaaacaaaaaactatcttcccgcccccgcgtacctacaatcaaccccaatctccctaaaaaaccgacgaacgcacctaaactaaattctaaactccaacgttttaaaactaaaaattacgaactaataactaaaacgacacgaaaatataaacgcgcgaaatcgttaccgaaaacacaaaataaaaacaaacaaaaaaaccctactaaattacaacttaaaaaaccctaaatcctaaaaatacgttaaaaccgaaaacgcgcgacgtaataaa

SEQ ID NO: 22671 - DNA, 1063 bp, Artificial Sequence
  chemically treated genomic DNA (Homo sapiens) CpG-island No: 22671
gtttcggtttgtttcggtttagaatttggtggggttgaggaatcgatcgttttcgttataaaggggttatgttgttgttagaaaaatttatttcgttttcgtcgtttatagtcgggtttcgaagttagcgtcgggaggagtaatatcgagttagttttgtttaaagaggaaagaagttaggaaattgtgtttttggataatcggggacgtttggtcgattcgcgtgtttttagatcggcggtttttttgttgttgcgtaggatacgattgtatcgtatatattagtttttttcgggtaaaaattgtattattgcggtgcgcggttttcggtagaaatttgggttgtcgtttaggcggattaatttaattattttcgcgtttttttcgcgttaaaagattattcgtagtaaatgagttcgttatttatttattgagtgtaagtcgaggtataagaaatttgggacgagtttagtttttttgggaaattcgtcgcgggacgtttttttttgtcgttatttagtttttcgtttttattatgggtattttcgcgttttaggtgcgcggtttttacgtaaatttattttttggggtttgtaatgttcggggtcgaggagtatttattatttcgtgggtggttcgggttcgggatcgaagcgtagtcgcgagagtttaggagagcgttgtcgtcgatcgcggcgtcggcgtcggttcgtttttacgtttgattacgtttttatatttggtttcgttttcgtttcggtttcgtttagattcgtttttatcgtagttagaagtaagaagttgttttttcgttttcgcgtgtttataattagttttagtttttttgggaaatcgacgagcgtatttgagttgggttttgagttttagcgttttggggttagaagttgcggattagtagttgaggcggtacgggagtgtaggcgcgcggggtcgttgtcgggggtatagagtgagaataagtaagggagttttgttgaattgtagtttaggaagttttgaattttggaggtgcgttgaaatcgagaacgcgcggcgtagtaga

SEQ ID NO: 22672 - DNA, 1063 bp, Artificial Sequence
  chemically treated genomic DNA (Homo sapiens) CpG-island No: 22672
tctactacgccgcgcgttctcgatttcaacgcacctccaaaattcaaaacttcctaaactacaattcaacaaaactcccttacttattctcactctatacccccgacaacgaccccgcgcgcctacactcccgtaccgcctcaactactaatccgcaacttctaaccccaaaacgctaaaactcaaaacccaactcaaatacgctcgtcgatttcccaaaaaaactaaaactaattataaacacgcgaaaacgaaaaaacaacttcttacttctaactacgataaaaacgaatctaaacgaaaccgaaacgaaaacgaaaccaaatataaaaacgtaatcaaacgtaaaaacgaaccgacgccgacgccgcgatcgacgacaacgctctcctaaactctcgcgactacgcttcgatcccgaacccgaaccacccacgaaataataaatactcctcgaccccgaacattacaaaccccaaaaaataaatttacgtaaaaaccgcgcacctaaaacgcgaaaatacccataataaaaacgaaaaactaaataacgacaaaaaaaaacgtcccgcgacgaatttcccaaaaaaactaaactcgtcccaaatttcttatacctcgacttacactcaataaataaataacgaactcatttactacgaataatcttttaacgcgaaaaaaacgcgaaaataattaaattaatccgcctaaacgacaacccaaatttctaccgaaaaccgcgcaccgcaataatacaatttttacccgaaaaaaactaatatatacgatacaatcgtatcctacgcaacaacaaaaaaaccgccgatctaaaaacacgcgaatcgaccaaacgtccccgattatccaaaaacacaatttcctaacttctttcctctttaaacaaaactaactcgatattactcctcccgacgctaacttcgaaacccgactataaacgacgaaaacgaaataaatttttctaacaacaacataacccctttataacgaaaacgatcgattcctcaaccccaccaaattctaaaccgaaacaaaccgaaac

SEQ ID NO: 22673 - DNA, 1185 bp, Artificial Sequence
  chemically treated genomic DNA (Homo sapiens) CpG-island No: 22673
tcgttcggcgtggttgttgaatggaaattatatatttgagttttatatttttttcgtgtgtgagttgcgtgggagtttttcgtcgtgtgttgttacgggtttttcgtggttgtacgttcgtttttgttagtttttaatagagtcgtttagaataggagagaatatttatttatcgtgatatatttatattttttttcggtaacgttacgcgtaaatagttattcgcgttttagcgtattcgttttatatttcgtaggcggtttttgggatttttataatgcggtttttttttcgcgtggttgttatatacgttttttttttcgagtgcgtaggtatataatgtattcgtatatatataagtatacgtatatatatgtatatttatacgtgcgcgttttttcggttcgcgaggtagtagtttgcgtatttgtttttgagagtcgcggcgtgggggttacggtgttgtgttttagttttatcgtcgcgtttttgtcgggggtcgttcggtacgttaggcgttcgtcgcggtttttacgtatttatttttcgtgcgcgtgtgtcggggcggcgtcgcggttcggtcgggatacgcgcgttttcggcggcgtcgtattttggtttttttgttggcggttcggggagttgtttagtatcgcgtttacgtcgtcgttcgttttttcgcgttcgggttcggagcgtatttatttttaattagtagaagtagtagcggcgaaagtagcggcggtagtcgggcggttcgtagtagtcggtttatggtgtagtcgtcgtcgtttgtagtcgtagcggcgcggcgttcgggttcgcgttaggggtcgcgcgggcggcggcggcggcgcgcgttcgttttattggttcgtatggtcgttatttacgttcggtttcgttcggtcgcgtgtcgcgggcgcgttttcgcggagacgaagcggacgcgcgggcggtcgttttttcgttcgtttttttcgttaggtcggttaattagtatcgtcgaggttcgggggtttggttcggtcgttcgtagatttgggtttcgtatttcgcgttcggatgtcgtttttttttcgcgcggttattcgttttttgggaagtagagtgggtagttgtggtagatgggattgatgggacgaggacgacgcgtggaaatgattgtgagggtggatagaggtt

SEQ ID NO: 22674 - DNA, 1185 bp, Artificial Sequence
  chemically treated genomic DNA (Homo sapiens) CpG-island No: 22674
aacctctatccaccctcacaatcatttccacgcgtcgtcctcgtcccatcaatcccatctaccacaactacccactctacttcccaaaaaacgaataaccgcgcgaaaaaaaaacgacatccgaacgcgaaatacgaaacccaaatctacgaacgaccgaaccaaacccccgaacctcgacgatactaattaaccgacctaacgaaaaaaacgaacgaaaaaacgaccgcccgcgcgtccgcttcgtctccgcgaaaacgcgcccgcgacacgcgaccgaacgaaaccgaacgtaaataacgaccatacgaaccaataaaacgaacgcgcgccgccgccgccgcccgcgcgacccctaacgcgaacccgaacgccgcgccgctacgactacaaacgacgacgactacaccataaaccgactactacgaaccgcccgactaccgccgctactttcgccgctactacttctactaattaaaaataaatacgctccgaacccgaacgcgaaaaaacgaacgacgacgtaaacgcgatactaaacaactccccgaaccgccaacaaaaaaaccaaaatacgacgccgccgaaaacgcgcgtatcccgaccgaaccgcgacgccgccccgacacacgcgcacgaaaaataaatacgtaaaaaccgcgacgaacgcctaacgtaccgaacgacccccgacaaaaacgcgacgataaaactaaaacacaacaccgtaacccccacgccgcgactctcaaaaacaaatacgcaaactactacctcgcgaaccgaaaaaacgcgcacgtataaatatacatatatatacgtatacttatatatatacgaatacattatatacctacgcactcgaaaaaaaaaacgtatataacaaccacgcgaaaaaaaaaccgcattataaaaatcccaaaaaccgcctacgaaatataaaacgaatacgctaaaacgcgaataactatttacgcgtaacgttaccgaaaaaaaatataaatatatcacgataaataaatattctctcctattctaaacgactctattaaaaactaacaaaaacgaacgtacaaccacgaaaaacccgtaacaacacacgacgaaaaactcccacgcaactcacacacgaaaaaaatataaaactcaaatatataatttccattcaacaaccacgccgaacga

SEQ ID NO: 22675 - DNA, 1185 bp, Artificial Sequence
  chemically treated genomic DNA (Homo sapiens) CpG-island No: 22675
ggtttttgtttatttttatagttatttttacgcgtcgttttcgttttattagttttatttgttatagttgtttattttgttttttagggaacgggtgatcgcgcggggagagagcggtattcgggcgcgaggtgcgaggtttaggtttgcgggcggtcgggttaagttttcgagtttcggcggtgttgattggtcggtttggcgggggggacgggcggagggacggtcgttcgcgcgttcgtttcgttttcgcgggggcgcgttcgcggtacgcggtcgggcggggtcgggcgtgagtgacggttatgcggattaatggggcgggcgcgcgtcgtcgtcgtcgttcgcgcggtttttgacgcgggttcgggcgtcgcgtcgttgcggttgtaggcggcgacggttatattatgggtcggttgttgcgggtcgttcggttgtcgtcgttgttttcgtcgttgttgtttttgttggttgggggtgagtgcgtttcgggttcgagcgcgggagggcgggcggcggcgtgggcgcggtgttggatagtttttcgggtcgttaataaaggggttagagtgcggcgtcgtcgggagcgcgcgtgtttcggtcgggtcgcggcgtcgtttcgatatacgcgtacgaggagtgggtgcgtgggggtcgcggcgggcgtttggcgtgtcgggcgattttcgataaaggcgcggcggtgaagttgggatatagtatcgtggtttttacgtcgcggtttttaggggtaggtgcgtaggttgttgtttcgcgggtcgggggggcgcgtacgtgtgggtgtgtatgtgtgtgcgtgtgtttgtgtgtgtgcgagtgtattgtgtgtttgcgtattcgggggaagaggcgtgtgtgatagttacgcggggaggaggtcgtattgtgaaggttttaggggtcgtttgcggagtgtggggcgggtacgttgaggcgcgggtggttgtttacgcgtggcgttgtcgggagggagtgtgagtgtgttacggtgaatgggtatttttttttgttttgggcgattttattaggagttgataaaaacgggcgtatagttacggaaggttcgtgatagtatacggcgggaggtttttacgtagtttatatacgagggaggtgtgagatttagatgtgtggtttttatttagtagttacgtcgggcgg

SEQ ID NO: 22676 - DNA, 1185 bp, Artificial Sequence
  chemically treated genomic DNA (Homo sapiens) CpG-island No: 22676
ccgcccgacgtaactactaaataaaaaccacacatctaaatctcacacctccctcgtatataaactacgtaaaaacctcccgccgtatactatcacgaaccttccgtaactatacgcccgtttttatcaactcctaataaaatcgcccaaaacaaaaaaaaatacccattcaccgtaacacactcacactccctcccgacaacgccacgcgtaaacaaccacccgcgcctcaacgtacccgccccacactccgcaaacgacccctaaaaccttcacaatacgacctcctccccgcgtaactatcacacacgcctcttcccccgaatacgcaaacacacaatacactcgcacacacacaaacacacgcacacacatacacacccacacgtacgcgcccccccgacccgcgaaacaacaacctacgcacctacccctaaaaaccgcgacgtaaaaaccacgatactatatcccaacttcaccgccgcgcctttatcgaaaatcgcccgacacgccaaacgcccgccgcgacccccacgcacccactcctcgtacgcgtatatcgaaacgacgccgcgacccgaccgaaacacgcgcgctcccgacgacgccgcactctaacccctttattaacgacccgaaaaactatccaacaccgcgcccacgccgccgcccgccctcccgcgctcgaacccgaaacgcactcacccccaaccaacaaaaacaacaacgacgaaaacaacgacgacaaccgaacgacccgcaacaaccgacccataatataaccgtcgccgcctacaaccgcaacgacgcgacgcccgaacccgcgtcaaaaaccgcgcgaacgacgacgacgacgcgcgcccgccccattaatccgcataaccgtcactcacgcccgaccccgcccgaccgcgtaccgcgaacgcgcccccgcgaaaacgaaacgaacgcgcgaacgaccgtccctccgcccgtcccccccgccaaaccgaccaatcaacaccgccgaaactcgaaaacttaacccgaccgcccgcaaacctaaacctcgcacctcgcgcccgaataccgctctctccccgcgcgatcacccgttccctaaaaaacaaaataaacaactataacaaataaaactaataaaacgaaaacgacgcgtaaaaataactataaaaataaacaaaaacc

SEQ ID NO: 22677 - DNA, 762 bp, Artificial Sequence
  chemically treated genomic DNA (Homo sapiens) CpG-island No: 22677
gtatttcggtcgttgcgggtagttatcgtggggttggagttcgtgtcgttatttcgcgtcggatcgggtcgtcgaggttcggatttttattcgtattgtttttagtcggggtcgagttcgacgtcgttacgtgcggttttttttcgggtttcgcgtgttttcgcgtttcgagcgattttcgattgttcggtatttttttcgtgggtttttatatttagggtttttttttttaaacgtcgttttggtcgttcgagttgcgttcgagcggaaatgggtcgttcgcggagtaaggaggggaacggcggttgggtttttcgtcggggcgagggacggggttttttttttagttgcggtaggagacggggagaaggtttttttttatttgatagttcgggtcgcgtttaggatcggtcgtttcggtcgtttcggtcgtttattcgtcgttattgggtgtgcgcggatttagtataggtcgcgggatttcggtttttagcgttagattaggcggtttgggtcgggaagcgtcgcgtaaggatcgggcgcgatcggtttcgtggaatgagggttaggtaggaaaggcgaggcggggttagttcgtcgggtcgcgggtttcgcggatattttgtagtttttttcgatagcggcgatcgggaaagtaagatcgtttttttcgtttagtttaaattgcgaaaacggttatagttttataagttttagagttttagagtttttgttattatttaggttcgttttttaattttt

SEQ ID NO: 22678 - DNA, 762 bp, Artificial Sequence
  chemically treated genomic DNA (Homo sapiens) CpG-island No: 22678
aaaaattaaaaaacgaacctaaataataacaaaaactctaaaactctaaaacttataaaactataaccgttttcgcaatttaaactaaacgaaaaaaacgatcttactttcccgatcgccgctatcgaaaaaaactacaaaatatccgcgaaacccgcgacccgacgaactaaccccgcctcgcctttcctacctaaccctcattccacgaaaccgatcgcgcccgatccttacgcgacgcttcccgacccaaaccgcctaatctaacgctaaaaaccgaaatcccgcgacctatactaaatccgcgcacacccaataacgacgaataaacgaccgaaacgaccgaaacgaccgatcctaaacgcgacccgaactatcaaataaaaaaaaaccttctccccgtctcctaccgcaactaaaaaaaaaaccccgtccctcgccccgacgaaaaacccaaccgccgttcccctccttactccgcgaacgacccatttccgctcgaacgcaactcgaacgaccaaaacgacgtttaaaaaaaaaaaccctaaatataaaaacccacgaaaaaaataccgaacaatcgaaaatcgctcgaaacgcgaaaacacgcgaaacccgaaaaaaaaccgcacgtaacgacgtcgaactcgaccccgactaaaaacaatacgaataaaaatccgaacctcgacgacccgatccgacgcgaaataacgacacgaactccaaccccacgataactacccgcaacgaccgaaatac

SEQ ID NO: 22679 - DNA, 762 bp, Artificial Sequence
  chemically treated genomic DNA (Homo sapiens) CpG-island No: 22679
ggaggttagagggcgggtttgagtgataatagggattttgggattttgggatttgtgggattgtggtcgttttcgtaatttgggttggacgaaaaagacggttttgttttttcggtcgtcgttgtcgggaagggttgtagggtgttcgcgagattcgcggttcggcgagttgatttcgtttcgttttttttgtttagtttttattttacggagtcggtcgcgttcggtttttgcgcgacgtttttcggtttaggtcgtttggtttggcgttggaggtcggagtttcgcggtttgtgttggattcgcgtatatttagtggcggcggatgggcggtcggggcggtcggggcggtcggttttgagcgcggttcgggttgttaggtaaggaggggtttttttttcgttttttgtcgtagttagagggggagtttcgtttttcgtttcggcgggaagtttagtcgtcgtttttttttttgtttcgcgagcggtttattttcgttcgggcgtagttcggacggttaaggcggcgtttgggagggaaggttttggatgtgggaatttacgggaggggtgtcgggtagtcgggagtcgttcggggcgcgggggtacgcgaggttcgggagggagtcgtacgtagcggcgtcgggttcggtttcggttggaggtagtgcgggtggagattcggatttcggcgattcggttcggcgcggggtggcggtacgggttttagttttacggtggttgttcgtagcggtcgaggtgt

SEQ ID NO: 22680 - DNA, 762 bp, Artificial Sequence
  chemically treated genomic DNA (Homo sapiens) CpG-island No: 22680
acacctcgaccgctacgaacaaccaccgtaaaactaaaacccgtaccgccaccccgcgccgaaccgaatcgccgaaatccgaatctccacccgcactacctccaaccgaaaccgaacccgacgccgctacgtacgactccctcccgaacctcgcgtacccccgcgccccgaacgactcccgactacccgacacccctcccgtaaattcccacatccaaaaccttccctcccaaacgccgccttaaccgtccgaactacgcccgaacgaaaataaaccgctcgcgaaacaaaaaaaaaaacgacgactaaacttcccgccgaaacgaaaaacgaaactccccctctaactacgacaaaaaacgaaaaaaaaacccctccttacctaacaacccgaaccgcgctcaaaaccgaccgccccgaccgccccgaccgcccatccgccgccactaaatatacgcgaatccaacacaaaccgcgaaactccgacctccaacgccaaaccaaacgacctaaaccgaaaaacgtcgcgcaaaaaccgaacgcgaccgactccgtaaaataaaaactaaacaaaaaaaacgaaacgaaatcaactcgccgaaccgcgaatctcgcgaacaccctacaacccttcccgacaacgacgaccgaaaaaacaaaaccgtctttttcgtccaacccaaattacgaaaacgaccacaatcccacaaatcccaaaatcccaaaatccctattatcactcaaacccgccctctaacctcc

SEQ ID NO: 22681 - DNA, 1095 bp, Artificial Sequence
  chemically treated genomic DNA (Homo sapiens) CpG-island No: 22681
gttggttcgttcgtttatggtttttttttatttcgttttagtcgtacggcgaggagttgcgtttcgtggagaacggttgttacgataattttacgttggacgtggttagcgatagttagtcggagatgtaggagaagtattttagtttgaacggcggcggggtttttaacggttcggggagttggggggcgtttatggggggtaagcgggatttcgaggattcggacgtgttcgaggaggatacgtatttgtgagcgtagtcgaggcgtaggtcgagtgggtcgttaggattaagcgaggtggatttcgaaacggacggttcggagttcgtattagtttcgcgtttattcgggtcgttttcgcggtttggttttcggcgcgggttttttttcgtttttttcgattttatacggcggtttcggattaatttttttattttcgttcgaggggtaggttttaaagttcgttttggtttcgttttttcgtttttgaatttcggtttcgcgggcggcgggcggcgttttttgcgttttgggatttaattaaattcgttcggagattacgtcgggtttagcgcgtttgtttttttgatttatttttattttcggggttggggcggggcggggcgggcggggtatttcggggtaggggcggggtcgcggggcggggaggtcggggcgggcgggtttttcggacgtcgttgtagagcggggcggggcggggttgagcgtgtttatattcgtcgggtgcgcggtttcgtcgttcgaggtcgttcggttcgggtattatttttcgcgtcgtggatattagcgatttgttcgttttttgttgggtgggggatgtgggtcgagtgcggtgtggttttcgtaatataaggagaggagtgcgggaaagtggttcgttttcgaaaacgttttcgggttcgtgcgacgggtagaatggacgattttcgaagagcgtaggcgtttatgtttggttatagttattttcggtcgttttcggcgtgggatagtaaaatttttcgattcgtcgtttagggaattatttattgtgtgaatagtgatagaagggtatagcgagatattatagataggt

SEQ ID NO: 22682 - DNA, 1095 bp, Artificial Sequence
  chemically treated genomic DNA (Homo sapiens) CpG-island No: 22682
acctatctataatatctcgctatacccttctatcactattcacacaataaataattccctaaacgacgaatcgaaaaattttactatcccacgccgaaaacgaccgaaaataactataaccaaacataaacgcctacgctcttcgaaaatcgtccattctacccgtcgcacgaacccgaaaacgttttcgaaaacgaaccactttcccgcactcctctccttatattacgaaaaccacaccgcactcgacccacatcccccacccaacaaaaaacgaacaaatcgctaatatccacgacgcgaaaaataatacccgaaccgaacgacctcgaacgacgaaaccgcgcacccgacgaatataaacacgctcaaccccgccccgccccgctctacaacgacgtccgaaaaacccgcccgccccgacctccccgccccgcgaccccgcccctaccccgaaataccccgcccgccccgccccgccccaaccccgaaaataaaaataaatcaaaaaaacaaacgcgctaaacccgacgtaatctccgaacgaatttaattaaatcccaaaacgcaaaaaacgccgcccgccgcccgcgaaaccgaaattcaaaaacgaaaaaacgaaaccaaaacgaactttaaaacctacccctcgaacgaaaataaaaaaattaatccgaaaccgccgtataaaatcgaaaaaaacgaaaaaaaacccgcgccgaaaaccaaaccgcgaaaacgacccgaataaacgcgaaactaatacgaactccgaaccgtccgtttcgaaatccacctcgcttaatcctaacgacccactcgacctacgcctcgactacgctcacaaatacgtatcctcctcgaacacgtccgaatcctcgaaatcccgcttaccccccataaacgccccccaactccccgaaccgttaaaaaccccgccgccgttcaaactaaaatacttctcctacatctccgactaactatcgctaaccacgtccaacgtaaaattatcgtaacaaccgttctccacgaaacgcaactcctcgccgtacgactaaaacgaaataaaaaaaaaccataaacgaacgaaccaac

SEQ ID NO: 22683 - DNA, 1095 bp, Artificial Sequence
  chemically treated genomic DNA (Homo sapiens) CpG-island No: 22683
gtttgtttgtggtgtttcgttgtgtttttttgttattgtttatatagtgggtggttttttgaacggcgggtcgggagattttattgttttacgtcgggggcggtcgggagtggttgtggttaggtataggcgtttgcgtttttcgggggtcgtttattttgttcgtcgtacgggttcggaggcgttttcgggggcgggttattttttcgtatttttttttttgtgttgcgaggattatatcgtattcggtttatattttttatttagtagaaggcgaataggtcgttggtgtttacggcgcggaggatggtattcgagtcgaacgatttcgggcggcgaagtcgcgtattcgacggatgtaaatacgtttagtttcgtttcgtttcgttttgtagcggcgttcggaggattcgttcgtttcggttttttcgtttcgcggtttcgtttttgtttcggggtgtttcgttcgtttcgtttcgttttaatttcggaaataagaatgagttaagaaggtagacgcgttgggttcggcgtggttttcgggcgggtttaattgagttttagggcgtaggaagcgtcgttcgtcgttcgcggggtcggggtttaggggcgggaaagcggggttaaggcgggttttgaggtttgtttttcgggcgggagtgagggagttggttcgaagtcgtcgtgtgaagtcgggggaagcgggaaggagttcgcgtcgagggttaggtcgcgggggcggttcgggtaggcgcggggttggtgcgggtttcgggtcgttcgtttcggggtttatttcgtttggttttggcggtttattcggtttgcgtttcggttgcgtttataggtgcgtgtttttttcgaatacgttcgagttttcggggtttcgtttgttttttatgagcgttttttagtttttcgggtcgttgagggtttcgtcgtcgtttaggttggggtgttttttttgtattttcgattggttgtcgttggttacgtttagcgtggggttgtcgtggtagtcgttttttacgaagcgtagtttttcgtcgtgcgattgaggcggggtggggagaggttatgggcgagcgagttagt

SEQ ID NO: 22684 - DNA, 1095 bp, Artificial Sequence
  chemically treated genomic DNA (Homo sapiens) CpG-island No: 22684
actaactcgctcgcccataacctctccccaccccgcctcaatcgcacgacgaaaaactacgcttcgtaaaaaacgactaccacgacaaccccacgctaaacgtaaccaacgacaaccaatcgaaaatacaaaaaaaacaccccaacctaaacgacgacgaaaccctcaacgacccgaaaaactaaaaaacgctcataaaaaacaaacgaaaccccgaaaactcgaacgtattcgaaaaaaacacgcacctataaacgcaaccgaaacgcaaaccgaataaaccgccaaaaccaaacgaaataaaccccgaaacgaacgacccgaaacccgcaccaaccccgcgcctacccgaaccgcccccgcgacctaaccctcgacgcgaactccttcccgcttcccccgacttcacacgacgacttcgaaccaactccctcactcccgcccgaaaaacaaacctcaaaacccgccttaaccccgctttcccgcccctaaaccccgaccccgcgaacgacgaacgacgcttcctacgccctaaaactcaattaaacccgcccgaaaaccacgccgaacccaacgcgtctaccttcttaactcattcttatttccgaaattaaaacgaaacgaaacgaacgaaacaccccgaaacaaaaacgaaaccgcgaaacgaaaaaaccgaaacgaacgaatcctccgaacgccgctacaaaacgaaacgaaacgaaactaaacgtatttacatccgtcgaatacgcgacttcgccgcccgaaatcgttcgactcgaataccatcctccgcgccgtaaacaccaacgacctattcgccttctactaaataaaaaatataaaccgaatacgatataatcctcgcaacacaaaaaaaaaaatacgaaaaaataacccgcccccgaaaacgcctccgaacccgtacgacgaacaaaataaacgacccccgaaaaacgcaaacgcctatacctaaccacaaccactcccgaccgcccccgacgtaaaacaataaaatctcccgacccgccgttcaaaaaaccacccactatataaacaataacaaaaaaacacaacgaaacaccacaaacaaac

SEQ ID NO: 22685 - DNA, 525 bp, Artificial Sequence
  chemically treated genomic DNA (Homo sapiens) CpG-island No: 22685
tgagaacgtagcgcgttagggtcgagttttttattggtttgtttcgcgttttttaatgttagcgttaggcgtttattttgtagagcgtttcgttttttaaagaggggtgtgattcgcgagtttagataggaggtttttgtcgtggggaatatttcgtcgttttcggagttttttttgtggcgtagttttttcgttcgagtcgcgcgcggagttgtcgggggttttttagtattcgggcgtcggggttttcgttttttcgtagtttttattttagttttttgttttcgtacgttatgaagtcgtcgttttatcgttgttagaatattatttttgtggaaatcgtggttagggttaaaaaggttagggttaagacgaagtaggtgtacgtcggtttttcgggcgttagtgttattagggtttggtttcgcgcgtacgaagttagttttttggggtgatgaggtaggtttcgagtaggtcggtgaaatttttagttcggttattagtacgtggaataaggagagggag

SEQ ID NO: 22686 - DNA, 525 bp, Artificial Sequence
  chemically treated genomic DNA (Homo sapiens) CpG-island No: 22686
ctccctctccttattccacgtactaataaccgaactaaaaatttcaccgacctactcgaaacctacctcatcaccccaaaaaactaacttcgtacgcgcgaaaccaaaccctaataacactaacgcccgaaaaaccgacgtacacctacttcgtcttaaccctaacctttttaaccctaaccacgatttccacaaaaataatattctaacaacgataaaacgacgacttcataacgtacgaaaacaaaaaactaaaataaaaactacgaaaaaacgaaaaccccgacgcccgaatactaaaaaacccccgacaactccgcgcgcgactcgaacgaaaaaactacgccacaaaaaaaactccgaaaacgacgaaatattccccacgacaaaaacctcctatctaaactcgcgaatcacacccctctttaaaaaacgaaacgctctacaaaataaacgcctaacgctaacattaaaaaacgcgaaacaaaccaataaaaaactcgaccctaacgcgctacgttctca

SEQ ID NO: 22687 - DNA, 525 bp, Artificial Sequence
  chemically treated genomic DNA (Homo sapiens) CpG-island No: 22687
ttttttttttttgttttacgtgttggtgatcgagttgggggttttatcgatttgttcgggatttgttttattattttaagggattggtttcgtacgcgcgggattagattttggtggtattggcgttcgaagagtcggcgtgtatttatttcgttttggttttgatttttttaattttggttacgatttttatagaggtggtgttttggtagcggtagaacggcgattttatggcgtgcgggagtagagggttggagtgaaggttgcggaagggcgagggtttcggcgttcgggtgttaaggagttttcggtagtttcgcgcgcggttcgggcggagaagttgcgttatagaaaaagtttcgagggcggcggggtgttttttacggtaggaattttttatttaaattcgcgggttatatttttttttgagaggcgggacgttttgtagggtgagcgtttggcgttggtattgaagagcgcggagtaggttagtgaagagttcggttttgacgcgttgcgttttta

SEQ ID NO: 22688 - DNA, 525 bp, Artificial Sequence
  chemically treated genomic DNA (Homo sapiens) CpG-island No: 22688
taaaaacgcaacgcgtcaaaaccgaactcttcactaacctactccgcgctcttcaataccaacgccaaacgctcaccctacaaaacgtcccgcctctcaaaaaaaaatataacccgcgaatttaaataaaaaattcctaccgtaaaaaacaccccgccgccctcgaaactttttctataacgcaacttctccgcccgaaccgcgcgcgaaactaccgaaaactccttaacacccgaacgccgaaaccctcgcccttccgcaaccttcactccaaccctctactcccgcacgccataaaatcgccgttctaccgctaccaaaacaccacctctataaaaatcgtaaccaaaattaaaaaaatcaaaaccaaaacgaaataaatacacgccgactcttcgaacgccaataccaccaaaatctaatcccgcgcgtacgaaaccaatcccttaaaataataaaacaaatcccgaacaaatcgataaaacccccaactcgatcaccaacacgtaaaacaaaaaaaaaaaa

SEQ ID NO: 22689 - DNA, 506 bp, Artificial Sequence
  chemically treated genomic DNA (Homo sapiens) CpG-island No: 22689
cgcgtcgacggcggtttgttttgggtttttcgtcgcgcgtcgagtggcggttcggttgttgtattcgagcggcgttcgaggttttcgcgtttattcgcgtcggttaaggtcgggagttagagtttaggggagtcgtcgttttcgttttcgtattgtcggggggcgggtttaagagtgttggttaggttttgtaagtgcgagtgttcgcgagttgtaggggaggtaggacgcgttatattcgcgggggcgtttcgagtttttggggtgcgtcggcggggagggagagaaggagtttgagtattcgttgggcgcggtattgggtagaggcgcgcgtgttgtcggtgtattgaagttgttcgcgatcggcgggagcggcgtttttcgttttttcggggttcggtattcgaagcgtacggtagtttgatttcggttgggaagcgttaagttttagtagagggttgggagggagtgtaggagtatttgcggggtttgcgtagaatatatag

SEQ ID NO: 22690 - DNA, 506 bp, Artificial Sequence
  chemically treated genomic DNA (Homo sapiens) CpG-island No: 22690
ctatatattctacgcaaaccccgcaaatactcctacactccctcccaaccctctactaaaacttaacgcttcccaaccgaaatcaaactaccgtacgcttcgaataccgaaccccgaaaaaacgaaaaacgccgctcccgccgatcgcgaacaacttcaatacaccgacaacacgcgcgcctctacccaataccgcgcccaacgaatactcaaactccttctctccctccccgccgacgcaccccaaaaactcgaaacgcccccgcgaatataacgcgtcctacctcccctacaactcgcgaacactcgcacttacaaaacctaaccaacactcttaaacccgccccccgacaatacgaaaacgaaaacgacgactcccctaaactctaactcccgaccttaaccgacgcgaataaacgcgaaaacctcgaacgccgctcgaatacaacaaccgaaccgccactcgacgcgcgacgaaaaacccaaaacaaaccgccgtcgacgcg

SEQ ID NO: 22691 - DNA, 506 bp, Artificial Sequence
  chemically treated genomic DNA (Homo sapiens) CpG-island No: 22691
ttgtgtattttgcgtagatttcgtaagtgtttttgtatttttttttagttttttgttggggtttaacgttttttagtcgaggttagattgtcgtgcgtttcgagtatcggatttcgaggaagcgagaaacgtcgttttcgtcggtcgcgggtagttttagtatatcggtaatacgcgcgtttttgtttagtgtcgcgtttagcgggtgtttagatttttttttttttttttcgtcggcgtattttagggattcggaacgttttcgcgagtgtgacgcgttttgttttttttgtagttcgcggatattcgtatttgtaaggtttggttagtatttttgggttcgtttttcgatagtgcgggggcggagacgacggtttttttaggttttggttttcggttttggtcggcgcgggtaggcgcgggagtttcgagcgtcgttcggatgtagtagtcgagtcgttattcggcgcgcggcgggagatttagggtaagtcgtcgtcggcgcg

SEQ ID NO: 22692 - DNA, 506 bp, Artificial Sequence
  chemically treated genomic DNA (Homo sapiens) CpG-island No: 22692
cgcgccgacgacgacttaccctaaatctcccgccgcgcgccgaataacgactcgactactacatccgaacgacgctcgaaactcccgcgcctacccgcgccgaccaaaaccgaaaaccaaaacctaaaaaaaccgtcgtctccgcccccgcactatcgaaaaacgaacccaaaaatactaaccaaaccttacaaatacgaatatccgcgaactacaaaaaaaacaaaacgcgtcacactcgcgaaaacgttccgaatccctaaaatacgccgacgaaaaaaaaaaaaaaaaatctaaacacccgctaaacgcgacactaaacaaaaacgcgcgtattaccgatatactaaaactacccgcgaccgacgaaaacgacgtttctcgcttcctcgaaatccgatactcgaaacgcacgacaatctaacctcgactaaaaaacgttaaaccccaacaaaaaactaaaaaaaaatacaaaaacacttacgaaatctacgcaaaatacacaa

SEQ ID NO: 22693 - DNA, 800 bp, Artificial Sequence
  chemically treated genomic DNA (Homo sapiens) CpG-island No: 22693
ttagggatttatgatttgattttttcggggtcggcgtttttgcggaagcggcggtggttcgggagttagattcggtttttacgtcgtcgggagtatttttttcgttatttgcggtcgggttttttcgatagggttcggcggtttttgtaggacgcgagttggggggtttcgaaggcggtcggcgcgttttttcgcgttttttataattttcggcgttcggtttcgcgtttttgattcgggtgttatcgcggagttgcgggaggtttcggcggttttcggacgcggtcgggaaagtggcgagcgcgcgttcgcgttcgcgttttcgttcgcgaacgtcggtttcggttattttcggcgcggcgtttttcggtaagtttcgtagtcgtttgtcggaaatggttgtcggtcggtagggggagcggcggattaggcgcggtttggaaggcgggcggtcggtagttagaacggtttttgggacgtcgattttcgcgtaggcggcggcggcggcggcggcgggtttttgagttggaagtcggtaggattgttggtcgcgcgtgagttcgaggagcgggggtcgcgttcggaagggtttatgggagggtgtcggggttggtttcgagcgttggggacgcggcgggagggatcgggttcgtcgtgtttcggggaggttgttgttgttcggcggcgggaggtatgtagttttcgagcggagtaggtttgttcggtggttcgggggttcggggagaggtcgttaggttttcggtcggtagtcgggagggttaacgggtttttgggttggg

SEQ ID NO: 22694 - DNA, 800 bp, Artificial Sequence
  chemically treated genomic DNA (Homo sapiens) CpG-island No: 22694
cccaacccaaaaacccgttaaccctcccgactaccgaccgaaaacctaacgacctctccccgaacccccgaaccaccgaacaaacctactccgctcgaaaactacatacctcccgccgccgaacaacaacaacctccccgaaacacgacgaacccgatccctcccgccgcgtccccaacgctcgaaaccaaccccgacaccctcccataaacccttccgaacgcgacccccgctcctcgaactcacgcgcgaccaacaatcctaccgacttccaactcaaaaacccgccgccgccgccgccgccgcctacgcgaaaatcgacgtcccaaaaaccgttctaactaccgaccgcccgccttccaaaccgcgcctaatccgccgctccccctaccgaccgacaaccatttccgacaaacgactacgaaacttaccgaaaaacgccgcgccgaaaataaccgaaaccgacgttcgcgaacgaaaacgcgaacgcgaacgcgcgctcgccactttcccgaccgcgtccgaaaaccgccgaaacctcccgcaactccgcgataacacccgaatcaaaaacgcgaaaccgaacgccgaaaattataaaaaacgcgaaaaaacgcgccgaccgccttcgaaaccccccaactcgcgtcctacaaaaaccgccgaaccctatcgaaaaaacccgaccgcaaataacgaaaaaaatactcccgacgacgtaaaaaccgaatctaactcccgaaccaccgccgcttccgcaaaaacgccgaccccgaaaaaatcaaatcataaatccctaa

SEQ ID NO: 22695 - DNA, 800 bp, Artificial Sequence
  chemically treated genomic DNA (Homo sapiens) CpG-island No: 22695
tttagtttagggattcgttagttttttcggttgtcggtcgagggtttggcggttttttttcgggttttcgagttatcgggtaggtttatttcgttcggaggttgtatgtttttcgtcgtcgggtagtagtagttttttcggggtacggcggattcggtttttttcgtcgcgtttttagcgttcggggttagtttcggtatttttttatgagttttttcgggcgcggttttcgtttttcgggtttacgcgcggttagtagttttatcggtttttagtttagggattcgtcgtcgtcgtcgtcgtcgtttgcgcgaaagtcggcgttttagaagtcgttttggttgtcggtcgttcgttttttaggtcgcgtttgattcgtcgttttttttgtcggtcggtagttattttcgataggcgattgcggaatttgtcgaagggcgtcgcgtcggaaatggtcgaagtcggcgttcgcgagcgggggcgcggacgcgggcgcgcgttcgttattttttcgatcgcgttcgaagatcgtcgaggtttttcgtagtttcgcggtgatattcgggttaggggcgcggggtcgggcgtcggggattgtgggaggcgcgggggggcgcgtcggtcgttttcggagttttttaattcgcgttttgtaaaggtcgtcgggttttgtcgagaagattcgatcgtagatggcggggaggatgttttcggcggcgtgggaatcgggtttgattttcgagttatcgtcgttttcgtaggggcgtcggtttcgggaaagttaagttataaatttttga

SEQ ID NO: 22696 - DNA, 800 bp, Artificial Sequence
  chemically treated genomic DNA (Homo sapiens) CpG-island No: 22696
tcaaaaatttataacttaactttcccgaaaccgacgcccctacgaaaacgacgataactcgaaaatcaaacccgattcccacgccgccgaaaacatcctccccgccatctacgatcgaatcttctcgacaaaacccgacgacctttacaaaacgcgaattaaaaaactccgaaaacgaccgacgcgcccccccgcgcctcccacaatccccgacgcccgaccccgcgcccctaacccgaatatcaccgcgaaactacgaaaaacctcgacgatcttcgaacgcgatcgaaaaaataacgaacgcgcgcccgcgtccgcgcccccgctcgcgaacgccgacttcgaccatttccgacgcgacgcccttcgacaaattccgcaatcgcctatcgaaaataactaccgaccgacaaaaaaaacgacgaatcaaacgcgacctaaaaaacgaacgaccgacaaccaaaacgacttctaaaacgccgactttcgcgcaaacgacgacgacgacgacgacgaatccctaaactaaaaaccgataaaactactaaccgcgcgtaaacccgaaaaacgaaaaccgcgcccgaaaaaactcataaaaaaataccgaaactaaccccgaacgctaaaaacgcgacgaaaaaaaccgaatccgccgtaccccgaaaaaactactactacccgacgacgaaaaacatacaacctccgaacgaaataaacctacccgataactcgaaaacccgaaaaaaaaccgccaaaccctcgaccgacaaccgaaaaaactaacgaatccctaaactaaa

SEQ ID NO: 22697 - DNA, 586 bp, Artificial Sequence
  chemically treated genomic DNA (Homo sapiens) CpG-island No: 22697
  misc_feature (378)..(378): n is either a, c, g or t
attggaagttcgttttggttaaggcgtatttgaacgacgaggagacggcggtagtggaggcgatcgtgttgtttttttaggacgaattcggatcggttaggaaggtagcgttcgtttcgttggggatagtcggttatagtatttcggttattttttttttttcgatttaggcggcggtttcgaggggtaggaggcggcgagagggtagcggcggttaggggcgtagtaagtatcggaaaagttagcgagcggaagggagtaggcgaattggattttcgcgggagggggcgcgtaggggttcgtttacgttagttttggtttcgcgttcgtcgcgggttatgaaattcggttcgggtcgttatcgaattgggttatcgnggtagttagtaatttttttcgttcgttggtaacgtcgagttaatataataggggcgcgtagggaatcgtcgcggataattttttcgattgcgtttttttcgaggggtcgcgggtttcgttttgtataatcgcgttaaaaggcgtaattgaggtttaaggggaaatttggttttttggagggtttttaattttggggaagggtggtttt

SEQ ID NO: 22698 - DNA, 586 bp, Artificial Sequence
  chemically treated genomic DNA (Homo sapiens) CpG-island No: 22698
  misc_feature (209)..(209): n is either a, c, g or t
aaaaccacccttccccaaaattaaaaaccctccaaaaaaccaaatttccccttaaacctcaattacgccttttaacgcgattatacaaaacgaaacccgcgacccctcgaaaaaaacgcaatcgaaaaaattatccgcgacgattccctacgcgcccctattatattaactcgacgttaccaacgaacgaaaaaaattactaactaccncgataacccaattcgataacgacccgaaccgaatttcataacccgcgacgaacgcgaaaccaaaactaacgtaaacgaacccctacgcgccccctcccgcgaaaatccaattcgcctactcccttccgctcgctaacttttccgatacttactacgcccctaaccgccgctaccctctcgccgcctcctacccctcgaaaccgccgcctaaatcgaaaaaaaaaaaataaccgaaatactataaccgactatccccaacgaaacgaacgctaccttcctaaccgatccgaattcgtcctaaaaaaacaacacgatcgcctccactaccgccgtctcctcgtcgttcaaatacgccttaaccaaaacgaacttccaat

SEQ ID NO: 22699 - DNA, 586 bp, Artificial Sequence
  chemically treated genomic DNA (Homo sapiens) CpG-island No: 22699
  misc_feature (209)..(209): n is either a, c, g or t
ggaattatttttttttaaagttaaaagttttttaaaaagttaagtttttttttgaattttagttgcgttttttggcgcggttatatagggcgggattcgcggtttttcgggaaaagcgtagtcgggaaagttattcgcggcggttttttgcgcgtttttgttgtgttagttcggcgttgttagcggacggagaaagttgttggttgttncgatagtttagttcggtggcggttcgggtcggattttatggttcgcggcgaacgcggggttagagttggcgtgggcgagtttttgcgcgttttttttcgcggggatttagttcgtttgttttttttcgttcgttggttttttcgatgtttgttgcgtttttggtcgtcgttgttttttcgtcgttttttatttttcggagtcgtcgtttaagtcgaggaggagagaatgatcgaggtgttgtggtcggttgtttttaacgggacggacgttgtttttttggtcggttcgggttcgttttgggggaatagtacggtcgtttttattgtcgtcgttttttcgtcgtttaaatgcgttttgattaagacgggtttttagt

SEQ ID NO: 22700 - DNA, 586 bp, Artificial Sequence
  chemically treated genomic DNA (Homo sapiens) CpG-island No: 22700
  misc_feature (378)..(378): n is either a, c, g or t
actaaaaacccgtcttaatcaaaacgcatttaaacgacgaaaaaacgacgacaataaaaacgaccgtactattcccccaaaacgaacccgaaccgaccaaaaaaacaacgtccgtcccgttaaaaacaaccgaccacaacacctcgatcattctctcctcctcgacttaaacgacgactccgaaaaataaaaaacgacgaaaaaacaacgacgaccaaaaacgcaacaaacatcgaaaaaaccaacgaacgaaaaaaaacaaacgaactaaatccccgcgaaaaaaaacgcgcaaaaactcgcccacgccaactctaaccccgcgttcgccgcgaaccataaaatccgacccgaaccgccaccgaactaaactatcgnaacaaccaacaactttctccgtccgctaacaacgccgaactaacacaacaaaaacgcgcaaaaaaccgccgcgaataactttcccgactacgcttttcccgaaaaaccgcgaatcccgccctatataaccgcgccaaaaaacgcaactaaaattcaaaaaaaaacttaactttttaaaaaacttttaactttaaaaaaaaataattcc

SEQ ID NO: 22701 - DNA, 728 bp, Artificial Sequence
  chemically treated genomic DNA (Homo sapiens) CpG-island No: 22701
gtttgcggtaggcggtaggaggcgagcgtggtttaggaattttcgcgggagggtcgggacgcggcggggtttgggggcggggcggtttaacgcgtaggcgcggggttaggcgtttcgcgcggttaggggcgggcggtcgtagagtagtatcggtcgtggtttcggtagtagtaagtacgaatttcgttttcgtttcgtttcggttttcgttttttcggtttttgggtttttaaatattagttttcggtagttcgttgtgtattgcgtttttttcgttttaggatgtcggtaatcgagaaggatttagttgaggacgcgttttggaagaagatttagtagaatacgtttatacgttggtgtaacgagtattttaagtgcgtgaataaacgtatcggtaatttgtagatcgatttgagcgacgggttgcggtttatcgcgttgttcgaggtgtttagttagaagcgtatgtatcgtaagtattattagcggtttatttttcgttagatgtagttcgagaatgtgttcgtggcgttcgagtttttggatcgtgagagtattaagttcgtgtttatcggtgagttttttggtcgggtttaggcgtttattgtggtgtcgattcgttttcgcgcgtgtatttttgcggagggcgaggatttttcgtagcgcgtttttatttcggagataagggggagtcgtttttaggggtgggttatagggggtttagattt

SEQ ID NO: 22702 - DNA, 728 bp, Artificial Sequence
  chemically treated genomic DNA (Homo sapiens) CpG-island No: 22702
aaatctaaaccccctataacccacccctaaaaacgactcccccttatctccgaaataaaaacgcgctacgaaaaatcctcgccctccgcaaaaatacacgcgcgaaaacgaatcgacaccacaataaacgcctaaacccgaccaaaaaactcaccgataaacacgaacttaatactctcacgatccaaaaactcgaacgccacgaacacattctcgaactacatctaacgaaaaataaaccgctaataatacttacgatacatacgcttctaactaaacacctcgaacaacgcgataaaccgcaacccgtcgctcaaatcgatctacaaattaccgatacgtttattcacgcacttaaaatactcgttacaccaacgtataaacgtattctactaaatcttcttccaaaacgcgtcctcaactaaatccttctcgattaccgacatcctaaaacgaaaaaaacgcaatacacaacgaactaccgaaaactaatatttaaaaacccaaaaaccgaaaaaacgaaaaccgaaacgaaacgaaaacgaaattcgtacttactactaccgaaaccacgaccgatactactctacgaccgcccgcccctaaccgcgcgaaacgcctaaccccgcgcctacgcgttaaaccgccccgcccccaaaccccgccgcgtcccgaccctcccgcgaaaattcctaaaccacgctcgcctcctaccgcctaccgcaaac

SEQ ID NO: 22703 - DNA, 728 bp, Artificial Sequence
  chemically treated genomic DNA (Homo sapiens) CpG-island No: 22703
gggtttaggttttttataatttatttttggggacgatttttttttattttcgaggtgggggcgcgttgcgggaaattttcgtttttcgtaggggtgtacgcgcgggggcgggtcggtattatagtgggcgtttgggttcggttagagaatttatcgatggatacgagtttgatgtttttacggtttaggaattcgagcgttacggatatattttcgagttgtatttggcgaaaggtgggtcgttgatggtatttgcggtatatgcgtttttggttgagtatttcgagtagcgcgatgagtcgtagttcgtcgtttaggtcggtttgtaggttgtcgatgcgtttgtttacgtatttgaggtgttcgttgtattagcgtgtgaacgtgttttgttggatttttttttaaggcgcgtttttagttagatttttttcggttatcggtattttggggcggggagagcgtaatgtataacgagttgtcggggattggtgtttggaggtttaagggtcgaaggagcgagagtcgaagcggagcgggagcggggttcgtatttgttgttatcggagttacggtcggtgttgttttgcggtcgttcgtttttggtcgcgcgaggcgtttggtttcgcgtttgcgcgttgagtcgtttcgtttttaagtttcgtcgcgtttcggttttttcgcgggagtttttgggttacgttcgttttttgtcgtttgtcgtaggt

SEQ ID NO: 22704 - DNA, 728 bp, Artificial Sequence
  chemically treated genomic DNA (Homo sapiens) CpG-island No: 22704
acctacgacaaacgacaaaaaacgaacgtaacccaaaaactcccgcgaaaaaaccgaaacgcgacgaaacttaaaaacgaaacgactcaacgcgcaaacgcgaaaccaaacgcctcgcgcgaccaaaaacgaacgaccgcaaaacaacaccgaccgtaactccgataacaacaaatacgaaccccgctcccgctccgcttcgactctcgctccttcgacccttaaacctccaaacaccaatccccgacaactcgttatacattacgctctccccgccccaaaataccgataaccgaaaaaaatctaactaaaaacgcgccttaaaaaaaaatccaacaaaacacgttcacacgctaatacaacgaacacctcaaatacgtaaacaaacgcatcgacaacctacaaaccgacctaaacgacgaactacgactcatcgcgctactcgaaatactcaaccaaaaacgcatataccgcaaataccatcaacgacccacctttcgccaaatacaactcgaaaatatatccgtaacgctcgaattcctaaaccgtaaaaacatcaaactcgtatccatcgataaattctctaaccgaacccaaacgcccactataataccgacccgcccccgcgcgtacacccctacgaaaaacgaaaatttcccgcaacgcgcccccacctcgaaaataaaaaaaaatcgtccccaaaaataaattataaaaaacctaaaccc

SEQ ID NO: 22705 - DNA, 540 bp, Artificial Sequence
  chemically treated genomic DNA (Homo sapiens) CpG-island No: 22705
agtgtagcgggtggttggttttgtttcgggatattcgtagcgggttatcggcgtttcggtatcggttggcgtttagttcgtggttttgcgttttgcggaagtagggtaggtagtgcgcgtagttttagtcgcgggcgttttggcgttgttagcgttcgtagttttcggcgtgtttacggacgtagattatggtattgagggatgaggagttattttagacgcggtcgcgtggttagtatagtacgcggtcgtttaggtttcgttgtatttttgtgtggtagtattagttgtatttgtcgtcgtataggttggttattagggtcgcgggtatgtggattttttacgagagtcgtttgtttttcgcgagtacgtttttgggttcggtttttagtagtagtacgcgttcggcggggtttttcgtgagttttttagttagtacgtagttcgtcgagttcgcgtttattattatatagttgtattcgtttcggtttttagagtttgcgttggttagggttcgggtatttagggattgttgttgtt

SEQ ID NO: 22706 - DNA, 540 bp, Artificial Sequence
  chemically treated genomic DNA (Homo sapiens) CpG-island No: 22706
aacaacaacaatccctaaatacccgaaccctaaccaacgcaaactctaaaaaccgaaacgaatacaactatataataataaacgcgaactcgacgaactacgtactaactaaaaaactcacgaaaaaccccgccgaacgcgtactactactaaaaaccgaacccaaaaacgtactcgcgaaaaacaaacgactctcgtaaaaaatccacatacccgcgaccctaataaccaacctatacgacgacaaatacaactaatactaccacacaaaaatacaacgaaacctaaacgaccgcgtactatactaaccacgcgaccgcgtctaaaataactcctcatccctcaataccataatctacgtccgtaaacacgccgaaaactacgaacgctaacaacgccaaaacgcccgcgactaaaactacgcgcactacctaccctacttccgcaaaacgcaaaaccacgaactaaacgccaaccgataccgaaacgccgataacccgctacgaatatcccgaaacaaaaccaaccacccgctacact

SEQ ID NO: 22707 - DNA, 540 bp, Artificial Sequence
  chemically treated genomic DNA (Homo sapiens) CpG-island No: 22707
ggtagtagtaatttttgggtgttcgggttttggttagcgtaggttttgagagtcgggacgagtatagttatgtggtggtgggcgcgggttcggcgggttgcgtgttggttgggaggtttacggaggatttcgtcgagcgcgtgttgttgttggaggtcgggtttaaggacgtgttcgcggggagtaagcggttttcgtggaagatttatatgttcgcggttttggtggttaatttgtgcgacgataggtataattggtgttattatatagaggtgtagcggggtttggacggtcgcgtgttgtattggttacgcggtcgcgtttggggtggttttttattttttaatgttatggtttacgttcgtgggtacgtcgaggattacgagcgttggtagcgttagggcgttcgcggttgggattacgcgtattgtttgttttattttcgtaaggcgtagggttacgagttgggcgttagtcggtatcggggcgtcgatggttcgttgcgggtgtttcggggtaagattaattattcgttgtatt

SEQ ID NO: 22708 - DNA, 540 bp, Artificial Sequence
  chemically treated genomic DNA (Homo sapiens) CpG-island No: 22708
aatacaacgaataattaatcttaccccgaaacacccgcaacgaaccatcgacgccccgataccgactaacgcccaactcgtaaccctacgccttacgaaaataaaacaaacaatacgcgtaatcccaaccgcgaacgccctaacgctaccaacgctcgtaatcctcgacgtacccacgaacgtaaaccataacattaaaaaataaaaaaccaccccaaacgcgaccgcgtaaccaatacaacacgcgaccgtccaaaccccgctacacctctatataataacaccaattatacctatcgtcgcacaaattaaccaccaaaaccgcgaacatataaatcttccacgaaaaccgcttactccccgcgaacacgtccttaaacccgacctccaacaacaacacgcgctcgacgaaatcctccgtaaacctcccaaccaacacgcaacccgccgaacccgcgcccaccaccacataactatactcgtcccgactctcaaaacctacgctaaccaaaacccgaacacccaaaaattactactacc

SEQ ID NO: 22709 - DNA, 615 bp, Artificial Sequence
  chemically treated genomic DNA (Homo sapiens) CpG-island No: 22709
cgtgttcgagcgttggcggagtacgggtcgtcgcggcgcgcgtttattttcgcgtatacgtgtatgtagtgagttaggtgtattagttgtattcgttttcgggtttcgcgcgttttcgttggagtttagttagtttcgcggtttcggggtcgatcgggtcggaattgttgcgtttttatttcggacgtagagagcgcgcggggcgtcggcgtcgtcggttaaagtgtcgcggggtaggggtcgggtcgcggttattcgtttttttcgtttcggtttcgattgtcgggttttcggtcgagtcgtttcgggtgagtagtcgcggaggcgtttcgattatttcgtagtagcgtcgttcggtcgttagttcggagaggtttgggggtcggaggtttggggtcgggttggacgtcgagattcgggttcgttttatataatcgtttcgtcgcgcgaagcgaaacgggtggaacgtagattgtcgaagtttattgatttttttgagggagcgaatttttttagttacgcggggttagagcggtaggagtgttcgttgatcgattttaggttttttggtaaatgtttgtttttattaagtgagttcggatagtaatatttggg

SEQ ID NO: 22710 - DNA, 615 bp, Artificial Sequence
  chemically treated genomic DNA (Homo sapiens) CpG-island No: 22710
cccaaatattactatccgaactcacttaataaaaacaaacatttaccaaaaaacctaaaatcgatcaacgaacactcctaccgctctaaccccgcgtaactaaaaaaattcgctccctcaaaaaaatcaataaacttcgacaatctacgttccacccgtttcgcttcgcgcgacgaaacgattatataaaacgaacccgaatctcgacgtccaacccgaccccaaacctccgacccccaaacctctccgaactaacgaccgaacgacgctactacgaaataatcgaaacgcctccgcgactactcacccgaaacgactcgaccgaaaacccgacaatcgaaaccgaaacgaaaaaaacgaataaccgcgacccgacccctaccccgcgacactttaaccgacgacgccgacgccccgcgcgctctctacgtccgaaataaaaacgcaacaattccgacccgatcgaccccgaaaccgcgaaactaactaaactccaacgaaaacgcgcgaaacccgaaaacgaatacaactaatacacctaactcactacatacacgtatacgcgaaaataaacgcgcgccgcgacgacccgtactccgccaacgctcgaacacg

SEQ ID NO: 22711 - DNA, 615 bp, Artificial Sequence
  chemically treated genomic DNA (Homo sapiens) CpG-island No: 22711
tttaggtgttgttgttcgaatttatttggtggaaatagatatttattagaaagtttggggtcggttagcgggtatttttatcgttttaatttcgcgtagttgaaagaattcgtttttttaaaggagttagtgagtttcggtagtttgcgttttattcgtttcgtttcgcgcggcggggcgattgtgtaaagcgggttcgggtttcggcgtttagttcggttttaaattttcggtttttaggttttttcgggttagcggtcgggcggcgttgttgcggggtggtcggggcgttttcgcggttatttattcggggcgattcggtcgagagttcgatagtcgggatcggagcgggaggagcgggtggtcgcggttcggtttttgtttcgcggtattttaatcggcggcgtcggcgtttcgcgcgttttttgcgttcggaatggggacgtagtagtttcgattcggtcggtttcggagtcgcgaggttagttgggttttagcggaggcgcgcgaagttcgagggcgggtgtagttgatgtatttggtttattgtatgtacgtgtgcgcgggggtaggcgcgcgtcgcggcggttcgtgtttcgttagcgttcggatacg

SEQ ID NO: 22712 - DNA, 615 bp, Artificial Sequence
  chemically treated genomic DNA (Homo sapiens) CpG-island No: 22712
cgtatccgaacgctaacgaaacacgaaccgccgcgacgcgcgcctacccccgcgcacacgtacatacaataaaccaaatacatcaactacacccgccctcgaacttcgcgcgcctccgctaaaacccaactaacctcgcgactccgaaaccgaccgaatcgaaactactacgtccccattccgaacgcaaaaaacgcgcgaaacgccgacgccgccgattaaaataccgcgaaacaaaaaccgaaccgcgaccacccgctcctcccgctccgatcccgactatcgaactctcgaccgaatcgccccgaataaataaccgcgaaaacgccccgaccaccccgcaacaacgccgcccgaccgctaacccgaaaaaacctaaaaaccgaaaatttaaaaccgaactaaacgccgaaacccgaacccgctttacacaatcgccccgccgcgcgaaacgaaacgaataaaacgcaaactaccgaaactcactaactcctttaaaaaaacgaattctttcaactacgcgaaattaaaacgataaaaatacccgctaaccgaccccaaactttctaataaatatctatttccaccaaataaattcgaacaacaacacctaaa

SEQ ID NO: 22713 - DNA, 715 bp, Artificial Sequence
  chemically treated genomic DNA (Homo sapiens) CpG-island No: 22713
attattttcgtaaatttataattaagcgtttgttgtacgaaggcggggttgtagggtttttagtatttaacgtgaggtcggcgggatttcggttttcgattgtcggtttagagattatcggttgacgcgtcgtaagtcgaggcgatttcggtttagtttcgttcggtcgcggggcgttaagttcggggaagtcgtatcgggtttaagatttagcgagcgacgatgaaaggaatttggagttcgattttataagttatcggtcgaagttatagttcgtttttaatttatcgttcgagatgtaaattattttgttttattttttcgtttcggagttatcgggcgtttggtttttgtcggtttttgtatttttttttgtttttcgtttttcgagcgttataggtcgcgattagataaaatgttgacgaggacgaaggtgggtagagtttattggttgttgaaagagacgcgttttcgacgggcgtttttgtatcgttatatttgcgatttttggttaggcggaggcggtcgagttgataatcggatatgacgttaaggattgttttgtagtgttcgcggttgttagttttttattcgatttgatcgtgtagagttggttcgtatcgtttagtgaggggaagttgttttttcgtcgattgataggtttcgggtttgggtaggagaggttgttttgtatgaggtagtttgaagggtcgtt

SEQ ID NO: 22714 - DNA, 715 bp, Artificial Sequence
  chemically treated genomic DNA (Homo sapiens) CpG-island No: 22714
aacgacccttcaaactacctcatacaaaacaacctctcctacccaaacccgaaacctatcaatcgacgaaaaaacaacttcccctcactaaacgatacgaaccaactctacacgatcaaatcgaataaaaaactaacaaccgcgaacactacaaaacaatccttaacgtcatatccgattatcaactcgaccgcctccgcctaaccaaaaatcgcaaatataacgatacaaaaacgcccgtcgaaaacgcgtctctttcaacaaccaataaactctacccaccttcgtcctcgtcaacattttatctaatcgcgacctataacgctcgaaaaacgaaaaacaaaaaaaaatacaaaaaccgacaaaaaccaaacgcccgataactccgaaacgaaaaaataaaacaaaataatttacatctcgaacgataaattaaaaacgaactataacttcgaccgataacttataaaatcgaactccaaattcctttcatcgtcgctcgctaaatcttaaacccgatacgacttccccgaacttaacgccccgcgaccgaacgaaactaaaccgaaatcgcctcgacttacgacgcgtcaaccgataatctctaaaccgacaatcgaaaaccgaaatcccgccgacctcacgttaaatactaaaaaccctacaaccccgccttcgtacaacaaacgcttaattataaatttacgaaaataat

SEQ ID NO: 22715 - DNA, 715 bp, Artificial Sequence
  chemically treated genomic DNA (Homo sapiens) CpG-island No: 22715
agcggttttttaagttattttatatagggtagttttttttatttagattcggagtttattaatcgacgagaaaatagtttttttttattgggcggtgcgaattaattttgtacgattaagtcggatagaggattggtaatcgcgggtattatagggtagtttttaacgttatattcggttgttagttcggtcgttttcgtttaattagaagtcgtagatgtgacgatgtaaaaacgttcgtcgggggcgcgttttttttagtagttaatgggttttgtttattttcgttttcgttagtattttgtttaatcgcggtttgtgacgttcgaagggcggggagtagagggagatatagaaatcgataggggttaggcgttcggtggtttcgaagcggggaagtgggataagatggtttatatttcgaacggtaagttgagagcgggttgtggtttcgatcggtgatttgtaagatcggattttaggttttttttatcgtcgttcgttgagttttgagttcggtgcggttttttcgggtttagcgtttcgcggtcgggcggagttggatcgaagtcgtttcggtttgcggcgcgttagtcgatggtttttgagtcggtagtcgggggtcgaggtttcgtcggttttacgttgagtattgggagttttgtaatttcgttttcgtgtagtaagcgtttgattgtggatttgcgagggtggt

SEQ ID NO: 22716 - DNA, 715 bp, Artificial Sequence
  chemically treated genomic DNA (Homo sapiens) CpG-island No: 22716
accaccctcgcaaatccacaatcaaacgcttactacacgaaaacgaaattacaaaactcccaatactcaacgtaaaaccgacgaaacctcgacccccgactaccgactcaaaaaccatcgactaacgcgccgcaaaccgaaacgacttcgatccaactccgcccgaccgcgaaacgctaaacccgaaaaaaccgcaccgaactcaaaactcaacgaacgacgataaaaaaaacctaaaatccgatcttacaaatcaccgatcgaaaccacaacccgctctcaacttaccgttcgaaatataaaccatcttatcccacttccccgcttcgaaaccaccgaacgcctaacccctatcgatttctatatctccctctactccccgcccttcgaacgtcacaaaccgcgattaaacaaaatactaacgaaaacgaaaataaacaaaacccattaactactaaaaaaaacgcgcccccgacgaacgtttttacatcgtcacatctacgacttctaattaaacgaaaacgaccgaactaacaaccgaatataacgttaaaaactaccctataatacccgcgattaccaatcctctatccgacttaatcgtacaaaattaattcgcaccgcccaataaaaaaaaactattttctcgtcgattaataaactccgaatctaaataaaaaaaactaccctatataaaataacttaaaaaaccgct

SEQ ID NO: 22717 - DNA, 521 bp, Artificial Sequence
  chemically treated genomic DNA (Homo sapiens) CpG-island No: 22717
cgggaagcgaaagcggtggaaaggtcgtattggttatcgataatttttagttcggttaggtcggagatgttgaattattgtcggagttcggtcgtttgtcgaggtttttatatttcgtggtatcgggcgacgttaaggatgataggagaggtggttcgttattttttagttattagagttttgttttaaattttttagagatcgggatttaacgtattatggtggcggcgcgggtttggttgcggtttttagtaaaattgagaattaaggaggtgttgtcgaaagtatcgtttagcgatttatagagaagtttgcgggagtttgacggcggcggcgtagggtagcgtagtttattttagagatatcgataggtttgtaatatttttttttttttaaaatttttcgatcgttcggcggcgggcggagtttcggaagatttaggaattgagattggcgggaaaatttggttgggagtgtcggcggttgagagttgcggggtagtttttgttacgtagtttttt

SEQ ID NO: 22718 - DNA, 521 bp, Artificial Sequence
  chemically treated genomic DNA (Homo sapiens) CpG-island No: 22718
aaaaaactacgtaacaaaaactaccccgcaactctcaaccgccgacactcccaaccaaattttcccgccaatctcaattcctaaatcttccgaaactccgcccgccgccgaacgatcgaaaaattttaaaaaaaaaaaaatattacaaacctatcgatatctctaaaataaactacgctaccctacgccgccgccgtcaaactcccgcaaacttctctataaatcgctaaacgatactttcgacaacacctccttaattctcaattttactaaaaaccgcaaccaaacccgcgccgccaccataatacgttaaatcccgatctctaaaaaatttaaaacaaaactctaataactaaaaaataacgaaccacctctcctatcatccttaacgtcgcccgataccacgaaatataaaaacctcgacaaacgaccgaactccgacaataattcaacatctccgacctaaccgaactaaaaattatcgataaccaatacgacctttccaccgctttcgcttcccg

SEQ ID NO: 22719 - DNA, 521 bp, Artificial Sequence
  chemically treated genomic DNA (Homo sapiens) CpG-island No: 22719
gaagggttacgtgataggggttgtttcgtagtttttagtcgtcggtatttttagttaggttttttcgttagttttagtttttagatttttcgaggtttcgttcgtcgtcgagcggtcggaaagttttaaggagggggaagtgttgtaagtttatcgatatttttggaatagattgcgttattttgcgtcgtcgtcgttaaattttcgtagatttttttgtagatcgttgagcgatattttcggtagtatttttttgatttttagttttgttggaggtcgtaattaggttcgcgtcgttattatggtacgttgaatttcgatttttggaaggtttagggtagagttttggtgattgggggatgacgagttattttttttgttatttttagcgtcgttcggtgttacgaggtatgagagtttcggtagacggtcgggtttcggtagtgatttagtattttcggtttggtcgggttaggggttatcggtagttagtgcggtttttttatcgttttcgtttttcg

SEQ ID NO: 22720 - DNA, 521 bp, Artificial Sequence
  chemically treated genomic DNA (Homo sapiens) CpG-island No: 22720
cgaaaaacgaaaacgataaaaaaaccgcactaactaccgataacccctaacccgaccaaaccgaaaatactaaatcactaccgaaacccgaccgtctaccgaaactctcatacctcgtaacaccgaacgacgctaaaaataacaaaaaaaataactcgtcatcccccaatcaccaaaactctaccctaaaccttccaaaaatcgaaattcaacgtaccataataacgacgcgaacctaattacgacctccaacaaaactaaaaatcaaaaaaatactaccgaaaatatcgctcaacgatctacaaaaaaatctacgaaaatttaacgacgacgacgcaaaataacgcaatctattccaaaaatatcgataaacttacaacacttccccctccttaaaactttccgaccgctcgacgacgaacgaaacctcgaaaaatctaaaaactaaaactaacgaaaaaacctaactaaaaataccgacgactaaaaactacgaaacaacccctatcacgtaacccttc

SEQ ID NO: 22721 - DNA, 959 bp, Artificial Sequence
  chemically treated genomic DNA (Homo sapiens) CpG-island No: 22721
tcgcgaggtcgaggtcggggtcggggtgggttcggaggttaagttttcgaacgggaagggtcgacgggtcgtagttcggagtttagttcggtagcgggcgaggttttaggtcgttttttcgaggtttgattttgcgcgtgggtttcgtgcgttttttaagtttcgcgtgggtagagcgggttcggggtttttcgagttttcggggcggcgtcggcggtcgcgtttaggtggggcgggttcggcgggatcggtttgtgtttatttggttcgtaggaagttcggggaggcggggtcggggagttgggtgcgcgttcgtttttcggagtcgtcgtcgttagttatcgtcgtcgcgcgttagagagaagtagttttcggtttcggcggtttttgtttttcgatttcggaaggcgaagtaggttgttcggggatttcgcgcgtgggcgtttgaagtcgagattagtttgttcgggtttgggtaggcggagtagggttttggatttcgcggcgtttttcggtttcggagtaacgagcgtagcgtcggtgggtgattttcggggacgggcgggttgttttgtcgtttttgtttttgtgttttttcgagtggggatcgcggagatttgggcgggatttcggatcggagtttcgcgggagtcgggggcgtaagatcggggataggagttatttcgacgttcggatttcgggttttttttttggttggggacgcgtagggagaatttaggtagcggagtaggtggtcgagtaggtagtagtcggcggtttttttgattcgaatttaagtcgtcgttttcgatttttattgcgcgggggttgggcgcgggtgtagacgcgggtttatagcgtcggggttcgattttgataggtgtttaggggtggattttagttaggttcggcggttttagggtcgttgaaatcgttcggtttcgggtcgtggggttgag

SEQ ID NO: 22722 - DNA, 959 bp, Artificial Sequence
  chemically treated genomic DNA (Homo sapiens) CpG-island No: 22722
ctcaaccccacgacccgaaaccgaacgatttcaacgaccctaaaaccgccgaacctaactaaaatccacccctaaacacctatcaaaatcgaaccccgacgctataaacccgcgtctacacccgcgcccaacccccgcgcaataaaaatcgaaaacgacgacttaaattcgaatcaaaaaaaccgccgactactacctactcgaccacctactccgctacctaaattctccctacgcgtccccaaccaaaaaaaaaacccgaaatccgaacgtcgaaataactcctatccccgatcttacgcccccgactcccgcgaaactccgatccgaaatcccgcccaaatctccgcgatccccactcgaaaaaacacaaaaacaaaaacgacaaaacaacccgcccgtccccgaaaatcacccaccgacgctacgctcgttactccgaaaccgaaaaacgccgcgaaatccaaaaccctactccgcctacccaaacccgaacaaactaatctcgacttcaaacgcccacgcgcgaaatccccgaacaacctacttcgccttccgaaatcgaaaaacaaaaaccgccgaaaccgaaaactacttctctctaacgcgcgacgacgataactaacgacgacgactccgaaaaacgaacgcgcacccaactccccgaccccgcctccccgaacttcctacgaaccaaataaacacaaaccgatcccgccgaacccgccccacctaaacgcgaccgccgacgccgccccgaaaactcgaaaaaccccgaacccgctctacccacgcgaaacttaaaaaacgcacgaaacccacgcgcaaaatcaaacctcgaaaaaacgacctaaaacctcgcccgctaccgaactaaactccgaactacgacccgtcgacccttcccgttcgaaaacttaacctccgaacccaccccgaccccgacctcgacctcgcga

SEQ ID NO: 22723 - DNA, 959 bp, Artificial Sequence
  chemically treated genomic DNA (Homo sapiens) CpG-island No: 22723
tttagttttacggttcgaggtcgagcggttttagcgattttgggatcgtcgggtttggttggagtttatttttggatatttgttagggtcgggtttcggcgttgtaaattcgcgtttatattcgcgtttagttttcgcgtaatggggatcgggggcggcgatttgggttcgggttagggaggtcgtcggttgttatttgttcggttatttgtttcgttgtttaggttttttttgcgcgtttttagttaagaaagggattcggagttcgggcgtcgggatagtttttgttttcgattttgcgttttcggttttcgcggggtttcggttcggggtttcgtttaggttttcgcggtttttattcggaggggtatagagataaaggcggtagagtagttcgttcgttttcgagggttatttatcggcgttgcgttcgttgtttcgaggtcgaggggcgtcgcggggtttaaggttttgtttcgtttgtttaggttcgggtaggttggtttcggttttaagcgtttacgcgcggggttttcgggtagtttgtttcgtttttcggggtcgggagataggggtcgtcggggtcggaggttgtttttttttggcgcgcggcggcggtgattgacggcggcggtttcgagggacgggcgcgtatttagtttttcggtttcgttttttcgggttttttgcgagttaggtaaatataggtcgatttcgtcgggttcgttttatttggacgcggtcgtcggcgtcgtttcgggagttcggaggatttcgggttcgttttgtttacgcggaatttggggggcgtacggggtttacgcgtagggttagatttcggaggggcggtttggagtttcgttcgttgtcgaattgggtttcgaattgcggttcgtcgatttttttcgttcggaggtttggttttcgaatttatttcgatttcgatttcgatttcgcgg

SEQ ID NO: 22724 - DNA, 959 bp, Artificial Sequence
  chemically treated genomic DNA (Homo sapiens) CpG-island No: 22724
ccgcgaaatcgaaatcgaaatcgaaataaattcgaaaaccaaacctccgaacgaaaaaaatcgacgaaccgcaattcgaaacccaattcgacaacgaacgaaactccaaaccgcccctccgaaatctaaccctacgcgtaaaccccgtacgccccccaaattccgcgtaaacaaaacgaacccgaaatcctccgaactcccgaaacgacgccgacgaccgcgtccaaataaaacgaacccgacgaaatcgacctatatttacctaactcgcaaaaaacccgaaaaaacgaaaccgaaaaactaaatacgcgcccgtccctcgaaaccgccgccgtcaatcaccgccgccgcgcgccaaaaaaaaacaacctccgaccccgacgacccctatctcccgaccccgaaaaacgaaacaaactacccgaaaaccccgcgcgtaaacgcttaaaaccgaaaccaacctacccgaacctaaacaaacgaaacaaaaccttaaaccccgcgacgcccctcgacctcgaaacaacgaacgcaacgccgataaataaccctcgaaaacgaacgaactactctaccgcctttatctctatacccctccgaataaaaaccgcgaaaacctaaacgaaaccccgaaccgaaaccccgcgaaaaccgaaaacgcaaaatcgaaaacaaaaactatcccgacgcccgaactccgaatccctttcttaactaaaaacgcgcaaaaaaaacctaaacaacgaaacaaataaccgaacaaataacaaccgacgacctccctaacccgaacccaaatcgccgcccccgatccccattacgcgaaaactaaacgcgaatataaacgcgaatttacaacgccgaaacccgaccctaacaaatatccaaaaataaactccaaccaaacccgacgatcccaaaatcgctaaaaccgctcgacctcgaaccgtaaaactaaa

SEQ ID NO: 22725 - DNA, 515 bp, Artificial Sequence
  chemically treated genomic DNA (Homo sapiens) CpG-island No: 22725
gcgtaggcgtagaggaggttagcgttttttgttgtttcgtttcgcggtttttaggagataggggttacggggagagtatagttattcggcgcgaagagttttttgtatttcgtttttttttgaggttttcggatcgtttaggaaatgtttgggagttcgtttgcggagggtatagcgtcgattttcgtttttcgtttaggattcgaatgaatttggagagcggatgttagtagtggtcgaggcgttaggataggaaggatcgttagattttttaagattagtttttttcgttatcgtttttatttttttgttcgttgttttttttttaatgtttagtagcgcgtataggtttatttgtaagagttttttggttattgttatggtttcggtttgacggattcgtattataatttttaagagtttaagcgcgcgtgaggattgtaggttcggggattttatagagtaggatttgtaggcgatgtaagttatttttagtgtattaagaataaatggga

SEQ ID NO: 22726 - DNA, 515 bp, Artificial Sequence
  chemically treated genomic DNA (Homo sapiens) CpG-island No: 22726
tcccatttattcttaatacactaaaaataacttacatcgcctacaaatcctactctataaaatccccgaacctacaatcctcacgcgcgcttaaactcttaaaaattataatacgaatccgtcaaaccgaaaccataacaataaccaaaaaactcttacaaataaacctatacgcgctactaaacattaaaaaaaaaacaacgaacaaaaaaataaaaacgataacgaaaaaaactaatcttaaaaaatctaacgatccttcctatcctaacgcctcgaccactactaacatccgctctccaaattcattcgaatcctaaacgaaaaacgaaaatcgacgctataccctccgcaaacgaactcccaaacatttcctaaacgatccgaaaacctcaaaaaaaaacgaaatacaaaaaactcttcgcgccgaataactatactctccccgtaacccctatctcctaaaaaccgcgaaacgaaacaacaaaaaacgctaacctcctctacgcctacgc

SEQ ID NO: 22727 - DNA, 515 bp, Artificial Sequence
  chemically treated genomic DNA (Homo sapiens) CpG-island No: 22727
ttttatttatttttgatatattaagaatagtttgtatcgtttgtaggttttattttataggattttcgagtttgtagtttttacgcgcgtttagatttttgggagttgtagtacgaattcgttaggtcggaattatggtagtgattaaggagtttttatagatggatttgtacgcgttgttaggtattgaggagaaggtagcggataaagaggtgagaacggtggcgaggaaggttgattttgagaggtttggcggttttttttgttttagcgtttcggttattgttggtattcgttttttaggtttattcgggttttgggcggggagcgagggtcggcgttatgtttttcgtaggcgggtttttagatattttttggacggttcgagggttttaagaggaagcggggtatagagggtttttcgcgtcgggtggttgtgtttttttcgtggtttttgttttttagaggtcgcggggcgaggtagtaaggaacgttagttttttttgcgtttgcgt

SEQ ID NO: 22728 - DNA, 515 bp, Artificial Sequence
  chemically treated genomic DNA (Homo sapiens) CpG-island No: 22728
acgcaaacgcaaaaaaaactaacgttccttactacctcgccccgcgacctctaaaaaacaaaaaccacgaaaaaaacacaaccacccgacgcgaaaaaccctctataccccgcttcctcttaaaaccctcgaaccgtccaaaaaatatctaaaaacccgcctacgaaaaacataacgccgaccctcgctccccgcccaaaacccgaataaacctaaaaaacgaataccaacaataaccgaaacgctaaaacaaaaaaaaccgccaaacctctcaaaatcaaccttcctcgccaccgttctcacctctttatccgctaccttctcctcaatacctaacaacgcgtacaaatccatctataaaaactccttaatcactaccataattccgacctaacgaattcgtactacaactcccaaaaatctaaacgcgcgtaaaaactacaaactcgaaaatcctataaaataaaacctacaaacgatacaaactattcttaatatatcaaaaataaataaaa

SEQ ID NO: 22729 - DNA, 502 bp, Artificial Sequence
  chemically treated genomic DNA (Homo sapiens) CpG-island No: 22729
gggcgtcgtagcgtagttgtagtagtattcgggcgcgttcggggttgtgggagtcgaagtgagtgtattggatttggcggggttcgaaggtgtaggggaagcggcgcggggagagcgcgtttttgagtcgcggtagggcgtttagtatcgtgatttcgtatcggtttttcggttgtattttaattattagatttcggagcgggtcgagttaaagggaacgatttaggggtattcggagtttagggttggtaattagtacgttggggtcgtcggggcgagtgtcgttaagcgtatttcgggcgggtaggtaaagcgtcgggtcgggttcggttttaagtgaggatgttcgtttttgtagcgcggggcgatttaagagtaggtaggcgagcgttataaggagttgtcggggcgttttagtcgggtgtcgagaagttttcgttatggttacggatggtttttggcgttgggattttcggggtggggtgttttgtgtaaagaggga

SEQ ID NO: 22730 - DNA, 502 bp, Artificial Sequence
  chemically treated genomic DNA (Homo sapiens) CpG-island No: 22730
tccctctttacacaaaacaccccaccccgaaaatcccaacgccaaaaaccatccgtaaccataacgaaaacttctcgacacccgactaaaacgccccgacaactccttataacgctcgcctacctactcttaaatcgccccgcgctacaaaaacgaacatcctcacttaaaaccgaacccgacccgacgctttacctacccgcccgaaatacgcttaacgacactcgccccgacgaccccaacgtactaattaccaaccctaaactccgaatacccctaaatcgttccctttaactcgacccgctccgaaatctaataattaaaatacaaccgaaaaaccgatacgaaatcacgatactaaacgccctaccgcgactcaaaaacgcgctctccccgcgccgcttcccctacaccttcgaaccccgccaaatccaatacactcacttcgactcccacaaccccgaacgcgcccgaatactactacaactacgctacgacgccc

SEQ ID NO: 22731 - DNA, 502 bp, Artificial Sequence
  chemically treated genomic DNA (Homo sapiens) CpG-island No: 22731
tttttttttgtatagggtattttatttcgggaattttaacgttaggagttattcgtggttatggcgggggtttttcggtattcgattgggacgtttcggtagttttttgtggcgttcgtttgtttgtttttgagtcgtttcgcgttgtagggacgggtatttttatttgggatcgagttcgattcggcgttttatttgttcgttcggggtgcgtttgacggtattcgtttcgacggttttagcgtgttgattgttaattttggatttcgggtgtttttgggtcgttttttttggttcgattcgtttcgggatttggtgattggagtgtagtcgggggatcggtgcgaagttacggtattggacgttttgtcgcggtttaagggcgcgtttttttcgcgtcgttttttttgtattttcgggtttcgttaagtttagtatatttatttcggtttttatagtttcggacgcgttcgggtgttgttgtagttgcgttacgacgttt

SEQ ID NO: 22732 - DNA, 502 bp, Artificial Sequence
  chemically treated genomic DNA (Homo sapiens) CpG-island No: 22732
aaacgtcgtaacgcaactacaacaacacccgaacgcgtccgaaactataaaaaccgaaataaatatactaaacttaacgaaacccgaaaatacaaaaaaaacgacgcgaaaaaaacgcgcccttaaaccgcgacaaaacgtccaataccgtaacttcgcaccgatcccccgactacactccaatcaccaaatcccgaaacgaatcgaaccaaaaaaaacgacccaaaaacacccgaaatccaaaattaacaatcaacacgctaaaaccgtcgaaacgaataccgtcaaacgcaccccgaacgaacaaataaaacgccgaatcgaactcgatcccaaataaaaatacccgtccctacaacgcgaaacgactcaaaaacaaacaaacgaacgccacaaaaaactaccgaaacgtcccaatcgaataccgaaaaacccccgccataaccacgaataactcctaacgttaaaattcccgaaataaaataccctatacaaaaaaaaa

SEQ ID NO: 22733 - DNA, 528 bp, Artificial Sequence
  chemically treated genomic DNA (Homo sapiens) CpG-island No: 22733
cgatgtttgtgtcgatttatcgtattatgcgcgtcgtgtcgttgttcgcgtcgtttttgtcgttgttgttgttcgcgtttttggtcgttttcgtcgttcgcgttagtagagtcgagttcgttttcgcgtcgtggttcgaattcgagcgcgagtcgcggttatcgttcggttcggggttcgggaatattattcggtttgggtttggggcggcgggcggtagcggtagttttagttttaatagtagtggcgacgttttggtgattcgtatttttattttttttcgcgatttatttatttttaaggtagtcgtgatcgtggcgttcgtttttattattttttttatcgtttgtttgttgttgcgcgtttttaggtgggttttttcgtttttttttttttttcgtcggtcgatagggcggtatcgttaatttgttgtcgtcgcgcgttcgttttatttgtacgtataggtgttttggtgcgttttagttagtcgtgtgttttttgttttgttcgggagagtgggtggggggt

SEQ ID NO: 22734 - DNA, 528 bp, Artificial Sequence
  chemically treated genomic DNA (Homo sapiens) CpG-island No: 22734
accccccacccactctcccgaacaaaacaaaaaacacacgactaactaaaacgcaccaaaacacctatacgtacaaataaaacgaacgcgcgacgacaacaaattaacgataccgccctatcgaccgacgaaaaaaaaaaaaaaacgaaaaaacccacctaaaaacgcgcaacaacaaacaaacgataaaaaaaataataaaaacgaacgccacgatcacgactaccttaaaaataaataaatcgcgaaaaaaaataaaaatacgaatcaccaaaacgtcgccactactattaaaactaaaactaccgctaccgcccgccgccccaaacccaaaccgaataatattcccgaaccccgaaccgaacgataaccgcgactcgcgctcgaattcgaaccacgacgcgaaaacgaactcgactctactaacgcgaacgacgaaaacgaccaaaaacgcgaacaacaacaacgacaaaaacgacgcgaacaacgacacgacgcgcataatacgataaatcgacacaaacatcg

SEQ ID NO: 22735 - DNA, 528 bp, Artificial Sequence
  chemically treated genomic DNA (Homo sapiens) CpG-island No: 22735
gttttttatttattttttcgggtagggtaggaggtatacggttggttggggcgtattagggtatttgtgcgtgtaggtggggcgggcgcgcggcgatagtaggttggcgatgtcgttttgtcggtcggcgggggaaggaagagggcgggagggtttatttgaagacgcgtagtagtaggtaggcgatgaggagggtggtaaaggcgaacgttacgattacggttgttttgagggtgggtaggtcgcggaggaggatggaaatgcgggttattaaggcgtcgttattgttgttggagttggagttgtcgttgtcgttcgtcgttttagatttaaatcgggtggtgttttcgggtttcgggtcgggcggtggtcgcgattcgcgttcgggttcgggttacggcgcggagacggattcggttttgttggcgcgggcggcgggagcggttaggagcgcgagtagtagtagcggtaggagcggcgcgggtagcggtacggcgcgtatagtgcggtgggtcggtataggtatcg

SEQ ID NO: 22736 - DNA, 528 bp, Artificial Sequence
  chemically treated genomic DNA (Homo sapiens) CpG-island No: 22736
cgatacctataccgacccaccgcactatacgcgccgtaccgctacccgcgccgctcctaccgctactactactcgcgctcctaaccgctcccgccgcccgcgccaacaaaaccgaatccgtctccgcgccgtaacccgaacccgaacgcgaatcgcgaccaccgcccgacccgaaacccgaaaacaccacccgatttaaatctaaaacgacgaacgacaacgacaactccaactccaacaacaataacgacgccttaataacccgcatttccatcctcctccgcgacctacccaccctcaaaacaaccgtaatcgtaacgttcgcctttaccaccctcctcatcgcctacctactactacgcgtcttcaaataaaccctcccgccctcttccttcccccgccgaccgacaaaacgacatcgccaacctactatcgccgcgcgcccgccccacctacacgcacaaataccctaatacgccccaaccaaccgtatacctcctaccctacccgaaaaaataaataaaaaac

SEQ ID NO: 22737 - DNA, 629 bp, Artificial Sequence
  chemically treated genomic DNA (Homo sapiens) CpG-island No: 22737
agtagtttcgattttttaaggagaaggtttatttttttcggcgtttcggtatcgtcggtaattaagagtttttcgtgttgttttcggggtttcgcggttgtacgtagtatcggcgcgggatttgttagttcggtttcgtagtcggtcgtagtttcgcggggtcggtatcgcgggagggacgttgttataggaatcgcgtttcggatttcggttcgagaagtttcggagaggttagataggaaggttcgcgagattcgcggagtttttatgtaattacgttcggttttttttttttacggtagtttcgtacggttagtagcgtttttatagtttcgtgttttttcgcgcggttttataaaaaaattttatttttcgttatgtttggttcggtattgtttgtaatttcgcgagaagtgcgcggtttaatcggggcggtgcggaacggaattattaagtttcgcgagaatcgcgggaggcgcggtaaaaggcggagtcgagggtaggaaagtgggtgaatgaaagcggagggggttgttggattttgggggaagcggagagtcgggtttttttttatcgggtatttttgaggttcgagatttattaagtattgattgagttttgttatattt

SEQ ID NO: 22738 - DNA, 629 bp, Artificial Sequence
  chemically treated genomic DNA (Homo sapiens) CpG-island No: 22738
aaatataacaaaactcaatcaatacttaataaatctcgaacctcaaaaatacccgataaaaaaaaacccgactctccgcttcccccaaaatccaacaaccccctccgctttcattcacccactttcctaccctcgactccgccttttaccgcgcctcccgcgattctcgcgaaacttaataattccgttccgcaccgccccgattaaaccgcgcacttctcgcgaaattacaaacaataccgaaccaaacataacgaaaaataaaatttttttataaaaccgcgcgaaaaaacacgaaactataaaaacgctactaaccgtacgaaactaccgtaaaaaaaaaaaaccgaacgtaattacataaaaactccgcgaatctcgcgaaccttcctatctaacctctccgaaacttctcgaaccgaaatccgaaacgcgattcctataacaacgtccctcccgcgataccgaccccgcgaaactacgaccgactacgaaaccgaactaacaaatcccgcgccgatactacgtacaaccgcgaaaccccgaaaacaacacgaaaaactcttaattaccgacgataccgaaacgccgaaaaaaataaaccttctccttaaaaaatcgaaactact

SEQ ID NO: 22739 - DNA, 629 bp, Artificial Sequence
  chemically treated genomic DNA (Homo sapiens) CpG-island No: 22739
gaatatgatagggtttagttagtgtttaataaatttcgagttttaaaaatattcggtaaaaagaaattcggtttttcgttttttttagagtttagtaatttttttcgtttttatttatttatttttttattttcggtttcgttttttgtcgcgtttttcgcgattttcgcgagatttggtgatttcgtttcgtatcgtttcggttgagtcgcgtatttttcgcgaggttgtaggtagtgtcgggttagatatggcggaaggtagggtttttttgtggagtcgcgcgggaagatacggagttgtgggggcgttgttggtcgtgcgaagttgtcgtgggaggggaaggtcgggcgtggttgtatgggggtttcgcgggtttcgcgagtttttttgtttagttttttcggagtttttcgggtcggggttcggagcgcggtttttatgataacgtttttttcgcgatgtcgatttcgcgggattgcggtcggttgcggagtcgggttggtaggtttcgcgtcggtgttgcgtgtagtcgcggggtttcgagggtagtacgggaggtttttgattgtcggcggtgtcgggacgtcgggggaagtaagttttttttttaggaaatcgaaattgtt

SEQ ID NO: 22740 - DNA, 629 bp, Artificial Sequence
  chemically treated genomic DNA (Homo sapiens) CpG-island No: 22740
aacaatttcgatttcctaaaaaaaaaacttacttcccccgacgtcccgacaccgccgacaatcaaaaacctcccgtactaccctcgaaaccccgcgactacacgcaacaccgacgcgaaacctaccaacccgactccgcaaccgaccgcaatcccgcgaaatcgacatcgcgaaaaaaacgttatcataaaaaccgcgctccgaaccccgacccgaaaaactccgaaaaaactaaacaaaaaaactcgcgaaacccgcgaaacccccatacaaccacgcccgaccttcccctcccacgacaacttcgcacgaccaacaacgcccccacaactccgtatcttcccgcgcgactccacaaaaaaaccctaccttccgccatatctaacccgacactacctacaacctcgcgaaaaatacgcgactcaaccgaaacgatacgaaacgaaatcaccaaatctcgcgaaaatcgcgaaaaacgcgacaaaaaacgaaaccgaaaataaaaaaataaataaataaaaacgaaaaaaattactaaactctaaaaaaaacgaaaaaccgaatttctttttaccgaatatttttaaaactcgaaatttattaaacactaactaaaccctatcatattc

SEQ ID NO: 22741 - DNA, 553 bp, Artificial Sequence
  chemically treated genomic DNA (Homo sapiens) CpG-island No: 22741
tatttttacgttttttttttttttttttttttattttttcgtttttttcggttttttttttattttttttaaattttttcgtttattttcgagaaaaaaaattttttttttttttttttttttattattttttatttcgtttattttttttatttttattttttttttatttatattttttttatttttttttttatatttttattttttatttttttcgtttttttattttttatttttttttttttttttaattttttttttttattttattataattttttttttttttttttttttttttttttttcgatttttatttttttattttcgtttttaattttttttttattttttatcgttttttttcgtattttatttatttttaatttatttttttttatattttttttatagtattttatatatatatcgttagattatttcgttcgtttttcgagtttatttatttttcgttttttacgattttttacgttattcgtttaaaaaaagataaaattattttcgtcgtttaatttttttttcgaatttt

SEQ ID NO: 22742 - DNA, 553 bp, Artificial Sequence
  chemically treated genomic DNA (Homo sapiens) CpG-island No: 22742
aaaattcgaaaaaaaaattaaacgacgaaaataattttatctttttttaaacgaataacgtaaaaaatcgtaaaaaacgaaaaataaataaactcgaaaaacgaacgaaataatctaacgatatatatataaaatactataaaaaaaatataaaaaaaaataaattaaaaataaataaaatacgaaaaaaaacgataaaaaataaaaaaaaaattaaaaacgaaaataaaaaaataaaaatcgaaaaaaaaaaaaaaaaaaaaaaaaaaaaaaaattataataaaataaaaaaaaaaaattaaaaaaaaaaaaaaaaataaaaaataaaaaaacgaaaaaaataaaaaataaaaatataaaaaaaaaaataaaaaaaatataaataaaaaaaaaataaaaataaaaaaaataaacgaaataaaaaataataaaaaaaaaaaaaaaaaaaaaattttttttctcgaaaataaacgaaaaaatttaaaaaaaataaaaaaaaaaccgaaaaaaacgaaaaaataaaaaaaaaaaaaaaaaaaaaacgtaaaaata

SEQ ID NO: 22743 - DNA, 553 bp, Artificial Sequence
  chemically treated genomic DNA (Homo sapiens) CpG-island No: 22743
gggattcgggggggagattgggcggcgggggtgattttatttttttttgagcgggtagcgtggaaaatcgtggggggcgaaggataggtgggttcggggggcgggcgaaatgatttggcggtgtgtatgtggggtattatgggagagatatgggggggggtgggttggaggtggatgggatgcgggggggaacggtgggaggtggggaggggattgggggcggagatggggggatagggatcggggggaaaagggggggggggaagagggggaggttgtggtaaggtggagggggggagttgggggagggggggaggataagggatgggggggcgggggggatggggggtgggggtatggggggggggatgggaggggtgtgaatagggggggggtggggataaggagggtgggcggggtggggggtgatggggggggggggagggggggggttttttttttcggggatgggcgggggggtttgaagggggtgggggagggatcggggggggcgggggggtgaggggggggggggggggggggcgtgggggtg

SEQ ID NO: 22744 - DNA, 553 bp, Artificial Sequence
  chemically treated genomic DNA (Homo sapiens) CpG-island No: 22744
cacccccacgcccccccccccccccccccctcacccccccgccccccccgatccctcccccacccccttcaaacccccccgcccatccccgaaaaaaaaaaccccccccctccccccccccccatcaccccccaccccgcccaccctccttatccccaccccccccctattcacacccctcccatccccccccccatacccccaccccccatcccccccgcccccccatcccttatcctccccccctcccccaactccccccctccaccttaccacaacctccccctcttcccccccccccttttccccccgatccctatccccccatctccgcccccaatcccctccccacctcccaccgttcccccccgcatcccatccacctccaacccacccccccccatatctctcccataataccccacatacacaccgccaaatcatttcgcccgccccccgaacccacctatccttcgccccccacgattttccacgctacccgctcaaaaaaaaataaaatcacccccgccgcccaatctcccccccgaatccc

SEQ ID NO: 22745 - DNA, 507 bp, Artificial Sequence
  chemically treated genomic DNA (Homo sapiens) CpG-island No: 22745
tttttttgtcgcgtacgttatattatagatagagtaattttgttatttatgtcgttataggatattcgtgattcgtcgttcgatcgttgttttattttcgttttttttttatgtgatcgatcgtattatattacgattcgttcgtcgtttattatttattatcgcggagaaattttcgtcgagttcgcgtcgagcgtttaatttatattaaattatttatttattcgtatatttcgtcgtatatttttatattattcgtagcgaattcgtcgtaagggacgtatagacggtcgcgattattttttttttatatagatatttatatatatatacgagggagggagagtattttttattttttcgcgaggtatttcgaagtttttttttataagcgttttcgcggtaagtttttacgcggttataagttttagtttttttcgttatttattatgacgatttagataatgttgcggtattagtaggttttttagtgtttatttacggttg

SEQ ID NO: 22746 - DNA, 507 bp, Artificial Sequence
  chemically treated genomic DNA (Homo sapiens) CpG-island No: 22746
caaccgtaaataaacactaaaaaacctactaataccgcaacattatctaaatcgtcataataaataacgaaaaaaactaaaacttataaccgcgtaaaaacttaccgcgaaaacgcttataaaaaaaaacttcgaaatacctcgcgaaaaaataaaaaatactctccctccctcgtatatatatataaatatctatataaaaaaaaaataatcgcgaccgtctatacgtcccttacgacgaattcgctacgaataatataaaaatatacgacgaaatatacgaataaataaataatttaatataaattaaacgctcgacgcgaactcgacgaaaatttctccgcgataataaataataaacgacgaacgaatcgtaatataatacgatcgatcacataaaaaaaaaacgaaaataaaacaacgatcgaacgacgaatcacgaatatcctataacgacataaataacaaaattactctatctataatataacgtacgcgacaaaaaaa

SEQ ID NO: 22747 - DNA, 507 bp, Artificial Sequence
  chemically treated genomic DNA (Homo sapiens) CpG-island No: 22747
tagtcgtgggtggatattggggggtttgttggtgtcgtagtattgtttaggtcgttatagtgaatggcggggggggttggagtttgtagtcgcgtgaaagtttgtcgcggaggcgtttgtggaggggagtttcgagatatttcgcgggggaatgaagagtgttttttttttttcgtgtgtgtatgtggatgtttatatggagagagagtagtcgcggtcgtttgtacgttttttgcggcgagttcgttacgggtggtgtgagggtgtgcggcgaggtgtgcgggtgagtggatggtttgatgtgggttagacgttcggcgcgagttcggcgggggttttttcgcggtggtgggtggtgggcggcgggcgaatcgtggtataatgcggtcggttatatagaggaggggcgggaatgaggtaacggtcggacggcgggttacgggtgttttatgacggtatgggtgatagggttattttgtttgtggtatgacgtgcgcgatagagggg

SEQ ID NO: 22748 - DNA, 507 bp, Artificial Sequence
  chemically treated genomic DNA (Homo sapiens) CpG-island No: 22748
cccctctatcgcgcacgtcataccacaaacaaaataaccctatcacccataccgtcataaaacacccgtaacccgccgtccgaccgttacctcattcccgcccctcctctatataaccgaccgcattataccacgattcgcccgccgcccaccacccaccaccgcgaaaaaacccccgccgaactcgcgccgaacgtctaacccacatcaaaccatccactcacccgcacacctcgccgcacaccctcacaccacccgtaacgaactcgccgcaaaaaacgtacaaacgaccgcgactactctctctccatataaacatccacatacacacacgaaaaaaaaaaaacactcttcattcccccgcgaaatatctcgaaactcccctccacaaacgcctccgcgacaaactttcacgcgactacaaactccaaccccccccgccattcactataacgacctaaacaatactacgacaccaacaaaccccccaatatccacccacgacta

SEQ ID NO: 22749 - DNA, 585 bp, Artificial Sequence
  chemically treated genomic DNA (Homo sapiens) CpG-island No: 22749
cgggggagaaggggaatttatcgtagtcggggcgggcgggggggtcggcggtttacgtcgggtttatcggtgcgtggcggggcgcgcgggggcgtcggtcgtcgttcgttggggttttgttcgtcggaggttcgggggaggggcgcgcgcggtcggcgttcgcgggatattaggcggcggggggggcgtcgttcgcgcgggggcgcgtattaggtcgcgcgcggcggcggggagcggcgcggggggcgtcgggggtcgggcgggatttttttatcggcgtgagggagggggggcgggttcggattttcgcgcgcggcgggggggtcgggggggggggcgttcggattgtcgggttcgggtcggatttaaggataggaatcgcgggcggggggcgcgcgagcgggtaattcggcgggggcggtatagggttcgtggggggggggtaatcgttggggagtaatagatggcgtcgttataatgtagcgtattttttcggggggttattttttagcgtttgtagtttttatgatagtttttgaggataaagattagatcgttatgttggtcggtgttgtaagtttttaa

SEQ ID NO: 22750 - DNA, 585 bp, Artificial Sequence
  chemically treated genomic DNA (Homo sapiens) CpG-island No: 22750
ttaaaaacttacaacaccgaccaacataacgatctaatctttatcctcaaaaactatcataaaaactacaaacgctaaaaaataaccccccgaaaaaatacgctacattataacgacgccatctattactccccaacgattaccccccccccacgaaccctataccgcccccgccgaattacccgctcgcgcgccccccgcccgcgattcctatccttaaatccgacccgaacccgacaatccgaacgcccccccccccgacccccccgccgcgcgcgaaaatccgaacccgccccccctccctcacgccgataaaaaaatcccgcccgacccccgacgccccccgcgccgctccccgccgccgcgcgcgacctaatacgcgcccccgcgcgaacgacgccccccccgccgcctaatatcccgcgaacgccgaccgcgcgcgcccctcccccgaacctccgacgaacaaaaccccaacgaacgacgaccgacgcccccgcgcgccccgccacgcaccgataaacccgacgtaaaccgccgacccccccgcccgccccgactacgataaattccccttctcccccg

SEQ ID NO: 22751 - DNA, 585 bp, Artificial Sequence
  chemically treated genomic DNA (Homo sapiens) CpG-island No: 22751
ttggggatttgtagtatcggttaatatagcgatttaatttttgtttttagaaattattatggggattgtaagcgttaaagaatgatttttcgaggagatgcgttatattgtagcggcgttatttattgttttttagcgattgttttttttttacgggttttgtatcgttttcgtcggattattcgttcgcgcgtttttcgttcgcggtttttgtttttgggttcggttcgggttcggtagttcgggcgttttttttttcggttttttcgtcgcgcgcggagattcgggttcgtttttttttttttacgtcggtgaaagggtttcgttcggttttcggcgtttttcgcgtcgtttttcgtcgtcgcgcgcggtttggtgcgcgttttcgcgcgggcggcgtttttttcgtcgtttagtgtttcgcgggcgtcggtcgcgcgcgtttttttttcgggttttcggcggatagggttttagcggacggcggtcggcgttttcgcgcgtttcgttacgtatcggtgggttcggcgtaggtcgtcggttttttcgttcgtttcggttgcgataggttttttttttttttcg

SEQ ID NO: 22752 - DNA, 585 bp, Artificial Sequence
  chemically treated genomic DNA (Homo sapiens) CpG-island No: 22752
cgaaaaaaaaaaaaaacctatcgcaaccgaaacgaacgaaaaaaccgacgacctacgccgaacccaccgatacgtaacgaaacgcgcgaaaacgccgaccgccgtccgctaaaaccctatccgccgaaaacccgaaaaaaaaacgcgcgcgaccgacgcccgcgaaacactaaacgacgaaaaaaacgccgcccgcgcgaaaacgcgcaccaaaccgcgcgcgacgacgaaaaacgacgcgaaaaacgccgaaaaccgaacgaaaccctttcaccgacgtaaaaaaaaaaaaacgaacccgaatctccgcgcgcgacgaaaaaaccgaaaaaaaaaacgcccgaactaccgaacccgaaccgaacccaaaaacaaaaaccgcgaacgaaaaacgcgcgaacgaataatccgacgaaaacgatacaaaacccgtaaaaaaaaaacaatcgctaaaaaacaataaataacgccgctacaatataacgcatctcctcgaaaaatcattctttaacgcttacaatccccataataatttctaaaaacaaaaattaaatcgctatattaaccgatactacaaatccccaa

SEQ ID NO: 22753 - DNA, 503 bp, Artificial Sequence
  chemically treated genomic DNA (Homo sapiens) CpG-island No: 22753
gcgtcgcggtcgcggcgttcggttttttcggcgtcgtttttcgcgttcggtcgttttttcgttcgcgtttttttttttttttcgtttttcgttttcggtcgggcgcgtcgcgacgggcgggcggggtcgcgcgttttttcgttcgttcgcgcggcgttcgggtttttttttttcgcgtttacggtttcgtttttttcggttagtcgtcggtttttttacgttttatcggttcggcgttcgattcgtaattttcgttttcgtatcgcgttttttcgtcggttttcgttttcgtttatcgtttcgattatatcgcggagtcgtaaggtcggcgcgcgcggttaattatttattttttattcgcgatttttcgttttatattcgcggtttttacgtttacgtttaatcgtcgatttttagtagtcgtcgcgtcgtttcgcgttcgatcgttcgtttatcgtatatatattataaagcgttcgcgtttattcgtcgcgatagtacgt

SEQ ID NO: 22754 - DNA, 503 bp, Artificial Sequence
  chemically treated genomic DNA (Homo sapiens) CpG-island No: 22754
acgtactatcgcgacgaataaacgcgaacgctttataatatatatacgataaacgaacgatcgaacgcgaaacgacgcgacgactactaaaaatcgacgattaaacgtaaacgtaaaaaccgcgaatataaaacgaaaaatcgcgaataaaaaataaataattaaccgcgcgcgccgaccttacgactccgcgatataatcgaaacgataaacgaaaacgaaaaccgacgaaaaaacgcgatacgaaaacgaaaattacgaatcgaacgccgaaccgataaaacgtaaaaaaaccgacgactaaccgaaaaaaacgaaaccgtaaacgcgaaaaaaaaaaacccgaacgccgcgcgaacgaacgaaaaaacgcgcgaccccgcccgcccgtcgcgacgcgcccgaccgaaaacgaaaaacgaaaaaaaaaaaaaaacgcgaacgaaaaaacgaccgaacgcgaaaaacgacgccgaaaaaaccgaacgccgcgaccgcgacgc

SEQ ID NO: 22755 - DNA, 503 bp, Artificial Sequence
  chemically treated genomic DNA (Homo sapiens) CpG-island No: 22755
acgtgttgtcgcgacgggtgggcgcggacgttttgtggtgtgtgtacggtgggcgggcggtcgggcgcggggcggcgcggcggttgttgagggtcggcggttgggcgtgggcgtggggatcgcgagtgtggggcggggggtcgcgggtagggggtgggtgattgatcgcgcgcgtcggttttgcggtttcgcgatgtggtcggggcggtggacgggggcgggggtcggcggaggggcgcggtgcgggggcggggattgcgggtcgggcgtcgggtcgatggggcgtggggaggtcggcggttggtcggggggagcggggtcgtggacgcgagggggggaggttcgggcgtcgcgcgagcgggcgggggaacgcgcggtttcgttcgttcgtcgcggcgcgttcggtcggggacgggaggcggaagaggggggggggcgcgggcgggggaacggtcgggcgcggggagcggcgtcgggggggtcgggcgtcgcggtcgcggcgt

SEQ ID NO: 22756 - DNA, 503 bp, Artificial Sequence
  chemically treated genomic DNA (Homo sapiens) CpG-island No: 22756
acgccgcgaccgcgacgcccgacccccccgacgccgctccccgcgcccgaccgttcccccgcccgcgcccccccccctcttccgcctcccgtccccgaccgaacgcgccgcgacgaacgaacgaaaccgcgcgttcccccgcccgctcgcgcgacgcccgaacctccccccctcgcgtccacgaccccgctccccccgaccaaccgccgacctccccacgccccatcgacccgacgcccgacccgcaatccccgcccccgcaccgcgcccctccgccgacccccgcccccgtccaccgccccgaccacatcgcgaaaccgcaaaaccgacgcgcgcgatcaatcacccaccccctacccgcgaccccccgccccacactcgcgatccccacgcccacgcccaaccgccgaccctcaacaaccgccgcgccgccccgcgcccgaccgcccgcccaccgtacacacaccacaaaacgtccgcgcccacccgtcgcgacaacacgt

SEQ ID NO: 22757 - DNA, 658 bp, Artificial Sequence
  chemically treated genomic DNA (Homo sapiens) CpG-island No: 22757
gttattttcgcgaattagggaggtttttaagtcgttaaaatatatcgggatgtggttcgttaggataaaattcgcgggtttttcggttttttcgtgcgtttcgcggcggggagaggggtttaggcgttgaaatttattcgtttgcgcgttttcgagtttattttattggagcggcgttcgttcgggtttttaggttttttttttggttttgggggcgtcgcgcgggtcgggtttcgtcgggtttgtgggcgaagcgcgcggggttttgggagttcgggagttcgttttattttgtttcgaggtttcgcgtcgcggtcgtcgggtttcgggatgtggcggcggcggtagcggaagtaaggaagacgttcgcgcgttagatcggttttggggtttagaacgtcgtatcgttttacgcggttttttcgcgttattcggtcgtgcgtcgtttgttcgcgcggttttcgtcgcgttttcggtcgtgcgcgttttagcgggtcgcggggagtggggaggggtcggtcgcgggattttaggttcggatttcgagtttttttttttgtcgttgtaaaagcgttttttttgatcgagatttgcggtcggaataagttcgttgggtttttatttagaaaataggttcgttttttgagaaagaaaaaaa

SEQ ID NO: 22758 - DNA, 658 bp, Artificial Sequence
  chemically treated genomic DNA (Homo sapiens) CpG-island No: 22758
tttttttctttctcaaaaaacgaacctattttctaaataaaaacccaacgaacttattccgaccgcaaatctcgatcaaaaaaaacgcttttacaacgacaaaaaaaaaaactcgaaatccgaacctaaaatcccgcgaccgacccctccccactccccgcgacccgctaaaacgcgcacgaccgaaaacgcgacgaaaaccgcgcgaacaaacgacgcacgaccgaataacgcgaaaaaaccgcgtaaaacgatacgacgttctaaaccccaaaaccgatctaacgcgcgaacgtcttccttacttccgctaccgccgccgccacatcccgaaacccgacgaccgcgacgcgaaacctcgaaacaaaataaaacgaactcccgaactcccaaaaccccgcgcgcttcgcccacaaacccgacgaaacccgacccgcgcgacgcccccaaaaccaaaaaaaaaacctaaaaacccgaacgaacgccgctccaataaaataaactcgaaaacgcgcaaacgaataaatttcaacgcctaaacccctctccccgccgcgaaacgcacgaaaaaaccgaaaaacccgcgaattttatcctaacgaaccacatcccgatatattttaacgacttaaaaacctccctaattcgcgaaaataac

SEQ ID NO: 22759 - DNA, 658 bp, Artificial Sequence
  chemically treated genomic DNA (Homo sapiens) CpG-island No: 22759
ttttttttttttttaaaaagcgaatttgttttttggatggaggtttagcggatttgtttcggtcgtaggtttcggttagaaagaacgtttttgtagcggtagaaagggagattcgggattcgggtttggggtttcgcggtcggtttttttttatttttcgcgattcgttggaacgcgtacggtcggggacgcggcggggatcgcgcgggtaggcggcgtacggtcggatagcgcgagggggtcgcgtgaggcggtgcgacgttttgggttttaaagtcggtttagcgcgcgggcgttttttttattttcgttgtcgtcgtcgttatatttcgggattcgacggtcgcggcgcgaggtttcggggtaaggtggggcgggttttcgagtttttaggatttcgcgcgtttcgtttataggttcggcgaagttcgattcgcgcggcgtttttagggttaggggaggagtttaaggattcggacgagcgtcgttttagtagggtgagttcggggacgcgtaggcgggtgggttttagcgtttgggttttttttttcgtcgcggggcgtacggaaaaatcggggaattcgcgggttttgttttggcgagttatatttcggtgtgttttggcgatttgaagatttttttagttcgcgggagtagt

SEQ ID NO: 22760 - DNA, 658 bp, Artificial Sequence
  chemically treated genomic DNA (Homo sapiens) CpG-island No: 22760
actactcccgcgaactaaaaaaatcttcaaatcgccaaaacacaccgaaatataactcgccaaaacaaaacccgcgaattccccgatttttccgtacgccccgcgacgaaaaaaaaaacccaaacgctaaaacccacccgcctacgcgtccccgaactcaccctactaaaacgacgctcgtccgaatccttaaactcctcccctaaccctaaaaacgccgcgcgaatcgaacttcgccgaacctataaacgaaacgcgcgaaatcctaaaaactcgaaaacccgccccaccttaccccgaaacctcgcgccgcgaccgtcgaatcccgaaatataacgacgacgacaacgaaaataaaaaaaacgcccgcgcgctaaaccgactttaaaacccaaaacgtcgcaccgcctcacgcgaccccctcgcgctatccgaccgtacgccgcctacccgcgcgatccccgccgcgtccccgaccgtacgcgttccaacgaatcgcgaaaaataaaaaaaaaccgaccgcgaaaccccaaacccgaatcccgaatctccctttctaccgctacaaaaacgttctttctaaccgaaacctacgaccgaaacaaatccgctaaacctccatccaaaaaacaaattcgctttttaaaaaaaaaaaaaa

SEQ ID NO: 22761 - DNA, 500 bp, Artificial Sequence
  chemically treated genomic DNA (Homo sapiens) CpG-island No: 22761
gaacgttcgcggttttcggtattcgttttttatttttaaagggggtatatacgttattaatttttattttatcgaggattagcgttttttttaatcgcgattttttcgaaaggttaggtagaaaattaacgtgttcgtttttgattatatcgtcgggatgtcgttttttgtcgagaatgatatttttagtcgtttagttattttataggttcgggatagtattttgggagttgggcggagacgtttaaattttaacgtttttagaaagaagtttgtgaagaaaaggtgaagagcgagttttcgtaggtaaattggatgggcgtttggtcgtcgtggagtttcggtgatttattattttagttatgtcgtttttaggattattcgatggaaattaataggcgggttttacggtgcggttttgttcgtttatgttttgtcgggtttgtacggaattggattgttttatggtttgtgagtatcggagcgtttggttgtttgtt

SEQ ID NO: 22762 - DNA, 500 bp, Artificial Sequence
  chemically treated genomic DNA (Homo sapiens) CpG-island No: 22762
aacaaacaaccaaacgctccgatactcacaaaccataaaacaatccaattccgtacaaacccgacaaaacataaacgaacaaaaccgcaccgtaaaacccgcctattaatttccatcgaataatcctaaaaacgacataactaaaataataaatcaccgaaactccacgacgaccaaacgcccatccaatttacctacgaaaactcgctcttcaccttttcttcacaaacttctttctaaaaacgttaaaatttaaacgtctccgcccaactcccaaaatactatcccgaacctataaaataactaaacgactaaaaatatcattctcgacaaaaaacgacatcccgacgatataatcaaaaacgaacacgttaattttctacctaacctttcgaaaaaatcgcgattaaaaaaaacgctaatcctcgataaaataaaaattaataacgtatataccccctttaaaaataaaaaacgaataccgaaaaccgcgaacgttc

SEQ ID NO: 22763 - DNA, 500 bp, Artificial Sequence
  chemically treated genomic DNA (Homo sapiens) CpG-island No: 22763
ggtaggtagttaggcgtttcgatgtttataggttatgggatagtttagtttcgtgtagattcggtagggtatgggcgggtagaatcgtatcgtgaagttcgtttgttaatttttatcgggtggttttggagacgatatggttggggtaatgggttatcggaattttacggcggttagacgtttatttaatttgtttgcgggaattcgttttttattttttttttataaatttttttttggaagcgttgggatttaagcgttttcgtttagtttttaaggtgttgtttcggatttgtagggtagttgagcggttggagatgttattttcgataaagggcgatatttcggcgatgtagttaggggcgaatacgttggttttttgtttggtttttcgggagagtcgcggttgagggaagcgttgattttcggtgagatgggggttgatggcgtatgtgttttttttgggagtgggaagcgagtatcggaggtcgcgggcgttt

SEQ ID NO: 22764 - DNA, 500 bp, Artificial Sequence
  chemically treated genomic DNA (Homo sapiens) CpG-island No: 22764
aaacgcccgcgacctccgatactcgcttcccactcccaaaaaaaacacatacgccatcaacccccatctcaccgaaaatcaacgcttccctcaaccgcgactctcccgaaaaaccaaacaaaaaaccaacgtattcgcccctaactacatcgccgaaatatcgccctttatcgaaaataacatctccaaccgctcaactaccctacaaatccgaaacaacaccttaaaaactaaacgaaaacgcttaaatcccaacgcttccaaaaaaaaatttataaaaaaaaaataaaaaacgaattcccgcaaacaaattaaataaacgtctaaccgccgtaaaattccgataacccattaccccaaccatatcgtctccaaaaccacccgataaaaattaacaaacgaacttcacgatacgattctacccgcccataccctaccgaatctacacgaaactaaactatcccataacctataaacatcgaaacgcctaactacctacc

SEQ ID NO: 22765 - DNA, 692 bp, Artificial Sequence
  chemically treated genomic DNA (Homo sapiens) CpG-island No: 22765
gtttatttagggcgggagatattttcgaggcgttttttttttttttcgcggtcgggtttttatcggggtcgtttttttttttggtttttcggggacgtcgcggattcgagttgtatagttagaagaggacgttgaaaaggcgttaggtagtcgtttcgaattaggttttttcggttgtcgggtttgtaggtttttatcgttgcggttttacggatttagagtttgagggcgcggagggggttgcgggggcgggattaggattttcgaggggcgttcggggcggggttagagagagttcggggttgttagaggcgaggttttgaggaggcggggtcgggaggtttcggagtttaagaggcggggttagaggcgtagggggttgcgaggggcggattttgggggcgtgatcggggggggcgtttggggatttaggggcggggcgttagggggcgggattaagggacgttcgaggggcgttcggttagtttcgttagagcgcgagtcgttagttcgtaacggtcgttagtgtgaggggcgggagggaaagaagaggggtttaaattagattttttaaaatatagagtaagcgttagaggcgtcggtattttaggtgtcgtcgttttttgttgtatagggttcggcgtataggtttttttttttttaagttttttttttttttttcgttttatttt

SEQ ID NO: 22766 - DNA, 692 bp, Artificial Sequence
  chemically treated genomic DNA (Homo sapiens) CpG-island No: 22766
aaaataaaacgaaaaaaaaaaaaaaaacttaaaaaaaaaaaaacctatacgccgaaccctatacaacaaaaaacgacgacacctaaaataccgacgcctctaacgcttactctatattttaaaaaatctaatttaaacccctcttctttccctcccgcccctcacactaacgaccgttacgaactaacgactcgcgctctaacgaaactaaccgaacgcccctcgaacgtcccttaatcccgccccctaacgccccgcccctaaatccccaaacgccccccccgatcacgcccccaaaatccgcccctcgcaaccccctacgcctctaaccccgcctcttaaactccgaaacctcccgaccccgcctcctcaaaacctcgcctctaacaaccccgaactctctctaaccccgccccgaacgcccctcgaaaatcctaatcccgcccccgcaaccccctccgcgccctcaaactctaaatccgtaaaaccgcaacgataaaaacctacaaacccgacaaccgaaaaaacctaattcgaaacgactacctaacgccttttcaacgtcctcttctaactatacaactcgaatccgcgacgtccccgaaaaaccaaaaaaaaaaacgaccccgataaaaacccgaccgcgaaaaaaaaaaaaaacgcctcgaaaatatctcccgccctaaataaac

SEQ ID NO: 22767 - DNA, 692 bp, Artificial Sequence
  chemically treated genomic DNA (Homo sapiens) CpG-island No: 22767
agggtagggcgggagaaggggagggggtttgaggagggagggatttgtacgtcgagttttgtgtagtaggaagcggcgatatttgggatgtcgacgtttttggcgtttgttttgtgttttaaaaaatttaatttaaattttttttttttttttttcgttttttatattggcgatcgttacgggttggcggttcgcgttttggcgggattagtcgagcgtttttcgagcgttttttggtttcgttttttaacgtttcgtttttaggtttttaagcgtttttttcggttacgtttttaaggttcgtttttcgtagttttttacgtttttggtttcgttttttgggtttcgaagtttttcggtttcgtttttttaagatttcgtttttggtagtttcgagttttttttggtttcgtttcgagcgtttttcgggagttttggtttcgttttcgtagtttttttcgcgtttttaagttttaagttcgtgaagtcgtagcggtgggggtttgtaggttcggtagtcgggagggtttggttcggggcggttgtttggcgtttttttaacgtttttttttgattgtgtagttcgaattcgcggcgttttcggagggttagagggggaaacgatttcgatagaaattcgatcgcgaaggggaggaggggcgtttcggaaatgtttttcgttttaaatgagt

SEQ ID NO: 22768 - DNA, 692 bp, Artificial Sequence
  chemically treated genomic DNA (Homo sapiens) CpG-island No: 22768
actcatttaaaacgaaaaacatttccgaaacgcccctcctccccttcgcgatcgaatttctatcgaaatcgtttccccctctaaccctccgaaaacgccgcgaattcgaactacacaatcaaaaaaaaacgttaaaaaaacgccaaacaaccgccccgaaccaaaccctcccgactaccgaacctacaaacccccaccgctacgacttcacgaacttaaaacttaaaaacgcgaaaaaaactacgaaaacgaaaccaaaactcccgaaaaacgctcgaaacgaaaccaaaaaaaactcgaaactaccaaaaacgaaatcttaaaaaaacgaaaccgaaaaacttcgaaacccaaaaaacgaaaccaaaaacgtaaaaaactacgaaaaacgaaccttaaaaacgtaaccgaaaaaaacgcttaaaaacctaaaaacgaaacgttaaaaaacgaaaccaaaaaacgctcgaaaaacgctcgactaatcccgccaaaacgcgaaccgccaacccgtaacgatcgccaatataaaaaacgaaaaaaaaaaaaaaaaaatttaaattaaattttttaaaacacaaaacaaacgccaaaaacgtcgacatcccaaatatcgccgcttcctactacacaaaactcgacgtacaaatccctccctcctcaaaccccctccccttctcccgccctaccct

SEQ ID NO: 22769 - DNA, 665 bp, Artificial Sequence
  chemically treated genomic DNA (Homo sapiens) CpG-island No: 22769
gtaggcgttgcggtcgcgaattttaggttcgggagtgtgggcggggtttgcgtgtgggcggggtcgcggcgttagcgttcgttacgggcgagggcgtggtcgattcggcgttagttcgttcgttcgttcgtcggttttcgcgtttttttcgcgtcggttttttcgcgggtgattagttggtttgcgtttttttgacgtgggttggggtacgttatcgtcgaatggtagtttttagaaagttatcgcgagtaaggtgagggtatttcgtcggtagtcggcgttcgggtagcgtgtagttttcgtttgcgcggtcgcgcgtgttgtatttcggcgggtagggacgcgcgggtgaggagttcggttcgtcgtagtttggcgagggtcgcgttcgtcggagtttcggaataggagtcgggggaaggggtttatgaggtcgggcgagattcggttcgttttcggagggtcggtgggtacggggcggttcgagtttggtttttggacgcgtatgttcgcggaattgttgtattcggtttgagggggcggcggtcgttatagtttttggttcgcgggaaggtttcgtttttggaggaagttggttttttttcgtgttcggggaggtgggcgagtttttgttttcgtttttgttatttaggaatttaaatttt

SEQ ID NO: 22770 - DNA, 665 bp, Artificial Sequence
  chemically treated genomic DNA (Homo sapiens) CpG-island No: 22770
aaaatttaaattcctaaataacaaaaacgaaaacaaaaactcgcccacctccccgaacacgaaaaaaaaccaacttcctccaaaaacgaaaccttcccgcgaaccaaaaactataacgaccgccgccccctcaaaccgaatacaacaattccgcgaacatacgcgtccaaaaaccaaactcgaaccgccccgtacccaccgaccctccgaaaacgaaccgaatctcgcccgacctcataaaccccttcccccgactcctattccgaaactccgacgaacgcgaccctcgccaaactacgacgaaccgaactcctcacccgcgcgtccctacccgccgaaatacaacacgcgcgaccgcgcaaacgaaaactacacgctacccgaacgccgactaccgacgaaataccctcaccttactcgcgataactttctaaaaactaccattcgacgataacgtaccccaacccacgtcaaaaaaacgcaaaccaactaatcacccgcgaaaaaaccgacgcgaaaaaaacgcgaaaaccgacgaacgaacgaacgaactaacgccgaatcgaccacgccctcgcccgtaacgaacgctaacgccgcgaccccgcccacacgcaaaccccgcccacactcccgaacctaaaattcgcgaccgcaacgcctac

SEQ ID NO: 22771 - DNA, 665 bp, Artificial Sequence
  chemically treated genomic DNA (Homo sapiens) CpG-island No: 22771
gaggtttagatttttgggtaatagaagcgagggtaaaggttcgtttattttttcggatacgaagaggggttaattttttttaagaacggggttttttcgcgggttaggaattgtgacggtcgtcgtttttttaggtcgagtgtagtagtttcgcgggtatacgcgtttaggaattagattcgggtcgtttcgtgtttatcgatttttcggaaacgaatcggatttcgttcggttttatggattttttttttcggtttttgtttcggggtttcggcgagcgcggttttcgttagattgcggcgggtcgggttttttattcgcgcgtttttgttcgtcgaggtgtaatacgcgcggtcgcgtaggcgagggttgtacgttgttcggacgtcggttgtcggcggagtgtttttattttattcgcggtggttttttggaggttgttattcggcggtgacgtgttttagtttacgttaggggagcgtagattagttgattattcgcggaagggtcggcgcgaaggaggcgcgagagtcggcgggcgggcgggcgggttagcgtcgggtcggttacgttttcgttcgtggcgggcgttggcgtcgcggtttcgtttatacgtaggtttcgtttatattttcggatttggggttcgcggtcgtagcgtttgt

SEQ ID NO: 22772 - DNA, 665 bp, Artificial Sequence
  chemically treated genomic DNA (Homo sapiens) CpG-island No: 22772
acaaacgctacgaccgcgaaccccaaatccgaaaatataaacgaaacctacgtataaacgaaaccgcgacgccaacgcccgccacgaacgaaaacgtaaccgacccgacgctaacccgcccgcccgcccgccgactctcgcgcctccttcgcgccgacccttccgcgaataatcaactaatctacgctcccctaacgtaaactaaaacacgtcaccgccgaataacaacctccaaaaaaccaccgcgaataaaataaaaacactccgccgacaaccgacgtccgaacaacgtacaaccctcgcctacgcgaccgcgcgtattacacctcgacgaacaaaaacgcgcgaataaaaaacccgacccgccgcaatctaacgaaaaccgcgctcgccgaaaccccgaaacaaaaaccgaaaaaaaaaatccataaaaccgaacgaaatccgattcgtttccgaaaaatcgataaacacgaaacgacccgaatctaattcctaaacgcgtatacccgcgaaactactacactcgacctaaaaaaacgacgaccgtcacaattcctaacccgcgaaaaaaccccgttcttaaaaaaaattaacccctcttcgtatccgaaaaaataaacgaacctttaccctcgcttctattacccaaaaatctaaacctc

SEQ ID NO: 22773 - DNA, 744 bp, Artificial Sequence
  chemically treated genomic DNA (Homo sapiens) CpG-island No: 22773
cgtcgttatttcggcgttttttaggttttgttcgcgagtttttatttcgattgcgtattcgcgattttagttcgaggggcggggatttttttggagcgacgggacgcgacgttaatcgcgacgaggtttcgtttcgtggcgcggtttgaaattttgcggggtttaacggttcgcggagcggttacgcggagtgatatcgtcggtgtttgcgggtggttgttgttttcggggtcgtgtggagtaggtttggatttggatttacggttgtttggagcgttcgttatgaggagaaggtgcgggttgcggggaaatcgaggggacgcgggagggagcgacgttcgtttcggttgcggggtttgtttaggggtgcgggattcgtgcggggtttcgggtttagatcgttacggtagtcggcgtcgagggaggtcgggggcgttgaggggtagggtttggaggcggcgagttagtgcgagggtcgcggcggtgagatttgacgcgttgttcgtcggcggtcgtaggtgttcgtaggtttagacgttcgggtgggagtcgagcgtcggtgttcggacgcggtagggtagtcgaggttcggggttcggggcggtttttatttaggcggttagcgttggcgttcggattttatttttttcgttcgtagcgttttaggtgtcgttgtttggcgtagatgattcgttgtaaattttttgtggtcgtggtttttttttaaagttgttaagtttattt

SEQ ID NO: 22774 - DNA, 744 bp, Artificial Sequence
  chemically treated genomic DNA (Homo sapiens) CpG-island No: 22774
aaataaacttaacaactttaaaaaaaaaccacgaccacaaaaaatttacaacgaatcatctacgccaaacaacgacacctaaaacgctacgaacgaaaaaaataaaatccgaacgccaacgctaaccgcctaaataaaaaccgccccgaaccccgaacctcgactaccctaccgcgtccgaacaccgacgctcgactcccacccgaacgtctaaacctacgaacacctacgaccgccgacgaacaacgcgtcaaatctcaccgccgcgaccctcgcactaactcgccgcctccaaaccctacccctcaacgcccccgacctccctcgacgccgactaccgtaacgatctaaacccgaaaccccgcacgaatcccgcacccctaaacaaaccccgcaaccgaaacgaacgtcgctccctcccgcgtcccctcgatttccccgcaacccgcaccttctcctcataacgaacgctccaaacaaccgtaaatccaaatccaaacctactccacacgaccccgaaaacaacaaccacccgcaaacaccgacgatatcactccgcgtaaccgctccgcgaaccgttaaaccccgcaaaatttcaaaccgcgccacgaaacgaaacctcgtcgcgattaacgtcgcgtcccgtcgctccaaaaaaatccccgcccctcgaactaaaatcgcgaatacgcaatcgaaataaaaactcgcgaacaaaacctaaaaaacgccgaaataacgacg

SEQ ID NO: 22775 - DNA, 744 bp, Artificial Sequence
  chemically treated genomic DNA (Homo sapiens) CpG-island No: 22775
aaataaatttaatagttttaaagaaaagttacgattatagaaggtttataacgagttatttgcgttaagtagcggtatttgagacgttgcgggcggggagggtggggttcgagcgttagcgttgatcgtttgggtggaggtcgtttcgggtttcgggtttcgattattttgtcgcgttcgggtatcggcgttcggtttttattcgggcgtttgagtttgcgggtatttgcggtcgtcggcggatagcgcgttaggttttatcgtcgcggttttcgtattggttcgtcgtttttagattttgttttttagcgttttcggtttttttcggcgtcgattgtcgtgacgatttaggttcgggatttcgtacgggtttcgtatttttgaataggtttcgtagtcgaaacgagcgtcgttttttttcgcgttttttcgattttttcgtaattcgtattttttttttatggcggacgttttaagtagtcgtgagtttaggtttagatttattttatacggtttcgagagtaataattattcgtaaatatcggcgatgttatttcgcgtagtcgtttcgcgagtcgttgagtttcgtaaaattttaaatcgcgttacggggcgaagtttcgtcgcgattggcgtcgcgtttcgtcgttttaagaaaattttcgtttttcgggttgaagtcgcgggtgcgtaatcggggtggggattcgcgagtagggtttgggaagcgtcggagtggcggcg

SEQ ID NO: 22776 - DNA, 744 bp, Artificial Sequence
  chemically treated genomic DNA (Homo sapiens) CpG-island No: 22776
cgccgccactccgacgcttcccaaaccctactcgcgaatccccaccccgattacgcacccgcgacttcaacccgaaaaacgaaaattttcttaaaacgacgaaacgcgacgccaatcgcgacgaaacttcgccccgtaacgcgatttaaaattttacgaaactcaacgactcgcgaaacgactacgcgaaataacatcgccgatatttacgaataattattactctcgaaaccgtataaaataaatctaaacctaaactcacgactacttaaaacgtccgccataaaaaaaaaatacgaattacgaaaaaatcgaaaaaacgcgaaaaaaaacgacgctcgtttcgactacgaaacctattcaaaaatacgaaacccgtacgaaatcccgaacctaaatcgtcacgacaatcgacgccgaaaaaaaccgaaaacgctaaaaaacaaaatctaaaaacgacgaaccaatacgaaaaccgcgacgataaaacctaacgcgctatccgccgacgaccgcaaatacccgcaaactcaaacgcccgaataaaaaccgaacgccgatacccgaacgcgacaaaataatcgaaacccgaaacccgaaacgacctccacccaaacgatcaacgctaacgctcgaaccccaccctccccgcccgcaacgtctcaaataccgctacttaacgcaaataactcgttataaaccttctataatcgtaacttttctttaaaactattaaatttattt

SEQ ID NO: 22777 - DNA, 614 bp, Artificial Sequence
  chemically treated genomic DNA (Homo sapiens) CpG-island No: 22777
ttacgtaacggtttgttcggcggaatttatcgttgcggttcgggaggtaggcggggaggggcgcgcgtttttatttcggagcggcggttcggttcgcggttttcgtcgtcgtcgtcgtcgtttcgtttatcgagcggtcggcgtcggcgattggttcggcgcggtttagtaggttcggttcggttcgttttttcgtgcgtttcggttcgttgttaggcgtttttttaggagcggttcgggaatttgcgggcgttcgtcgtcgtttttcggtttcggtcgtcgtcgtttaatgatattatcgttaggagaagaaagacgcggtcgttcgttcggttcgcgttcggttcgcgtcgtttcgcgttttgcgtagttttcgttttaggtcgtgcgcggggcggcggcggcggttgggagcgggcggggaagggaaaggggaaggggagcggggagcggatggggagggagtcgggggtgggggcgggcgcgtatttgcgtttatttgtttcgggttcgtcgtgcgtttcgcgtttttggtcggggtattcggaagtttttgtttatgttttgaattcgtgagcgttgaaatgatgaagtattttttagaatgttttttt

SEQ ID NO: 22778 - DNA, 614 bp, Artificial Sequence
  chemically treated genomic DNA (Homo sapiens) CpG-island No: 22778
aaaaaaacattctaaaaaatacttcatcatttcaacgctcacgaattcaaaacataaacaaaaacttccgaataccccgaccaaaaacgcgaaacgcacgacgaacccgaaacaaataaacgcaaatacgcgcccgcccccacccccgactccctccccatccgctccccgctccccttcccctttcccttccccgcccgctcccaaccgccgccgccgccccgcgcacgacctaaaacgaaaactacgcaaaacgcgaaacgacgcgaaccgaacgcgaaccgaacgaacgaccgcgtctttcttctcctaacgataatatcattaaacgacgacgaccgaaaccgaaaaacgacgacgaacgcccgcaaattcccgaaccgctcctaaaaaaacgcctaacaacgaaccgaaacgcacgaaaaaacgaaccgaaccgaacctactaaaccgcgccgaaccaatcgccgacgccgaccgctcgataaacgaaacgacgacgacgacgacgaaaaccgcgaaccgaaccgccgctccgaaataaaaacgcgcgcccctccccgcctacctcccgaaccgcaacgataaattccgccgaacaaaccgttacgtaa

SEQ ID NO: 22779 - DNA, 614 bp, Artificial Sequence
  chemically treated genomic DNA (Homo sapiens) CpG-island No: 22779
aaaagagtattttgggaagtattttattattttaacgtttacgaatttaaaatataaataaaggttttcgagtgtttcggttaggggcgcggggcgtacggcgggttcggggtaggtaagcgtaggtgcgcgttcgtttttattttcggttttttttttattcgtttttcgtttttttttttttttttttttttcgttcgtttttagtcgtcgtcgtcgtttcgcgtacggtttggagcggaggttgcgtagggcgcggggcggcgcgggtcgggcgcgggtcgggcggacggtcgcgtttttttttttttggcggtgatgttattgggcgacggcggtcgaggtcggggggcggcggcgggcgttcgtaggttttcgagtcgtttttgagaaggcgtttgatagcgggtcggggcgtacggagaagcgggtcgggtcggatttgttgggtcgcgtcgagttaatcgtcggcgtcggtcgttcgatgggcgaggcggcggcggcggcggcgggggtcgcgggtcgggtcgtcgtttcgaggtgaaggcgcgcgttttttttcgtttgtttttcgggtcgtagcgatgaatttcgtcgagtaaatcgttacgtgg

SEQ ID NO: 22780 - DNA, 614 bp, Artificial Sequence
  chemically treated genomic DNA (Homo sapiens) CpG-island No: 22780
ccacgtaacgatttactcgacgaaattcatcgctacgacccgaaaaacaaacgaaaaaaaacgcgcgccttcacctcgaaacgacgacccgacccgcgacccccgccgccgccgccgccgcctcgcccatcgaacgaccgacgccgacgattaactcgacgcgacccaacaaatccgacccgacccgcttctccgtacgccccgacccgctatcaaacgccttctcaaaaacgactcgaaaacctacgaacgcccgccgccgccccccgacctcgaccgccgtcgcccaataacatcaccgccaaaaaaaaaaaaacgcgaccgtccgcccgacccgcgcccgacccgcgccgccccgcgccctacgcaacctccgctccaaaccgtacgcgaaacgacgacgacgactaaaaacgaacgaaaaaaaaaaaaaaaaaaaaaaacgaaaaacgaataaaaaaaaaaccgaaaataaaaacgaacgcgcacctacgcttacctaccccgaacccgccgtacgccccgcgcccctaaccgaaacactcgaaaacctttatttatattttaaattcgtaaacgttaaaataataaaatacttcccaaaatactctttt

SEQ ID NO: 22781 - DNA, 509 bp, Artificial Sequence
  chemically treated genomic DNA (Homo sapiens) CpG-island No: 22781
gcgggttcgttttaggtcgtcgggggtcgttcgttagcgtcgttcgttgtgttgggagcgcgggtcgtgggcgtcgttcggttttgttcgcggcgttttcgttgtcggttacggcgtttagcgtttgtgttttgtattgtaggtttatttcgagtttcggagcgagagcgagtgtttgagtaatattcgcgagtttttgcgcggttgcggggtttttttgcggttggaggtgagcgcgggcggttacgggtcgagggaggggtcgggaagacggggttgggttcggggtgggtgtttcgttttagtcggattttttgtttttttcgcgttcggattcgatttttttcggttgttcgagagttcgggatgtgtggaacggggcgttgcgggtttgggtaatggtcgggaggtggcggcgcgcgggttatttttagggtagggtggagtttgcgtgtggaattttagatattgttttcgttttagtgaggaagagtggttttggtcgttgg

SEQ ID NO: 22782 - DNA, 509 bp, Artificial Sequence
  chemically treated genomic DNA (Homo sapiens) CpG-island No: 22782
ccaacgaccaaaaccactcttcctcactaaaacgaaaacaatatctaaaattccacacgcaaactccaccctaccctaaaaataacccgcgcgccgccacctcccgaccattacccaaacccgcaacgccccgttccacacatcccgaactctcgaacaaccgaaaaaaatcgaatccgaacgcgaaaaaaacaaaaaatccgactaaaacgaaacacccaccccgaacccaaccccgtcttcccgacccctccctcgacccgtaaccgcccgcgctcacctccaaccgcaaaaaaaccccgcaaccgcgcaaaaactcgcgaatattactcaaacactcgctctcgctccgaaactcgaaataaacctacaatacaaaacacaaacgctaaacgccgtaaccgacaacgaaaacgccgcgaacaaaaccgaacgacgcccacgacccgcgctcccaacacaacgaacgacgctaacgaacgacccccgacgacctaaaacgaacccgc

SEQ ID NO: 22783 - DNA, 509 bp, Artificial Sequence
  chemically treated genomic DNA (Homo sapiens) CpG-island No: 22783
ttagcgattagaattatttttttttattggaacgagagtaatgtttggggttttatacgtagattttattttgttttgggggtggttcgcgcgtcgttatttttcggttattatttaaattcgtaacgtttcgttttatatatttcggattttcgagtagtcggggagggtcggattcgggcgcggaggaggtaggaggttcggttggagcgaagtatttatttcgggtttaatttcgttttttcggtttttttttcggttcgtggtcgttcgcgtttatttttagtcgtagggaagtttcgtagtcgcgtaggaattcgcggatgttgtttaggtattcgttttcgtttcggggttcggggtagatttgtaatatagagtataagcgttgagcgtcgtggtcggtagcggggacgtcgcggataaggtcgagcgacgtttacggttcgcgtttttaatatagcgggcgacgttggcgagcggttttcgacggtttggagcgagttcgt

SEQ ID NO: 22784 - DNA, 509 bp, Artificial Sequence
  chemically treated genomic DNA (Homo sapiens) CpG-island No: 22784
acgaactcgctccaaaccgtcgaaaaccgctcgccaacgtcgcccgctatattaaaaacgcgaaccgtaaacgtcgctcgaccttatccgcgacgtccccgctaccgaccacgacgctcaacgcttatactctatattacaaatctaccccgaaccccgaaacgaaaacgaatacctaaacaacatccgcgaattcctacgcgactacgaaacttccctacgactaaaaataaacgcgaacgaccacgaaccgaaaaaaaaaccgaaaaaacgaaattaaacccgaaataaatacttcgctccaaccgaacctcctacctcctccgcgcccgaatccgaccctccccgactactcgaaaatccgaaatatataaaacgaaacgttacgaatttaaataataaccgaaaaataacgacgcgcgaaccacccccaaaacaaaataaaatctacgtataaaaccccaaacattactctcgttccaataaaaaaaaataattctaatcgctaa

SEQ ID NO: 22785 - DNA, 656 bp, Artificial Sequence
  chemically treated genomic DNA (Homo sapiens) CpG-island No: 22785
gatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggatatgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatatcggtcgtttttggatgagcgagcggtggtgttggggtcggatcgtgaaaacgttgttgtgcggtgtgaaagcgttgttttgtcggttattgaggtttttgggttgggggattcggatttgtgggggttggggggtcgtattcgggtttgtgtttttcggttagggtggttaattg

SEQ ID NO: 22786 - DNA, 656 bp, Artificial Sequence
  chemically treated genomic DNA (Homo sapiens) CpG-island No: 22786
caattaaccaccctaaccgaaaaacacaaacccgaatacgaccccccaacccccacaaatccgaatcccccaacccaaaaacctcaataaccgacaaaacaacgctttcacaccgcacaacaacgttttcacgatccgaccccaacaccaccgctcgctcatccaaaaacgaccgatatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacatatccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatc

SEQ ID NO: 22787 - DNA, 656 bp, Artificial Sequence
  chemically treated genomic DNA (Homo sapiens) CpG-island No: 22787
taattgattattttgatcggaaaatataaattcgaatgcggttttttagtttttatagattcgggttttttaatttaaaagttttaatgatcggtaagatagcgtttttatatcgtataataacgtttttacggttcgattttagtattatcgttcgtttatttaagaacggtcggtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacgatatatttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgatt

SEQ ID NO: 22788 - DNA, 656 bp, Artificial Sequence
  chemically treated genomic DNA (Homo sapiens) CpG-island No: 22788
aatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaatatatcgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacaccgaccgttcttaaataaacgaacgataatactaaaatcgaaccgtaaaaacgttattatacgatataaaaacgctatcttaccgatcattaaaacttttaaattaaaaaacccgaatctataaaaactaaaaaaccgcattcgaatttatattttccgatcaaaataatcaatta

SEQ ID NO: 22789 - DNA, 590 bp, Artificial Sequence
  chemically treated genomic DNA (Homo sapiens) CpG-island No: 22789
  misc_feature (122)..(122): n is either a, c, g or t
  misc_feature (560)..(560): n is either a, c, g or t
ggcgggaaatcgcgtcgggttcgtcgcgttacggaatcggttaacgcgcggggagaggacgaatgtttaaagggcgtcggggcggttcgtttttttattagggagacgggtaatagttcganggttttttatcgtttggttttgagagagtcgtagttagcggtttacgttggttcgtcgtcgtcgtcgataaattcgtgggaagggggcgtcgtcgttcggaaatattttgatttttcgaacgattaggttcgcgatcgggtcgggcgtcgatttaggcggttataagacgttattaggaaagaacggggacgtttattttttagggcgaaaaatcgtttattagggcgacggtttataacgggaatcgatatttaaaataaggtgtttggggcgcggggggtcggaaggttttacggcggatttcgtaggggagttttttatcgagtagttgggcgggggaaagtcggtcgaacgcgggcgagaaaggaaagggaaaaaggggaataggagcgggaggaacggtcgttggtaaacggagcggggttcgtagcgcgggnttttttattattcgtcggcgcgaaaggcgg

SEQ ID NO: 22790 - DNA, 590 bp, Artificial Sequence
  chemically treated genomic DNA (Homo sapiens) CpG-island No: 22790
  misc_feature (31)..(31): n is either a, c, g or t
  misc_feature (469)..(469): n is either a, c, g or t
ccgcctttcgcgccgacgaataataaaaaancccgcgctacgaaccccgctccgtttaccaacgaccgttcctcccgctcctattcccctttttccctttcctttctcgcccgcgttcgaccgactttcccccgcccaactactcgataaaaaactcccctacgaaatccgccgtaaaaccttccgaccccccgcgccccaaacaccttattttaaatatcgattcccgttataaaccgtcgccctaataaacgatttttcgccctaaaaaataaacgtccccgttctttcctaataacgtcttataaccgcctaaatcgacgcccgacccgatcgcgaacctaatcgttcgaaaaatcaaaatatttccgaacgacgacgcccccttcccacgaatttatcgacgacgacgacgaaccaacgtaaaccgctaactacgactctctcaaaaccaaacgataaaaaaccntcgaactattacccgtctccctaataaaaaaacgaaccgccccgacgccctttaaacattcgtcctctccccgcgcgttaaccgattccgtaacgcgacgaacccgacgcgatttcccgcc

SEQ ID NO: 22791 - DNA, 590 bp, Artificial Sequence
  chemically treated genomic DNA (Homo sapiens) CpG-island No: 22791
  misc_feature (31)..(31): n is either a, c, g or t
  misc_feature (469)..(469): n is either a, c, g or t
tcgtttttcgcgtcggcgggtggtggggggnttcgcgttgcgggtttcgtttcgtttgttagcggtcgtttttttcgtttttgttttttttttttttttttttttttcgttcgcgttcggtcggttttttttcgtttagttgttcggtggggggtttttttgcggggttcgtcgtggggtttttcggtttttcgcgttttaagtattttgttttgggtgtcggttttcgttgtgggtcgtcgttttgataggcggtttttcgttttggggggtgggcgttttcgtttttttttggtggcgttttgtggtcgtttgggtcggcgttcggttcggtcgcgggtttggtcgttcgagggattagggtgttttcgggcggcggcgttttttttttacgggtttgtcggcggcggcggcgggttagcgtggatcgttggttgcggtttttttagggttaggcggtgaagggttntcgggttgttgttcgtttttttggtgggggggcgggtcgtttcggcgttttttaaatattcgtttttttttcgcgcgttggtcggtttcgtggcgcggcgggttcggcgcggtttttcgtt

SEQ ID NO: 22792 - DNA, 590 bp, Artificial Sequence
  chemically treated genomic DNA (Homo sapiens) CpG-island No: 22792
  misc_feature (122)..(122): n is either a, c, g or t
  misc_feature (560)..(560): n is either a, c, g or t
aacgaaaaaccgcgccgaacccgccgcgccacgaaaccgaccaacgcgcgaaaaaaaaacgaatatttaaaaaacgccgaaacgacccgcccccccaccaaaaaaacgaacaacaacccganaacccttcaccgcctaaccctaaaaaaaccgcaaccaacgatccacgctaacccgccgccgccgccgacaaacccgtaaaaaaaaaacgccgccgcccgaaaacaccctaatccctcgaacgaccaaacccgcgaccgaaccgaacgccgacccaaacgaccacaaaacgccaccaaaaaaaaacgaaaacgcccaccccccaaaacgaaaaaccgcctatcaaaacgacgacccacaacgaaaaccgacacccaaaacaaaatacttaaaacgcgaaaaaccgaaaaaccccacgacgaaccccgcaaaaaaaccccccaccgaacaactaaacgaaaaaaaaccgaccgaacgcgaacgaaaaaaaaaaaaaaaaaaaaaaaacaaaaacgaaaaaaacgaccgctaacaaacgaaacgaaacccgcaacgcgaanccccccaccacccgccgacgcgaaaaacga

SEQ ID NO: 22793 - DNA, 1006 bp, Artificial Sequence
  chemically treated genomic DNA (Homo sapiens) CpG-island No: 22793
tggaacgtaagattttttgattttttttttcgagcgaaattgtatatagagtagggaagttttgtcgcgttgggttcggaggaaagaggaggtcgtggacggggaagaggtcgggtttcgtttttttagcgtcgtcgtttgggcgatttttttattttcggttcgggttcgaagcggcgcggtttagagaagaggaagaaagacgaaaaggaattttgttcgtggttttagttagtaggcgggttaggtttcgtaggggggtggtcggagaaatttgcgattttggcgatttgggttcgcgggagtaagggtcggggcggttttggggattgagttttagcgcgggggttgcggtagtaattttttcggaggaagtttgtcgcgaattttagcgacgcggtgtttcgttcgttgcgcgatgttttttgggtttcggtcgggtttagacgttcggcgcgttcgttttcggatttttgttttttcgggacgttttgtagaatttcggtttcgcgtttcgcgtttatttattatttgcgttatttttagtagggtcgcgtgggtgcgggggtagttgaggtttagtagtttttttaaggggttcgcgttgggttgggtcgcgtcggtttcgggttcgagcgcgttgtcgttgttgtacgtggtgcggacgagttcggtttcgtgcgatattgcgcggttttagttcgttggtcgttttttcgggtagttgtttaggggttagatatagagggcgggtcgggggcgggcgggggcgggcgttggcgagggcggggcgttcgggtttttgtttcgttgttggagacgcggagtcgtttttggcgggattttttcggtgattggtcggtcggcgttttttagaaaggtagcggtagtttcggttttcgtagatgcgcggaagttagattggagcgagaggaaatcggatgttttgggtcgtggttttttcgaggtgggtaaggttcggattatagttggtattgagtttttt

SEQ ID NO: 22794 - DNA, 1006 bp, Artificial Sequence
  chemically treated genomic DNA (Homo sapiens) CpG-island No: 22794
aaaaaactcaataccaactataatccgaaccttacccacctcgaaaaaaccacgacccaaaacatccgatttcctctcgctccaatctaacttccgcgcatctacgaaaaccgaaactaccgctacctttctaaaaaacgccgaccgaccaatcaccgaaaaaatcccgccaaaaacgactccgcgtctccaacaacgaaacaaaaacccgaacgccccgccctcgccaacgcccgcccccgcccgcccccgacccgccctctatatctaacccctaaacaactacccgaaaaaacgaccaacgaactaaaaccgcgcaatatcgcacgaaaccgaactcgtccgcaccacgtacaacaacgacaacgcgctcgaacccgaaaccgacgcgacccaacccaacgcgaaccccttaaaaaaactactaaacctcaactacccccgcacccacgcgaccctactaaaaataacgcaaataataaataaacgcgaaacgcgaaaccgaaattctacaaaacgtcccgaaaaaacaaaaatccgaaaacgaacgcgccgaacgtctaaacccgaccgaaacccaaaaaacatcgcgcaacgaacgaaacaccgcgtcgctaaaattcgcgacaaacttcctccgaaaaaattactaccgcaacccccgcgctaaaactcaatccccaaaaccgccccgacccttactcccgcgaacccaaatcgccaaaatcgcaaatttctccgaccacccccctacgaaacctaacccgcctactaactaaaaccacgaacaaaattccttttcgtctttcttcctcttctctaaaccgcgccgcttcgaacccgaaccgaaaataaaaaaatcgcccaaacgacgacgctaaaaaaacgaaacccgacctcttccccgtccacgacctcctctttcctccgaacccaacgcgacaaaacttccctactctatatacaatttcgctcgaaaaaaaaaatcaaaaaatcttacgttcca

SEQ ID NO: 22795 - DNA, 1006 bp, Artificial Sequence
  chemically treated genomic DNA (Homo sapiens) CpG-island No: 22795
aggaggtttagtattagttgtggttcgggttttgtttatttcggagaggttacgatttaaggtattcggttttttttcgttttagtttaattttcgcgtatttacgagggtcgggattgtcgttatttttttggaaggcgtcggtcggttagttatcggagggatttcgttagaggcggtttcgcgtttttagtagcggggtagggattcgggcgtttcgttttcgttagcgttcgttttcgttcgttttcggttcgttttttgtatttggtttttgggtagttgttcggggaggcggttagcgagttggggtcgcgtaatgtcgtacggagtcgggttcgttcgtattacgtgtagtagcggtagcgcgttcggattcggggtcggcgcggtttagtttagcgcgagttttttggaggggttgttggattttagttattttcgtatttacgcggttttgttgaaagtggcgtaaatggtaagtgagcgcggggcgcgaggtcgaggttttatagggcgtttcgggaaagtaggggttcgggagcggacgcgtcgggcgtttggattcggtcggagtttagggagtatcgcgtagcgggcggggtatcgcgtcgttaaagttcgcggtaggtttttttcgggaaagttgttgtcgtagttttcgcgttggagtttagtttttagagtcgtttcggtttttgttttcgcggatttaggtcgttagggtcgtaagttttttcggttatttttttgcgaagtttgattcgtttattgattgaaattacgggtaaagttttttttcgttttttttttttttttttgggtcgcgtcgtttcgaattcgagtcgggggtggaagagtcgtttaggcggcggcgttgagggagcgaaattcgatttttttttcgtttacggttttttttttttttcgaatttagcgcggtagggtttttttgttttgtgtgtagtttcgttcgaaggaggaggttagagggttttgcgtttta

SEQ ID NO: 22796 - DNA, 1006 bp, Artificial Sequence
  chemically treated genomic DNA (Homo sapiens) CpG-island No: 22796
taaaacgcaaaaccctctaacctcctccttcgaacgaaactacacacaaaacaaaaaaaccctaccgcgctaaattcgaaaaaaaaaaaaaaccgtaaacgaaaaaaaaatcgaatttcgctccctcaacgccgccgcctaaacgactcttccacccccgactcgaattcgaaacgacgcgacccaaaaaaaaaaaaaaaaaacgaaaaaaaactttacccgtaatttcaatcaataaacgaatcaaacttcgcaaaaaaataaccgaaaaaacttacgaccctaacgacctaaatccgcgaaaacaaaaaccgaaacgactctaaaaactaaactccaacgcgaaaactacgacaacaactttcccgaaaaaaacctaccgcgaactttaacgacgcgataccccgcccgctacgcgatactccctaaactccgaccgaatccaaacgcccgacgcgtccgctcccgaacccctactttcccgaaacgccctataaaacctcgacctcgcgccccgcgctcacttaccatttacgccactttcaacaaaaccgcgtaaatacgaaaataactaaaatccaacaacccctccaaaaaactcgcgctaaactaaaccgcgccgaccccgaatccgaacgcgctaccgctactacacgtaatacgaacgaacccgactccgtacgacattacgcgaccccaactcgctaaccgcctccccgaacaactacccaaaaaccaaatacaaaaaacgaaccgaaaacgaacgaaaacgaacgctaacgaaaacgaaacgcccgaatccctaccccgctactaaaaacgcgaaaccgcctctaacgaaatccctccgataactaaccgaccgacgccttccaaaaaaataacgacaatcccgaccctcgtaaatacgcgaaaattaaactaaaacgaaaaaaaaccgaataccttaaatcgtaacctctccgaaataaacaaaacccgaaccacaactaatactaaacctcct

SEQ ID NO: 22797 - DNA, 739 bp, Artificial Sequence
  chemically treated genomic DNA (Homo sapiens) CpG-island No: 22797
  misc_feature (453)..(453): n is either a, c, g or t
  misc_feature (709)..(710): n is either a, c, g or t
ggtagtacgtcgtagaggattttttcgagtttgttggtatcggtggcgcgaatgttttttatcgggtcgggtttaatcgtttttatcgtttcggaaagtagtttggagagtacgtcggtggtgtggataaatagcgttatacgttagtacgttagcgaacgggtcgaggtcgacggcgattacgaatagtatggcgaagattatttcgttaatggcgcggtaggcgtttattaggcggcgaacgggttggtaaatttattacggtattaggttttcggcgtttattaggttaaaggggatggagagaattatcgttagcgcggtgttttagacggcgatttgtagcgtgacggttatttcggtgaggtaattttgttattggttgaaatcgggcgtgaagaagtcggcggcgaacgtcgttatgttgtcgtcgtttttgattagcgtaacggnggttattttcgcgttttgttacgagacgattaatacggcgagtataacggtttagtttagaagcgagaattagttgcgtttgggtggggcgatggtgatggtttgtatgtttggtttcggtttgtaggtcggataaggtgtttgtacgtattcggtattaacgtttgtatattgtcggatgcgaacgcggggcgttttatttcgattacgatttattgtaacgttttatttaacgaatttatcgcgtttagtcgtnntgtttaagtcgatttaggttatttaattg

SEQ ID NO: 22798 - DNA, 739 bp, Artificial Sequence
  chemically treated genomic DNA (Homo sapiens) CpG-island No: 22798
  misc_feature (30)..(31): n is either a, c, g or t
  misc_feature (287)..(287): n is either a, c, g or t
caattaaataacctaaatcgacttaaacannacgactaaacgcgataaattcgttaaataaaacgttacaataaatcgtaatcgaaataaaacgccccgcgttcgcatccgacaatatacaaacgttaataccgaatacgtacaaacaccttatccgacctacaaaccgaaaccaaacatacaaaccatcaccatcgccccacccaaacgcaactaattctcgcttctaaactaaaccgttatactcgccgtattaatcgtctcgtaacaaaacgcgaaaataaccnccgttacgctaatcaaaaacgacgacaacataacgacgttcgccgccgacttcttcacgcccgatttcaaccaataacaaaattacctcaccgaaataaccgtcacgctacaaatcgccgtctaaaacaccgcgctaacgataattctctccatcccctttaacctaataaacgccgaaaacctaataccgtaataaatttaccaacccgttcgccgcctaataaacgcctaccgcgccattaacgaaataatcttcgccatactattcgtaatcgccgtcgacctcgacccgttcgctaacgtactaacgtataacgctatttatccacaccaccgacgtactctccaaactactttccgaaacgataaaaacgattaaacccgacccgataaaaaacattcgcgccaccgataccaacaaactcgaaaaaatcctctacgacgtactacc

SEQ ID NO: 22799 - DNA, 739 bp, Artificial Sequence
  chemically treated genomic DNA (Homo sapiens) CpG-island No: 22799
  misc_feature (30)..(31): n is either a, c, g or t
  misc_feature (287)..(287): n is either a, c, g or t
tagttggatgatttggatcggtttgaatannacggttaagcgcgatgagttcgttgagtaaagcgttgtagtaaatcgtagtcggaataagacgtttcgcgttcgtattcgataatgtgtaggcgttgatgtcggatgcgtgtaagtattttattcggtttatagatcggagttaaatatgtaaattattattatcgttttatttaagcgtagttggttttcgtttttgagttgggtcgttgtattcgtcgtgttggtcgtttcgtggtagggcgcggaaatggttntcgttacgttgattaaagacggcggtaatatggcgacgttcgtcgtcgatttttttacgttcgattttagttagtggtaggattattttatcgaaatggtcgttacgttgtaaatcgtcgtttggggtatcgcgttggcggtggttttttttattttttttggtttgatgagcgtcgaaaatttggtgtcgtggtgggtttattagttcgttcgtcgtttgatggacgtttgtcgcgttattaacgaaatggttttcgttatgttgttcgtggtcgtcgtcggtttcggttcgttcgttggcgtgttggcgtgtggcgttgtttatttatattatcggcgtgttttttaagttgtttttcgaagcggtggaagcgattgagttcggttcggtggaaggtattcgcgttatcggtgttaataagttcgaagagattttttacggcgtgttgtt

SEQ ID NO: 22800 - DNA, 739 bp, Artificial Sequence
  chemically treated genomic DNA (Homo sapiens) CpG-island No: 22800
  misc_feature (453)..(453): n is either a, c, g or t
  misc_feature (709)..(710): n is either a, c, g or t
aacaacacgccgtaaaaaatctcttcgaacttattaacaccgataacgcgaataccttccaccgaaccgaactcaatcgcttccaccgcttcgaaaaacaacttaaaaaacacgccgataatataaataaacaacgccacacgccaacacgccaacgaacgaaccgaaaccgacgacgaccacgaacaacataacgaaaaccatttcgttaataacgcgacaaacgtccatcaaacgacgaacgaactaataaacccaccacgacaccaaattttcgacgctcatcaaaccaaaaaaaataaaaaaaaccaccgccaacgcgataccccaaacgacgatttacaacgtaacgaccatttcgataaaataatcctaccactaactaaaatcgaacgtaaaaaaatcgacgacgaacgtcgccatattaccgccgtctttaatcaacgtaacganaaccatttccgcgccctaccacgaaacgaccaacacgacgaatacaacgacccaactcaaaaacgaaaaccaactacgcttaaataaaacgataataataatttacatatttaactccgatctataaaccgaataaaatacttacacgcatccgacatcaacgcctacacattatcgaatacgaacgcgaaacgtcttattccgactacgatttactacaacgctttactcaacgaactcatcgcgcttaaccgtnntattcaaaccgatccaaatcatccaacta

SEQ ID NO: 22801 - DNA, 769 bp, Artificial Sequence
  chemically treated genomic DNA (Homo sapiens) CpG-island No: 22801
tcgtttttcgtgtgttgatattaaatgcgtcgcgcggtacgggcgtggtaatggtcggaatacgtgttttatgttagttaatgtcggtgttgataatggtcgcgttcgtcgttttaatggtttgcgttattttatcgtttcggtaaaagtttcgtcgttttcgattaggtcgagtatcgatagtcggtagataataatgaagtcgttgtcgacgcgttcgcgtatcgtacgtattatttttacggtaaatcgtattcggttgcggtaatcgtcgttttattggttattacgttgattggtgcgtacgttagaaattcgttgattaaatatttttcggaatttattatttttatatcgtcgtattttgtttttcgcgttagttgcgcgtagtaggcgaaattgtcgattagttgtaggatttttttatggtttaatttatggggtacgaaacggttgatgggggtttgtaatgcggacggggcgattagatgcggttggtagttgtagcgttcggtatgtaaaatttgtagggttattttgtcgtttttttgatgtatcgtttcggtaatggtgcgatggtgtgggatttggttggcgtcgttgagtatttcgttattttttatgttaacgtttgttaaatttggtgtaatgtcgtcgttgataattagcgttacgtcgtgacgggcgcgttcggtataaaacgttgttagtcgttcggtaacgttcgggtatttttgggatttattttttttttaaagagataattttg

SEQ ID NO: 22802 - DNA, 769 bp, Artificial Sequence
  chemically treated genomic DNA (Homo sapiens) CpG-island No: 22802
caaaattatctctttaaaaaaaaaataaatcccaaaaatacccgaacgttaccgaacgactaacaacgttttataccgaacgcgcccgtcacgacgtaacgctaattatcaacgacgacattacaccaaatttaacaaacgttaacataaaaaataacgaaatactcaacgacgccaaccaaatcccacaccatcgcaccattaccgaaacgatacatcaaaaaaacgacaaaataaccctacaaattttacataccgaacgctacaactaccaaccgcatctaatcgccccgtccgcattacaaacccccatcaaccgtttcgtaccccataaattaaaccataaaaaaatcctacaactaatcgacaatttcgcctactacgcgcaactaacgcgaaaaacaaaatacgacgatataaaaataataaattccgaaaaatatttaatcaacgaatttctaacgtacgcaccaatcaacgtaataaccaataaaacgacgattaccgcaaccgaatacgatttaccgtaaaaataatacgtacgatacgcgaacgcgtcgacaacgacttcattattatctaccgactatcgatactcgacctaatcgaaaacgacgaaacttttaccgaaacgataaaataacgcaaaccattaaaacgacgaacgcgaccattatcaacaccgacattaactaacataaaacacgtattccgaccattaccacgcccgtaccgcgcgacgcatttaatatcaacacacgaaaaacga

SEQ ID NO: 22803 - DNA, 769 bp, Artificial Sequence
  chemically treated genomic DNA (Homo sapiens) CpG-island No: 22803
taaaattatttttttaagaaagagataaattttaagaatattcggacgttgtcgagcggttggtagcgttttatgtcgaacgcgttcgttacggcgtggcgttgattgttagcggcggtattgtattagatttaataggcgttggtatggaaggtggcgaaatgtttaacgacgttagttagattttatattatcgtattattatcgaagcggtatattaggaaggcggtaaaatagttttgtaaattttgtatatcgggcgttatagttattaatcgtatttggtcgtttcgttcgtattgtaggtttttattaatcgtttcgtgttttatgagttaagttatgaagagattttgtaattgatcgataatttcgtttgttgcgcgtaattggcgcgggaggtaggatacgacggtgtagaggtgatgggtttcgaagggtatttgattaacgaatttttgacgtgcgtattaattagcgtagtgattagtggggcggcgattatcgtaatcggatgcgatttgtcgtagaagtagtgcgtgcggtgcgcgaacgcgtcggtaacgattttattattatttatcgattgtcgatgttcgatttggtcgaagacggcgggatttttgtcgaaacggtagagtggcgtaggttattgaagcggcgggcgcgattattattaatatcggtattggttggtatgaagtacgtatttcgattattgttacgttcgtgtcgcgcggcgtatttagtgttaatatacggggagcgg

SEQ ID NO: 22804 - DNA, 769 bp, Artificial Sequence
  chemically treated genomic DNA (Homo sapiens) CpG-island No: 22804
ccgctccccgtatattaacactaaatacgccgcgcgacacgaacgtaacaataatcgaaatacgtacttcataccaaccaataccgatattaataataatcgcgcccgccgcttcaataacctacgccactctaccgtttcgacaaaaatcccgccgtcttcgaccaaatcgaacatcgacaatcgataaataataataaaatcgttaccgacgcgttcgcgcaccgcacgcactacttctacgacaaatcgcatccgattacgataatcgccgccccactaatcactacgctaattaatacgcacgtcaaaaattcgttaatcaaatacccttcgaaacccatcacctctacaccgtcgtatcctacctcccgcgccaattacgcgcaacaaacgaaattatcgatcaattacaaaatctcttcataacttaactcataaaacacgaaacgattaataaaaacctacaatacgaacgaaacgaccaaatacgattaataactataacgcccgatatacaaaatttacaaaactattttaccgccttcctaatataccgcttcgataataatacgataatataaaatctaactaacgtcgttaaacatttcgccaccttccataccaacgcctattaaatctaatacaataccgccgctaacaatcaacgccacgccgtaacgaacgcgttcgacataaaacgctaccaaccgctcgacaacgtccgaatattcttaaaatttatctctttcttaaaaaaataatttta

SEQ ID NO: 22805 - DNA, 877 bp, Artificial Sequence
  chemically treated genomic DNA (Homo sapiens) CpG-island No: 22805
tcgtatacgtttattatttttcgtaggtatatatgtatatacgcgcgcgtatacgtatatatatttttagttcggatcggtcgatttgtttttcggggtttttttcgtaggtaggttttttcgtcgagttttcgaaaaggggcggtcgtggcggttttggcgtttagttgggtaacgtttcgtggtattttatcgtttttttttgttgtgtttagcgtttcgattgaagattcggatttttagttttcggcggtttttcgtttagtttagagatcgtagtttcgtcgtttcgttgtttttgagtcgttttcggttcggtttcggttcgtagcgtttttattaggcgggcggttaggtttcgcgtttcgtatttcgtatttcgcgtttttttttagcggcgtcgttttttggtttcgagtttcgtttttcggcgaagtcgttcgcgtcggggtttcgcggtagtcggttttgacggttttttcgttcgttcgttttcgttttcgcgttttttttttttttttttttttttttttttttatttagttcgttattcgcggtttttttatattcgggcgggtaggtaggcgtttatagtagcgcggagtcgcggttatttcggtgtcgggcgtttttacgcgcgtttatttatttagcgttgttaattagtcgcggcgggcgtttcgttgtgagtttggcgagagtaattatatatttttagggcggtttagtatatatatttatacgcgcgttaggaaatatattcgtaggttagagggcgcgcgtatatacgcgtatatatggtagtttgttttaggatggtatttcgggtaataggagttttatcgtttgttaagtagaagtataatggataatttta

SEQ ID NO: 22806 - DNA, 877 bp, Artificial Sequence
  chemically treated genomic DNA (Homo sapiens) CpG-island No: 22806
taaaattatccattatacttctacttaacaaacgataaaactcctattacccgaaataccatcctaaaacaaactaccatatatacgcgtatatacgcgcgccctctaacctacgaatatatttcctaacgcgcgtataaatatatatactaaaccgccctaaaaatatataattactctcgccaaactcacaacgaaacgcccgccgcgactaattaacaacgctaaataaataaacgcgcgtaaaaacgcccgacaccgaaataaccgcgactccgcgctactataaacgcctacctacccgcccgaatataaaaaaaccgcgaataacgaactaaataaaaaaaaaaaaaaaaaaaaaaaaaaaaaaaacgcgaaaacgaaaacgaacgaacgaaaaaaccgtcaaaaccgactaccgcgaaaccccgacgcgaacgacttcgccgaaaaacgaaactcgaaaccaaaaaacgacgccgctaaaaaaaaacgcgaaatacgaaatacgaaacgcgaaacctaaccgcccgcctaataaaaacgctacgaaccgaaaccgaaccgaaaacgactcaaaaacaacgaaacgacgaaactacgatctctaaactaaacgaaaaaccgccgaaaactaaaaatccgaatcttcaatcgaaacgctaaacacaacaaaaaaaaacgataaaataccacgaaacgttacccaactaaacgccaaaaccgccacgaccgccccttttcgaaaactcgacgaaaaaacctacctacgaaaaaaaccccgaaaaacaaatcgaccgatccgaactaaaaatatatatacgtatacgcgcgcgtatatacatatatacctacgaaaaataataaacgtatacga

SEQ ID NO: 22807 - DNA, 877 bp, Artificial Sequence
  chemically treated genomic DNA (Homo sapiens) CpG-island No: 22807
tagaattgtttattgtatttttatttagtaaacggtgggatttttattgttcggggtgttattttggggtaggttgttatgtgtgcgcgtgtgtgcgcgcgttttttgatttgcgagtgtgttttttggcgcgcgtgtggatgtgtgtgttgggtcgttttgggagtgtgtgattgttttcgttaggtttatagcgaggcgttcgtcgcggttgattgatagcgttgggtgaatgagcgcgcgtggaggcgttcggtatcgaggtggtcgcggtttcgcgttgttgtgagcgtttgtttgttcgttcgggtgtggggggatcgcgggtggcgggttgggtgggaggaggaggaggaggaggaggagagagggcgcgggagcgagggcgggcggacgggagggtcgttagagtcggttgtcgcggagtttcggcgcgggcggtttcgtcggggagcgaggttcggagttaggaggcggcgtcgttgggagggagcgcggagtgcggagtgcggagcgcggggtttggtcgttcgtttggtgagagcgttgcgggtcggggtcgggtcgggggcggtttaggggtagcggggcggcgaggttgcggtttttggattaggcgaggggtcgtcgggggttggaggttcggatttttagtcggggcgttgggtataatagagagaagcggtgagatattacgaagcgttgtttagttgggcgttagggtcgttacgatcgttttttttcggagattcggcgaggagatttgtttgcgggagagatttcggggagtaggtcggtcggttcgggttgggggtgtgtgtgcgtgtgcgcgcgcgtgtgtgtatgtgtgtttgcgaggggtggtgggcgtgtacga

SEQ ID NO: 22808 - DNA, 877 bp, Artificial Sequence
  chemically treated genomic DNA (Homo sapiens) CpG-island No: 22808
tcgtacacgcccaccacccctcgcaaacacacatacacacacgcgcgcgcacacgcacacacacccccaacccgaaccgaccgacctactccccgaaatctctcccgcaaacaaatctcctcgccgaatctccgaaaaaaaacgatcgtaacgaccctaacgcccaactaaacaacgcttcgtaatatctcaccgcttctctctattatacccaacgccccgactaaaaatccgaacctccaacccccgacgacccctcgcctaatccaaaaaccgcaacctcgccgccccgctacccctaaaccgcccccgacccgaccccgacccgcaacgctctcaccaaacgaacgaccaaaccccgcgctccgcactccgcactccgcgctccctcccaacgacgccgcctcctaactccgaacctcgctccccgacgaaaccgcccgcgccgaaactccgcgacaaccgactctaacgaccctcccgtccgcccgccctcgctcccgcgccctctctcctcctcctcctcctcctcctcccacccaacccgccacccgcgatccccccacacccgaacgaacaaacaaacgctcacaacaacgcgaaaccgcgaccacctcgataccgaacgcctccacgcgcgctcattcacccaacgctatcaatcaaccgcgacgaacgcctcgctataaacctaacgaaaacaatcacacactcccaaaacgacccaacacacacatccacacgcgcgccaaaaaacacactcgcaaatcaaaaaacgcgcgcacacacgcgcacacataacaacctaccccaaaataacaccccgaacaataaaaatcccaccgtttactaaataaaaatacaataaacaattcta

SEQ ID NO: 22809 - DNA, 500 bp, Artificial Sequence
  chemically treated genomic DNA (Homo sapiens) CpG-island No: 22809
gttcgcggtaggcgtcggtcgtattggtgagggggcgcgggttgtttggttagggtagtttttttagtttcgggttggagtcggagtcggagtcggatttcgcgtatatcgttacgttaatttaaatttatatcgttttttttattttatcgtcgtaggttcgttgggttcgtagcgggtttttttaggtagcgttttttacgttttttttataatgtttcgcgttaggtttcgtttcggttcgtcgtggagatcggcgcgtgaggaatttatcggtatcggtcgcgcgttggtagtcgtcggtgtggttgtattttattaatttcgtgcgtcgcggttgggcgtcggagagtgcgtgtgttttttttttgtacgcggtgtttgggttcggttaggcggggttcgtcgttagggtttgaggatgggggagtagttataggaagcgatttcgcgatggtaaggtgggtatgggttcggggttagggttttgttggagtcgg

SEQ ID NO: 22810 - DNA, 500 bp, Artificial Sequence
  chemically treated genomic DNA (Homo sapiens) CpG-island No: 22810
ccgactccaacaaaaccctaaccccgaacccatacccaccttaccatcgcgaaatcgcttcctataactactcccccatcctcaaaccctaacgacgaaccccgcctaaccgaacccaaacaccgcgtacaaaaaaaaaacacacgcactctccgacgcccaaccgcgacgcacgaaattaataaaatacaaccacaccgacgactaccaacgcgcgaccgataccgataaattcctcacgcgccgatctccacgacgaaccgaaacgaaacctaacgcgaaacattataaaaaaaacgtaaaaaacgctacctaaaaaaacccgctacgaacccaacgaacctacgacgataaaataaaaaaaacgatataaatttaaattaacgtaacgatatacgcgaaatccgactccgactccgactccaacccgaaactaaaaaaactaccctaaccaaacaacccgcgccccctcaccaatacgaccgacgcctaccgcgaac

SEQ ID NO: 22811 - DNA, 500 bp, Artificial Sequence
  chemically treated genomic DNA (Homo sapiens) CpG-island No: 22811
tcggttttagtaaagttttagtttcgggtttatgtttattttgttatcgcggggtcgttttttgtagttatttttttatttttaaattttggcggcggatttcgtttggtcgagtttaagtatcgcgtgtaggagagaagtatacgtatttttcgacgtttagtcgcggcgtacgggattggtgaggtgtagttatatcggcgattattagcgcgcggtcggtatcggtaggttttttacgcgtcggtttttacggcgagtcggggcggggtttggcgcggagtattgtgggaaaggcgtggaggacgttgtttggggagattcgttgcgggtttagcgggtttgcggcggtggggtggagagggcggtgtaggtttaggttgacgtggcggtgtgcgcgggattcggtttcggtttcggttttaattcggagttgagggaattgttttggttaagtagttcgcgtttttttattaatgcggtcggcgtttgtcgcgggt

SEQ ID NO: 22812 - DNA, 500 bp, Artificial Sequence
  chemically treated genomic DNA (Homo sapiens) CpG-island No: 22812
acccgcgacaaacgccgaccgcattaataaaaaaacgcgaactacttaaccaaaacaattccctcaactccgaattaaaaccgaaaccgaaaccgaatcccgcgcacaccgccacgtcaacctaaacctacaccgccctctccaccccaccgccgcaaacccgctaaacccgcaacgaatctccccaaacaacgtcctccacgcctttcccacaatactccgcgccaaaccccgccccgactcgccgtaaaaaccgacgcgtaaaaaacctaccgataccgaccgcgcgctaataatcgccgatataactacacctcaccaatcccgtacgccgcgactaaacgtcgaaaaatacgtatacttctctcctacacgcgatacttaaactcgaccaaacgaaatccgccgccaaaatttaaaaataaaaaaataactacaaaaaacgaccccgcgataacaaaataaacataaacccgaaactaaaactttactaaaaccga

SEQ ID NO: 22813 - DNA, 631 bp, Artificial Sequence
  chemically treated genomic DNA (Homo sapiens) CpG-island No: 22813
tcgggcgacgcgcggggttggggcgggtcggcggtttcggggagtggcggtcgggagttcgcgaacgcgggtgggcgtcgtcgttttattaatcgggcgttttcgggaagttcgggcggggttcgtcgtttatatataggattagcgttttttaaattttatttttgggaaaagtcgtcgtattttttatttaaattcgcggagtcgaggggttgggtaggggttgggcgggcgcgggggtcggcgaggcggattcgggaacgggtggattcgggcggttaagtttttttagcgtcggtttaatcgtttcggttcgggttagtttagcggggcgggggtcggcgatataaaggcggcggcgggtttttcgggttttcggtttcgggtagtcgtagggcgtttcgggtcgtcggattttttttcgcgttgcggttcgttagtcggcgtcgttcgtcgttcgtttttagtcgttcggcgaggcgcggtttttttcgtcggcgcggggttttttggttaatttttgttcggtagcgcggtcgttgattggagaaggcggggcgtcggggtagcggggatttttttttatttttttcgttttttttttttgtttttttattgtcggcgttttttt

SEQ ID NO: 22814 - DNA, 631 bp, Artificial Sequence
  chemically treated genomic DNA (Homo sapiens) CpG-island No: 22814
aaaaaaacgccgacaataaaaaaacaaaaaaaaaaaacgaaaaaaataaaaaaaaatccccgctaccccgacgccccgccttctccaatcaacgaccgcgctaccgaacaaaaattaaccaaaaaaccccgcgccgacgaaaaaaaccgcgcctcgccgaacgactaaaaacgaacgacgaacgacgccgactaacgaaccgcaacgcgaaaaaaaatccgacgacccgaaacgccctacgactacccgaaaccgaaaacccgaaaaacccgccgccgcctttatatcgccgacccccgccccgctaaactaacccgaaccgaaacgattaaaccgacgctaaaaaaacttaaccgcccgaatccacccgttcccgaatccgcctcgccgacccccgcgcccgcccaacccctacccaacccctcgactccgcgaatttaaataaaaaatacgacgacttttcccaaaaataaaatttaaaaaacgctaatcctatatataaacgacgaaccccgcccgaacttcccgaaaacgcccgattaataaaacgacgacgcccacccgcgttcgcgaactcccgaccgccactccccgaaaccgccgacccgccccaaccccgcgcgtcgcccga

SEQ ID NO: 22815 - DNA, 631 bp, Artificial Sequence
  chemically treated genomic DNA (Homo sapiens) CpG-island No: 22815
ggggaagcgtcgatagtgggggagtagggggaggggacgaggaaggtgggggggggttttcgttgtttcggcgtttcgttttttttaattagcggtcgcgttgtcgggtaggggttaattaggggatttcgcgtcggcggaggaagtcgcgtttcgtcggacggttgagggcgggcgacgggcggcgtcggttgacgggtcgtaacgcgaggggaggttcggcggttcggggcgttttgcgattgttcgaggtcggaggttcggaggattcgtcgtcgtttttgtgtcgtcggttttcgtttcgttggattggttcgggtcggggcggttgggtcggcgttgaaggggtttggtcgttcgggtttattcgttttcggattcgtttcgtcggttttcgcgttcgtttaatttttgtttagtttttcggtttcgcgagtttgggtgagaagtgcggcggttttttttagggatggagtttagaggacgttaattttatgtgtgagcggcggatttcgttcggatttttcggaggcgttcggttagtgaggcgacggcgtttattcgcgttcgcgggttttcggtcgttatttttcggagtcgtcggttcgttttagtttcgcgcgtcgttcgg

SEQ ID NO: 22816 - DNA, 631 bp, Artificial Sequence
  chemically treated genomic DNA (Homo sapiens) CpG-island No: 22816
ccgaacgacgcgcgaaactaaaacgaaccgacgactccgaaaaataacgaccgaaaacccgcgaacgcgaataaacgccgtcgcctcactaaccgaacgcctccgaaaaatccgaacgaaatccgccgctcacacataaaattaacgtcctctaaactccatccctaaaaaaaaccgccgcacttctcacccaaactcgcgaaaccgaaaaactaaacaaaaattaaacgaacgcgaaaaccgacgaaacgaatccgaaaacgaataaacccgaacgaccaaaccccttcaacgccgacccaaccgccccgacccgaaccaatccaacgaaacgaaaaccgacgacacaaaaacgacgacgaatcctccgaacctccgacctcgaacaatcgcaaaacgccccgaaccgccgaacctcccctcgcgttacgacccgtcaaccgacgccgcccgtcgcccgccctcaaccgtccgacgaaacgcgacttcctccgccgacgcgaaatcccctaattaacccctacccgacaacgcgaccgctaattaaaaaaaacgaaacgccgaaacaacgaaaacccccccccaccttcctcgtcccctccccctactcccccactatcgacgcttcccc

SEQ ID NO: 22817 - DNA, 719 bp, Artificial Sequence
  chemically treated genomic DNA (Homo sapiens) CpG-island No: 22817
  misc_feature (255)..(256): n is either a, c, g or t
  misc_feature (392)..(392): n is either a, c, g or t
  misc_feature (660)..(660): n is either a, c, g or t
cgtattatcggatgtagtaacggcgggtttttcgcgatcgtttcgcgttacggttgatgttttttttcggttttgcggtatttgtatttcgggaacgatttacggaaattatgtttcgtacgtagtttatttagtagttggcggaagggaatagagagcgttttataggtcgtaatatcgttggtttagagcgtattatcgtcgggtcgaggtaattttttagttgttagaatcgtttttgcggggtggcgtttnnataatgttatatcggtatgttagttgtcggtatttggcggattattcgtatgggtattagtacgatgatttcgttaattttttcggtatgcggggtaatagggtgaatatgttattcgttaaatacgttgggtagngcgcgtagttgttgcgtcgtaatagtttattgcgtagaatattatttgatgcgtatcgtatggtaagttgttaattgagtattttatcggtcgttagtcgattcgaatttgttcgaatagtttagcggtattttacgttatatgatttttattaggttacgttttacgcgtatagtttaagaggtattattcggtcgtatttattttcgaattcggttattattacggtcgtattattcgtcgttatttcgtatgtcggagtcgtttngaataatattttagtttaaatgggatttttgagttttacgattttgtattaaatgattt

SEQ ID NO: 22818 - DNA, 719 bp, Artificial Sequence
  chemically treated genomic DNA (Homo sapiens) CpG-island No: 22818
  misc_feature (60)..(60): n is either a, c, g or t
  misc_feature (328)..(328): n is either a, c, g or t
  misc_feature (464)..(465): n is either a, c, g or t
aaatcatttaatacaaaatcgtaaaactcaaaaatcccatttaaactaaaatattattcnaaacgactccgacatacgaaataacgacgaataatacgaccgtaataataaccgaattcgaaaataaatacgaccgaataatacctcttaaactatacgcgtaaaacgtaacctaataaaaatcatataacgtaaaataccgctaaactattcgaacaaattcgaatcgactaacgaccgataaaatactcaattaacaacttaccatacgatacgcatcaaataatattctacgcaataaactattacgacgcaacaactacgcgcnctacccaacgtatttaacgaataacatattcaccctattaccccgcataccgaaaaaattaacgaaatcatcgtactaatacccatacgaataatccgccaaataccgacaactaacataccgatataacattatnnaaacgccaccccgcaaaaacgattctaacaactaaaaaattacctcgacccgacgataatacgctctaaaccaacgatattacgacctataaaacgctctctattcccttccgccaactactaaataaactacgtacgaaacataatttccgtaaatcgttcccgaaatacaaataccgcaaaaccgaaaaaaaacatcaaccgtaacgcgaaacgatcgcgaaaaacccgccgttactacatccgataatacg

SEQ ID NO: 22819 - DNA, 719 bp, Artificial Sequence
  chemically treated genomic DNA (Homo sapiens) CpG-island No: 22819
  misc_feature (60)..(60): n is either a, c, g or t
  misc_feature (328)..(328): n is either a, c, g or t
  misc_feature (464)..(465): n is either a, c, g or t
aagttatttagtataggatcgtgggatttaagaattttatttgaattgaggtgttatttngggcgatttcgatatgcggggtgacggcgagtaatgcgatcgtagtagtagtcggattcgaagatggatgcgatcggatgatattttttagattgtgcgcgtaaggcgtgatttgatggaagttatgtgacgtggaatatcgttgggttattcgggtaaattcgggtcgattaacggtcggtaggatatttagttgatagtttattatgcggtgcgtattaagtggtgttttacgtaataagttattacggcgtagtagttacgcgtnttgtttagcgtgtttggcgaatggtatatttattttgttatttcgtatgtcgaaggggttgacgagattatcgtgttgatatttatacggataattcgttagatatcgataattggtatatcgatgtgatattatnngaacgttatttcgtaggggcgattttggtagttaaagagttatttcgattcggcggtgatacgttttggattagcggtattgcggtttatgaggcgttttttgttttttttcgttagttgttgagtgggttgcgtgcggagtatgattttcgtaaatcgttttcggaatataaatatcgtaaaatcgaggaggaatattaatcgtggcgcgaggcggtcgcgaaaaattcgtcgttgttatattcggtggtgcg

SEQ ID NO: 22820 - DNA, 719 bp, Artificial Sequence
  chemically treated genomic DNA (Homo sapiens) CpG-island No: 22820
  misc_feature (255)..(256): n is either a, c, g or t
  misc_feature (392)..(392): n is either a, c, g or t
  misc_feature (660)..(660): n is either a, c, g or t
cgcaccaccgaatataacaacgacgaatttttcgcgaccgcctcgcgccacgattaatattcctcctcgattttacgatatttatattccgaaaacgatttacgaaaatcatactccgcacgcaacccactcaacaactaacgaaaaaaaacaaaaaacgcctcataaaccgcaataccgctaatccaaaacgtatcaccgccgaatcgaaataactctttaactaccaaaatcgcccctacgaaataacgttcnnataatatcacatcgatataccaattatcgatatctaacgaattatccgtataaatatcaacacgataatctcgtcaaccccttcgacatacgaaataacaaaataaatataccattcgccaaacacgctaaacaanacgcgtaactactacgccgtaataacttattacgtaaaacaccacttaatacgcaccgcataataaactatcaactaaatatcctaccgaccgttaatcgacccgaatttacccgaataacccaacgatattccacgtcacataacttccatcaaatcacgccttacgcgcacaatctaaaaaatatcatccgatcgcatccatcttcgaatccgactactactacgatcgcattactcgccgtcaccccgcatatcgaaatcgcccnaaataacacctcaattcaaataaaattcttaaatcccacgatcctatactaaataactt

SEQ ID NO: 22821 - DNA, 675 bp, Artificial Sequence
  chemically treated genomic DNA (Homo sapiens) CpG-island No: 22821
taggcgtttttttttttgttcgtcgaaggtcgcgatggtgttttaggtgagtttttcgttgggggtggtatggcgttttagttagtagtcgtagacgaaaaagtagaagttttggtacgagtttatgttggcgtttaggttggttgttaggaggtcggcggcgcgcgttaaggttttgttttcggggtagttttcgggataggcgtcgtcgttcgtcgcgatcgggtttaggtatttgagcgttagtatagtcgttaggatggcgtagagattagcggcgaatattagtttcgatagtaggtatatttcgcgtcggttttagcgcggtagttcggatcgggtttcggtggcgttgcgcgtagcgtttaacgggaagttcgggggtagggaggtttcgcgcgcgtttttcgcgtcgtagcggtttacgtatttgattttttggaatttatcgtagtgcgtcgttagcgaatacgggggttttatggcgtcgaggtcgtcgcggtgtagatttgggttatttgggttacgggatgcgcgtggtcgtcggttttttcgtgggttttcgtatggttttggggtcgtagttgcgggaagggcggaagtaggtttaggaggcgtcgtagtcggatggggtttagggttatcgcgaggagggatataggtttgggtgtagag

SEQ ID NO: 22822 - DNA, 675 bp, Artificial Sequence
  chemically treated genomic DNA (Homo sapiens) CpG-island No: 22822
ctctacacccaaacctatatccctcctcgcgataaccctaaaccccatccgactacgacgcctcctaaacctacttccgcccttcccgcaactacgaccccaaaaccatacgaaaacccacgaaaaaaccgacgaccacgcgcatcccgtaacccaaataacccaaatctacaccgcgacgacctcgacgccataaaacccccgtattcgctaacgacgcactacgataaattccaaaaaatcaaatacgtaaaccgctacgacgcgaaaaacgcgcgcgaaacctccctacccccgaacttcccgttaaacgctacgcgcaacgccaccgaaacccgatccgaactaccgcgctaaaaccgacgcgaaatatacctactatcgaaactaatattcgccgctaatctctacgccatcctaacgactatactaacgctcaaatacctaaacccgatcgcgacgaacgacgacgcctatcccgaaaactaccccgaaaacaaaaccttaacgcgcgccgccgacctcctaacaaccaacctaaacgccaacataaactcgtaccaaaacttctactttttcgtctacgactactaactaaaacgccataccacccccaacgaaaaactcacctaaaacaccatcgcgaccttcgacgaacaaaaaaaaaaacgccta

SEQ ID NO: 22823 - DNA, 675 bp, Artificial Sequence
  chemically treated genomic DNA (Homo sapiens) CpG-island No: 22823
ttttgtatttaggtttgtgttttttttcgcggtgattttgagttttattcggttgcggcgttttttgagtttgttttcgtttttttcgtagttgcggttttagggttatgcggaggtttacgaggaggtcggcggttacgcgtatttcgtagtttaggtggtttaggtttgtatcgcggcggtttcggcgttatggagttttcgtattcgttgacggcgtattacgatgagttttaagaggttaagtacgtgagtcgttgcggcgcggggggcgcgcgcggggtttttttgttttcgggtttttcgttgggcgttgcgcgtagcgttatcggggttcggttcgggttgtcgcgttggaatcggcgcgaggtgtgtttgttgtcggggttggtgttcgtcgttgatttttgcgttattttggcggttatgttggcgtttaagtatttgggttcggtcgcggcgggcggcggcgtttgtttcgagagttgtttcgagggtaaggttttagcgcgcgtcgtcggttttttggtagttaatttggacgttagtatggattcgtattagaatttttattttttcgtttgcggttgttgattgaagcgttatgttatttttaacgaaaagtttatttaaagtattatcgcggttttcggcgagtagaaagaggagcgtttg

SEQ ID NO: 22824 - DNA, 675 bp, Artificial Sequence
  chemically treated genomic DNA (Homo sapiens) CpG-island No: 22824
caaacgctcctctttctactcgccgaaaaccgcgataatactttaaataaacttttcgttaaaaataacataacgcttcaatcaacaaccgcaaacgaaaaaataaaaattctaatacgaatccatactaacgtccaaattaactaccaaaaaaccgacgacgcgcgctaaaaccttaccctcgaaacaactctcgaaacaaacgccgccgcccgccgcgaccgaacccaaatacttaaacgccaacataaccgccaaaataacgcaaaaatcaacgacgaacaccaaccccgacaacaaacacacctcgcgccgattccaacgcgacaacccgaaccgaaccccgataacgctacgcgcaacgcccaacgaaaaacccgaaaacaaaaaaaccccgcgcgcgccccccgcgccgcaacgactcacgtacttaacctcttaaaactcatcgtaatacgccgtcaacgaatacgaaaactccataacgccgaaaccgccgcgatacaaacctaaaccacctaaactacgaaatacgcgtaaccgccgacctcctcgtaaacctccgcataaccctaaaaccgcaactacgaaaaaaacgaaaacaaactcaaaaaacgccgcaaccgaataaaactcaaaatcaccgcgaaaaaaaacacaaacctaaatacaaaa

SEQ ID NO: 22825 - DNA, 658 bp, Artificial Sequence
  chemically treated genomic DNA (Homo sapiens) CpG-island No: 22825
acggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaatcgttgttgtgcgggggggaaaacgttgttttggcgggtatgaggtttttgggttggtgattcggtttgtggggggttgggggttcgtaacggggtttgtgtttttttcgttaaggtggtt

SEQ ID NO: 22826 - DNA, 658 bp, Artificial Sequence
  chemically treated genomic DNA (Homo sapiens) CpG-island No: 22826
aaccaccttaacgaaaaaaacacaaaccccgttacgaacccccaaccccccacaaaccgaatcaccaacccaaaaacctcatacccgccaaaacaacgttttcccccccgcacaacaacgatttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgt

SEQ ID NO: 22827 - DNA, 658 bp, Artificial Sequence
  chemically treated genomic DNA (Homo sapiens) CpG-island No: 22827
gattattttgacggaaaaaatataaatttcgttgcgggtttttagttttttatagatcgggttattaatttagaagttttatgttcgttaagatagcgttttttttttcgtataataacggttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgt

SEQ ID NO: 22828 - DNA, 658 bp, Artificial Sequence
  chemically treated genomic DNA (Homo sapiens) CpG-island No: 22828
acgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaaccgttattatacgaaaaaaaaaacgctatcttaacgaacataaaacttctaaattaataacccgatctataaaaaactaaaaacccgcaacgaaatttatattttttccgtcaaaataatc

SEQ ID NO: 22829 - DNA, 551 bp, Artificial Sequence
  chemically treated genomic DNA (Homo sapiens) CpG-island No: 22829
  misc_feature (529)..(529): n is either a, c, g or t
  misc_feature (532)..(532): n is either a, c, g or t
  misc_feature (538)..(538): n is either a, c, g or t
  misc_feature (548)..(548): n is either a, c, g or t
ttttttcgcgttttgtttttgtgcgttttttttttttttttttttttgttcgtttttttttttttttttttttacgtattcgtttttcgcgcgtagggatttttgggtaaggttattgcgtttcggattcgcggtcgttggtagggcgtttagggggcgtatttacgcggatgacgtagcgcgaggagtttttgtcgtttaggttgatcgtgagcgagaagagcgcggcggcgttgtatacgttttgcgttttgtatagtagtcggttgaggttttatcgcgtcgcgattttcggacgttttttcgcgtcgtttaggttttagttttcgtagttttcgatgatttttagtatgggtcgcgggtttagtcgttcgatttcgcgtatgtcgaggtacgagcggaagaaggcgcgtattttgcgttggaacgcgtcgttaggtttatattcgggtcgcgttagtaggcgtcgtaggcgtttttcgttttgttcgacgatggtcgcggtggtgtgataaattgttatttattnttnttaagnggaaattatnttt

SEQ ID NO: 22830 - DNA, 551 bp, Artificial Sequence
  chemically treated genomic DNA (Homo sapiens) CpG-island No: 22830
  misc_feature (4)..(4): n is either a, c, g or t
  misc_feature (14)..(14): n is either a, c, g or t
  misc_feature (20)..(20): n is either a, c, g or t
  misc_feature (23)..(23): n is either a, c, g or t
aaanataatttccncttaanaanaataaataacaatttatcacaccaccgcgaccatcgtcgaacaaaacgaaaaacgcctacgacgcctactaacgcgacccgaatataaacctaacgacgcgttccaacgcaaaatacgcgccttcttccgctcgtacctcgacatacgcgaaatcgaacgactaaacccgcgacccatactaaaaatcatcgaaaactacgaaaactaaaacctaaacgacgcgaaaaaacgtccgaaaatcgcgacgcgataaaacctcaaccgactactatacaaaacgcaaaacgtatacaacgccgccgcgctcttctcgctcacgatcaacctaaacgacaaaaactcctcgcgctacgtcatccgcgtaaatacgccccctaaacgccctaccaacgaccgcgaatccgaaacgcaataaccttacccaaaaatccctacgcgcgaaaaacgaatacgtaaaaaaaaaaaaaaaaaaaaacgaacaaaaaaaaaaaaaaaaaaaaaacgcacaaaaacaaaacgcgaaaaaa

SEQ ID NO: 22831 - DNA, 551 bp, Artificial Sequence
  chemically treated genomic DNA (Homo sapiens) CpG-island No: 22831
  misc_feature (4)..(4): n is either a, c, g or t
  misc_feature (14)..(14): n is either a, c, g or t
  misc_feature (20)..(20): n is either a, c, g or t
  misc_feature (23)..(23): n is either a, c, g or t
aggnatgatttttntttggnaangatgagtagtagtttattatattatcgcggttatcgtcgagtaaaacgaggagcgtttacggcgtttgttggcgcggttcgggtgtgggtttggcggcgcgttttagcgtaaggtgcgcgttttttttcgttcgtgtttcgatatgcgcgagatcgagcgattgggttcgcgatttatgttagaggttatcgaggattgcgggggttgggatttgggcggcgcggaggagcgttcgggggtcgcggcgcgatgggattttaatcggttgttgtataaggcgtagggcgtgtatagcgtcgtcgcgtttttttcgtttacggttagtttggacgataggaatttttcgcgttacgttattcgcgtgagtgcgttttttgagcgttttgttagcggtcgcggattcggggcgtagtggttttgtttaggggtttttgcgcgcgggaggcgggtgcgtgagaggagaggagggaagagacgagtaggagaggggaggggaggggagcgtatagaggtagagcgcgggagga

SEQ ID NO: 22832 - DNA, 551 bp, Artificial Sequence
  chemically treated genomic DNA (Homo sapiens) CpG-island No: 22832
  misc_feature (529)..(529): n is either a, c, g or t
  misc_feature (532)..(532): n is either a, c, g or t
  misc_feature (538)..(538): n is either a, c, g or t
  misc_feature (548)..(548): n is either a, c, g or t
tcctcccgcgctctacctctatacgctcccctcccctcccctctcctactcgtctcttccctcctctcctctcacgcacccgcctcccgcgcgcaaaaacccctaaacaaaaccactacgccccgaatccgcgaccgctaacaaaacgctcaaaaaacgcactcacgcgaataacgtaacgcgaaaaattcctatcgtccaaactaaccgtaaacgaaaaaaacgcgacgacgctatacacgccctacgccttatacaacaaccgattaaaatcccatcgcgccgcgacccccgaacgctcctccgcgccgcccaaatcccaacccccgcaatcctcgataacctctaacataaatcgcgaacccaatcgctcgatctcgcgcatatcgaaacacgaacgaaaaaaaacgcgcaccttacgctaaaacgcgccgccaaacccacacccgaaccgcgccaacaaacgccgtaaacgctcctcgttttactcgacgataaccgcgataatataataaactactactcatcnttnccaaanaaaaatcatncct

SEQ ID NO: 22833 - DNA, 526 bp, Artificial Sequence
  chemically treated genomic DNA (Homo sapiens) CpG-island No: 22833
ttatggttttgcgtgttttttacggtaattaattgtttacggttgtcgtatgcgcggtattgatttagttttttttcgcggtgtatcgtcgttatttgattaaaacggttatggttatagcgggttatataatcggaatagttagtgaagtttagtaattgatcgtaacggttttacgttatggtttttcggttgtcggtggtatttttcgttgcgtagggtaagttattgtgtggattattataacggtagcgggtgatatcgtcgttaggggtagttttttgaattagacggttttatttattatattttcggcgtatttttagttcgttaggttcggtggttgacgttaattggttgtggtggttattgtaaaacgtcgatgttttgttattcggcgtggtgatgcgcgtgatgaggttcgttattatattcggattgtattttgttgttttgtttgcggtattcgtttgtgttttgagtttgtttatcgcgttaaattgattttgcgtgacgttgtcgttgt

SEQ ID NO: 22834 - DNA, 526 bp, Artificial Sequence
  chemically treated genomic DNA (Homo sapiens) CpG-island No: 22834
acaacgacaacgtcacgcaaaatcaatttaacgcgataaacaaactcaaaacacaaacgaataccgcaaacaaaacaacaaaatacaatccgaatataataacgaacctcatcacgcgcatcaccacgccgaataacaaaacatcgacgttttacaataaccaccacaaccaattaacgtcaaccaccgaacctaacgaactaaaaatacgccgaaaatataataaataaaaccgtctaattcaaaaaactacccctaacgacgatatcacccgctaccgttataataatccacacaataacttaccctacgcaacgaaaaataccaccgacaaccgaaaaaccataacgtaaaaccgttacgatcaattactaaacttcactaactattccgattatataacccgctataaccataaccgttttaatcaaataacgacgatacaccgcgaaaaaaaactaaatcaataccgcgcatacgacaaccgtaaacaattaattaccgtaaaaaacacgcaaaaccataa

SEQ ID NO: 22835 - DNA, 526 bp, Artificial Sequence
  chemically treated genomic DNA (Homo sapiens) CpG-island No: 22835
atagcggtagcgttacgtagagttagtttgacgcggtgggtaggtttagggtatagacggatgtcgtaggtaggataatagaatatagttcggatgtggtgacgggttttattacgcgtattattacgtcggatggtagggtatcggcgttttataataattattatagttagttaacgttagttatcgggtttgacgggttggaaatacgtcgggaatatgatgaatggggtcgtttgatttaggaaattgtttttgacggcgatattattcgttatcgttatgataatttatatagtgatttattttgcgtaacggaagatgttatcggtagtcggaaaattatgacgtggagtcgttacggttagttgttgagttttattgattgtttcggttatgtaattcgttatgattatgatcgttttggttaggtgacggcggtgtatcgcgaggaagggttgagttagtatcgcgtatacgatagtcgtggatagttaattgtcgtgaaagatacgtagggttatga

SEQ ID NO: 22836 - DNA, 526 bp, Artificial Sequence
  chemically treated genomic DNA (Homo sapiens) CpG-island No: 22836
tcataaccctacgtatctttcacgacaattaactatccacgactatcgtatacgcgatactaactcaacccttcctcgcgatacaccgccgtcacctaaccaaaacgatcataatcataacgaattacataaccgaaacaatcaataaaactcaacaactaaccgtaacgactccacgtcataattttccgactaccgataacatcttccgttacgcaaaataaatcactatataaattatcataacgataacgaataatatcgccgtcaaaaacaatttcctaaatcaaacgaccccattcatcatattcccgacgtatttccaacccgtcaaacccgataactaacgttaactaactataataattattataaaacgccgataccctaccatccgacgtaataatacgcgtaataaaacccgtcaccacatccgaactatattctattatcctacctacgacatccgtctataccctaaacctacccaccgcgtcaaactaactctacgtaacgctaccgctat

SEQ ID NO: 22837 - DNA, 1536 bp, Artificial Sequence
  chemically treated genomic DNA (Homo sapiens) CpG-island No: 22837
tttagtgggttgtttattagattcggtagttgcgtttggtatttacgggtttatcgaacgttgtttggaacggttggtttgtattatattggaacgtattttttagatgtagatcgttgaatatattacgtatgtaggtagtgtttttatagcgaatattcgtcgttttatggcgggtgtatcggatttgcggggtagattgtttgggtggtttttttggttaaaagttttggtcgattcggaaatttagtcgattatgttgcgtatgaagttcgatttggttgagttttgtttggcggtttgtgaaagtaaattggacgagaaaacgttcgagtgggatgaacgcgtttttttcggcgtggtgatggttgcgggtggatattcgggtgattatcgtatcggtgacgtgatttacggtttgtcgttggaagaagtggtaggcggtaaagtgttttacgcgggtataaaattggcggatgacgagtaggtagtgattaacggcgggcgcgtattgtgcgttatcgcgttgggttatatcgtggtagaagcgtagaaacgcgtttatgttttaatgatcgatatttattgggacgattgtttttgtcggaaagatatcggttggcgcgttatcgaacgcgagtagaattaacgcgatagttttgttaatagcgttttgcgcgtgatttttaattgacgggcggtttcggttttgttgtcgttcgttttttttagcgtcgttagaattatttttttttttatttttattaacggttgaatattttgattttgttttagcgggatcggcgtattggtaatcgttagcggtagttcgcgttcggaaatatatttttcggttagtagtattattgttcgttttatcgcgttttttagtttacgaatatttttcggttagtcgtaatgaattaatagatttatcgtttggggcgtaaaattttttatcgttttgcgattacgttcggtaaagcgttgtagaaaatggttagttagtagagggatattttttcgtcgttgtcgtagcgatggtattttaatcgttattatatttaggcgatagtagagattttggcgaaaacgttcggtatttatttttgcggtaagatcgcgatgggtcgtcgtaattagtcggatattaatcgagataatttggttgttatcgatacgttgaatttcgcgtttgatgatttatattttgttatcgttgatgaaatttttttttggcgttaatttggtttcgtgttggggttgatggtatttttttattttttcgttcgtttgacgttgttttgcgcggcgtggattgttatcgtcgaatataaagacgattcgcgaatgtcggggaaaacgtagttttaaaatatgtcggatgcggcgtaaacgttttattcggtatacgattttattcggtttggtttttcgtaggtcggataagatgcgttaatcgtattcggttataatgcgtatataattttttgaaattcgtttttagagtttttttagttatttatttgggagtaa

SEQ ID NO: 22838 - DNA, 1536 bp, Artificial Sequence
  chemically treated genomic DNA (Homo sapiens) CpG-island No: 22838
ttactcccaaataaataactaaaaaaactctaaaaacgaatttcaaaaaattatatacgcattataaccgaatacgattaacgcatcttatccgacctacgaaaaaccaaaccgaataaaatcgtataccgaataaaacgtttacgccgcatccgacatattttaaaactacgttttccccgacattcgcgaatcgtctttatattcgacgataacaatccacgccgcgcaaaacaacgtcaaacgaacgaaaaaataaaaaaataccatcaaccccaacacgaaaccaaattaacgccaaaaaaaaatttcatcaacgataacaaaatataaatcatcaaacgcgaaattcaacgtatcgataacaaccaaattatctcgattaatatccgactaattacgacgacccatcgcgatcttaccgcaaaaataaataccgaacgttttcgccaaaatctctactatcgcctaaatataataacgattaaaataccatcgctacgacaacgacgaaaaaatatccctctactaactaaccattttctacaacgctttaccgaacgtaatcgcaaaacgataaaaaattttacgccccaaacgataaatctattaattcattacgactaaccgaaaaatattcgtaaactaaaaaacgcgataaaacgaacaataatactactaaccgaaaaatatatttccgaacgcgaactaccgctaacgattaccaatacgccgatcccgctaaaacaaaatcaaaatattcaaccgttaataaaaataaaaaaaaaaataattctaacgacgctaaaaaaaacgaacgacaacaaaaccgaaaccgcccgtcaattaaaaatcacgcgcaaaacgctattaacaaaactatcgcgttaattctactcgcgttcgataacgcgccaaccgatatctttccgacaaaaacaatcgtcccaataaatatcgatcattaaaacataaacgcgtttctacgcttctaccacgatataacccaacgcgataacgcacaatacgcgcccgccgttaatcactacctactcgtcatccgccaattttatacccgcgtaaaacactttaccgcctaccacttcttccaacgacaaaccgtaaatcacgtcaccgatacgataatcacccgaatatccacccgcaaccatcaccacgccgaaaaaaacgcgttcatcccactcgaacgttttctcgtccaatttactttcacaaaccgccaaacaaaactcaaccaaatcgaacttcatacgcaacataatcgactaaatttccgaatcgaccaaaacttttaaccaaaaaaaccacccaaacaatctaccccgcaaatccgatacacccgccataaaacgacgaatattcgctataaaaacactacctacatacgtaatatattcaacgatctacatctaaaaaatacgttccaatataatacaaaccaaccgttccaaacaacgttcgataaacccgtaaataccaaacgcaactaccgaatctaataaacaacccactaaa

SEQ ID NO: 22839 - DNA, 1536 bp, Artificial Sequence
  chemically treated genomic DNA (Homo sapiens) CpG-island No: 22839
ttgtttttaaatagatggttgaagaggttttggggacgagttttaagaggttatgtgcgtattatagtcggatgcgattggcgtattttattcggtttacggggagttaggtcgaataaaatcgtatgtcggataaggcgtttacgtcgtattcggtatattttaaggttgcgtttttttcggtattcgcgggtcgtttttatattcggcggtggtaatttacgtcgcgtaaaatagcgttaaacgggcgaagaagtagaaaaatgttattagttttagtacggaattaaattggcgttagagggggattttattaacgatggtagggtgtaggttattaaacgcgaagtttagcgtgtcggtagtaattagattatttcggttgatgttcggttgattgcggcgatttatcgcgattttgtcgtagaggtgaatgtcgggcgttttcgttaggatttttattatcgtttgaatgtggtggcgattgaagtattatcgttgcggtaacggcgggaagatatttttttgttggttggttattttttgtagcgttttgtcgagcgtaatcgtaaggcggtaaaaggttttacgttttaggcgatggatttgttgatttattacgattggtcgggaaatattcgtgagttggaaaacgcggtggaacgggtagtggtgttgttgatcggggaatatattttcgaacgcgagttgtcgttggcgattgttagtacgtcgatttcgttgggataaagttaggatatttagtcgttggtggaagtggaaaaagaggtgattttggcggcgttggagaaaacgggcggtaataaaatcgaagtcgttcgttagttagggattacgcgtaaaacgttattggtaaaattgtcgcgttagttttgttcgcgttcgatagcgcgttagtcgatattttttcggtagaagtagtcgttttagtggatatcggttattaaggtataggcgcgtttttgcgtttttgttacggtatgatttagcgcggtgacgtatagtacgcgttcgtcgttggttattatttgttcgttattcgttagttttgtgttcgcgtggaatattttgtcgtttgttattttttttagcggtaggtcgtggattacgttatcggtgcggtaattattcggatatttattcgtagttattattacgtcgagagaagcgcgtttattttattcggacgttttttcgtttagtttgtttttataggtcgttaggtagagtttaattagatcggattttatgcgtagtataatcggttgggttttcggatcgattaaagtttttgattagggaagttatttaggtagtttatttcgtaagttcggtatattcgttataaaacggcggatgttcgttgtggaaatattgtttgtatgcgtggtgtatttaacgatttgtatttgaaaggtacgttttagtgtggtgtagattaatcgttttaggtaacgttcgatgaattcgtaaatgttaaacgtaattatcgggtttggtaagtagtttattgag

SEQ ID NO: 22840 - DNA, 1536 bp, Artificial Sequence
  chemically treated genomic DNA (Homo sapiens) CpG-island No: 22840
ctcaataaactacttaccaaacccgataattacgtttaacatttacgaattcatcgaacgttacctaaaacgattaatctacaccacactaaaacgtacctttcaaatacaaatcgttaaatacaccacgcatacaaacaatatttccacaacgaacatccgccgttttataacgaatataccgaacttacgaaataaactacctaaataacttccctaatcaaaaactttaatcgatccgaaaacccaaccgattatactacgcataaaatccgatctaattaaactctacctaacgacctataaaaacaaactaaacgaaaaaacgtccgaataaaataaacgcgcttctctcgacgtaataataactacgaataaatatccgaataattaccgcaccgataacgtaatccacgacctaccgctaaaaaaaataacaaacgacaaaatattccacgcgaacacaaaactaacgaataacgaacaaataataaccaacgacgaacgcgtactatacgtcaccgcgctaaatcataccgtaacaaaaacgcaaaaacgcgcctataccttaataaccgatatccactaaaacgactacttctaccgaaaaaatatcgactaacgcgctatcgaacgcgaacaaaactaacgcgacaattttaccaataacgttttacgcgtaatccctaactaacgaacgacttcgattttattaccgcccgttttctccaacgccgccaaaatcacctctttttccacttccaccaacgactaaatatcctaactttatcccaacgaaatcgacgtactaacaatcgccaacgacaactcgcgttcgaaaatatattccccgatcaacaacaccactacccgttccaccgcgttttccaactcacgaatatttcccgaccaatcgtaataaatcaacaaatccatcgcctaaaacgtaaaaccttttaccgccttacgattacgctcgacaaaacgctacaaaaaataaccaaccaacaaaaaaatatcttcccgccgttaccgcaacgataatacttcaatcgccaccacattcaaacgataataaaaatcctaacgaaaacgcccgacattcacctctacgacaaaatcgcgataaatcgccgcaatcaaccgaacatcaaccgaaataatctaattactaccgacacgctaaacttcgcgtttaataacctacaccctaccatcgttaataaaatccccctctaacgccaatttaattccgtactaaaactaataacatttttctacttcttcgcccgtttaacgctattttacgcgacgtaaattaccaccgccgaatataaaaacgacccgcgaataccgaaaaaaacgcaaccttaaaatataccgaatacgacgtaaacgccttatccgacatacgattttattcgacctaactccccgtaaaccgaataaaatacgccaatcgcatccgactataatacgcacataacctcttaaaactcgtccccaaaacctcttcaaccatctatttaaaaacaa

SEQ ID NO: 22841 - DNA, 551 bp, Artificial Sequence
  chemically treated genomic DNA (Homo sapiens) CpG-island No: 22841
gtgtagtttgtttgacgtataatatcgggaatacgaaacgcgtcgttaatttttattagttcgtcgcgagatattattatttttttttcgttggtagtggtcgttaatattaataatatcgtcgtcgtattgttattgacgatataggtatttttcgttttcgtaatacggtatagtagttgcgttacgtttcgatcgcgatgttcgcgttcggcgtcgtttagattatattcgagggttattggcgaacgtatagtttgcgtaacggtttttatcgcggttttcgtttgtaaagttcgtttaaggttggtatgtagtacggttttcgttaggttgattatcggacgtagcgcgttttgtcgttttttcgttaatcgggtatcgattttttgcgtttagtttttatattacgtaggtagcgtttggttgttacgaattatttttcgcgtttcgtcgagtatttgacgtaataattttattacgcgggtgtgattataagtattacgtaaagaaaggaaggagttatcgcgtaataagcgattaatagtcgg

SEQ ID NO: 22842 - DNA, 551 bp, Artificial Sequence
  chemically treated genomic DNA (Homo sapiens) CpG-island No: 22842
ccgactattaatcgcttattacgcgataactccttcctttctttacgtaatacttataatcacacccgcgtaataaaattattacgtcaaatactcgacgaaacgcgaaaaataattcgtaacaaccaaacgctacctacgtaatataaaaactaaacgcaaaaaatcgatacccgattaacgaaaaaacgacaaaacgcgctacgtccgataatcaacctaacgaaaaccgtactacataccaaccttaaacgaactttacaaacgaaaaccgcgataaaaaccgttacgcaaactatacgttcgccaataaccctcgaatataatctaaacgacgccgaacgcgaacatcgcgatcgaaacgtaacgcaactactataccgtattacgaaaacgaaaaatacctatatcgtcaataacaatacgacgacgatattattaatattaacgaccactaccaacgaaaaaaaaataataatatctcgcgacgaactaataaaaattaacgacgcgtttcgtattcccgatattatacgtcaaacaaactacac

SEQ ID NO: 22843 - DNA, 551 bp, Artificial Sequence
  chemically treated genomic DNA (Homo sapiens) CpG-island No: 22843
tcggttattgatcgtttattgcgcgatagtttttttttttttttgcgtgatatttatggttatattcgcgtggtggaattgttgcgttagatgttcgacgaagcgcgagaagtgattcgtggtagttagacgttgtttgcgtggtgtgaaaattgggcgtaagaagtcgatgttcggttgacgaaagaacggtagagcgcgttgcgttcggtgattaatttgacgggaatcgtgttgtatattaattttgggcgagttttataggcggaagtcgcggtggaagtcgttgcgtaggttatgcgttcgttagtgattttcgagtatgatttggacgacgtcggacgcggatatcgcgatcgggacgtggcgtagttgttgtgtcgtattacgggggcggaagatgtttgtatcgttaataataatgcggcggcggtgttattgatgttggcggttattgttagcggaaaagaggtggtggtatttcgcggcgaattggtggagattggcggcgcgtttcgtattttcgatgttatgcgttaggtaggttgtat

SEQ ID NO: 22844 - DNA, 551 bp, Artificial Sequence
  chemically treated genomic DNA (Homo sapiens) CpG-island No: 22844
atacaacctacctaacgcataacatcgaaaatacgaaacgcgccgccaatctccaccaattcgccgcgaaataccaccacctcttttccgctaacaataaccgccaacatcaataacaccgccgccgcattattattaacgatacaaacatcttccgcccccgtaatacgacacaacaactacgccacgtcccgatcgcgatatccgcgtccgacgtcgtccaaatcatactcgaaaatcactaacgaacgcataacctacgcaacgacttccaccgcgacttccgcctataaaactcgcccaaaattaatatacaacacgattcccgtcaaattaatcaccgaacgcaacgcgctctaccgttctttcgtcaaccgaacatcgacttcttacgcccaattttcacaccacgcaaacaacgtctaactaccacgaatcacttctcgcgcttcgtcgaacatctaacgcaacaattccaccacgcgaatataaccataaatatcacgcaaaaaaaaaaaaaaactatcgcgcaataaacgatcaataaccga

SEQ ID NO: 22845 - DNA, 504 bp, Artificial Sequence
  chemically treated genomic DNA (Homo sapiens) CpG-island No: 22845
cgatgtcgttggttagtttttttagtatcgtcgttagcgttacgttcgttagggttaaacgtatcggatttaattgttcgtcgttttgattgtcggtaaaggtaataattaatgaggttattagcgtttcggcgaaggttatcgttagttgtttttgcgcggaagagtaattaaatagcgtcgtatttagtataatggtaaagttggtttcggcgtttacgttaagtaagtcggggtcggtaagtgggtttcgggtgagggtttgtattaacgtttcggtaaggttaagcgcgtcgtttgttagtaaatcggtaagggtacgcggtatcgcgcgtcgagtacgatggttgaataatttattttattttttgttcgcggatcgttatattgttggtttgcgttagtgatatttttcgagttttcggggtaaacgttacggaaattaataagttaaatagcgagatattcgtttttattagtatcgtgttattgatatcgtaatta

SEQ ID NO: 22846 - DNA, 504 bp, Artificial Sequence
  chemically treated genomic DNA (Homo sapiens) CpG-island No: 22846
taattacgatatcaataacacgatactaataaaaacgaatatctcgctatttaacttattaatttccgtaacgtttaccccgaaaactcgaaaaatatcactaacgcaaaccaacaatataacgatccgcgaacaaaaaataaaataaattattcaaccatcgtactcgacgcgcgataccgcgtacccttaccgatttactaacaaacgacgcgcttaaccttaccgaaacgttaatacaaaccctcacccgaaacccacttaccgaccccgacttacttaacgtaaacgccgaaaccaactttaccattatactaaatacgacgctatttaattactcttccgcgcaaaaacaactaacgataaccttcgccgaaacgctaataacctcattaattattacctttaccgacaatcaaaacgacgaacaattaaatccgatacgtttaaccctaacgaacgtaacgctaacgacgatactaaaaaaactaaccaacgacatcg

SEQ ID NO: 22847 - DNA, 504 bp, Artificial Sequence
  chemically treated genomic DNA (Homo sapiens) CpG-island No: 22847
taattacggtattagtaatacgatgttaatgggggcgggtatttcgttgtttggtttgttgattttcgtagcgtttgtttcggagattcgagggatgttattggcgtagattagtaatatgacgattcgcgggtagagaatggggtaaattgtttaattatcgtgttcgacgcgcggtgtcgcgtatttttgtcggtttattggtaggcggcgcgtttggttttgtcggggcgttaatgtaaatttttattcgaaatttatttgtcgatttcggtttgtttagcgtgaacgtcggagttagttttgttattgtgttgggtgcggcgttgtttggttattttttcgcgtaggaataattggcgatggttttcgtcggggcgttggtggttttattgattgttgtttttatcggtagttagggcggcgggtagttaagttcggtgcgtttaattttggcgggcgtggcgttggcggcggtgttggaaggattgattagcggtatcg

SEQ ID NO: 22848 - DNA, 504 bp, Artificial Sequence
  chemically treated genomic DNA (Homo sapiens) CpG-island No: 22848
cgataccgctaatcaatccttccaacaccgccgccaacgccacgcccgccaaaattaaacgcaccgaacttaactacccgccgccctaactaccgataaaaacaacaatcaataaaaccaccaacgccccgacgaaaaccatcgccaattattcctacgcgaaaaaataaccaaacaacgccgcacccaacacaataacaaaactaactccgacgttcacgctaaacaaaccgaaatcgacaaataaatttcgaataaaaatttacattaacgccccgacaaaaccaaacgcgccgcctaccaataaaccgacaaaaatacgcgacaccgcgcgtcgaacacgataattaaacaatttaccccattctctacccgcgaatcgtcatattactaatctacgccaataacatccctcgaatctccgaaacaaacgctacgaaaatcaacaaaccaaacaacgaaatacccgcccccattaacatcgtattactaataccgtaatta

SEQ ID NO: 22849 - DNA, 571 bp, Artificial Sequence
  chemically treated genomic DNA (Homo sapiens) CpG-island No: 22849
ttacgtagtcgaagtattggtcgaaatttttatcgcgtacgtgttcgacgtattatcgtaaattatgtcgttgatatcgtcgattatattgttgatcgttatcgagatggttttataacgtttatttattagttatgttatttcggcggcggtttttattgttgcggtcgttgcggtatatagcgtagataaacgcggtaattggttatggatgtaaattgcgtttaaatgcgaaatattagcgtacgcgttatcgtttattattcgtttcgaagtgttttgttattattattataggtattgttgcggtaattttttggttattcgagtcggagttatttatagtcggaagcgtacgtcgtttatacgcgtatcggatgtcgcgttggtacgaattataatggatgaagagagatttttcgttagtaaatcgcgttcgtattgtttttttagcgtcgcgttaatatgtagtttttatttatcgtttaaatttttttgcgataacgtataatttagtttcgcggaatcgagaataaagcggatcgtcgtaaacgggattttattgacgaat

SEQ ID NO: 22850 - DNA, 571 bp, Artificial Sequence
  chemically treated genomic DNA (Homo sapiens) CpG-island No: 22850
attcgtcaataaaatcccgtttacgacgatccgctttattctcgattccgcgaaactaaattatacgttatcgcaaaaaaatttaaacgataaataaaaactacatattaacgcgacgctaaaaaaacaatacgaacgcgatttactaacgaaaaatctctcttcatccattataattcgtaccaacgcgacatccgatacgcgtataaacgacgtacgcttccgactataaataactccgactcgaataaccaaaaaattaccgcaacaatacctataataataataacaaaacacttcgaaacgaataataaacgataacgcgtacgctaatatttcgcatttaaacgcaatttacatccataaccaattaccgcgtttatctacgctatataccgcaacgaccgcaacaataaaaaccgccgccgaaataacataactaataaataaacgttataaaaccatctcgataacgatcaacaatataatcgacgatatcaacgacataatttacgataatacgtcgaacacgtacgcgataaaaatttcgaccaatacttcgactacgtaa

SEQ ID NO: 22851 - DNA, 571 bp, Artificial Sequence
  chemically treated genomic DNA (Homo sapiens) CpG-island No: 22851
gttcgttaatgaagtttcgtttgcggcgattcgttttattttcgatttcgcgaagttaaattgtgcgttatcgtaggaaggtttgagcggtaagtgggggttgtatattggcgcgacgttggaaaaatagtgcgagcgcggtttgttggcgaaagatttttttttatttattgtgattcgtattagcgcggtattcgatgcgcgtatgggcggcgtacgttttcggttatgagtaatttcggttcgggtaattaggggattatcgtaataatgtttgtggtggtggtagtagaatatttcggagcggatgatgaacggtggcgcgtgcgttgatgtttcgtatttgagcgtaatttatatttataattagttatcgcgtttgtttgcgttgtgtgtcgtaacgatcgtagtaatgggggtcgtcgtcgggatggtatggttggtggatgggcgttatgaaattatttcgatggcgattagtagtatgatcggcgatgttagcggtatgatttgcgatggtgcgtcgaatacgtgcgcgatgaaggtttcgattagtgtttcggttgcgtgg

SEQ ID NO: 22852 - DNA, 571 bp, Artificial Sequence
  chemically treated genomic DNA (Homo sapiens) CpG-island No: 22852
ccacgcaaccgaaacactaatcgaaaccttcatcgcgcacgtattcgacgcaccatcgcaaatcataccgctaacatcgccgatcatactactaatcgccatcgaaataatttcataacgcccatccaccaaccataccatcccgacgacgacccccattactacgatcgttacgacacacaacgcaaacaaacgcgataactaattataaatataaattacgctcaaatacgaaacatcaacgcacgcgccaccgttcatcatccgctccgaaatattctactaccaccaccacaaacattattacgataatcccctaattacccgaaccgaaattactcataaccgaaaacgtacgccgcccatacgcgcatcgaataccgcgctaatacgaatcacaataaataaaaaaaaatctttcgccaacaaaccgcgctcgcactatttttccaacgtcgcgccaatatacaacccccacttaccgctcaaaccttcctacgataacgcacaatttaacttcgcgaaatcgaaaataaaacgaatcgccgcaaacgaaacttcattaacgaac

SEQ ID NO: 22853 - DNA, 558 bp, Artificial Sequence
  chemically treated genomic DNA (Homo sapiens) CpG-island No: 22853
gttagcgtcgttttggaaagtatcgttagcggagatttttgttcgttttttgttatatacgtttgttgggtaaatattatattatcgtgcgtttcgatatgtataatgttggtatgttcgtcgacgatggtgatatacgtttattttttatcgttttagattttggcgcgtgagaagaggattttatcgtaaggtttttggattttaacggagatttttttcgtcgttagtagtgttttggtatcggtaattgtttgcgttgttgcgttttttagtatttttagttcggcgttggtatttttatttaacgtttttagcgtcgcggtaatcggtagttttattattttcgtgtcgggaacggtgacgtttagatcgttttttattagatttggcgaaatttaggtttttatacgtttaatcggattttttagttttgcggtagtaatcgtcgtcgtaagcgttagtgaaatcggtttagtatattttagcgtcggttttatttttttttgaacggcgaggatgtatcgttgttataacgaatttaaagttcgattaatt

SEQ ID NO: 22854 - DNA, 558 bp, Artificial Sequence
  chemically treated genomic DNA (Homo sapiens) CpG-island No: 22854
aattaatcgaactttaaattcgttataacaacgatacatcctcgccgttcaaaaaaaaataaaaccgacgctaaaatatactaaaccgatttcactaacgcttacgacgacgattactaccgcaaaactaaaaaatccgattaaacgtataaaaacctaaatttcgccaaatctaataaaaaacgatctaaacgtcaccgttcccgacacgaaaataataaaactaccgattaccgcgacgctaaaaacgttaaataaaaataccaacgccgaactaaaaatactaaaaaacgcaacaacgcaaacaattaccgataccaaaacactactaacgacgaaaaaaatctccgttaaaatccaaaaaccttacgataaaatcctcttctcacgcgccaaaatctaaaacgataaaaaataaacgtatatcaccatcgtcgacgaacataccaacattatacatatcgaaacgcacgataatataatatttacccaacaaacgtatataacaaaaaacgaacaaaaatctccgctaacgatactttccaaaacgacgctaac

SEQ ID NO: 22855 - DNA, 558 bp, Artificial Sequence
  chemically treated genomic DNA (Homo sapiens) CpG-island No: 22855
ggttgatcggattttaaattcgttatggtagcggtatattttcgtcgtttaagaggaagtaaagtcggcgttgggatgtattgaatcgattttattggcgtttgcggcggcggttgttgtcgtagaattggaaggttcggttgaacgtgtagaagtttgggtttcgttaaatttgatgaagaacggtttgggcgttatcgttttcggtacgggaatggtggggttgtcgattgtcgcggcgttgggggcgttaggtggaaatgttaacgtcgggttggaagtgttgaaagacgtaatagcgtaggtaattgtcgatgttaaagtattgttggcggcggggaaagttttcgttaagatttaggaattttgcgatgaaattttttttttacgcgttaaagtttggaacggtgagaagtgggcgtgtgttattatcgtcggcgggtatattaatattgtgtatatcgagacgtacgatggtgtggtgtttatttagtaggcgtgtgtggtagagggcgagtaagagttttcgttgacggtgttttttagaacgacgttggt

SEQ ID NO: 22856 - DNA, 558 bp, Artificial Sequence
  chemically treated genomic DNA (Homo sapiens) CpG-island No: 22856
accaacgtcgttctaaaaaacaccgtcaacgaaaactcttactcgccctctaccacacacgcctactaaataaacaccacaccatcgtacgtctcgatatacacaatattaatatacccgccgacgataataacacacgcccacttctcaccgttccaaactttaacgcgtaaaaaaaaaatttcatcgcaaaattcctaaatcttaacgaaaactttccccgccgccaacaatactttaacatcgacaattacctacgctattacgtctttcaacacttccaacccgacgttaacatttccacctaacgcccccaacgccgcgacaatcgacaaccccaccattcccgtaccgaaaacgataacgcccaaaccgttcttcatcaaatttaacgaaacccaaacttctacacgttcaaccgaaccttccaattctacgacaacaaccgccgccgcaaacgccaataaaatcgattcaatacatcccaacgccgactttacttcctcttaaacgacgaaaatataccgctaccataacgaatttaaaatccgatcaacc

SEQ ID NO: 22857 - DNA, 523 bp, Artificial Sequence
  chemically treated genomic DNA (Homo sapiens) CpG-island No: 22857
  misc_feature (520)..(520): n is either a, c, g or t
  misc_feature (522)..(522): n is either a, c, g or t
taggcggttagttcgaagaaggttttatggtaatgggcgtattgggtttggcgatggtcggtatgatcgcgttggtatcggtattggtttacgttttcgggtcggtaattatttcggtttacgaaatgttcggcgttaatttatcgatgttcgtcggaatattgttggcgtgcgatatgggcggtttttttttcgttaaagagttggcgggcggcgacgtagtcgcgtggttatattttgggttaattttcgggtcgatgatggggttaacgattgtgttttttatttcggtggcgttcggtattatcgaattttttgatcgtcgttatttggcgttcggcgtgttggcgggtattgtgattatttcgattggttgtatcgttggtggtttggttgttatgtatttcggtgtgtagattaacggttagtcggtggaatttattttcgttttgattttgatgaatatgatttcggtgattattgttgcgattttggtggcgttggggttgaaatttatttngna

SEQ ID NO: 22858 - DNA, 523 bp, Artificial Sequence
  chemically treated genomic DNA (Homo sapiens) CpG-island No: 22858
  misc_feature (2)..(2): n is either a, c, g or t
  misc_feature (4)..(4): n is either a, c, g or t
tncnaaataaatttcaaccccaacgccaccaaaatcgcaacaataatcaccgaaatcatattcatcaaaatcaaaacgaaaataaattccaccgactaaccgttaatctacacaccgaaatacataacaaccaaaccaccaacgatacaaccaatcgaaataatcacaatacccgccaacacgccgaacgccaaataacgacgatcaaaaaattcgataataccgaacgccaccgaaataaaaaacacaatcgttaaccccatcatcgacccgaaaattaacccaaaatataaccacgcgactacgtcgccgcccgccaactctttaacgaaaaaaaaaccgcccatatcgcacgccaacaatattccgacgaacatcgataaattaacgccgaacatttcgtaaaccgaaataattaccgacccgaaaacgtaaaccaataccgataccaacgcgatcataccgaccatcgccaaacccaatacgcccattaccataaaaccttcttcgaactaaccgccta

SEQ ID NO: 22859 - DNA, 523 bp, Artificial Sequence
  chemically treated genomic DNA (Homo sapiens) CpG-island No: 22859
  misc_feature (2)..(2): n is either a, c, g or t
  misc_feature (4)..(4): n is either a, c, g or t
tntnggatgaattttagttttagcgttattagaatcgtaataatgattatcgggattatgtttattaggattagggcgaaagtgaattttatcggttggtcgttgatttgtatatcggagtatatagtaattagattattagcgatataattaatcggaatggttataatgttcgttagtacgtcgagcgttagataacgacggttagaaggttcgataatgtcgagcgttatcggaatggaaaatataatcgttggttttattatcgattcgagaattaatttagagtatagttacgcggttacgtcgtcgttcgttagttttttggcgaggaagaagtcgtttatatcgtacgttagtagtgtttcggcgaatatcgatgggttagcgtcgagtatttcgtaaatcggaataattatcggttcgagaacgtgagttagtatcggtgttagcgcggttatatcgattatcgttaggtttagtgcgtttattgttataaagtttttttcgaattgatcgtttg

SEQ ID NO: 22860 - DNA, 523 bp, Artificial Sequence
  chemically treated genomic DNA (Homo sapiens) CpG-island No: 22860
  misc_feature (520)..(520): n is either a, c, g or t
  misc_feature (522)..(522): n is either a, c, g or t
caaacgatcaattcgaaaaaaactttataacaataaacgcactaaacctaacgataatcgatataaccgcgctaacaccgatactaactcacgttctcgaaccgataattattccgatttacgaaatactcgacgctaacccatcgatattcgccgaaacactactaacgtacgatataaacgacttcttcctcgccaaaaaactaacgaacgacgacgtaaccgcgtaactatactctaaattaattctcgaatcgataataaaaccaacgattatattttccattccgataacgctcgacattatcgaaccttctaaccgtcgttatctaacgctcgacgtactaacgaacattataaccattccgattaattatatcgctaataatctaattactatatactccgatatacaaatcaacgaccaaccgataaaattcactttcgccctaatcctaataaacataatcccgataatcattattacgattctaataacgctaaaactaaaattcatccnana

SEQ ID NO: 22861 - DNA, 545 bp, Artificial Sequence
  chemically treated genomic DNA (Homo sapiens) CpG-island No: 22861
ttcgtgcggagaatgcgttttgtagcgagttaagtgtcgaacgggtcgtttgtttcgaattggcgtcgataagatttgtaatcgtttcggtttgggttaagttaagtttatcgttaagaaacgcgcgttcggaaaatttattagggcgagtaattcgtaggtcgggaatggttagaatgcgttttaatagtaggtcgaggattatcggatcgttatgattttgtagttttagtatattttcgtcggtgaacgagttcgggttagggaattatagcgtaattttttgatcgagtacgttgtcgtcggcgtttttaaacggaagataatcggcgtacggcggtttaggtagtttatttagtacggtttcggtaattttacgggttttgaagtcggagatgcgtaggatgttaacgtcgttacgtttcggaggcgtggtttgggttacgatagtgttattatcgtttatgatgtttttgttgttttgtgtggcggatgcgcggtgtttattcgttttacgaaaagaaaaaaggcggttaattgatcgt

SEQ ID NO: 22862 - DNA, 545 bp, Artificial Sequence
  chemically treated genomic DNA (Homo sapiens) CpG-island No: 22862
acgatcaattaaccgccttttttcttttcgtaaaacgaataaacaccgcgcatccgccacacaaaacaacaaaaacatcataaacgataataacactatcgtaacccaaaccacgcctccgaaacgtaacgacgttaacatcctacgcatctccgacttcaaaacccgtaaaattaccgaaaccgtactaaataaactacctaaaccgccgtacgccgattatcttccgtttaaaaacgccgacgacaacgtactcgatcaaaaaattacgctataattccctaacccgaactcgttcaccgacgaaaatatactaaaactacaaaatcataacgatccgataatcctcgacctactattaaaacgcattctaaccattcccgacctacgaattactcgccctaataaattttccgaacgcgcgtttcttaacgataaacttaacttaacccaaaccgaaacgattacaaatcttatcgacgccaattcgaaacaaacgacccgttcgacacttaactcgctacaaaacgcattctccgcacgaa

SEQ ID NO: 22863 - DNA, 545 bp, Artificial Sequence
  chemically treated genomic DNA (Homo sapiens) CpG-island No: 22863
gcggttagttgatcgtttttttttttttcgtagggcggataagtatcgcgtattcgttatataaagtaataggaatattatgagcgataatgatattatcgtagtttaggttacgttttcgggacgtggcggcgttggtattttgcgtattttcggttttaaagttcgtgaagttgtcgaaatcgtgttgggtaaattgtttaagtcgtcgtacgtcgattatttttcgtttaaagacgtcgacggtagcgtgttcgattaggggattgcgttatggttttttggttcgaattcgtttatcggcgaagatgtgttggaattgtaaggttatggcggttcggtgattttcgatttgttgttaaaacgtattttgattattttcggtttgcggattgttcgttttggtgagtttttcgaacgcgcgttttttaacgataaatttgatttagtttaggtcgaggcgattgtaaattttatcgacgttagttcggaataggcggttcgttcggtatttaattcgttgtaaggcgtatttttcgtacggg

SEQ ID NO: 22864 - DNA, 545 bp, Artificial Sequence
  chemically treated genomic DNA (Homo sapiens) CpG-island No: 22864
cccgtacgaaaaatacgccttacaacgaattaaataccgaacgaaccgcctattccgaactaacgtcgataaaatttacaatcgcctcgacctaaactaaatcaaatttatcgttaaaaaacgcgcgttcgaaaaactcaccaaaacgaacaatccgcaaaccgaaaataatcaaaatacgttttaacaacaaatcgaaaatcaccgaaccgccataaccttacaattccaacacatcttcgccgataaacgaattcgaaccaaaaaaccataacgcaatcccctaatcgaacacgctaccgtcgacgtctttaaacgaaaaataatcgacgtacgacgacttaaacaatttacccaacacgatttcgacaacttcacgaactttaaaaccgaaaatacgcaaaataccaacgccgccacgtcccgaaaacgtaacctaaactacgataatatcattatcgctcataatattcctattactttatataacgaatacgcgatacttatccgccctacgaaaaaaaaaaaaacgatcaactaaccgc

SEQ ID NO: 22865 - DNA, 905 bp, Artificial Sequence
  chemically treated genomic DNA (Homo sapiens) CpG-island No: 22865
cgcgatggtgtagacgatatcgttaattagtgcgttacgggataggtcgttaatcggtttgcgtatattttgtagtatcggttcgatggagattaggtcggtagaacgttgtatcgttttgtaggtggtgttatcggtgtttagattcgggaagatgaatacggtagcgcgatttgtaatcggagagttcggcgttttggatttcgtaacgttagttattatcgtagcgtcgtattgtagcggatcgtcgattattaggttaggacgttttttttgcgttagacgagttgtttcgcgaattttttttacgtcgttatttgtattagaagtatcggtggagtaggagagtatagtaacgcgcggttcgatatcgaaggtcgtagcggaattagcggattgaatcgcgatttttgttagttgtttagcggtcggattcgggttgatcgtatagttatcgtaaacgtaaatttgtttcggtagtagtatgggggatttttagagtcgacgtgtaggcgaattagttaacgtatgaattagcgtattaaattttcggtgaaaagtttaatagtatggcgatgacggtagtagtaataaatattagcgtcgagtagattttggttacggttattatatcgatatttttagtataggtggttacgtcgttatcgtcgatagagtcggaaagtatcgttgttagattatcgtttacgaatgttcgttttatatacgggtttatattgcgttcggttatttcggcgattgttttgagatgatttaagtttttcgttattagaattatcgttacgggcgtaattagtattattgtttgattattaaaagtaggagtggaaaaatgtggtagatcgaattaggtagtatggttgacgagagtaaaatcgacggtt

SEQ ID NO: 22866 - DNA, 905 bp, Artificial Sequence
  chemically treated genomic DNA (Homo sapiens) CpG-island No: 22866
aaccgtcgattttactctcgtcaaccatactacctaattcgatctaccacatttttccactcctacttttaataatcaaacaataatactaattacgcccgtaacgataattctaataacgaaaaacttaaatcatctcaaaacaatcgccgaaataaccgaacgcaatataaacccgtatataaaacgaacattcgtaaacgataatctaacaacgatactttccgactctatcgacgataacgacgtaaccacctatactaaaaatatcgatataataaccgtaaccaaaatctactcgacgctaatatttattactactaccgtcatcgccatactattaaacttttcaccgaaaatttaatacgctaattcatacgttaactaattcgcctacacgtcgactctaaaaatcccccatactactaccgaaacaaatttacgtttacgataactatacgatcaacccgaatccgaccgctaaacaactaacaaaaatcgcgattcaatccgctaattccgctacgaccttcgatatcgaaccgcgcgttactatactctcctactccaccgatacttctaatacaaataacgacgtaaaaaaaattcgcgaaacaactcgtctaacgcaaaaaaaacgtcctaacctaataatcgacgatccgctacaatacgacgctacgataataactaacgttacgaaatccaaaacgccgaactctccgattacaaatcgcgctaccgtattcatcttcccgaatctaaacaccgataacaccacctacaaaacgatacaacgttctaccgacctaatctccatcgaaccgatactacaaaatatacgcaaaccgattaacgacctatcccgtaacgcactaattaacgatatcgtctacaccatcgcg

SEQ ID NO: 22867 - DNA, 905 bp, Artificial Sequence
  chemically treated genomic DNA (Homo sapiens) CpG-island No: 22867
agtcgtcgattttattttcgttagttatgttgtttggttcggtttgttatatttttttatttttgtttttaatggttaggtaatgatgttgattgcgttcgtggcggtgattttggtggcggaaaatttaggttattttaaggtagtcgtcgggatgatcggacgtaatatggattcgtatatggggcgggtattcgtaggcgatggtttggtaacgatgtttttcggttttgtcggcggtagcggcgtgattatttatgttgaaaatatcggtgtgatggtcgtgattaaagtttattcgacgttggtgtttgttgttgttgtcgttatcgttatgttgttgggttttttatcggaaatttggtgcgttgatttatacgttgattagttcgtttgtacgtcgattttagagattttttatgttgttgtcggaataggtttacgtttacggtgattgtgcgattaattcggattcgatcgttgaatagttggtagaaatcgcgatttagttcgttgatttcgttgcggttttcggtatcgaatcgcgcgttgttatgtttttttattttatcggtatttttggtgtaggtagcgacgtagaaaaagttcgcgaagtaattcgtttggcgtaggaaaaacgttttgatttgatgatcgacggttcgttgtagtacgacgttgcggtaatggttgacgttgcgaaatttaaagcgtcgaatttttcggttgtaggtcgcgttatcgtgtttattttttcggatttgaatatcggtaatattatttataaagcggtatagcgttttgtcgatttgatttttatcgggtcgatgttgtagggtatgcgtaagtcggttaacgatttgtttcgtggcgtattggttgacgatatcgtttatattatcgcg

SEQ ID NO: 22868 - DNA, 905 bp, Artificial Sequence
  chemically treated genomic DNA (Homo sapiens) CpG-island No: 22868
cgcgataatataaacgatatcgtcaaccaatacgccacgaaacaaatcgttaaccgacttacgcataccctacaacatcgacccgataaaaatcaaatcgacaaaacgctataccgctttataaataatattaccgatattcaaatccgaaaaaataaacacgataacgcgacctacaaccgaaaaattcgacgctttaaatttcgcaacgtcaaccattaccgcaacgtcgtactacaacgaaccgtcgatcatcaaatcaaaacgtttttcctacgccaaacgaattacttcgcgaactttttctacgtcgctacctacaccaaaaataccgataaaataaaaaaacataacaacgcgcgattcgataccgaaaaccgcaacgaaatcaacgaactaaatcgcgatttctaccaactattcaacgatcgaatccgaattaatcgcacaatcaccgtaaacgtaaacctattccgacaacaacataaaaaatctctaaaatcgacgtacaaacgaactaatcaacgtataaatcaacgcaccaaatttccgataaaaaacccaacaacataacgataacgacaacaacaacaaacaccaacgtcgaataaactttaatcacgaccatcacaccgatattttcaacataaataatcacgccgctaccgccgacaaaaccgaaaaacatcgttaccaaaccatcgcctacgaatacccgccccatatacgaatccatattacgtccgatcatcccgacgactaccttaaaataacctaaattttccgccaccaaaatcaccgccacgaacgcaatcaacatcattacctaaccattaaaaacaaaaataaaaaaatataacaaaccgaaccaaacaacataactaacgaaaataaaatcgacgact

SEQ ID NO: 22869 - DNA, 586 bp, Artificial Sequence
  chemically treated genomic DNA (Homo sapiens) CpG-island No: 22869
cgttgttagcgtcgggacgtttttatattgtgtatttgtcgtatagtaacgatcgcgaaaagcgtacgcgtttacgaaatgggtgaggtttggtatcgtttttggaatggcgggtaatagttggcgtggtattttatgttttggtgcgtattgtagtaaattaatggtatacggatgtcggggatgatggataacgtttgtcgttacgtcgtttttaattacgttttcggtatatattacgtaaacgttatcgtatagttgcgatattacggttatattatgggttgatgatagaacgtagtttattggcgcgggttttatgtttaagtaaacgtagtatttgtaattgtatcgtgacgtttagcgtcgtagtcggttcgtcggtaataattaattgcggttcgtaggagaatgttagcgtaattattattcgttggcgtatattatttgaaagtttaaacggatagcgcgatataatttttacggtattcgggatttgtattttttttagtaggttaatcgttttagttttggtttttcgacgatttattggttgatgatggcggattacgtttattatttgaag

SEQ ID NO: 22870 - DNA, 586 bp, Artificial Sequence
  chemically treated genomic DNA (Homo sapiens) CpG-island No: 22870
cttcaaataataaacgtaatccgccatcatcaaccaataaatcgtcgaaaaaccaaaactaaaacgattaacctactaaaaaaaatacaaatcccgaataccgtaaaaattatatcgcgctatccgtttaaactttcaaataatatacgccaacgaataataattacgctaacattctcctacgaaccgcaattaattattaccgacgaaccgactacgacgctaaacgtcacgatacaattacaaatactacgtttacttaaacataaaacccgcgccaataaactacgttctatcatcaacccataatataaccgtaatatcgcaactatacgataacgtttacgtaatatataccgaaaacgtaattaaaaacgacgtaacgacaaacgttatccatcatccccgacatccgtataccattaatttactacaatacgcaccaaaacataaaataccacgccaactattacccgccattccaaaaacgataccaaacctcacccatttcgtaaacgcgtacgcttttcgcgatcgttactatacgacaaatacacaatataaaaacgtcccgacgctaacaacg

SEQ ID NO: 22871 - DNA, 586 bp, Artificial Sequence
  chemically treated genomic DNA (Homo sapiens) CpG-island No: 22871
ttttagatgatggacgtgattcgttattattaattaataagtcgtcgggaagttagagttaaagcgattgatttgttggaagagatgtaaatttcggatgtcgtggaagttatgtcgcgttattcgtttgagtttttaggtggtatgcgttagcgggtaatgattgcgttggtatttttttgcgagtcgtaattgattattgtcgacgaatcgattacggcgttggacgttacggtgtagttgtaggtattgcgtttgtttaaatataaagttcgcgttagtgaattgcgttttgttattagtttatgatatggtcgtggtgtcgtaattgtgcgatagcgtttacgtgatgtatgtcggaagcgtaattgaaagcggcgtgacggtagacgttatttattattttcggtattcgtatattattggtttgttgtaatgcgtattagaatatggagtattacgttagttattattcgttattttagggacggtattaaattttatttatttcgtagacgcgtgcgtttttcgcgatcgttgttatgcggtaggtgtatagtgtgaaaacgtttcggcgttgatagcg

SEQ ID NO: 22872 - DNA, 586 bp, Artificial Sequence
  chemically treated genomic DNA (Homo sapiens) CpG-island No: 22872
cgctatcaacgccgaaacgttttcacactatacacctaccgcataacaacgatcgcgaaaaacgcacgcgtctacgaaataaataaaatttaataccgtccctaaaataacgaataataactaacgtaatactccatattctaatacgcattacaacaaaccaataatatacgaataccgaaaataataaataacgtctaccgtcacgccgctttcaattacgcttccgacatacatcacgtaaacgctatcgcacaattacgacaccacgaccatatcataaactaataacaaaacgcaattcactaacgcgaactttatatttaaacaaacgcaatacctacaactacaccgtaacgtccaacgccgtaatcgattcgtcgacaataatcaattacgactcgcaaaaaaataccaacgcaatcattacccgctaacgcataccacctaaaaactcaaacgaataacgcgacataacttccacgacatccgaaatttacatctcttccaacaaatcaatcgctttaactctaacttcccgacgacttattaattaataataacgaatcacgtccatcatctaaaa

SEQ ID NO: 22873 - DNA, 594 bp, Artificial Sequence
  chemically treated genomic DNA (Homo sapiens) CpG-island No: 22873
tcgaggtgcgttattgtattatcgaaacgtttacgcgtggcgttaagttgtgcgagtagggtttttgttaaacgatattttagttgttgaatgcgcgtttgcgcgcgatgaatttttcgttgtggattttgttgatttagtcgttgtgttaatcgttgttgttgttgttcggtacgtttaagttgattttttagcgtaaagtttattcgtttttgtaggcgtttaagtatggtttgttggcgtgttagtcggagttgcggatgttgttgttgtaatcggtgatgaatttgcgtaaagcgacgtgtgcggttggcgagataataatttatcgttatttttagtcgttgacgggtcgattgtatttggcgtagtaatttttgttgattacggtttattattttagcggcggtagacggcgttggcgtacgtagatcggtaataaaatcggtaatggttatattcgttttatgttcgatagcgttgtatattcggaatcggttgggtaaaatcgttacgttatattttcgtcgttaaattttataaatttttagttgatagcgacggttagacgattattcgtttatttaatgcgtt

SEQ ID NO: 22874 - DNA, 594 bp, Artificial Sequence
  chemically treated genomic DNA (Homo sapiens) CpG-island No: 22874
aacgcattaaataaacgaataatcgtctaaccgtcgctatcaactaaaaatttataaaatttaacgacgaaaatataacgtaacgattttacccaaccgattccgaatatacaacgctatcgaacataaaacgaatataaccattaccgattttattaccgatctacgtacgccaacgccgtctaccgccgctaaaataataaaccgtaatcaacaaaaattactacgccaaatacaatcgacccgtcaacgactaaaaataacgataaattattatctcgccaaccgcacacgtcgctttacgcaaattcatcaccgattacaacaacaacatccgcaactccgactaacacgccaacaaaccatacttaaacgcctacaaaaacgaataaactttacgctaaaaaatcaacttaaacgtaccgaacaacaacaacaacgattaacacaacgactaaatcaacaaaatccacaacgaaaaattcatcgcgcgcaaacgcgcattcaacaactaaaatatcgtttaacaaaaaccctactcgcacaacttaacgccacgcgtaaacgtttcgataatacaataacgcacctcga

SEQ ID NO: 22875 - DNA, 594 bp, Artificial Sequence
  chemically treated genomic DNA (Homo sapiens) CpG-island No: 22875
agcgtattgagtggacgaatgatcgtttggtcgtcgttgttagttgaagatttatggagtttaacgacgaaagtgtagcgtggcgattttatttagtcgatttcgggtgtatagcgttgtcgggtatgagacggatgtgattattgtcgattttgttgtcgatttgcgtgcgttaacgtcgtttgtcgtcgttgaagtagtgagtcgtaattagtaagagttattgcgttaggtgtaatcgattcgttaacggttggagatggcgatggattattatttcgttaatcgtatacgtcgttttacgtaaatttattatcgattatagtaatagtattcgtagtttcggttggtacgttagtaaattatgtttgagcgtttgtaaaagcgaatgagttttgcgttggaaaattaatttaagcgtatcgggtaatagtagtagcggttaatatagcggttgaattagtaaaatttatagcggaagatttatcgcgcgtaaacgcgtatttagtaattggaatatcgtttagtagaaattttgttcgtatagtttagcgttacgcgtgaacgtttcggtaatgtagtaacgtatttcga

SEQ ID NO: 22876 - DNA, 594 bp, Artificial Sequence
  chemically treated genomic DNA (Homo sapiens) CpG-island No: 22876
tcgaaatacgttactacattaccgaaacgttcacgcgtaacgctaaactatacgaacaaaatttctactaaacgatattccaattactaaatacgcgtttacgcgcgataaatcttccgctataaattttactaattcaaccgctatattaaccgctactactattacccgatacgcttaaattaattttccaacgcaaaactcattcgcttttacaaacgctcaaacataatttactaacgtaccaaccgaaactacgaatactattactataatcgataataaatttacgtaaaacgacgtatacgattaacgaaataataatccatcgccatctccaaccgttaacgaatcgattacacctaacgcaataactcttactaattacgactcactacttcaacgacgacaaacgacgttaacgcacgcaaatcgacaacaaaatcgacaataatcacatccgtctcatacccgacaacgctatacacccgaaatcgactaaataaaatcgccacgctacactttcgtcgttaaactccataaatcttcaactaacaacgacgaccaaacgatcattcgtccactcaatacgct

SEQ ID NO: 22877 - DNA, 1109 bp, Artificial Sequence
  chemically treated genomic DNA (Homo sapiens) CpG-island No: 22877
  misc_feature (878)..(878): n is either a, c, g or t
tttcgcgcggacgttggattatgttttaagtacggtagattttcggaaattttttcgtaatttgcgtatatttagtcggacgttcgtgatttttattacgttagaaggggagtcgggtagaacgattcggagtaggagttataattatttgatcgcgggtgatttgttggattcgttatgaggtagcgtcgagagtgataatgtcgtttattcgcgatttatatattatttttttatttagtttatttattcgtcgcgaatcggttttttttttattttcggggaataatacgttatatatgttacgattcggaatggtgtcgtcgttggtaatcgttaataattgagcgttaggtcgggcggttaatatttcggtttttttgttttagattagtttggggcgaaaagtagaaaaatcgttagagggatagcgttcggaaagtatatttagcgtggcgttaaaaatacgttttggtagatttttttacggtgcggtacggcgtacgcgggagtattattcgtttatttgtaatgtatttatcgtcgcggcggtaacggtttgttgcgtaaggacgtcgagaggattatgcggtggtgttaggttttttagtttgtttgcgaatatatattttataatgattgcggaatcgattaaattacgtcgggtacgggggaaaaatagttttttagatatatcgttaatttgatgttcggcgcgattaatgcggtggtatttacgtggtatagaaagcggcgtttgtatttgaatttatagagttacgcgtttatattaatttttaggttaagattggaggttgcgattacgtagcgtaatttattcgattttagcgtttgttcggtgattgttcgttgttttntagagacggagtcgtggtgtgagcgggtaataaaaacgtcgttattttgtatacggttagaggttgcgtcggaggtcgattcgaaatgggtcgtattaacggcgatagacggggaacgttgtaagcgtgcggcgtaaagtttatttaatcgtgtcgttagttttttcgttagttttcgcgaattagtaaagataatggtcgagcgatggcgtaatattttattaaggatat

SEQ ID NO: 22878 - DNA, 1109 bp, Artificial Sequence
  chemically treated genomic DNA (Homo sapiens) CpG-island No: 22878
  misc_feature (232)..(232): n is either a, c, g or t
atatccttaataaaatattacgccatcgctcgaccattatctttactaattcgcgaaaactaacgaaaaaactaacgacacgattaaataaactttacgccgcacgcttacaacgttccccgtctatcgccgttaatacgacccatttcgaatcgacctccgacgcaacctctaaccgtatacaaaataacgacgtttttattacccgctcacaccacgactccgtctctanaaaacaacgaacaatcaccgaacaaacgctaaaatcgaataaattacgctacgtaatcgcaacctccaatcttaacctaaaaattaatataaacgcgtaactctataaattcaaatacaaacgccgctttctataccacgtaaataccaccgcattaatcgcgccgaacatcaaattaacgatatatctaaaaaactatttttcccccgtacccgacgtaatttaatcgattccgcaatcattataaaatatatattcgcaaacaaactaaaaaacctaacaccaccgcataatcctctcgacgtccttacgcaacaaaccgttaccgccgcgacgataaatacattacaaataaacgaataatactcccgcgtacgccgtaccgcaccgtaaaaaaatctaccaaaacgtatttttaacgccacgctaaatatactttccgaacgctatccctctaacgatttttctacttttcgccccaaactaatctaaaacaaaaaaaccgaaatattaaccgcccgacctaacgctcaattattaacgattaccaacgacgacaccattccgaatcgtaacatatataacgtattattccccgaaaataaaaaaaaaaccgattcgcgacgaataaataaactaaataaaaaaataatatataaatcgcgaataaacgacattatcactctcgacgctacctcataacgaatccaacaaatcacccgcgatcaaataattataactcctactccgaatcgttctacccgactccccttctaacgtaataaaaatcacgaacgtccgactaaatatacgcaaattacgaaaaaatttccgaaaatctaccgtacttaaaacataatccaacgtccgcgcgaaa

SEQ ID NO: 22879 - DNA, 1109 bp, Artificial Sequence
  chemically treated genomic DNA (Homo sapiens) CpG-island No: 22879
  misc_feature (232)..(232): n is either a, c, g or t
gtatttttgatgaagtgttgcgttatcgttcgattattgtttttattaattcgcgggggttggcggaaaaattgacggtacgattaaatgagttttacgtcgtacgtttatagcgtttttcgtttatcgtcgttgatgcggtttatttcgagtcgattttcggcgtaatttttaatcgtgtataaagtagcgacgtttttattgttcgtttatattacggtttcgtttttanagaataacgagtaattatcgaataggcgttgaaatcgggtgaattacgttgcgtggtcgtaatttttagttttgatttggggattgatatgggcgcgtgattttgtgaatttaggtgtaaacgtcgttttttgtgttacgtgggtattatcgtattggtcgcgtcggatattaggttggcggtgtatttaaagggttgtttttttttcgtattcggcgtgatttagtcgatttcgtagttattgtagagtgtatgttcgtaggtaggttggaaaatttgatattatcgtataattttttcgacgtttttgcgtagtaaatcgttgtcgtcgcggcgatggatgtattataggtagacgaatggtattttcgcgtacgtcgtgtcgtatcgtggaaagatttgttaagacgtgtttttgacgttacgttggatatgtttttcgggcgttatttttttggcgatttttttgtttttcgttttaaattggtttggaatagggagatcgggatattgatcgttcgatttggcgtttaattgttggcggttattagcggcggtattatttcggatcgtggtatgtatagcgtgttatttttcgaaggtgaagaaaaggtcggttcgcggcgggtgggtgaattggatgaggagatggtatatgagtcgcgggtgaacgatattattattttcggcgttattttatggcggatttagtaaattattcgcgattaggtgattgtgatttttgtttcgggtcgttttgttcggttttttttttggcgtggtgaaggttacggacgttcggttgaatgtgcgtaggttacgaggagattttcgggaatttgtcgtgtttaagatatggtttaacgttcgcgcggaa

SEQ ID NO: 22880 - DNA, 1109 bp, Artificial Sequence
  chemically treated genomic DNA (Homo sapiens) CpG-island No: 22880
  misc_feature (878)..(878): n is either a, c, g or t
ttccgcgcgaacgttaaaccatatcttaaacacgacaaattcccgaaaatctcctcgtaacctacgcacattcaaccgaacgtccgtaaccttcaccacgccaaaaaaaaaaccgaacaaaacgacccgaaacaaaaatcacaatcacctaatcgcgaataatttactaaatccgccataaaataacgccgaaaataataatatcgttcacccgcgactcatataccatctcctcatccaattcacccacccgccgcgaaccgaccttttcttcaccttcgaaaaataacacgctatacataccacgatccgaaataataccgccgctaataaccgccaacaattaaacgccaaatcgaacgatcaatatcccgatctccctattccaaaccaatttaaaacgaaaaacaaaaaaatcgccaaaaaaataacgcccgaaaaacatatccaacgtaacgtcaaaaacacgtcttaacaaatctttccacgatacgacacgacgtacgcgaaaataccattcgtctacctataatacatccatcgccgcgacgacaacgatttactacgcaaaaacgtcgaaaaaattatacgataatatcaaattttccaacctacctacgaacatacactctacaataactacgaaatcgactaaatcacgccgaatacgaaaaaaaaacaaccctttaaatacaccgccaacctaatatccgacgcgaccaatacgataatacccacgtaacacaaaaaacgacgtttacacctaaattcacaaaatcacgcgcccatatcaatccccaaatcaaaactaaaaattacgaccacgcaacgtaattcacccgatttcaacgcctattcgataattactcgttattctntaaaaacgaaaccgtaatataaacgaacaataaaaacgtcgctactttatacacgattaaaaattacgccgaaaatcgactcgaaataaaccgcatcaacgacgataaacgaaaaacgctataaacgtacgacgtaaaactcatttaatcgtaccgtcaatttttccgccaacccccgcgaattaataaaaacaataatcgaacgataacgcaacacttcatcaaaaatac

SEQ ID NO: 22881 - DNA, 622 bp, Artificial Sequence
  chemically treated genomic DNA (Homo sapiens) CpG-island No: 22881
  misc_feature (268)..(268): n is either a, c, g or t
  misc_feature (270)..(270): n is either a, c, g or t
  misc_feature (297)..(297): n is either a, c, g or t
  misc_feature (380)..(380): n is either a, c, g or t
  misc_feature (445)..(445): n is either a, c, g or t
  misc_feature (502)..(502): n is either a, c, g or t
taggattcggggttgattttttattcgtttttgttttatatggggtacgtgggtttttcggtggcgtttgtttttgttattgtttttttgttgagcgggcgtttggatagtatttatgcgcgttttattcgttcgtggacgttggtagcgtggatttttttgacgttcggtatcgtgttcggtttcgtatgggtttattacgaattcggttggggtggttggtggttttgggattcggtagaaaacgtttcgtttatgtcgtgttggngngggaattgcgttgatgtatttattggncgttattgaataacgcgttagttttaaagcgtggatattattgttggtaattagtgttttttcgttgtgtttggtggggattnttttcgtgcgtttcggcgtgttggtattcgtatacgtcgttgcgtttgattcggcgcgcggtatngttattttgggttttatggtgtcggggaatggacggttcgttgttgttgtttgtcgngtcgtggatataaagtttcgttacgttttaaattatttcgttgtgggtttcgggaaatttttgttcggtaatcgaaatatgttttggttgggtttttggtaaattttggtggtgttgttg

SEQ ID NO: 22882 - DNA, 622 bp, Artificial Sequence
  chemically treated genomic DNA (Homo sapiens) CpG-island No: 22882
  misc_feature (121)..(121): n is either a, c, g or t
  misc_feature (178)..(178): n is either a, c, g or t
  misc_feature (243)..(243): n is either a, c, g or t
  misc_feature (326)..(326): n is either a, c, g or t
  misc_feature (353)..(353): n is either a, c, g or t
  misc_feature (355)..(355): n is either a, c, g or t
caacaacaccaccaaaatttaccaaaaacccaaccaaaacatatttcgattaccgaacaaaaatttcccgaaacccacaacgaaataatttaaaacgtaacgaaactttatatccacgacncgacaaacaacaacaacgaaccgtccattccccgacaccataaaacccaaaataacnataccgcgcgccgaatcaaacgcaacgacgtatacgaataccaacacgccgaaacgcacgaaaanaatccccaccaaacacaacgaaaaaacactaattaccaacaataatatccacgctttaaaactaacgcgttattcaataacgnccaataaatacatcaacgcaattcccncnccaacacgacataaacgaaacgttttctaccgaatcccaaaaccaccaaccaccccaaccgaattcgtaataaacccatacgaaaccgaacacgataccgaacgtcaaaaaaatccacgctaccaacgtccacgaacgaataaaacgcgcataaatactatccaaacgcccgctcaacaaaaaaacaataacaaaaacaaacgccaccgaaaaacccacgtaccccatataaaacaaaaacgaataaaaaatcaaccccgaatccta

SEQ ID NO: 22883 - DNA, 622 bp, Artificial Sequence
  chemically treated genomic DNA (Homo sapiens) CpG-island No: 22883
  misc_feature (121)..(121): n is either a, c, g or t
  misc_feature (178)..(178): n is either a, c, g or t
  misc_feature (243)..(243): n is either a, c, g or t
  misc_feature (326)..(326): n is either a, c, g or t
  misc_feature (353)..(353): n is either a, c, g or t
  misc_feature (355)..(355): n is either a, c, g or t
tagtaatattattaggatttgttagggatttagttaaaatatgtttcggttatcgagtaaagatttttcgggatttatagcggaatggtttaaggcgtaacggaattttgtgtttacggtncggtaaatagtagtagcgaatcgtttatttttcggtattataaagtttaggataatnatatcgcgcgtcggattagacgtaacggcgtgtacggatattagtacgtcggaacgtacgagganagtttttattagatataacgagaaggtattgattgttagtagtaatgtttacgttttgaagttggcgcgttgtttagtgacgnttagtgagtgtattagcgtagtttttntnttagtacggtataaacgaggcgttttttatcggattttagaattattagttattttagtcgagttcgtaataggtttatgcggaatcgagtacgatgtcgagcgttaggaagatttacgttgttagcgtttacggacgagtaaaacgcgtataagtgttgtttagacgttcgtttagtaaagaagtaatggtaaaagtaaacgttatcgagaaatttacgtattttatataaagtagaggcggatggaagattagtttcggattttg

SEQ ID NO: 22884 - DNA, 622 bp, Artificial Sequence
  chemically treated genomic DNA (Homo sapiens) CpG-island No: 22884
  misc_feature (268)..(268): n is either a, c, g or t
  misc_feature (270)..(270): n is either a, c, g or t
  misc_feature (297)..(297): n is either a, c, g or t
  misc_feature (380)..(380): n is either a, c, g or t
  misc_feature (445)..(445): n is either a, c, g or t
  misc_feature (502)..(502): n is either a, c, g or t
caaaatccgaaactaatcttccatccgcctctactttatataaaatacgtaaatttctcgataacgtttacttttaccattacttctttactaaacgaacgtctaaacaacacttatacgcgttttactcgtccgtaaacgctaacaacgtaaatcttcctaacgctcgacatcgtactcgattccgcataaacctattacgaactcgactaaaataactaataattctaaaatccgataaaaaacgcctcgtttataccgtactaananaaaaactacgctaatacactcactaancgtcactaaacaacgcgccaacttcaaaacgtaaacattactactaacaatcaataccttctcgttatatctaataaaaactntcctcgtacgttccgacgtactaatatccgtacacgccgttacgtctaatccgacgcgcgatatnattatcctaaactttataataccgaaaaataaacgattcgctactactatttaccgnaccgtaaacacaaaattccgttacgccttaaaccattccgctataaatcccgaaaaatctttactcgataaccgaaacatattttaactaaatccctaacaaatcctaataatattacta

SEQ ID NO: 22885 - DNA, 526 bp, Artificial Sequence
  chemically treated genomic DNA (Homo sapiens) CpG-island No: 22885
agtcgtcgttttaattacggcgtataatcgtttgtgtagtcggtttttgatggtaaaattattttttattggtatcgtatgattaatcgtttgatgtggatttggcgcggtattgatttacgcgaaattttcgacgtttaggtacgtattgtgatgagcgatgtcgaacgtatcgacgatgatttatacgatacggtgattggttattgtggcggtaattggatttatgagtgggttattaggcgatggtgtggtataaaaagtttgtgcggaagacgattcgtaatttagtggtcgttattggttgtatgcggttacgttgtataatattggcgtttatttttatttgaaatgagatgattttgtcgagtaagcgtaggtttttgtttaaacgcgtttatgaagaggtcgtttagcgtttaacggggacgatgcggtaaattgagtttatcgtatacggcgttcgttattaacggttttttgtatattcgaaacgatttggtttgttcgaacgtattcggaagga

SEQ ID NO: 22886 - DNA, 526 bp, Artificial Sequence
  chemically treated genomic DNA (Homo sapiens) CpG-island No: 22886
tccttccgaatacgttcgaacaaaccaaatcgtttcgaatatacaaaaaaccgttaataacgaacgccgtatacgataaactcaatttaccgcatcgtccccgttaaacgctaaacgacctcttcataaacgcgtttaaacaaaaacctacgcttactcgacaaaatcatctcatttcaaataaaaataaacgccaatattatacaacgtaaccgcatacaaccaataacgaccactaaattacgaatcgtcttccgcacaaactttttataccacaccatcgcctaataacccactcataaatccaattaccgccacaataaccaatcaccgtatcgtataaatcatcgtcgatacgttcgacatcgctcatcacaatacgtacctaaacgtcgaaaatttcgcgtaaatcaataccgcgccaaatccacatcaaacgattaatcatacgataccaataaaaaataattttaccatcaaaaaccgactacacaaacgattatacgccgtaattaaaacgacgact

SEQ ID NO: 22887 - DNA, 526 bp, Artificial Sequence
  chemically treated genomic DNA (Homo sapiens) CpG-island No: 22887
ttttttcgaatacgttcggataggttaaatcgtttcggatatgtaaaaagtcgttgatggcgaacgtcgtgtacggtaaatttaatttgtcgtatcgttttcgttagacgttgagcggtttttttataggcgcgtttgaataaaagtttgcgtttgttcggtaaggttattttattttagatgagaataggcgttaatgttgtataacgtagtcgtatgtagttagtgacgattattgagttgcggatcgtttttcgtataggttttttgtgttatattatcgtttggtggtttatttataaatttagttgtcgttatagtagttaattatcgtatcgtataaattatcgtcggtacgttcggtatcgtttattataatacgtgtttggacgtcgaggatttcgcgtgggttaatgtcgcgttagatttatattagacggttaattatgcgatattagtgagggatggttttattattaagggtcgattgtataggcggttgtgcgtcgtgattaaagcggcgatt

SEQ ID NO: 22888 - DNA, 526 bp, Artificial Sequence
  chemically treated genomic DNA (Homo sapiens) CpG-island No: 22888
aatcgccgctttaatcacgacgcacaaccgcctatacaatcgacccttaataataaaaccatccctcactaatatcgcataattaaccgtctaatataaatctaacgcgacattaacccacgcgaaatcctcgacgtccaaacacgtattataataaacgataccgaacgtaccgacgataatttatacgatacgataattaactactataacgacaactaaatttataaataaaccaccaaacgataatataacacaaaaaacctatacgaaaaacgatccgcaactcaataatcgtcactaactacatacgactacgttatacaacattaacgcctattctcatctaaaataaaataaccttaccgaacaaacgcaaacttttattcaaacgcgcctataaaaaaaccgctcaacgtctaacgaaaacgatacgacaaattaaatttaccgtacacgacgttcgccatcaacgactttttacatatccgaaacgatttaacctatccgaacgtattcgaaaaaa

SEQ ID NO: 22889 - DNA, 1344 bp, Artificial Sequence
  chemically treated genomic DNA (Homo sapiens) CpG-island No: 22889
  misc_feature (538)..(538): n is either a, c, g or t
tttttgaatcgatttcgatgattttcgttagtattggatgttcgtgttggcgtatagttaatcggttgaattgtttgtacgtttgttcgcgttaaatattatcggcgattatgatgggattcgcgtcgttgaaattggtttggtatagatttaggcgcggatgggcggtatcggcgaacgtttttttgtcggcgacgttacgttgattcgcgtcgtcgtgcgtttgattgacggtacgttcggttatagttgggtgtaggggcgtgataaatagtacgtcgaacgttgcgcgttgattgacgcgttgatgtagtaatttcgttatttttaaaatttattagaaatttttattgtttcgttggacgttgatcgtatggtacgtattgtcgtacgttaggtcgaagtgaacgttagtcgggtcgatttttttacgatggttcgcggagataacgtatgattttggaaatcgtttttatgtttttcgtgtaggatgtttagtatagttttcgtcgtttgttaaaggttatgagcgagtcgngcgtgattgtcgttttgtattagtttaaacgcggttggtaatcgttgaatatcgttattattagcgtgttgttgacgttggtcgataacgatacgtcggtgtggttttttattttattaaataacgatatcgttaattagagttttgcgtttttatattaacgcgtcgttggttagttagtcggaataggcgattttcgcggtgacggatgaggcgatttttagcgaatagtttaacgttttttttatcggtatcgtcgttgcgtcggaagcgggtgcgacgttgattttataggtcgttagtttgagcggcggacgtatgttgcgttttattggtgcgggtattgtcgaagaacgaatgatcgtttcgtagttgtcggagtgtattttgtacgaatttatcgagcgttcgtattcgttttcgttcggtatcgatttgattttgatttgtggcgagcgtttgttggttatttcgcgaattatttatgtggaggtgtgttgatgtacgttgtcgtgaaagggggcgagaaggcgatcgacgtcgtttacgttttgtaagagagtcgacgtcgaggcgatatcgatttgttcgaattgagcgtcgtttagattgaatagtagtttaatttcgcggtagatcgcgtgatgatcgaaggcggtattgtcgatcgcgaattggcggcgttggcgttgaaataggttagcggcgataacgttgaagcgatttttttgttgcgcgtttatcgtattacgttggcgaagttttttttttcgtggattgaaaaataggggttaagtatcgggata

SEQ ID NO: 22890 - DNA, 1344 bp, Artificial Sequence
  chemically treated genomic DNA (Homo sapiens) CpG-island No: 22890
  misc_feature (807)..(807): n is either a, c, g or t
tatcccgatacttaacccctatttttcaatccacgaaaaaaaaaacttcgccaacgtaatacgataaacgcgcaacaaaaaaatcgcttcaacgttatcgccgctaacctatttcaacgccaacgccgccaattcgcgatcgacaataccgccttcgatcatcacgcgatctaccgcgaaattaaactactattcaatctaaacgacgctcaattcgaacaaatcgatatcgcctcgacgtcgactctcttacaaaacgtaaacgacgtcgatcgccttctcgccccctttcacgacaacgtacatcaacacacctccacataaataattcgcgaaataaccaacaaacgctcgccacaaatcaaaatcaaatcgataccgaacgaaaacgaatacgaacgctcgataaattcgtacaaaatacactccgacaactacgaaacgatcattcgttcttcgacaatacccgcaccaataaaacgcaacatacgtccgccgctcaaactaacgacctataaaatcaacgtcgcacccgcttccgacgcaacgacgataccgataaaaaaaacgttaaactattcgctaaaaatcgcctcatccgtcaccgcgaaaatcgcctattccgactaactaaccaacgacgcgttaatataaaaacgcaaaactctaattaacgatatcgttatttaataaaataaaaaaccacaccgacgtatcgttatcgaccaacgtcaacaacacgctaataataacgatattcaacgattaccaaccgcgtttaaactaatacaaaacgacaatcacgcncgactcgctcataacctttaacaaacgacgaaaactatactaaacatcctacacgaaaaacataaaaacgatttccaaaatcatacgttatctccgcgaaccatcgtaaaaaaatcgacccgactaacgttcacttcgacctaacgtacgacaatacgtaccatacgatcaacgtccaacgaaacaataaaaatttctaataaattttaaaaataacgaaattactacatcaacgcgtcaatcaacgcgcaacgttcgacgtactatttatcacgcccctacacccaactataaccgaacgtaccgtcaatcaaacgcacgacgacgcgaatcaacgtaacgtcgccgacaaaaaaacgttcgccgataccgcccatccgcgcctaaatctataccaaaccaatttcaacgacgcgaatcccatcataatcgccgataatatttaacgcgaacaaacgtacaaacaattcaaccgattaactatacgccaacacgaacatccaatactaacgaaaatcatcgaaatcgattcaaaaa

SEQ ID NO: 22891 - DNA, 1344 bp, Artificial Sequence
  chemically treated genomic DNA (Homo sapiens) CpG-island No: 22891
  misc_feature (807)..(807): n is either a, c, g or t
tatttcgatatttagtttttgttttttaatttacggaaaaaagagtttcgttaacgtggtgcggtaggcgcgtagtaggaaaatcgttttaacgttatcgtcgttggtttgttttagcgttagcgtcgttagttcgcggtcggtaatgtcgttttcggttattacgcgatttatcgcgaggttaagttgttgtttaatttgggcgacgtttagttcgggtaaatcggtatcgtttcggcgtcggtttttttgtagggcgtgggcggcgtcgatcgttttttcgtttttttttacggtaacgtatattagtatatttttatatgagtggttcgcggaatagttagtaggcgttcgttataggttaggattaggtcgatgtcgagcgggaacggatgcgggcgttcggtgagttcgtgtagaatgtatttcggtagttgcggagcgattattcgtttttcggtaatattcgtattagtaaggcgtaatatgcgttcgtcgtttaggttggcgatttgtaaaattagcgtcgtattcgttttcggcgtaacggcggtgtcggtggaaagggcgttgagttgttcgttggaaatcgttttattcgttatcgcgaaggtcgtttgtttcggttggttgattagcggcgcgttggtatgaaaacgtagggttttggttgacgatatcgttatttaatggggtagaaagttatatcggcgtgtcgttatcggttagcgttagtagtacgttggtggtggcgatatttagcggttgttagtcgcgtttgagttgatgtagggcgataattacgtncggttcgtttatggtttttaataggcgacgaaaattgtgttgggtattttgtacgggaagtataaaagcggtttttagggttatgcgttgttttcgcgaattatcgtaaagaagtcgattcggttggcgtttatttcggtttggcgtgcggtaatgcgtgttatacggttagcgtttagcggggtaataagggtttttgataagttttgaaagtggcgagattgttgtattagcgcgttaattagcgcgtagcgttcggcgtgttgtttattacgtttttgtatttagttgtagtcgagcgtgtcgttagttaggcgtacggcggcgcgggttagcgtggcgtcgtcggtaaaaaaacgttcgtcggtgtcgtttattcgcgtttgaatttgtattaggttagttttagcggcgcggattttattatagtcgtcggtaatgtttagcgcgaataggcgtgtaaatagtttagtcggttggttgtgcgttagtacggatatttagtgttggcggggattatcggggtcgatttaaggg

SEQ ID NO: 22892 - DNA, 1344 bp, Artificial Sequence
  chemically treated genomic DNA (Homo sapiens) CpG-island No: 22892
  misc_feature (538)..(538): n is either a, c, g or t
cccttaaatcgaccccgataatccccgccaacactaaatatccgtactaacgcacaaccaaccgactaaactatttacacgcctattcgcgctaaacattaccgacgactataataaaatccgcgccgctaaaactaacctaatacaaattcaaacgcgaataaacgacaccgacgaacgtttttttaccgacgacgccacgctaacccgcgccgccgtacgcctaactaacgacacgctcgactacaactaaatacaaaaacgtaataaacaacacgccgaacgctacgcgctaattaacgcgctaatacaacaatctcgccactttcaaaacttatcaaaaacccttattaccccgctaaacgctaaccgtataacacgcattaccgcacgccaaaccgaaataaacgccaaccgaatcgacttctttacgataattcgcgaaaacaacgcataaccctaaaaaccgcttttatacttcccgtacaaaatacccaacacaattttcgtcgcctattaaaaaccataaacgaaccgnacgtaattatcgccctacatcaactcaaacgcgactaacaaccgctaaatatcgccaccaccaacgtactactaacgctaaccgataacgacacgccgatataactttctaccccattaaataacgatatcgtcaaccaaaaccctacgttttcataccaacgcgccgctaatcaaccaaccgaaacaaacgaccttcgcgataacgaataaaacgatttccaacgaacaactcaacgccctttccaccgacaccgccgttacgccgaaaacgaatacgacgctaattttacaaatcgccaacctaaacgacgaacgcatattacgccttactaatacgaatattaccgaaaaacgaataatcgctccgcaactaccgaaatacattctacacgaactcaccgaacgcccgcatccgttcccgctcgacatcgacctaatcctaacctataacgaacgcctactaactattccgcgaaccactcatataaaaatatactaatatacgttaccgtaaaaaaaaacgaaaaaacgatcgacgccgcccacgccctacaaaaaaaccgacgccgaaacgataccgatttacccgaactaaacgtcgcccaaattaaacaacaacttaacctcgcgataaatcgcgtaataaccgaaaacgacattaccgaccgcgaactaacgacgctaacgctaaaacaaaccaacgacgataacgttaaaacgattttcctactacgcgcctaccgcaccacgttaacgaaactcttttttccgtaaattaaaaaacaaaaactaaatatcgaaata

SEQ ID NO: 22893 - DNA, 672 bp, Artificial Sequence
  chemically treated genomic DNA (Homo sapiens) CpG-island No: 22893
cgtacgggaatcgtagttttgtatttaatcgttttgcgtaaagataaattcgtcgaggtgttcgttaaagtattttattatgttattacgttcggtttcgttatgtattagtatatttagttttaaacgtttttgtttaataatggtttgtttgatatgtttcgtaatgttcgtgcggtagttgttggcgtcgagattgttttttttgaaatttagacgtagggtacgaattttcgtggtttgcgggaaggaattaatcgtggtggtcggttacgttggtagtttaaaacgcgtacgttgggttttagtacgtattttatagatattcgtacgttggttgttttgggcggtgatcgtcgttagacgtttttttatcgtcggattatgtacgcgggtagagtgacgacgtgtttgaatcggggcgttttattttgttagagttgtcgtgttattattgtttagcgtatcgcgagtagtgttagtttatggtatttttgtagggcgaaggtaaattagttttttatttttgtattaagacgcgtttttacgtttaggtcgatggggttgtgtagtaacgagtaggaagatgttatttataaattacgtttgtcgataatgtttttaatttgcgtatatttttcggtaagatcggcgcgttagacgttacgatta

SEQ ID NO: 22894 - DNA, 672 bp, Artificial Sequence
  chemically treated genomic DNA (Homo sapiens) CpG-island No: 22894
taatcgtaacgtctaacgcgccgatcttaccgaaaaatatacgcaaattaaaaacattatcgacaaacgtaatttataaataacatcttcctactcgttactacacaaccccatcgacctaaacgtaaaaacgcgtcttaatacaaaaataaaaaactaatttaccttcgccctacaaaaataccataaactaacactactcgcgatacgctaaacaataataacacgacaactctaacaaaataaaacgccccgattcaaacacgtcgtcactctacccgcgtacataatccgacgataaaaaaacgtctaacgacgatcaccgcccaaaacaaccaacgtacgaatatctataaaatacgtactaaaacccaacgtacgcgttttaaactaccaacgtaaccgaccaccacgattaattccttcccgcaaaccacgaaaattcgtaccctacgtctaaatttcaaaaaaaacaatctcgacgccaacaactaccgcacgaacattacgaaacatatcaaacaaaccattattaaacaaaaacgtttaaaactaaatatactaatacataacgaaaccgaacgtaataacataataaaatactttaacgaacacctcgacgaatttatctttacgcaaaacgattaaatacaaaactacgattcccgtacg

SEQ ID NO: 22895 - DNA, 672 bp, Artificial Sequence
  chemically treated genomic DNA (Homo sapiens) CpG-island No: 22895
tggtcgtaacgtttggcgcgtcgattttatcgagaaatatgcgtaaattaaggatattgtcggtaaacgtgatttgtgggtggtatttttttgttcgttgttgtatagttttatcgatttgagcgtggaaacgcgttttgatgtagaagtgaaaagttggtttgttttcgttttataaaaatgttatgaattggtattgttcgcgatgcgttgaatagtggtgatacggtagttttggtagagtggagcgtttcgatttaggtacgtcgttattttattcgcgtatataattcggcggtagaaaagcgtttggcggcgattatcgtttaggatagttagcgtgcgaatgtttatgaagtgcgtgttgaagtttagcgtgcgcgttttaaattgttagcgtggtcgattattacgattggttttttttcgtaaattacggaaattcgtattttgcgtttggattttaaaaagggtaatttcgacgttaataattatcgtacgggtattgcggaatatattaagtaggttattgttgagtaggaacgtttgggattggatgtgttggtatatggcgaggtcgagcgtaatgatatggtggaatattttggcgagtatttcgacggatttgtttttacgtaaaacggttgggtatagagttacggttttcgtgcg

SEQ ID NO: 22896 - DNA, 672 bp, Artificial Sequence
  chemically treated genomic DNA (Homo sapiens) CpG-island No: 22896
cgcacgaaaaccgtaactctatacccaaccgttttacgtaaaaacaaatccgtcgaaatactcgccaaaatattccaccatatcattacgctcgacctcgccatataccaacacatccaatcccaaacgttcctactcaacaataacctacttaatatattccgcaatacccgtacgataattattaacgtcgaaattaccctttttaaaatccaaacgcaaaatacgaatttccgtaatttacgaaaaaaaaccaatcgtaataatcgaccacgctaacaatttaaaacgcgcacgctaaacttcaacacgcacttcataaacattcgcacgctaactatcctaaacgataatcgccgccaaacgcttttctaccgccgaattatatacgcgaataaaataacgacgtacctaaatcgaaacgctccactctaccaaaactaccgtatcaccactattcaacgcatcgcgaacaataccaattcataacatttttataaaacgaaaacaaaccaacttttcacttctacatcaaaacgcgtttccacgctcaaatcgataaaactatacaacaacgaacaaaaaaataccacccacaaatcacgtttaccgacaatatccttaatttacgcatatttctcgataaaatcgacgcgccaaacgttacgacca

SEQ ID NO: 22897 - DNA, 595 bp, Artificial Sequence
  chemically treated genomic DNA (Homo sapiens) CpG-island No: 22897
tgtcgtcgtaggttcgttagtcggcgtacgtttacgattaatacggaatagggtgtcgatatttatcgaattatttttgttttgatgacgcgtcggaacgttatttagtagtagattggtggttagtatatgatcgtattaggtaaaatcgtttatcggtagtaggtcgatattcgtttgtttttgttgattttagtgacgagtacgtaatttacgttttatcgttagtagttttttacgcgtggagtttttcgtttaataattattttgcgttttttttagttcgcgacgtaggttaacgcgagggaaatcgagggtgtgatttaaataatgatatggtttcgttttagtaaaagttggtggtggtgagtaataagcgggaaaaatcgattaacgatcgtcgttcgcgttataggaagtgatttcggtaggtattagtatacgttatgaggtaagttttaaatcgtaaagcgaggaatggagtagacgtttcgtttcgacgtttagtagtattacgttttgatagtgggcgataaaggtacgttgagttataaaggaacgcgttttgttagttttgtaggcgaataataaggtt

SEQ ID NO: 22898 - DNA, 595 bp, Artificial Sequence
  chemically treated genomic DNA (Homo sapiens) CpG-island No: 22898
aaccttattattcgcctacaaaactaacaaaacgcgttcctttataactcaacgtacctttatcgcccactatcaaaacgtaatactactaaacgtcgaaacgaaacgtctactccattcctcgctttacgatttaaaacttacctcataacgtatactaatacctaccgaaatcacttcctataacgcgaacgacgatcgttaatcgatttttcccgcttattactcaccaccaccaacttttactaaaacgaaaccatatcattatttaaatcacaccctcgatttccctcgcgttaacctacgtcgcgaactaaaaaaaacgcaaaataattattaaacgaaaaactccacgcgtaaaaaactactaacgataaaacgtaaattacgtactcgtcactaaaatcaacaaaaacaaacgaatatcgacctactaccgataaacgattttacctaatacgatcatatactaaccaccaatctactactaaataacgttccgacgcgtcatcaaaacaaaaataattcgataaatatcgacaccctattccgtattaatcgtaaacgtacgccgactaacgaacctacgacgaca

SEQ ID NO: 22899 - DNA, 595 bp, Artificial Sequence
  chemically treated genomic DNA (Homo sapiens) CpG-island No: 22899
aattttattgttcgtttataaagttgataaagcgcgtttttttatagtttagcgtatttttatcgtttattgttagggcgtggtattgttgggcgtcgaggcgaaacgtttgttttatttttcgttttgcggtttgaagtttgttttatagcgtatattggtgtttgtcggagttattttttgtggcgcgaacggcgatcgttaatcggtttttttcgtttgttgtttattattattagtttttgttggagcggagttatattattatttgaattatattttcggtttttttcgcgttggtttgcgtcgcgagttgaaaaaagcgtaagatagttattgggcggggaattttacgcgtgaagaattgttggcggtagggcgtgaattgcgtgttcgttattgggattaataaaagtaagcgggtatcgatttgttgtcggtgggcgattttgtttggtacgattatgtattgattattagtttgttgttgggtaacgtttcggcgcgttattagaataaagatggttcggtagatatcgatattttgtttcgtattggtcgtggacgtgcgtcgattggcgaatttgcggcggta

SEQ ID NO: 22900 - DNA, 595 bp, Artificial Sequence
  chemically treated genomic DNA (Homo sapiens) CpG-island No: 22900
taccgccgcaaattcgccaatcgacgcacgtccacgaccaatacgaaacaaaatatcgatatctaccgaaccatctttattctaataacgcgccgaaacgttacccaacaacaaactaataatcaatacataatcgtaccaaacaaaatcgcccaccgacaacaaatcgatacccgcttacttttattaatcccaataacgaacacgcaattcacgccctaccgccaacaattcttcacgcgtaaaattccccgcccaataactatcttacgcttttttcaactcgcgacgcaaaccaacgcgaaaaaaaccgaaaatataattcaaataataatataactccgctccaacaaaaactaataataataaacaacaaacgaaaaaaaccgattaacgatcgccgttcgcgccacaaaaaataactccgacaaacaccaatatacgctataaaacaaacttcaaaccgcaaaacgaaaaataaaacaaacgtttcgcctcgacgcccaacaataccacgccctaacaataaacgataaaaatacgctaaactataaaaaaacgcgctttatcaactttataaacgaacaataaaatt

SEQ ID NO: 22901 - DNA, 785 bp, Artificial Sequence
  chemically treated genomic DNA (Homo sapiens) CpG-island No: 22901
  misc_feature (713)..(713): n is either a, c, g or t
  misc_feature (749)..(750): n is either a, c, g or t
  misc_feature (767)..(767): n is either a, c, g or t
cggtacgttataatttcgcgacgtattgcgttaaagtgcgcggtgagttgcggatcgtcgtatattatacgcgtacgtattagcgtttgatgtttttacgtttaggtttcgtttttttgataatcggtaaatgtttttgcggatgttattagtattttcgtcgtttcggacggacgtagtcgagtatttattttatataaaatgtcggaagaggtacgcgtattgaatagatgtataatgcgttgcgttagacgtagataaaattgtcgttcgtcgatttttcgtttatcgttagttatcgtatttattgggtaattatggaggaagataaggttaagatcggaattgtagtttaatttttagtcgtttagtttgtcgtagtcgattatcgtaaaattacgtttttcgcgttcgtttaggtgattcggtttatcgtagcgggtaattatttgaatttacgtttgttgaacgacggtatttattatggttttcgttagttaggttaagtgatcgtttatttttattatcggtagcgtatcggcgatattcgttgcggcgatgcgtaatagttgcgtttgtttgaattgacgtagcgttttaagttgttgtttttcgttatttttcggtacgcgtacgaaatatttggcgtaatttatcgcggtaggtatcggtcgtcgtcgggttggtaaaggggtgtttggtatcgagtaaantttaatttagtaataatgggataacgcgttacgtgnngttggtaatttaatcgngcgtaagcgggtattata

SEQ ID NO: 22902 - DNA, 785 bp, Artificial Sequence
  chemically treated genomic DNA (Homo sapiens) CpG-island No: 22902
  misc_feature (19)..(19): n is either a, c, g or t
  misc_feature (36)..(37): n is either a, c, g or t
  misc_feature (73)..(73): n is either a, c, g or t
tataatacccgcttacgcncgattaaattaccaacnncacgtaacgcgttatcccattattactaaattaaantttactcgataccaaacacccctttaccaacccgacgacgaccgatacctaccgcgataaattacgccaaatatttcgtacgcgtaccgaaaaataacgaaaaacaacaacttaaaacgctacgtcaattcaaacaaacgcaactattacgcatcgccgcaacgaatatcgccgatacgctaccgataataaaaataaacgatcacttaacctaactaacgaaaaccataataaataccgtcgttcaacaaacgtaaattcaaataattacccgctacgataaaccgaatcacctaaacgaacgcgaaaaacgtaattttacgataatcgactacgacaaactaaacgactaaaaattaaactacaattccgatcttaaccttatcttcctccataattacccaataaatacgataactaacgataaacgaaaaatcgacgaacgacaattttatctacgtctaacgcaacgcattatacatctattcaatacgcgtacctcttccgacattttatataaaataaatactcgactacgtccgtccgaaacgacgaaaatactaataacatccgcaaaaacatttaccgattatcaaaaaaacgaaacctaaacgtaaaaacatcaaacgctaatacgtacgcgtataatatacgacgatccgcaactcaccgcgcactttaacgcaatacgtcgcgaaattataacgtaccg

SEQ ID NO: 22903 - DNA, 785 bp, Artificial Sequence
  chemically treated genomic DNA (Homo sapiens) CpG-island No: 22903
  misc_feature (19)..(19): n is either a, c, g or t
  misc_feature (36)..(37): n is either a, c, g or t
  misc_feature (73)..(73): n is either a, c, g or t
tgtggtgttcgtttacgtncgattgaattgttagtnntacgtggcgcgttattttattattgttggattgaantttgttcgatgttaaatatttttttattagttcgacggcgatcgatgtttatcgcgatgagttgcgttagatatttcgtgcgcgtgtcggaagatgacgaagagtaatagtttgaggcgttgcgttagtttaaataggcgtagttgttacgtatcgtcgtagcggatatcgtcggtacgttatcggtgatgaaagtgagcgattatttaatttggttggcggaagttatgatagatgtcgtcgtttagtaggcgtgggtttaaatggttgttcgttacggtaagtcgaattatttgaacgaacgcgaagggcgtggttttgcggtggtcggttacggtaagttgggcggttgggagttaggttatagtttcgattttgattttatttttttttatgattgtttaatggatgcgatgattgacggtgagcgggaaatcgacgggcggtagttttatttgcgtttggcgtaacgtattatgtatttgtttagtacgcgtatttttttcggtattttgtatgaagtggatgttcgattgcgttcgttcggggcggcgggaatgttggtgatattcgtagaagtatttgtcgattattagaaaaacgaggtttggacgtgggaatattaggcgttggtgcgtgcgcgtgtagtgtacggcgattcgtagtttatcgcgtattttgacgtagtgcgtcgcgagattatgacgtgtcg

SEQ ID NO: 22904 - DNA, 785 bp, Artificial Sequence
  chemically treated genomic DNA (Homo sapiens) CpG-island No: 22904
  misc_feature (713)..(713): n is either a, c, g or t
  misc_feature (749)..(750): n is either a, c, g or t
  misc_feature (767)..(767): n is either a, c, g or t
cgacacgtcataatctcgcgacgcactacgtcaaaatacgcgataaactacgaatcgccgtacactacacgcgcacgcaccaacgcctaatattcccacgtccaaacctcgtttttctaataatcgacaaatacttctacgaatatcaccaacattcccgccgccccgaacgaacgcaatcgaacatccacttcatacaaaataccgaaaaaaatacgcgtactaaacaaatacataatacgttacgccaaacgcaaataaaactaccgcccgtcgatttcccgctcaccgtcaatcatcgcatccattaaacaatcataaaaaaaaataaaatcaaaatcgaaactataacctaactcccaaccgcccaacttaccgtaaccgaccaccgcaaaaccacgcccttcgcgttcgttcaaataattcgacttaccgtaacgaacaaccatttaaacccacgcctactaaacgacgacatctatcataacttccgccaaccaaattaaataatcgctcactttcatcaccgataacgtaccgacgatatccgctacgacgatacgtaacaactacgcctatttaaactaacgcaacgcctcaaactattactcttcgtcatcttccgacacgcgcacgaaatatctaacgcaactcatcgcgataaacatcgatcgccgtcgaactaataaaaaaatatttaacatcgaacaaanttcaatccaacaataataaaataacgcgccacgtannactaacaattcaatcgnacgtaaacgaacaccaca

SEQ ID NO: 22905 - DNA, 805 bp, Artificial Sequence
  chemically treated genomic DNA (Homo sapiens) CpG-island No: 22905
cgtttcggtagaaaagagttgttcgagcgtatttttggttttttttagcggttagttaaagtgggtagttattttttttgtcgttattttttgacgtattgatgttaatagcgttaataattcgttagtagatttcgcgacgataattggcgcgtcgggtttcgttacgggttgtttcggttggcggttaaagttagtaattagttattgggtgttatcgtttggtcgatcgatttttttgcggttgatgatacgttcggtacgtatcgcggtagtataatttgcgtttagcgtcgtacgatacgtcgttagatcgttttttattattagcgttaagcgattagggttaagtatttcgtgattgagtagacgaacgttagttgttttgagtatggtattcgttgtatttatcgcggcgattatgtcgtttatttttagtaattttagtgtattgattatcggtaattttcgttacgtacgttggattggattacgcgcgatttttagtattgtatcggtaaaggcgttataggttgttttatacgttgtttggttatcggttaaaaatgttgtcgagtagttggttttagacggtggcgggatataggtcgttagttgtacgtcggtagattttagggttgtattaatgttataggtcgtttttagcggcggtgttattagatacgttatcggatttttaagcgtgatttcggcggttgatgagagataagatcggtaagcgaaattatatgtgttagaatgtcgtattttgcgcgttattaagttattggtaagttgcgttatt

SEQ ID NO: 22906 - DNA, 805 bp, Artificial Sequence
  chemically treated genomic DNA (Homo sapiens) CpG-island No: 22906
aataacgcaacttaccaataacttaataacgcgcaaaatacgacattctaacacatataatttcgcttaccgatcttatctctcatcaaccgccgaaatcacgcttaaaaatccgataacgtatctaataacaccgccgctaaaaacgacctataacattaatacaaccctaaaatctaccgacgtacaactaacgacctatatcccgccaccgtctaaaaccaactactcgacaacatttttaaccgataaccaaacaacgtataaaacaacctataacgcctttaccgatacaatactaaaaatcgcgcgtaatccaatccaacgtacgtaacgaaaattaccgataatcaatacactaaaattactaaaaataaacgacataatcgccgcgataaatacaacgaataccatactcaaaacaactaacgttcgtctactcaatcacgaaatacttaaccctaatcgcttaacgctaataataaaaaacgatctaacgacgtatcgtacgacgctaaacgcaaattatactaccgcgatacgtaccgaacgtatcatcaaccgcaaaaaaatcgatcgaccaaacgataacacccaataactaattactaactttaaccgccaaccgaaacaacccgtaacgaaacccgacgcgccaattatcgtcgcgaaatctactaacgaattattaacgctattaacatcaatacgtcaaaaaataacgacaaaaaaaataactacccactttaactaaccgctaaaaaaaaccaaaaatacgctcgaacaactcttttctaccgaaacg

SEQ ID NO: 22907 - DNA, 805 bp, Artificial Sequence
  chemically treated genomic DNA (Homo sapiens) CpG-island No: 22907
aatggcgtagtttattagtggtttaatgacgcgtaagatacggtattttggtatatgtagtttcgtttatcggttttattttttattaatcgtcgggattacgtttgagaattcgatggcgtatttggtggtatcgtcgttggaagcgatttatggtattgatgtagttttgaagtttgtcgacgtatagttggcgatttatgtttcgttatcgtttgaaattaattattcggtagtatttttaatcggtagttaggtagcgtgtaaagtagtttgtaacgtttttatcgatgtagtgttggaaatcgcgcgtaatttaatttagcgtgcgtaacggaggttgtcgatgattaatgtattgggattgttggaagtggacggtatggtcgtcgcgatagatgtagcggatgttatgtttaaagtagttaacgttcgtttgtttagttacgaagtgtttgattttggtcgtttaacgttggtggtggaaggcgatttggcggcgtgtcgtgcggcgttggacgtaggttgtgttgtcgcgatgcgtatcgggcgtgttattagtcgtaaggagatcggtcggttagacgatgatatttagtggttggttattggttttaatcgttagtcgaagtaattcgtaacggaattcgacgcgttagttatcgtcgcggaatttgttgacgagttgttggcgttgttaatattagtacgttagggaatgacggtaggagaagtggttgtttattttggttggtcgttggaaaaagttagaaatgcgttcgaatagtttttttttgtcgggacg

SEQ ID NO: 22908 - DNA, 805 bp, Artificial Sequence
  chemically treated genomic DNA (Homo sapiens) CpG-island No: 22908
cgtcccgacaaaaaaaaactattcgaacgcatttctaactttttccaacgaccaaccaaaataaacaaccacttctcctaccgtcattccctaacgtactaatattaacaacgccaacaactcgtcaacaaattccgcgacgataactaacgcgtcgaattccgttacgaattacttcgactaacgattaaaaccaataaccaaccactaaatatcatcgtctaaccgaccgatctccttacgactaataacacgcccgatacgcatcgcgacaacacaacctacgtccaacgccgcacgacacgccgccaaatcgccttccaccaccaacgttaaacgaccaaaatcaaacacttcgtaactaaacaaacgaacgttaactactttaaacataacatccgctacatctatcgcgacgaccataccgtccacttccaacaatcccaatacattaatcatcgacaacctccgttacgcacgctaaattaaattacgcgcgatttccaacactacatcgataaaaacgttacaaactactttacacgctacctaactaccgattaaaaatactaccgaataattaatttcaaacgataacgaaacataaatcgccaactatacgtcgacaaacttcaaaactacatcaataccataaatcgcttccaacgacgataccaccaaatacgccatcgaattctcaaacgtaatcccgacgattaataaaaaataaaaccgataaacgaaactacatataccaaaataccgtatcttacgcgtcattaaaccactaataaactacgccatt

SEQ ID NO: 22909 - DNA, 713 bp, Artificial Sequence
  chemically treated genomic DNA (Homo sapiens) CpG-island No: 22909
  misc_feature (670)..(671): n is either a, c, g or t
tcgttggcgagttggcgtatataacgatcgttagttgttgtaattttgttatattttagaagtggtcgatagtgcgttgaaaattttcgacgaagcgggattatttggcgaattgcgtttgcgttaggggttggcgttggtggcgatggtcggtgtaggcgttattcgtaattcgttgtattgttatcgtttttggtagtaattgaaaggttagtcggtcgaatttatttggtagttcgatgacggtattagtttggtggtagtattgcgtatcggttcgatcgaaagtttgatttaggggttgtattagttcgtttttcgcgtagaaaaacgtatcggtttggtattgttcggtaagggtaatatcggttttcgttggttggaattgttcgttcgtgagtagagtacgttttcggtacgtatcggttttgagtttgtgttggtaggtgtggtggatagtcgtcgtagtttgttgagttatgacgggttggacgttagtcgcgcgttagttttttttaacgatgaagcggttgagtaggatgaagagtcgttgtttttgtggatgcgcgtttattcgtatgatgatttagtggtgttggacgttatagttagttagtagtttgttgattagtattttgatttcgttagtacggttttttacgtattagtnngtataaattggcggagtagcgatacgaataaatatcgttaga

SEQ ID NO: 22910 - DNA, 713 bp, Artificial Sequence
  chemically treated genomic DNA (Homo sapiens) CpG-island No: 22910
  misc_feature (43)..(44): n is either a, c, g or t
tctaacgatatttattcgtatcgctactccgccaatttatacnnactaatacgtaaaaaaccgtactaacgaaatcaaaatactaatcaacaaactactaactaactataacgtccaacaccactaaatcatcatacgaataaacgcgcatccacaaaaacaacgactcttcatcctactcaaccgcttcatcgttaaaaaaaactaacgcgcgactaacgtccaacccgtcataactcaacaaactacgacgactatccaccacacctaccaacacaaactcaaaaccgatacgtaccgaaaacgtactctactcacgaacgaacaattccaaccaacgaaaaccgatattacccttaccgaacaataccaaaccgatacgtttttctacgcgaaaaacgaactaatacaacccctaaatcaaactttcgatcgaaccgatacgcaatactaccaccaaactaataccgtcatcgaactaccaaataaattcgaccgactaacctttcaattactaccaaaaacgataacaatacaacgaattacgaataacgcctacaccgaccatcgccaccaacgccaacccctaacgcaaacgcaattcgccaaataatcccgcttcgtcgaaaattttcaacgcactatcgaccacttctaaaatataacaaaattacaacaactaacgatcgttatatacgccaactcgccaacga

SEQ ID NO: 22911 - DNA, 713 bp, Artificial Sequence
  chemically treated genomic DNA (Homo sapiens) CpG-island No: 22911
  misc_feature (43)..(44): n is either a, c, g or t
tttggcgatatttattcgtgtcgttgtttcgttagtttgtgtnngttgatacgtgggaaatcgtgttggcgaaattaagatattgattagtaagttgttggttggttgtaacgtttagtattattaaattattatacggatgggcgcgtatttataggaataacgattttttattttgtttaatcgttttatcgttgaagaaggttaacgcgcggttggcgtttagttcgttatagtttaataggttgcggcggttgtttattatatttgttagtataaatttaaagtcggtacgtgtcgaaagcgtgttttgtttacgggcgaatagttttagttaacgggaatcgatattgtttttatcgaataatattaggtcgatgcgtttttttgcgcggaagacggattgatgtagtttttgaattaggttttcggtcgggtcggtgcgtagtattgttattaggttgatgtcgttatcggattgttaggtaaattcgatcggttggttttttagttgttgttagaagcggtggtaatgtagcgggttacgggtgacgtttgtatcgattatcgttattagcgttagtttttgacgtaggcgtagttcgttaggtaatttcgtttcgtcgaggatttttagcgtattgtcggttatttttgaggtgtagtaaaattgtagtaattggcgatcgttatgtacgttaattcgttagcgg

SEQ ID NO: 22912 - DNA, 713 bp, Artificial Sequence
  chemically treated genomic DNA (Homo sapiens) CpG-island No: 22912
  misc_feature (670)..(671): n is either a, c, g or t
ccgctaacgaattaacgtacataacgatcgccaattactacaattttactacacctcaaaaataaccgacaatacgctaaaaatcctcgacgaaacgaaattacctaacgaactacgcctacgtcaaaaactaacgctaataacgataatcgatacaaacgtcacccgtaacccgctacattaccaccgcttctaacaacaactaaaaaaccaaccgatcgaatttacctaacaatccgataacgacatcaacctaataacaatactacgcaccgacccgaccgaaaacctaattcaaaaactacatcaatccgtcttccgcgcaaaaaaacgcatcgacctaatattattcgataaaaacaatatcgattcccgttaactaaaactattcgcccgtaaacaaaacacgctttcgacacgtaccgactttaaatttatactaacaaatataataaacaaccgccgcaacctattaaactataacgaactaaacgccaaccgcgcgttaaccttcttcaacgataaaacgattaaacaaaataaaaaatcgttattcctataaatacgcgcccatccgtataataatttaataatactaaacgttacaaccaaccaacaacttactaatcaatatcttaatttcgccaacacgatttcccacgtatcaacnnacacaaactaacgaaacaacgacacgaataaatatcgccaaa

SEQ ID NO: 22913 - DNA, 534 bp, Artificial Sequence
  chemically treated genomic DNA (Homo sapiens) CpG-island No: 22913
cgatttgtacgcggtagatggcgatgagtataaatttttttgcgttgcgaaaggcggcggttttgttaataaaacgtatttttattaggaaattaaagttttgttgattttcggtaaattgaaaaattttttcgtcgagaaaatgcgtattttcggtattgtagtttgttcgtcgtattatatcgcgtttgtgattggcggtacgtttgcggaaattaatttgaaaatcgttaagttagtaagcgtttattattacgatgaattgtcgacggaagggatcgaatatggttaggcgtttcgcgatgtttagttggaataggaattgttggaagaggtttagaaattcggttttggcgcgtagtttggcggtaaatatttcgcgtacgatattcgcgttattcgtttgttacgttacggcgtattttgttcggtcggtatgggcgttttttgtttcgttgatcgtaatattaaagcgaaaattaatcgcgaaggtatttggatcgaaaaattggaatataatttaggttagtatat

SEQ ID NO: 22914 - DNA, 534 bp, Artificial Sequence
  chemically treated genomic DNA (Homo sapiens) CpG-island No: 22914
atatactaacctaaattatattccaatttttcgatccaaataccttcgcgattaattttcgctttaatattacgatcaacgaaacaaaaaacgcccataccgaccgaacaaaatacgccgtaacgtaacaaacgaataacgcgaatatcgtacgcgaaatatttaccgccaaactacgcgccaaaaccgaatttctaaacctcttccaacaattcctattccaactaaacatcgcgaaacgcctaaccatattcgatcccttccgtcgacaattcatcgtaataataaacgcttactaacttaacgattttcaaattaatttccgcaaacgtaccgccaatcacaaacgcgatataatacgacgaacaaactacaataccgaaaatacgcattttctcgacgaaaaaatttttcaatttaccgaaaatcaacaaaactttaatttcctaataaaaatacgttttattaacaaaaccgccgcctttcgcaacgcaaaaaaatttatactcatcgccatctaccgcgtacaaatcg

SEQ ID NO: 22915 - DNA, 534 bp, Artificial Sequence
  chemically treated genomic DNA (Homo sapiens) CpG-island No: 22915
atgtattggtttgggttgtgttttagtttttcgatttagatattttcgcggttgattttcgttttaatgttacggttagcggagtaggagacgtttatgtcgatcgggtaggatgcgtcgtgacgtggtagacggataacgcgaatgtcgtgcgcgaagtatttatcgttaaattgcgcgttaagatcgagtttttgggttttttttagtagtttttgttttagttggatatcgcggaacgtttgattatgttcgatttttttcgtcggtagtttatcgtaatagtgagcgtttgttaatttgacggtttttaggttggttttcgtagacgtatcgttaattataaacgcgatatggtacggcgggtaggttgtagtatcgagggtacgtattttttcgacgaggaagttttttagtttgtcgggagttagtagggttttggttttttggtagagatacgttttgttggtagagtcgtcgtttttcgtaacgtaaaggaatttgtatttatcgttatttatcgcgtataggtcg

SEQ ID NO: 22916 - DNA, 534 bp, Artificial Sequence
  chemically treated genomic DNA (Homo sapiens) CpG-island No: 22916
cgacctatacgcgataaataacgataaatacaaattcctttacgttacgaaaaacgacgactctaccaacaaaacgtatctctaccaaaaaaccaaaaccctactaactcccgacaaactaaaaaacttcctcgtcgaaaaaatacgtaccctcgatactacaacctacccgccgtaccatatcgcgtttataattaacgatacgtctacgaaaaccaacctaaaaaccgtcaaattaacaaacgctcactattacgataaactaccgacgaaaaaaatcgaacataatcaaacgttccgcgatatccaactaaaacaaaaactactaaaaaaaacccaaaaactcgatcttaacgcgcaatttaacgataaatacttcgcgcacgacattcgcgttatccgtctaccacgtcacgacgcatcctacccgatcgacataaacgtctcctactccgctaaccgtaacattaaaacgaaaatcaaccgcgaaaatatctaaatcgaaaaactaaaacacaacccaaaccaatacat

SEQ ID NO: 22917 - DNA, 522 bp, Artificial Sequence
  chemically treated genomic DNA (Homo sapiens) CpG-island No: 22917
  misc_feature (300)..(300): n is either a, c, g or t
ttagtcgaggcggtatttagcgtttagcgcgtattcggcgtaaaatttatcgcgggcgggattaatttgttggatttgatgaagttggaaattgaaacgtttatttattttatcgatgtgaacggtttcgggttcgataagattgaagtgatcgacgcgggtgggttgcgtatcggcgtattggtacggaatatcgatttggcggtttacgagcgcgtgcgtcgtgattacgcggtattttttcgcgttttgttcgttggcgcgtttggttagttacgtaattaggtaatttacgtagtnaatttgttttagcgtacgcgttgttttttatttttacgatattaattagttttgtaataaagcgttgttcgggagcggttgcgcggcgtttgaaggttttagcgttagtacgcggtggtaagcgtaacgacgttgtattgtatttattttttattattaataattagttggttagcgattttagatagggagtttagaacggttagtttggtagatatttta

SEQ ID NO: 22918 - DNA, 522 bp, Artificial Sequence
  chemically treated genomic DNA (Homo sapiens) CpG-island No: 22918
  misc_feature (223)..(223): n is either a, c, g or t
taaaatatctaccaaactaaccgttctaaactccctatctaaaatcgctaaccaactaattattaataataaaaaataaatacaatacaacgtcgttacgcttaccaccgcgtactaacgctaaaaccttcaaacgccgcgcaaccgctcccgaacaacgctttattacaaaactaattaatatcgtaaaaataaaaaacaacgcgtacgctaaaacaaattnactacgtaaattacctaattacgtaactaaccaaacgcgccaacgaacaaaacgcgaaaaaataccgcgtaatcacgacgcacgcgctcgtaaaccgccaaatcgatattccgtaccaatacgccgatacgcaacccacccgcgtcgatcacttcaatcttatcgaacccgaaaccgttcacatcgataaaataaataaacgtttcaatttccaacttcatcaaatccaacaaattaatcccgcccgcgataaattttacgccgaatacgcgctaaacgctaaataccgcctcgactaa

SEQ ID NO: 22919 - DNA, 522 bp, Artificial Sequence
  chemically treated genomic DNA (Homo sapiens) CpG-island No: 22919
  misc_feature (223)..(223): n is either a, c, g or t
taaagtatttattaaattgatcgttttggattttttgtttaaaatcgttgattagttgattgttggtggtgggaagtgggtgtaatgtagcgtcgttacgtttattatcgcgtgttgacgttaaagtttttaagcgtcgcgtagtcgttttcgggtagcgttttattgtagggttgattggtgtcgtaaaaatagggggtagcgcgtgcgttggagtagattnattgcgtgggttgtttgattacgtaattgattagacgcgttagcgagtagggcgcgggagagtatcgcgtaattacgacgtacgcgttcgtgagtcgttaggtcggtgtttcgtattagtgcgtcgatgcgtagtttattcgcgtcggttattttaattttatcgagttcgaggtcgtttatatcgataaggtgggtgggcgttttaatttttagttttattaggtttagtagattggtttcgttcgcgataaattttgcgtcgggtacgcgttgagcgttaagtgtcgtttcggttgg

SEQ ID NO: 22920 - DNA, 522 bp, Artificial Sequence
  chemically treated genomic DNA (Homo sapiens) CpG-island No: 22920
  misc_feature (300)..(300): n is either a, c, g or t
ccaaccgaaacgacacttaacgctcaacgcgtacccgacgcaaaatttatcgcgaacgaaaccaatctactaaacctaataaaactaaaaattaaaacgcccacccaccttatcgatataaacgacctcgaactcgataaaattaaaataaccgacgcgaataaactacgcatcgacgcactaatacgaaacaccgacctaacgactcacgaacgcgtacgtcgtaattacgcgatactctcccgcgccctactcgctaacgcgtctaatcaattacgtaatcaaacaacccacgcaatnaatctactccaacgcacgcgctaccccctatttttacgacaccaatcaaccctacaataaaacgctacccgaaaacgactacgcgacgcttaaaaactttaacgtcaacacgcgataataaacgtaacgacgctacattacacccacttcccaccaccaacaatcaactaatcaacgattttaaacaaaaaatccaaaacgatcaatttaataaatacttta

SEQ ID NO: 22921 - DNA, 1063 bp, Artificial Sequence
  chemically treated genomic DNA (Homo sapiens) CpG-island No: 22921
attcgttatattttggttcgttatgaatagggcgcgggttttatcgtttagggaatggcgcgtatcgacggtaaatcggcggtttgtatggtttgtagcggatcgggtgcgattaatttggtgatcgttattgtcgatgcgcggttggattttatttcgttgatttgtattattggttaggttttcgtttcgatgatcggtatcgacgttttttaggaagtggatatttacggtatttttatttttattattaaatataattatttggttagatatatcgaagaattttcgtaggttatgagcgatgtttttcgtattgcgtaattaggtcgtttaggttcggtgtggatagatatttttaaggatgtgtaaacggtagtttttgagattgaaatatagttcgttatggtagaaaaagtcgtcgttttcgtttttagcgaagaaagtattcgtgacgtagcggcgatgattaacgttgttaaacgttcggtgttttatttgggcggcggtgtgattaatgcgttcgtacgggtgcgtgaattggcggagaaagcgtaattgtttattattatgattttaatggcgttgggtatgttgttaaaagcgtattcgttgtcgttgggtatgttggggattacggttcgtagtattaattatattttgtaggaggcggatttgttgatagtgtttgaattggcgggcgtttagattgtcgatattgacgttaatgttagtaagttcgtatcggttattcgttatatcgcgttttagacggtaattattggttgtgatcgtaatttggcggatagcgtcgttttttcgtatagcgtcgatgatatcggtaaagtcgcggcgtaaagacggttttttttttgttaggcgtattttttcggtgtttagtttggcgaaggcgcgcgtaattcggcgaattttatcgacggtaagaaagtttttattggtgacgtcgttcggtttgtagttattcggtaggtagtaggtgtaacgaaagttatatatatcggtaatcgataggcgtaagtagtaaaatttacgcgtaaatgta

SEQ ID NO: 22922 - DNA, 1063 bp, Artificial Sequence
  chemically treated genomic DNA (Homo sapiens) CpG-island No: 22922
tacatttacgcgtaaattttactacttacgcctatcgattaccgatatatataactttcgttacacctactacctaccgaataactacaaaccgaacgacgtcaccaataaaaactttcttaccgtcgataaaattcgccgaattacgcgcgccttcgccaaactaaacaccgaaaaaatacgcctaacaaaaaaaaaaccgtctttacgccgcgactttaccgatatcatcgacgctatacgaaaaaacgacgctatccgccaaattacgatcacaaccaataattaccgtctaaaacgcgatataacgaataaccgatacgaacttactaacattaacgtcaatatcgacaatctaaacgcccgccaattcaaacactatcaacaaatccgcctcctacaaaatataattaatactacgaaccgtaatccccaacatacccaacgacaacgaatacgcttttaacaacatacccaacgccattaaaatcataataataaacaattacgctttctccgccaattcacgcacccgtacgaacgcattaatcacaccgccgcccaaataaaacaccgaacgtttaacaacgttaatcatcgccgctacgtcacgaatactttcttcgctaaaaacgaaaacgacgactttttctaccataacgaactatatttcaatctcaaaaactaccgtttacacatccttaaaaatatctatccacaccgaacctaaacgacctaattacgcaatacgaaaaacatcgctcataacctacgaaaattcttcgatatatctaaccaaataattatatttaataataaaaataaaaataccgtaaatatccacttcctaaaaaacgtcgataccgatcatcgaaacgaaaacctaaccaataatacaaatcaacgaaataaaatccaaccgcgcatcgacaataacgatcaccaaattaatcgcacccgatccgctacaaaccatacaaaccgccgatttaccgtcgatacgcgccattccctaaacgataaaacccgcgccctattcataacgaaccaaaatataacgaat

SEQ ID NO: 22923 - DNA, 1063 bp, Artificial Sequence
  chemically treated genomic DNA (Homo sapiens) CpG-island No: 22923
tgtatttgcgcgtaagttttattatttgcgtttgtcgattatcgatgtgtgtaattttcgttgtatttattgtttgtcggatggttataaatcgagcggcgttattaataaaggtttttttatcgtcgatgaaattcgtcgggttacgcgcgttttcgttagattgggtatcgaaaaagtgcgtttgataggaggagagtcgtttttacgtcgcgattttatcgatattatcgacgttgtgcgggaaaacgacgttattcgttagattgcggttataattaatggttatcgtttggaacgcgatgtggcgagtggtcgatgcgggtttattggtattaacgttagtgtcgatagtttggacgttcgttagtttaagtattattaataaattcgttttttgtaaaatatagttggtgttgcgagtcgtgatttttagtatatttagcgataacggatgcgtttttggtaatatgtttagcgttattaaagttatggtggtaggtagttgcgtttttttcgttagtttacgtattcgtgcgggcgtattgattatatcgtcgtttagataaagtatcgggcgtttggtagcgttaattatcgtcgttgcgttacgaatgtttttttcgttaaaggcgggggcggcggttttttttgttatagcgggttgtgttttaattttaaaaattgtcgtttgtatatttttaggaatgtttatttatatcgggtttgggcggtttgattgcgtaatgcggaaggtatcgtttatgatttgcgggagtttttcgatatgtttgattagatagttgtgtttggtgatggggatagagatgtcgtaggtgtttattttttggaaggcgtcggtgtcgattatcgaggcgggaatttgattagtgatgtaaattagcgggatggagtttagtcgcgtatcggtaatggcggttattaggttagtcgtattcggttcgttataggttatatagatcgtcggtttatcgtcggtgcgcgttattttttgagcgataaagttcgcgttttgtttatgacgggttagaatatggcggat

SEQ ID NO: 22924 - DNA, 1063 bp, Artificial Sequence
  chemically treated genomic DNA (Homo sapiens) CpG-island No: 22924
atccgccatattctaacccgtcataaacaaaacgcgaactttatcgctcaaaaaataacgcgcaccgacgataaaccgacgatctatataacctataacgaaccgaatacgactaacctaataaccgccattaccgatacgcgactaaactccatcccgctaatttacatcactaatcaaattcccgcctcgataatcgacaccgacgccttccaaaaaataaacacctacgacatctctatccccatcaccaaacacaactatctaatcaaacatatcgaaaaactcccgcaaatcataaacgataccttccgcattacgcaatcaaaccgcccaaacccgatataaataaacattcctaaaaatatacaaacgacaatttttaaaattaaaacacaacccgctataacaaaaaaaaccgccgcccccgcctttaacgaaaaaaacattcgtaacgcaacgacgataattaacgctaccaaacgcccgatactttatctaaacgacgatataatcaatacgcccgcacgaatacgtaaactaacgaaaaaaacgcaactacctaccaccataactttaataacgctaaacatattaccaaaaacgcatccgttatcgctaaatatactaaaaatcacgactcgcaacaccaactatattttacaaaaaacgaatttattaataatacttaaactaacgaacgtccaaactatcgacactaacgttaataccaataaacccgcatcgaccactcgccacatcgcgttccaaacgataaccattaattataaccgcaatctaacgaataacgtcgttttcccgcacaacgtcgataatatcgataaaatcgcgacgtaaaaacgactctcctcctatcaaacgcactttttcgatacccaatctaacgaaaacgcgcgtaacccgacgaatttcatcgacgataaaaaaacctttattaataacgccgctcgatttataaccatccgacaaacaataaatacaacgaaaattacacacatcgataatcgacaaacgcaaataataaaacttacgcgcaaataca

SEQ ID NO: 22925 - DNA, 509 bp, Artificial Sequence
  chemically treated genomic DNA (Homo sapiens) CpG-island No: 22925
gtttcggcgtaaataattttgtataacgcgttataaagggcgtattgcggtggtattagtagtatcgggttttttttcgtcgtttttatttgtttttttatttgtggtatcgtattttggaattggttgagtatattcgggtcgatcggtacgttgtcgagtattattttttcgttttgttgcgtttgatttattacgttggttagtagattttttagtttattatttagcgtatatatcgttagtttttgtttgcgaacgaacggatgggtaatgttgcgtcgtaatgttaggcgtatatcggtcgttagtagaatatgatttttcgttatcgtgttattggcgattagtacggtggcgatggtgacgatatcgcgtagggaaacgttttcggttagtagcgttcggtatatttttagtaattggttgtaattgagcgtcgcgtttaaatttttcgttagacgcggtgtcgtcgacgataaacggttatgtaattgcgtaatattatt

SEQ ID NO: 22926 - DNA, 509 bp, Artificial Sequence
  chemically treated genomic DNA (Homo sapiens) CpG-island No: 22926
aataatattacgcaattacataaccgtttatcgtcgacgacaccgcgtctaacgaaaaatttaaacgcgacgctcaattacaaccaattactaaaaatataccgaacgctactaaccgaaaacgtttccctacgcgatatcgtcaccatcgccaccgtactaatcgccaataacacgataacgaaaaatcatattctactaacgaccgatatacgcctaacattacgacgcaacattacccatccgttcgttcgcaaacaaaaactaacgatatatacgctaaataataaactaaaaaatctactaaccaacgtaataaatcaaacgcaacaaaacgaaaaaataatactcgacaacgtaccgatcgacccgaatatactcaaccaattccaaaatacgataccacaaataaaaaaacaaataaaaacgacgaaaaaaaacccgatactactaataccaccgcaatacgccctttataacgcgttatacaaaattatttacgccgaaac

SEQ ID NO: 22927 - DNA, 509 bp, Artificial Sequence
  chemically treated genomic DNA (Homo sapiens) CpG-island No: 22927
gatgatattacgtagttgtataatcgtttatcgtcgacggtatcgcgtttggcggaagatttgagcgcgacgtttaattatagttagttgttgaaagtgtatcgggcgttgttgatcgaaggcgtttttttgcgcgatatcgttattatcgttatcgtgttggtcgttagtagtacggtgacgaaagattatattttgttggcggtcgatgtgcgtttggtattgcggcgtagtattatttattcgttcgttcgtaagtaggagttgacggtgtatacgttgaataatgagttggaaaatttgttgattaacgtggtgaattaggcgtaatagggcgggaaagtgatgttcgatagcgtgtcggtcgattcgaatatgtttaattagttttagagtacgatgttataggtgaaagagtagatgaaagcggcggggaaagattcggtgttgttggtgttatcgtagtgcgttttttgtggcgcgttatgtaaggttgtttgcgtcggggt

SEQ ID NO: 22928 - DNA, 509 bp, Artificial Sequence
  chemically treated genomic DNA (Homo sapiens) CpG-island No: 22928
accccgacgcaaacaaccttacataacgcgccacaaaaaacgcactacgataacaccaacaacaccgaatctttccccgccgctttcatctactctttcacctataacatcgtactctaaaactaattaaacatattcgaatcgaccgacacgctatcgaacatcactttcccgccctattacgcctaattcaccacgttaatcaacaaattttccaactcattattcaacgtatacaccgtcaactcctacttacgaacgaacgaataaataatactacgccgcaataccaaacgcacatcgaccgccaacaaaatataatctttcgtcaccgtactactaacgaccaacacgataacgataataacgatatcgcgcaaaaaaacgccttcgatcaacaacgcccgatacactttcaacaactaactataattaaacgtcgcgctcaaatcttccgccaaacgcgataccgtcgacgataaacgattatacaactacgtaatatcatc

SEQ ID NO: 22929 - DNA, 588 bp, Artificial Sequence
  chemically treated genomic DNA (Homo sapiens) CpG-island No: 22929
tattgttgcggtttttgttagcgcggtattatgcgcgttaatggcggcggtaatcgttgagcgatgtatattttataaattaagatttagttcggtaaataaatttattgtggttttcgtatagtacggttcgtttatatttagtgttggcgtatttattgaataagggtttaaaaagtcgttcgtcgagatacgttggcggttgagtatttttaacgttgcgatttgtaattgtgaatcggtatttaataaatcggtttgggattgcgtttttttttttcgtagtttcgtttcggcgagggtgtgtgaattatttagcgttcgttggattagcgtatttagttgcgggttattgagttgtttttattattgcgtttgcggttagtcggagttggtaagatgaatatcgtcggttagtttgatttgtttcggtttgagttgttgatgaggtgtagaatttttacgtattagggtatagtcggaaattagcgtcgtgttgtcgagaatgttgtataatagtagacgtgaaagttgacgattgattattgcgtggttttttattatggtttttaattcgtgttattagat

SEQ ID NO: 22930 - DNA, 588 bp, Artificial Sequence
  chemically treated genomic DNA (Homo sapiens) CpG-island No: 22930
atctaataacacgaattaaaaaccataataaaaaaccacgcaataatcaatcgtcaactttcacgtctactattatacaacattctcgacaacacgacgctaatttccgactataccctaatacgtaaaaattctacacctcatcaacaactcaaaccgaaacaaatcaaactaaccgacgatattcatcttaccaactccgactaaccgcaaacgcaataataaaaacaactcaataacccgcaactaaatacgctaatccaacgaacgctaaataattcacacaccctcgccgaaacgaaactacgaaaaaaaaaaacgcaatcccaaaccgatttattaaataccgattcacaattacaaatcgcaacgttaaaaatactcaaccgccaacgtatctcgacgaacgactttttaaacccttattcaataaatacgccaacactaaatataaacgaaccgtactatacgaaaaccacaataaatttatttaccgaactaaatcttaatttataaaatatacatcgctcaacgattaccgccgccattaacgcgcataataccgcgctaacaaaaaccgcaacaata

SEQ ID NO: 22931 - DNA, 588 bp, Artificial Sequence
  chemically treated genomic DNA (Homo sapiens) CpG-island No: 22931
gtttagtaatacgaattaggggttatgatggagagttacgtaatgattaatcgttaatttttacgtttgttgttgtgtagtattttcggtagtacgacgttgattttcggttgtgttttggtacgtaaggattttgtattttattaatagtttaaatcggaataaattaaattggtcgacgatatttattttgttagtttcggttggtcgtaggcgtagtggtggaaataatttaatgattcgtagttggatgcgttgatttaacggacgttaagtggtttatatattttcgtcgaagcgaaattgcgggaagaaaaagcgtagttttaggtcgatttgttagatgtcggtttataattataggtcgtagcgttagggatgtttaatcgttaacgtgtttcggcgaacggttttttaagtttttatttaatggatgcgttagtattgggtatggacgggtcgtattatacggaagttatagtaggtttgtttgtcggattggattttgatttgtggggtgtgtatcgtttagcggttgtcgtcgttattggcgcgtataatgtcgcgttggtagaaatcgtagtagta

SEQ ID NO: 22932 - DNA, 588 bp, Artificial Sequence
  chemically treated genomic DNA (Homo sapiens) CpG-island No: 22932
tactactacgatttctaccaacgcgacattatacgcgccaataacgacgacaaccgctaaacgatacacaccccacaaatcaaaatccaatccgacaaacaaacctactataacttccgtataatacgacccgtccatacccaatactaacgcatccattaaataaaaacttaaaaaaccgttcgccgaaacacgttaacgattaaacatccctaacgctacgacctataattataaaccgacatctaacaaatcgacctaaaactacgctttttcttcccgcaatttcgcttcgacgaaaatatataaaccacttaacgtccgttaaatcaacgcatccaactacgaatcattaaattatttccaccactacgcctacgaccaaccgaaactaacaaaataaatatcgtcgaccaatttaatttattccgatttaaactattaataaaatacaaaatccttacgtaccaaaacacaaccgaaaatcaacgtcgtactaccgaaaatactacacaacaacaaacgtaaaaattaacgattaatcattacgtaactctccatcataacccctaattcgtattactaaac

SEQ ID NO: 22933 - DNA, 955 bp, Artificial Sequence
  chemically treated genomic DNA (Homo sapiens) CpG-island No: 22933
ttttcgttggtcggtacgtttggcgttgattattatcgttttgttggcgttgattgcgtttattagttagtggtggttgtcgtatgatttataggcgattgatttgtcgtcgcgtttgttttcgtcggatgcgtagtattggttgggtatcgattatttaggtcgcgatattttttcgcggttgatggtagcgattcgcgtgtcgttcggttcggtaatggtttgtttgttgttggtgttgatattagggttggttattggcggtagcgtcgggttgattggcgggcgcgttgattaggttattatgcgcgtcgtcgatatgtttatgattttttcgatttcgattttgtcgttttttatggttggcgtgttcggtatcgggttgattaacgtaattatcgttatcgttttgtcgtattgggcgtggtatgtacgtatggtgcgtagtttggtgattttattacgttaacgcgagtttgtgttggcgttacggtttttcggtgcgggttatgtgcgggtgtttgtcgattatttggtaggcgcggtgattttttcgttgttggtgttggtaacgttggatatcggttatatgatgttgtacgtcgcggggatgtttttttttggtttcggtgtgatcgcgtcgatcgtcgaatggggcgtgatgattaacgacgcgcgttagtatatttggatttagtcgttgtaaatgttttggtcggggttggcgttgtttattagcgtgatggtttttaatttggtgggtgacgtattgcgcgattatttggatttttatttggtgacggagtacgtatattatttattattaagttgtggaacgacgattataagcgttttcgcgaattttgttcgatagtttgaaaaaattttagtttgattatatcgatttttatttaatgtattggttcgttttcgttggagattattatgtcgaagt

SEQ ID NO: 22934 - DNA, 955 bp, Artificial Sequence
  chemically treated genomic DNA (Homo sapiens) CpG-island No: 22934
acttcgacataataatctccaacgaaaacgaaccaatacattaaataaaaatcgatataatcaaactaaaattttttcaaactatcgaacaaaattcgcgaaaacgcttataatcgtcgttccacaacttaataataaataatatacgtactccgtcaccaaataaaaatccaaataatcgcgcaatacgtcacccaccaaattaaaaaccatcacgctaataaacaacgccaaccccgaccaaaacatttacaacgactaaatccaaatatactaacgcgcgtcgttaatcatcacgccccattcgacgatcgacgcgatcacaccgaaaccaaaaaaaaacatccccgcgacgtacaacatcatataaccgatatccaacgttaccaacaccaacaacgaaaaaatcaccgcgcctaccaaataatcgacaaacacccgcacataacccgcaccgaaaaaccgtaacgccaacacaaactcgcgttaacgtaataaaatcaccaaactacgcaccatacgtacataccacgcccaatacgacaaaacgataacgataattacgttaatcaacccgataccgaacacgccaaccataaaaaacgacaaaatcgaaatcgaaaaaatcataaacatatcgacgacgcgcataataacctaatcaacgcgcccgccaatcaacccgacgctaccgccaataaccaaccctaatatcaacaccaacaacaaacaaaccattaccgaaccgaacgacacgcgaatcgctaccatcaaccgcgaaaaaatatcgcgacctaaataatcgatacccaaccaatactacgcatccgacgaaaacaaacgcgacgacaaatcaatcgcctataaatcatacgacaaccaccactaactaataaacgcaatcaacgccaacaaaacgataataatcaacgccaaacgtaccgaccaacgaaaa

SEQ ID NO: 22935 - DNA, 955 bp, Artificial Sequence
  chemically treated genomic DNA (Homo sapiens) CpG-island No: 22935
gtttcgatataatggtttttagcgggaacgggttagtgtattaagtagaggtcgatataattaagttggagtttttttaggttgtcgagtagggttcgcgggggcgtttgtggtcgtcgttttatagtttagtggtgaatagtgtgcgtgtttcgttattagatgagggtttagatgatcgcgtagtgcgttatttattaggttaaaggttattacgttgataaatagcgttagtttcggttagaatatttgtagcggttgggtttagatatattggcgcgcgtcgttaattattacgttttattcggcggtcggcgcggttatatcgaggttaaggaaagatattttcgcgacgtgtagtattatatggtcgatatttagcgttgttagtattagtagcgaagggattatcgcgtttgttagatgatcgataaatattcgtatatggttcgtatcggaaagtcgtgacgttagtataaattcgcgttggcgtagtgaaattattaggttgcgtattatgcgtgtatattacgtttagtgcgatagggcgatggcgataattacgttggttagttcggtgtcgagtacgttaattataaagaacgatagaatcgaggtcgggaaggttataaatatatcggcgacgcgtatggtggtttgattaacgcgttcgttaattaattcggcgttgtcgttaataattagttttaatgttagtattagtagtaggtaggttattatcgaatcgagcgatacgcgggtcgttgttattagtcgcgagaaaatatcgcgatttaagtgatcggtgtttagttagtgttgcgtattcggcgaaagtaggcgcgacggtaaattaatcgtttgtgggttatacggtagttattattggttggtgagcgtaattagcgttagtagggcgataatgattagcgttaggcgtatcgattagcgggaa

SEQ ID NO: 22936 - DNA, 955 bp, Artificial Sequence
  chemically treated genomic DNA (Homo sapiens) CpG-island No: 22936
ttcccgctaatcgatacgcctaacgctaatcattatcgccctactaacgctaattacgctcaccaaccaataataactaccgtataacccacaaacgattaatttaccgtcgcgcctactttcgccgaatacgcaacactaactaaacaccgatcacttaaatcgcgatattttctcgcgactaataacaacgacccgcgtatcgctcgattcgataataacctacctactactaatactaacattaaaactaattattaacgacaacgccgaattaattaacgaacgcgttaatcaaaccaccatacgcgtcgccgatatatttataaccttcccgacctcgattctatcgttctttataattaacgtactcgacaccgaactaaccaacgtaattatcgccatcgccctatcgcactaaacgtaatatacacgcataatacgcaacctaataatttcactacgccaacgcgaatttatactaacgtcacgactttccgatacgaaccatatacgaatatttatcgatcatctaacaaacgcgataatcccttcgctactaatactaacaacgctaaatatcgaccatataatactacacgtcgcgaaaatatctttccttaacctcgatataaccgcgccgaccgccgaataaaacgtaataattaacgacgcgcgccaatatatctaaacccaaccgctacaaatattctaaccgaaactaacgctatttatcaacgtaataacctttaacctaataaataacgcactacgcgatcatctaaaccctcatctaataacgaaacacgcacactattcaccactaaactataaaacgacgaccacaaacgcccccgcgaaccctactcgacaacctaaaaaaactccaacttaattatatcgacctctacttaatacactaacccgttcccgctaaaaaccattatatcgaaac

SEQ ID NO: 22937 - DNA, 509 bp, Artificial Sequence
  chemically treated genomic DNA (Homo sapiens) CpG-island No: 22937
tcggggcgtgcgttatgtgattgagatgattaatcgtgatatggggcgtaatgcgtaatttatgtttgatgtaatgcgcgagacggggattaacgtggtggtttgtatcggttattattaggacgcgtttttttcggaatatgtggcgattcgtagcgtgtaggaattggcgtaggagatggtcgatgaaattgaatagggtatcgatggtacggagttgaaatttgggattatcgcggagatcggtattagcgaaggaaagattacgtcgttggaagagaaggtatttattgtcgttgcgttggcgtataattagatcggacgttcgatttttacgtatacgtcgtttagtacgatggggttggagtaattggcgttgttataagtttacggggttgatttttcgcgcgttatcgttggttattgcgatttgaaagataatttcgataatattttgaagatgatcgatttcggcgcgtacgtgtagttcgatattatcggtaagaata

SEQ ID NO: 22938 - DNA, 509 bp, Artificial Sequence
  chemically treated genomic DNA (Homo sapiens) CpG-island No: 22938
tattcttaccgataatatcgaactacacgtacgcgccgaaatcgatcatcttcaaaatattatcgaaattatctttcaaatcgcaataaccaacgataacgcgcgaaaaatcaaccccgtaaacttataacaacgccaattactccaaccccatcgtactaaacgacgtatacgtaaaaatcgaacgtccgatctaattatacgccaacgcaacgacaataaataccttctcttccaacgacgtaatctttccttcgctaataccgatctccgcgataatcccaaatttcaactccgtaccatcgataccctattcaatttcatcgaccatctcctacgccaattcctacacgctacgaatcgccacatattccgaaaaaaacgcgtcctaataataaccgatacaaaccaccacgttaatccccgtctcgcgcattacatcaaacataaattacgcattacgccccatatcacgattaatcatctcaatcacataacgcacgccccga

SEQ ID NO: 22939 - DNA, 509 bp, Artificial Sequence
  chemically treated genomic DNA (Homo sapiens) CpG-island No: 22939
tgtttttgtcgatggtgtcgaattgtacgtacgcgtcgagatcgattatttttaaaatgttgtcgaggttgttttttagatcgtagtgattaacggtgacgcgcgaaagattaatttcgtgggtttgtagtaacgttagttgttttagttttatcgtgttgaacgacgtatgcgtggagatcgggcgttcggtttggttatgcgttagcgtagcggtaataaatatttttttttttagcggcgtaatttttttttcgttggtgtcgattttcgcgatgattttaggttttagtttcgtgttatcgatattttgtttaattttatcgattattttttgcgttagtttttgtacgttgcgggtcgttatatgtttcgggaaaaacgcgttttggtaataatcggtataggttattacgttgattttcgtttcgcgtattatattaagtataaattgcgtattgcgttttatgttacggttggttattttaattatatgacgtacgtttcgg

SEQ ID NO: 22940 - DNA, 509 bp, Artificial Sequence
  chemically treated genomic DNA (Homo sapiens) CpG-island No: 22940
ccgaaacgtacgtcatataattaaaataaccaaccgtaacataaaacgcaatacgcaatttatacttaatataatacgcgaaacgaaaatcaacgtaataacctataccgattattaccaaaacgcgtttttcccgaaacatataacgacccgcaacgtacaaaaactaacgcaaaaaataatcgataaaattaaacaaaatatcgataacacgaaactaaaacctaaaatcatcgcgaaaatcgacaccaacgaaaaaaaaattacgccgctaaaaaaaaaaatatttattaccgctacgctaacgcataaccaaaccgaacgcccgatctccacgcatacgtcgttcaacacgataaaactaaaacaactaacgttactacaaacccacgaaattaatctttcgcgcgtcaccgttaatcactacgatctaaaaaacaacctcgacaacattttaaaaataatcgatctcgacgcgtacgtacaattcgacaccatcgacaaaaaca

SEQ ID NO: 22941 - DNA, 1112 bp, Artificial Sequence
  chemically treated genomic DNA (Homo sapiens) CpG-island No: 22941
gatggcgaattttgggcgtaaagtatgttcgtttggttagtgttgatttcgttgatttatcgttagtaattttttttcgttcgtgtatgtgttgatcgacgttatcgatattacgtattgcgttacgaattgtcgtgtaatgcggatttttggttcgtagtatagtaagagttattatttttggtgaattttattttttttttagcgatcgtgtcgatcgattagtggttttcgggtagagttttagtgggtttttcgcgttgtattcggattttatttgtttgaacgttttggcggtgtattagttagttaggatcgtattggtgtcgatttgtaaaaagtttagtcggattggagtattgttttgttgcgttattttaattcggttggcgcgtattcgtcgggcgatatgggcgaagattcgtaaggtatttcgaataatttgatgttatatatcgtttaggttgttgtaggtcgtcgcgattcgttggcgatttttggtaacgattattcgatcgaagatggtattggcgtacgcgattatatttacgtaatggatttggcggacggttacgtcgtggcgatggaaaaattggcgaataagttaggcgtatatatttataatttcggcgttggcgtaggtaatagcgtgttggacgtggttaatgtttttagtaaagtttgcggtaaatcggttaattattattttgtatcgcgtcgcgagggcgatttttcggtttattgggcggacgttagtaaagtcgatcgtgaattgaattggcgcgtaacgcgtatattcgatgaaatggcgtaggatatttggtattggtagttacgttatttatagggatatttcgattaaggaacgattatgacgtaatttaatttcgttgattatttatatcgtcgttataattcgtttatcgggtaatggattttggttttatcgtatcgcgttaagcgtttttggtagggggcgtaggaaacgttagttaaataggtgttatttgcgtacgatttagattgttttttttgcgtaggtaatgtgcgggtgataggcgataaaaatttcgattatatcgggatttacgtttttattaatgattttgcgg

SEQ ID NO: 22942 - DNA, 1112 bp, Artificial Sequence
  chemically treated genomic DNA (Homo sapiens) CpG-island No: 22942
ccgcaaaatcattaataaaaacgtaaatcccgatataatcgaaatttttatcgcctatcacccgcacattacctacgcaaaaaaaacaatctaaatcgtacgcaaataacacctatttaactaacgtttcctacgccccctaccaaaaacgcttaacgcgatacgataaaaccaaaatccattacccgataaacgaattataacgacgatataaataatcaacgaaattaaattacgtcataatcgttccttaatcgaaatatccctataaataacgtaactaccaataccaaatatcctacgccatttcatcgaatatacgcgttacgcgccaattcaattcacgatcgactttactaacgtccgcccaataaaccgaaaaatcgccctcgcgacgcgatacaaaataataattaaccgatttaccgcaaactttactaaaaacattaaccacgtccaacacgctattacctacgccaacgccgaaattataaatatatacgcctaacttattcgccaatttttccatcgccacgacgtaaccgtccgccaaatccattacgtaaatataatcgcgtacgccaataccatcttcgatcgaataatcgttaccaaaaatcgccaacgaatcgcgacgacctacaacaacctaaacgatatataacatcaaattattcgaaataccttacgaatcttcgcccatatcgcccgacgaatacgcgccaaccgaattaaaataacgcaacaaaacaatactccaatccgactaaactttttacaaatcgacaccaatacgatcctaactaactaatacaccgccaaaacgttcaaacaaataaaatccgaatacaacgcgaaaaacccactaaaactctacccgaaaaccactaatcgatcgacacgatcgctaaaaaaaaaataaaattcaccaaaaataataactcttactatactacgaaccaaaaatccgcattacacgacaattcgtaacgcaatacgtaatatcgataacgtcgatcaacacatacacgaacgaaaaaaaattactaacgataaatcaacgaaatcaacactaaccaaacgaacatactttacgcccaaaattcgccatc

SEQ ID NO: 22943 - DNA, 1112 bp, Artificial Sequence
  chemically treated genomic DNA (Homo sapiens) CpG-island No: 22943
tcgtaaagttattagtgaaaacgtaagtttcggtgtaatcggggtttttatcgtttgttattcgtatattatttgcgtagaggaagtaatttggatcgtgcgtaggtaatatttgtttggttggcgttttttgcgttttttgttaggggcgtttagcgcggtgcggtgaaattagaatttattgttcggtgagcgggttgtagcggcgatgtggatgattaacgggattaaattgcgttatggtcgttttttaatcgggatatttttgtggatggcgtgattgttagtgttaggtgttttgcgttattttatcgagtgtgcgcgttacgcgttagtttagtttacggtcggttttgttggcgttcgtttagtaggtcggaaggtcgttttcgcgacgcggtgtaaaatgataattaatcggtttgtcgtaggttttgttgaaggtattaattacgtttagtacgttgttgtttacgttagcgtcgaggttgtagatgtgtacgtttggtttgttcgttagtttttttatcgttacgacgtgatcgttcgttagatttattacgtggatgtaatcgcgtacgttagtattattttcggtcggataatcgttattaaaaatcgttagcgagtcgcgacggtttatagtaatttgggcgatgtatggtattaggttattcggaatgttttgcggattttcgtttatatcgttcgacggatgcgcgttaatcgggttgaagtagcgtagtagggtaatgttttagttcggttgggttttttgtagatcggtattagtacgattttgattggttaatatatcgttaaagcgtttaggtaagtgaagttcggatatagcgcggaaagtttattaaaattttgttcgggaattattggtcgatcggtacgatcgttaaaaggggaataaggtttattaagggtaataatttttgttgtattgcgagttagaaattcgtattatacggtagttcgtggcgtagtgcgtggtgtcgatagcgtcgattaatatatatacgagcgggaggaagttgttgacgatgggttagcgaagttagtattggttagacgggtatattttgcgtttaaaattcgttatt

SEQ ID NO: 22944 - DNA, 1112 bp, Artificial Sequence
  chemically treated genomic DNA (Homo sapiens) CpG-island No: 22944
aataacgaattttaaacgcaaaatatacccgtctaaccaatactaacttcgctaacccatcgtcaacaacttcctcccgctcgtatatatattaatcgacgctatcgacaccacgcactacgccacgaactaccgtataatacgaatttctaactcgcaatacaacaaaaattattacccttaataaaccttattccccttttaacgatcgtaccgatcgaccaataattcccgaacaaaattttaataaactttccgcgctatatccgaacttcacttacctaaacgctttaacgatatattaaccaatcaaaatcgtactaataccgatctacaaaaaacccaaccgaactaaaacattaccctactacgctacttcaacccgattaacgcgcatccgtcgaacgatataaacgaaaatccgcaaaacattccgaataacctaataccatacatcgcccaaattactataaaccgtcgcgactcgctaacgatttttaataacgattatccgaccgaaaataatactaacgtacgcgattacatccacgtaataaatctaacgaacgatcacgtcgtaacgataaaaaaactaacgaacaaaccaaacgtacacatctacaacctcgacgctaacgtaaacaacaacgtactaaacgtaattaataccttcaacaaaacctacgacaaaccgattaattatcattttacaccgcgtcgcgaaaacgaccttccgacctactaaacgaacgccaacaaaaccgaccgtaaactaaactaacgcgtaacgcgcacactcgataaaataacgcaaaacacctaacactaacaatcacgccatccacaaaaatatcccgattaaaaaacgaccataacgcaatttaatcccgttaatcatccacatcgccgctacaacccgctcaccgaacaataaattctaatttcaccgcaccgcgctaaacgcccctaacaaaaaacgcaaaaaacgccaaccaaacaaatattacctacgcacgatccaaattacttcctctacgcaaataatatacgaataacaaacgataaaaaccccgattacaccgaaacttacgttttcactaataactttacga

SEQ ID NO: 22945 - DNA, 507 bp, Artificial Sequence
  chemically treated genomic DNA (Homo sapiens) CpG-island No: 22945
tgggatgcgaggtgatagtttttagttttaattcggcgaaagagtaggaagtgttggcgatgggtgtcgataaagtggtgaatagtcgcgattcgtaggtattgaaagtattggcggggtagtttgattttattattaatatcgttaacgttagtttcgattggtagttttattttgaggcgttgatttatggcggtaatttttatacggtcggtgcggtttttacgtcgttgtttgtttcggtttttacgttaattgcgggcgatcgtagcgtttttggttttgttatcggtacgttttatgagttgcgtaagttgatgcgttttgtcgttcgtagtaaggttgcgtcgattatcgaattgttttcgatgtcgaaaattaacgacgttatttagtatgtgcgcgacggtaaggcgcgttatcgcgtggtgttgaaagtcgatttttgaaaattattcgtagcgttgatttgaggcgttgttttttttcgtatatattttgttttgt

SEQ ID NO: 22946 - DNA, 507 bp, Artificial Sequence
  chemically treated genomic DNA (Homo sapiens) CpG-island No: 22946
acaaaacaaaatatatacgaaaaaaaacaacgcctcaaatcaacgctacgaataattttcaaaaatcgactttcaacaccacgcgataacgcgccttaccgtcgcgcacatactaaataacgtcgttaattttcgacatcgaaaacaattcgataatcgacgcaaccttactacgaacgacaaaacgcatcaacttacgcaactcataaaacgtaccgataacaaaaccaaaaacgctacgatcgcccgcaattaacgtaaaaaccgaaacaaacaacgacgtaaaaaccgcaccgaccgtataaaaattaccgccataaatcaacgcctcaaaataaaactaccaatcgaaactaacgttaacgatattaataataaaatcaaactaccccgccaatactttcaatacctacgaatcgcgactattcaccactttatcgacacccatcgccaacacttcctactctttcgccgaattaaaactaaaaactatcacctcgcatccca

SEQ ID NO: 22947 - DNA, 507 bp, Artificial Sequence
  chemically treated genomic DNA (Homo sapiens) CpG-island No: 22947
ataaaatagaatatgtgcgaaagagggtagcgttttagattagcgttgcgaatgatttttaaaaatcggtttttaatattacgcggtaacgcgttttatcgtcgcgtatatgttggatggcgtcgttaattttcgatatcgggaatagttcggtggtcggcgtaattttgttgcgggcggtaaaacgtattagtttacgtagtttataaggcgtgtcggtagtagaattagagacgttgcgatcgttcgtaattaacgtaaaggtcggaatagatagcggcgtgagaatcgtatcgatcgtatggaaattatcgttataggttagcgttttaaaatagggttgttagtcgaggttgacgttgacggtgttgataatgagattaaattgtttcgttagtgtttttagtgtttgcggatcgcggttatttattattttatcggtatttatcgttagtattttttgttttttcgtcggattagaattaaaggttgttatttcgtatttta

SEQ ID NO: 22948 - DNA, 507 bp, Artificial Sequence
  chemically treated genomic DNA (Homo sapiens) CpG-island No: 22948
taaaatacgaaataacaacctttaattctaatccgacgaaaaaacaaaaaatactaacgataaataccgataaaataataaataaccgcgatccgcaaacactaaaaacactaacgaaacaatttaatctcattatcaacaccgtcaacgtcaacctcgactaacaaccctattttaaaacgctaacctataacgataatttccatacgatcgatacgattctcacgccgctatctattccgacctttacgttaattacgaacgatcgcaacgtctctaattctactaccgacacgccttataaactacgtaaactaatacgttttaccgcccgcaacaaaattacgccgaccaccgaactattcccgatatcgaaaattaacgacgccatccaacatatacgcgacgataaaacgcgttaccgcgtaatattaaaaaccgatttttaaaaatcattcgcaacgctaatctaaaacgctaccctctttcgcacatattctattttat

SEQ ID NO: 22949 - DNA, 824 bp, Artificial Sequence
  chemically treated genomic DNA (Homo sapiens) CpG-island No: 22949
  misc_feature (817)..(817): n is either a, c, g or t
cgcgggaacgggtgttaggagaattcgtatttttagaggattttattataaattgagtggtataatttgcgtattgatcgtaagggtaacgttaaaagcgtttttgcgttgattggtatcgatacgttggcgggcgataattgttagttattgattttcggggtcgacgaataggaagcgtattagcgtttaagttaatggttgcgcgatgaatttttttattgcgatgcgtcgttggcggaagttaaatttgacgaattggaattattgtcggttttattgattaatttgaattcgtaaattattcgcgttcgtatcgtgtgtagcggtagtgtaggcggtattttgacgtcgattttttttttagattttaatgcgttgggtaattttttcgtagttaaaggcgttgacgtcgagtaattcgtattggaaaacggtttgacgttggtattgaaaaatattgagtttcgtttgttggatagcgacggtgttattagcgcgattttggaagtttatcgatttttggttggcgatatttttttgcgcgaatatttattggtaggcgttacgtcggattaagttgcgtcgaagtaattgttgttagcgcgaattatttttgcgaagagttttttcgttttagtagtagttatttgtaagaacgtgttttggacgtacgcgacgtttgtttttagttattttagtaaatttacggtgagtacgtttttcggtatcgggtaaattgacgtagttcgtatttgtatggttgatgaattgatttttagttagtttttcgaaattggataaaattattttaaangattggt

SEQ ID NO: 22950 - DNA, 824 bp, Artificial Sequence
  chemically treated genomic DNA (Homo sapiens) CpG-island No: 22950
  misc_feature (8)..(8): n is either a, c, g or t
accaatcntttaaaataattttatccaatttcgaaaaactaactaaaaatcaattcatcaaccatacaaatacgaactacgtcaatttacccgataccgaaaaacgtactcaccgtaaatttactaaaataactaaaaacaaacgtcgcgtacgtccaaaacacgttcttacaaataactactactaaaacgaaaaaactcttcgcaaaaataattcgcgctaacaacaattacttcgacgcaacttaatccgacgtaacgcctaccaataaatattcgcgcaaaaaaatatcgccaaccaaaaatcgataaacttccaaaatcgcgctaataacaccgtcgctatccaacaaacgaaactcaatatttttcaataccaacgtcaaaccgttttccaatacgaattactcgacgtcaacgcctttaactacgaaaaaattacccaacgcattaaaatctaaaaaaaaaatcgacgtcaaaataccgcctacactaccgctacacacgatacgaacgcgaataatttacgaattcaaattaatcaataaaaccgacaataattccaattcgtcaaatttaacttccgccaacgacgcatcgcaataaaaaaattcatcgcgcaaccattaacttaaacgctaatacgcttcctattcgtcgaccccgaaaatcaataactaacaattatcgcccgccaacgtatcgataccaatcaacgcaaaaacgcttttaacgttacccttacgatcaatacgcaaattataccactcaatttataataaaatcctctaaaaatacgaattctcctaacacccgttcccgcg

SEQ ID NO: 22951 - DNA, 824 bp, Artificial Sequence
  chemically treated genomic DNA (Homo sapiens) CpG-island No: 22951
  misc_feature (8)..(8): n is either a, c, g or t
attaattntttgaggtgattttatttagtttcgaggaattggttgggggttagtttattagttatataaatgcgggttgcgttagtttgttcggtgtcgggaagcgtgtttatcgtagatttgttggagtaattggaagtagacgtcgcgtacgtttagggtacgtttttgtaggtagttgttgttggaacgggaaaatttttcgtaaaagtgattcgcgttggtaataattgtttcggcgtagtttaattcggcgtgacgtttattagtaaatgttcgcgtagggaagtatcgttagttagggatcggtgagtttttagaatcgcgttggtagtatcgtcgttatttagtagacgaaatttaatgttttttagtattagcgttaggtcgttttttagtgcggattgttcggcgttaacgtttttggttgcgggaagattatttagcgtattgagatttaaagaagagatcggcgttagaatgtcgtttgtattatcgttgtatacggtgcgggcgcggataatttgcggatttagattggttagtgaaatcggtagtggttttagttcgttagatttaattttcgttagcggcgtatcgtagtgggggaatttatcgcgtagttattggtttaaacgttggtgcgttttttgttcgtcggtttcggaaattagtaattggtagttatcgttcgttagcgtatcggtgttaattagcgtaagggcgtttttggcgttgtttttgcggttagtgcgtaggttatgttatttaatttgtgatgggattttttagagatacgagtttttttggtattcgttttcgcg

SEQ ID NO: 22952 - DNA, 824 bp, Artificial Sequence
  chemically treated genomic DNA (Homo sapiens) CpG-island No: 22952
  misc_feature (817)..(817): n is either a, c, g or t
cgcgaaaacgaataccaaaaaaactcgtatctctaaaaaatcccatcacaaattaaataacataacctacgcactaaccgcaaaaacaacgccaaaaacgcccttacgctaattaacaccgatacgctaacgaacgataactaccaattactaatttccgaaaccgacgaacaaaaaacgcaccaacgtttaaaccaataactacgcgataaattcccccactacgatacgccgctaacgaaaattaaatctaacgaactaaaaccactaccgatttcactaaccaatctaaatccgcaaattatccgcgcccgcaccgtatacaacgataatacaaacgacattctaacgccgatctcttctttaaatctcaatacgctaaataatcttcccgcaaccaaaaacgttaacgccgaacaatccgcactaaaaaacgacctaacgctaatactaaaaaacattaaatttcgtctactaaataacgacgatactaccaacgcgattctaaaaactcaccgatccctaactaacgatacttccctacgcgaacatttactaataaacgtcacgccgaattaaactacgccgaaacaattattaccaacgcgaatcacttttacgaaaaattttcccgttccaacaacaactacctacaaaaacgtaccctaaacgtacgcgacgtctacttccaattactccaacaaatctacgataaacacgcttcccgacaccgaacaaactaacgcaacccgcatttatataactaataaactaacccccaaccaattcctcgaaactaaataaaatcacctcaaanaattaat

SEQ ID NO: 22953 - DNA, 529 bp, Artificial Sequence
  chemically treated genomic DNA (Homo sapiens) CpG-island No: 22953
gaatagacggtttggaatagtttttagatttgttagtttcgttttgatagtattaagcgttgcgtttacggatatggagagcgtagttatgttagcgtattcgtaatattgtgacgtttcggtaacggtagtagaatatcgacgttatcggttggggtttgtagggtaaatttcgtatcgtgcgaggttatatggatattggtggcggtgaaatcgttgttggcggtattgggtgagaaacgttatattttgcgtgagttaattacgttttgttagtttagttagtcgttgttgtcggcgtttataatggcgatatcgtttttcggtagtcgttaaagattttatttttcgttttcgcgatattcgtaagcgagtaaaaattttttagatgcgcgttgttagggttgttgattagcgtatttttcgggcgagttagatttatagtttaggttattttcgttatgatggtcgcgttaagtttaataattgcgtaatcgtattcgggcgttaacgtaatagcgttatcggt

SEQ ID NO: 22954 - DNA, 529 bp, Artificial Sequence
  chemically treated genomic DNA (Homo sapiens) CpG-island No: 22954
accgataacgctattacgttaacgcccgaatacgattacgcaattattaaacttaacgcgaccatcataacgaaaataacctaaactataaatctaactcgcccgaaaaatacgctaatcaacaaccctaacaacgcgcatctaaaaaatttttactcgcttacgaatatcgcgaaaacgaaaaataaaatctttaacgactaccgaaaaacgatatcgccattataaacgccgacaacaacgactaactaaactaacaaaacgtaattaactcacgcaaaatataacgtttctcacccaataccgccaacaacgatttcaccgccaccaatatccatataacctcgcacgatacgaaatttaccctacaaaccccaaccgataacgtcgatattctactaccgttaccgaaacgtcacaatattacgaatacgctaacataactacgctctccatatccgtaaacgcaacgcttaatactatcaaaacgaaactaacaaatctaaaaactattccaaaccgtctattc

SEQ ID NO: 22955 - DNA, 529 bp, Artificial Sequence
  chemically treated genomic DNA (Homo sapiens) CpG-island No: 22955
atcgatgacgttgttgcgttaacgttcgaatacgattacgtagttattgaatttggcgcgattattatggcgaaaatagtttggattgtgagtttgattcgttcgggaaatgcgttggttaataattttggtagcgcgtatttggaaggtttttgttcgtttgcgggtgtcgcgaaagcgaaaggtgaaatttttagcggttgtcggaaaacggtatcgttattatgaacgtcgataataacgattggttgaattggtagagcgtaattagtttacgtaaagtgtggcgttttttatttaatgtcgttaatagcgattttatcgttattaatatttatgtgatttcgtacggtacggaatttattttataaattttaatcggtagcgtcgatgttttgttgtcgttgtcggggcgttataatattgcgaatgcgttggtatgattgcgttttttatgttcgtgggcgtaacgtttgatgttattaaagcggggttggtaaatttgaaagttgttttaggtcgtttgttt

SEQ ID NO: 22956 - DNA, 529 bp, Artificial Sequence
  chemically treated genomic DNA (Homo sapiens) CpG-island No: 22956
aaacaaacgacctaaaacaactttcaaatttaccaaccccgctttaataacatcaaacgttacgcccacgaacataaaaaacgcaatcataccaacgcattcgcaatattataacgccccgacaacgacaacaaaacatcgacgctaccgattaaaatttataaaataaattccgtaccgtacgaaatcacataaatattaataacgataaaatcgctattaacgacattaaataaaaaacgccacactttacgtaaactaattacgctctaccaattcaaccaatcgttattatcgacgttcataataacgataccgttttccgacaaccgctaaaaatttcacctttcgctttcgcgacacccgcaaacgaacaaaaaccttccaaatacgcgctaccaaaattattaaccaacgcatttcccgaacgaatcaaactcacaatccaaactattttcgccataataatcgcgccaaattcaataactacgtaatcgtattcgaacgttaacgcaacaacgtcatcgat

SEQ ID NO: 22957 - DNA, 657 bp, Artificial Sequence
  chemically treated genomic DNA (Homo sapiens) CpG-island No: 22957
gttcgcgcgttagtatcgtatagcgtttcgtttgaaaaaaacgttaggacgttttgatttttagcgcggcgtgttgtaacgtaacgtcgatggcgaattggaagtgacgattatcggatattagggtttatatatatttagtttttttagtttcggtaattgttttatcgtgttggaacgcgatcgcggtaatgtggaagtgggcgaatgggtggaagtagaatcgtttaacgcgttgttcggaggtttgtaatggcggaatttagcgattaggagatgttgcgttataatcggtaaattattttgcgcggttttgattttgacggttaggaggcgttgaaagattttcgcgtgttgatagtgggtttgggcggtttcggttgtgtagtttcgtagtatttggtaagcgtcggtgtcggtaatttgacgttgttcgatttcgatacggtttcgttttcgaatttgtaacgttagatattgtatagtgatgttacggtcgggtaatcgaaggtggaattcgttcgtgacgttttgacgcggattatttatatatcgcgattacgttagttaatgtattgttggatgacgtagaatttgtagtattgattgttgaatacgatttggtgttcgattgtacggataacgttgcggtacgta

SEQ ID NO: 22958 - DNA, 657 bp, Artificial Sequence
  chemically treated genomic DNA (Homo sapiens) CpG-island No: 22958
tacgtaccgcaacgttatccgtacaatcgaacaccaaatcgtattcaacaatcaatactacaaattctacgtcatccaacaatacattaactaacgtaatcgcgatatataaataatccgcgtcaaaacgtcacgaacgaattccaccttcgattacccgaccgtaacatcactatacaatatctaacgttacaaattcgaaaacgaaaccgtatcgaaatcgaacaacgtcaaattaccgacaccgacgcttaccaaatactacgaaactacacaaccgaaaccgcccaaacccactatcaacacgcgaaaatctttcaacgcctcctaaccgtcaaaatcaaaaccgcgcaaaataatttaccgattataacgcaacatctcctaatcgctaaattccgccattacaaacctccgaacaacgcgttaaacgattctacttccacccattcgcccacttccacattaccgcgatcgcgttccaacacgataaaacaattaccgaaactaaaaaaactaaatatatataaaccctaatatccgataatcgtcacttccaattcgccatcgacgttacgttacaacacgccgcgctaaaaatcaaaacgtcctaacgtttttttcaaacgaaacgctatacgatactaacgcgcgaac

SEQ ID NO: 22959 - DNA, 657 bp, Artificial Sequence
  chemically treated genomic DNA (Homo sapiens) CpG-island No: 22959
tacgtatcgtaacgttattcgtatagtcgagtattagatcgtgtttagtaattaatgttgtaagttttgcgttatttagtagtgtattgattggcgtaatcgcgatatgtgggtgattcgcgttagggcgttacgggcggattttattttcggttgttcgatcgtggtattattgtgtagtgtttggcgttgtagattcgagagcgaaatcgtgtcgaagtcgagtagcgttaggttatcgatatcggcgtttgttagatattgcgaggttgtatagtcgaggtcgtttaggtttattattagtacgcgagaattttttagcgttttttggtcgttaaaattaaagtcgcgtagaatgatttgtcggttgtagcgtagtattttttgatcgttgagtttcgttattataggttttcgaataacgcgttaaacggttttatttttatttattcgtttatttttatattgtcgcgatcgcgttttagtacgataaagtagttgtcgaggttaaaggagttaaatatatgtgaattttgatgttcggtggtcgttatttttagttcgttatcggcgttgcgttgtagtacgtcgcgttggaaattaagacgttttggcgttttttttaggcgggacgttgtgcgatattggcgcgcgggt

SEQ ID NO: 22960 - DNA, 657 bp, Artificial Sequence
  chemically treated genomic DNA (Homo sapiens) CpG-island No: 22960
acccgcgcgccaatatcgcacaacgtcccgcctaaaaaaaacgccaaaacgtcttaatttccaacgcgacgtactacaacgcaacgccgataacgaactaaaaataacgaccaccgaacatcaaaattcacatatatttaactcctttaacctcgacaactactttatcgtactaaaacgcgatcgcgacaatataaaaataaacgaataaataaaaataaaaccgtttaacgcgttattcgaaaacctataataacgaaactcaacgatcaaaaaatactacgctacaaccgacaaatcattctacgcgactttaattttaacgaccaaaaaacgctaaaaaattctcgcgtactaataataaacctaaacgacctcgactatacaacctcgcaatatctaacaaacgccgatatcgataacctaacgctactcgacttcgacacgatttcgctctcgaatctacaacgccaaacactacacaataataccacgatcgaacaaccgaaaataaaatccgcccgtaacgccctaacgcgaatcacccacatatcgcgattacgccaatcaatacactactaaataacgcaaaacttacaacattaattactaaacacgatctaatactcgactatacgaataacgttacgatacgta

SEQ ID NO: 22961 - DNA, 830 bp, Artificial Sequence
  chemically treated genomic DNA (Homo sapiens) CpG-island No: 22961
aaagtggagtaattgtcgaataagttcgtttgttagcgtaaatttgttaacgtcgcggcgagtggcgttataattacgtattggtgtttaaagatcgttcggattatcgttttattttcggtgaaaaaggtgaagtgttggatatcgtcgtcgagtttcgtcgtattgttaatcgtatcgtcgaagaagcgatgattgtcgttaatatttgtgcggttcgcgtattgcgcgataagttcggttttggtatttataacgtgtatatgggttttgattcggcgaatgtcgacgcgttggtagcgttgttgaaaacgtacggtttgtatgtcgatgtcgaagaagtgtttacgttggacggtttttgtaaattgcgtcgtgaattggacgcgtaattaattggttttttcgatagtcgtattcgtcgtttttagttatttgttgaaattagtattgaattcggtttttattttggtttcggtttggaagtatacgttatttggatttcgtcgattcgtaaatatggcgatatgattaattatcgtttgttgaaagcggttattaaaggcgaaattgcgacgcgtttataggatgaaattattgtttaaatggtcgagcgtcgtcgttttaatcggatggtagaacgtgatgttggtgattggttatacgtacgttttttgaaagataaagtcgggatcgatattcgtttcgtagcggaaattgtcgatattagtcgtggcggtatgcgtgttcgtttggttgataacgagtttgtttagcgagataaagtcgacggtcggttagtgattggagttgtttaaaattataattat

SEQ ID NO: 22962 - DNA, 830 bp, Artificial Sequence
  chemically treated genomic DNA (Homo sapiens) CpG-island No: 22962
ataattataattttaaacaactccaatcactaaccgaccgtcgactttatctcgctaaacaaactcgttatcaaccaaacgaacacgcataccgccacgactaatatcgacaatttccgctacgaaacgaatatcgatcccgactttatctttcaaaaaacgtacgtataaccaatcaccaacatcacgttctaccatccgattaaaacgacgacgctcgaccatttaaacaataatttcatcctataaacgcgtcgcaatttcgcctttaataaccgctttcaacaaacgataattaatcatatcgccatatttacgaatcgacgaaatccaaataacgtatacttccaaaccgaaaccaaaataaaaaccgaattcaatactaatttcaacaaataactaaaaacgacgaatacgactatcgaaaaaaccaattaattacgcgtccaattcacgacgcaatttacaaaaaccgtccaacgtaaacacttcttcgacatcgacatacaaaccgtacgttttcaacaacgctaccaacgcgtcgacattcgccgaatcaaaacccatatacacgttataaataccaaaaccgaacttatcgcgcaatacgcgaaccgcacaaatattaacgacaatcatcgcttcttcgacgatacgattaacaatacgacgaaactcgacgacgatatccaacacttcacctttttcaccgaaaataaaacgataatccgaacgatctttaaacaccaatacgtaattataacgccactcgccgcgacgttaacaaatttacgctaacaaacgaacttattcgacaattactccacttt

SEQ ID NO: 22963 - DNA, 830 bp, Artificial Sequence
  chemically treated genomic DNA (Homo sapiens) CpG-island No: 22963
gtgattatgattttgaataattttagttattggtcgatcgtcggttttatttcgttaaataggttcgttattaattaaacgaatacgtatgtcgttacggttgatatcgataattttcgttgcgaaacgggtgtcggtttcggttttgttttttaggaagcgtgcgtataattagttattaatattacgttttgttattcggttgagacggcgacgttcggttatttggatagtgattttattttgtgggcgcgtcgtagtttcgtttttgataatcgtttttagtagacggtggttgattatgtcgttatatttacggatcggcgaagtttaggtggcgtatgtttttagatcgaggttaaagtgaggatcgggtttagtgttaattttagtaaatgattggaagcgacgaatgcggttgtcgaggaaattagttggttgcgcgtttagtttacgacgtagtttgtagaaatcgtttagcgtgagtattttttcggtatcgatatgtagatcgtgcgtttttagtaacgttgttagcgcgtcggtattcgtcggattaaagtttatatgtacgttatagatgttaaaatcgagtttatcgcgtagtacgcgggtcgtataaatgttagcggtaattatcgttttttcgacgatacggttggtaatgcgacgaggttcggcgacgatatttagtattttattttttttatcgagaataaagcggtaattcgggcgatttttaaatattagtgcgtggttatgacgttattcgtcgcggcgttggtaaatttgcgttagtaaacggatttgttcggtaattgttttatttt

SEQ ID NO: 22964 - DNA, 830 bp, Artificial Sequence
  chemically treated genomic DNA (Homo sapiens) CpG-island No: 22964
aaaataaaacaattaccgaacaaatccgtttactaacgcaaatttaccaacgccgcgacgaataacgtcataaccacgcactaatatttaaaaatcgcccgaattaccgctttattctcgataaaaaaaataaaatactaaatatcgtcgccgaacctcgtcgcattaccaaccgtatcgtcgaaaaaacgataattaccgctaacatttatacgacccgcgtactacgcgataaactcgattttaacatctataacgtacatataaactttaatccgacgaataccgacgcgctaacaacgttactaaaaacgcacgatctacatatcgataccgaaaaaatactcacgctaaacgatttctacaaactacgtcgtaaactaaacgcgcaaccaactaatttcctcgacaaccgcattcgtcgcttccaatcatttactaaaattaacactaaacccgatcctcactttaacctcgatctaaaaacatacgccacctaaacttcgccgatccgtaaatataacgacataatcaaccaccgtctactaaaaacgattatcaaaaacgaaactacgacgcgcccacaaaataaaatcactatccaaataaccgaacgtcgccgtctcaaccgaataacaaaacgtaatattaataactaattatacgcacgcttcctaaaaaacaaaaccgaaaccgacacccgtttcgcaacgaaaattatcgatatcaaccgtaacgacatacgtattcgtttaattaataacgaacctatttaacgaaataaaaccgacgatcgaccaataactaaaattattcaaaatcataatcac

SEQ ID NO: 22965 - DNA, 1145 bp, Artificial Sequence
  chemically treated genomic DNA (Homo sapiens) CpG-island No: 22965
ggtcgggataacggtattcgtttgtttgtcgtgtggttgacgtacgattcggaatattcggagaatttatttgtcgcgtcgttggtgcgttatggttggacgttacgcggcgaattggcggtggtgtatgatcgtagtggtaaataggtgcgtacgtttatttacgatgataaatatcggggtcggatggtggcgtatcgttatacgggtcggtcggaaattcgttatcgttacgatagcgacgggcgggtgatagaatagttaaattcggtaggtttaagttatacgtattagtatgagaaagatcgtattattattatcgatagtttggatcgtcgtgaagtgttgtatacgtagggcgaagtcgggttgaagcgggtggtgaaaaaggaatacgcggacggtagcgttacgtagagttagtttgacgtcgtgggtaggtttagggtatagacggatgtcgtaggtaggataatagagtatagttcggatgtggtgacgggttttattacgcgtataattacgtcggatggtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgataatttatatagtgatttattttgcgtaacggaagatgttatcggtagtcggaaaattatgacgtggagtcgttacggttagttgttgagttttatcgattgtttcggttatgtaattcgttatgattatgatcgtttcgggtagatgacggcggtgtatcgcgaggaagggttgagttagtatcgcgtatacgatagtcgtggatagttaattgtcgtgaaagatacgtagggttatgaaacgcggtatgaatataatatcgtcggtgatttgatcgtcgttattgtttcggacggtagtagaaacgggatatagtacgatgcgtggggaaaggtcgttcgtattacgtagggcgggtgacgcgtagtatggaatacgatgttgtcggacgggttattcgtttgattagtgaaaacggtagagtttgttagcgaaattattttggtaattgtttttatcgt

SEQ ID NO: 22966 - DNA, 1145 bp, Artificial Sequence
  chemically treated genomic DNA (Homo sapiens) CpG-island No: 22966
acgataaaaacaattaccaaaataatttcgctaacaaactctaccgttttcactaatcaaacgaataacccgtccgacaacatcgtattccatactacgcgtcacccgccctacgtaatacgaacgacctttccccacgcatcgtactatatcccgtttctactaccgtccgaaacaataacgacgatcaaatcaccgacgatattatattcataccgcgtttcataaccctacgtatctttcacgacaattaactatccacgactatcgtatacgcgatactaactcaacccttcctcgcgatacaccgccgtcatctacccgaaacgatcataatcataacgaattacataaccgaaacaatcgataaaactcaacaactaaccgtaacgactccacgtcataattttccgactaccgataacatcttccgttacgcaaaataaatcactatataaattatcataacgataacgaataatatcgccgtcaaaaacaatttcctaaatcaaacgacccaattcatcatattcccgacgcaattccaacccgtcaaacccgataactaacgttaactaattataataattataataaaacgccgataccctaccatccgacgtaattatacgcgtaataaaacccgtcaccacatccgaactatactctattatcctacctacgacatccgtctataccctaaacctacccacgacgtcaaactaactctacgtaacgctaccgtccgcgtattcctttttcaccacccgcttcaacccgacttcgccctacgtatacaacacttcacgacgatccaaactatcgataataataatacgatctttctcatactaatacgtataacttaaacctaccgaatttaactattctatcacccgcccgtcgctatcgtaacgataacgaatttccgaccgacccgtataacgatacgccaccatccgaccccgatatttatcatcgtaaataaacgtacgcacctatttaccactacgatcatacaccaccgccaattcgccgcgtaacgtccaaccataacgcaccaacgacgcgacaaataaattctccgaatattccgaatcgtacgtcaaccacacgacaaacaaacgaataccgttatcccgacc

SEQ ID NO: 22967 - DNA, 1145 bp, Artificial Sequence
  chemically treated genomic DNA (Homo sapiens) CpG-island No: 22967
acgatggaaataattattagaatgatttcgttggtaaattttgtcgtttttattggttaggcggatgattcgttcggtagtatcgtattttatattgcgcgttattcgttttgcgtggtacggacggtttttttttacgtatcgtattgtgtttcgtttttgttgtcgttcggggtaatgacggcggttaggttatcggcgatgttgtatttatatcgcgttttatggttttgcgtgttttttacggtaattaattgtttacggttgtcgtatgcgcggtattgatttagttttttttcgcggtgtatcgtcgttatttgttcgaagcggttatggttataacgggttatataatcggaatagtcggtgaagtttagtaattgatcgtaacggttttacgttatggtttttcggttgtcggtggtatttttcgttgcgtagggtaagttattgtgtggattattataacggtagcgggtgatatcgtcgttaggggtagttttttgaattagacggtttaatttattatattttcggcgtaattttagttcgttaggttcggtggttgacgttaattggttgtggtggttatagtaaaacgtcgatgttttgttattcggcgtggttatgcgcgtgatgaggttcgttattatattcgggttgtattttgttgttttgtttgcggtattcgtttgtgttttgagtttgtttacggcgttaaattgattttgcgtgacgttgtcgttcgcgtgttttttttttattattcgttttagttcggtttcgttttgcgtgtgtagtattttacggcggtttaggttgtcggtgatggtgatgcggttttttttatattgatacgtgtagtttaagtttgtcgggtttagttgttttgttattcgttcgtcgttgtcgtaacggtaacggattttcggtcggttcgtgtgacggtgcgttattattcggtttcggtatttattatcgtaagtaaacgtgcgtatttgtttgttattacggttatatattatcgttagttcgtcgcgtggcgtttagttatagcgtattagcggcgcggtaggtaaatttttcgggtatttcgggtcgtgcgttagttatacggtagatagacggatgtcgttgtttcggtt

SEQ ID NO: 22968 - DNA, 1145 bp, Artificial Sequence
  chemically treated genomic DNA (Homo sapiens) CpG-island No: 22968
aaccgaaacaacgacatccgtctatctaccgtataactaacgcacgacccgaaatacccgaaaaatttacctaccgcgccgctaatacgctataactaaacgccacgcgacgaactaacgataatatataaccgtaataacaaacaaatacgcacgtttacttacgataataaataccgaaaccgaataataacgcaccgtcacacgaaccgaccgaaaatccgttaccgttacgacaacgacgaacgaataacaaaacaactaaacccgacaaacttaaactacacgtatcaatataaaaaaaaccgcatcaccatcaccgacaacctaaaccgccgtaaaatactacacacgcaaaacgaaaccgaactaaaacgaataataaaaaaaaaacacgcgaacgacaacgtcacgcaaaatcaatttaacgccgtaaacaaactcaaaacacaaacgaataccgcaaacaaaacaacaaaatacaacccgaatataataacgaacctcatcacgcgcataaccacgccgaataacaaaacatcgacgttttactataaccaccacaaccaattaacgtcaaccaccgaacctaacgaactaaaattacgccgaaaatataataaattaaaccgtctaattcaaaaaactacccctaacgacgatatcacccgctaccgttataataatccacacaataacttaccctacgcaacgaaaaataccaccgacaaccgaaaaaccataacgtaaaaccgttacgatcaattactaaacttcaccgactattccgattatataacccgttataaccataaccgcttcgaacaaataacgacgatacaccgcgaaaaaaaactaaatcaataccgcgcatacgacaaccgtaaacaattaattaccgtaaaaaacacgcaaaaccataaaacgcgatataaatacaacatcgccgataacctaaccgccgtcattaccccgaacgacaacaaaaacgaaacacaatacgatacgtaaaaaaaaaccgtccgtaccacgcaaaacgaataacgcgcaatataaaatacgatactaccgaacgaatcatccgcctaaccaataaaaacgacaaaatttaccaacgaaatcattctaataattatttccatcgt

SEQ ID NO: 22969 - DNA, 687 bp, Artificial Sequence
  chemically treated genomic DNA (Homo sapiens) CpG-island No: 22969
  misc_feature (252)..(252): n is either a, c, g or t
acgcgcggattgatggttttggttgatattttacgcgttatttgggttttgtcgaggttgttatataaacggaagttgaattcgtcgtttagcggatcggttaggttaaagttagtgcgtttggtggtatttttttttttatgttttggcgtattgaaatatgcgttttaggagtcgtgttattcgtcgttgttttttttggtaatgatgttaattacgtcgttcgtcgcgtcgttgttataacgcgtattngtcggattacgtagaattttaatacgtttaattattttaggtggtatttaggaagtattattacgggtatcgcgttcgttacgttagttttgacgtatcgagttacggttgtttatcggtttgtcgttaattaaaattagcgtgtttttcggatttatatcgcgaatattaatttgtcggttatttttacgttgattattggtggagttatcggttaggttaacgtttggtatggtacggatgattttcgatatatcgcgggtaatcgggtttttgcggattttatttgcggtgatggtcgaaacgttaggcgtttgtaagttttgttcggcggcggtaacgataatagtatcgttatgtgaaataggagtatcggtcggtttttgtgtttgcgttattttataaatttttagattgattaataaggttagggaa

SEQ ID NO: 22970 - DNA, 687 bp, Artificial Sequence
  chemically treated genomic DNA (Homo sapiens) CpG-island No: 22970
  misc_feature (436)..(436): n is either a, c, g or t
ttccctaaccttattaatcaatctaaaaatttataaaataacgcaaacacaaaaaccgaccgatactcctatttcacataacgatactattatcgttaccgccgccgaacaaaacttacaaacgcctaacgtttcgaccatcaccgcaaataaaatccgcaaaaacccgattacccgcgatatatcgaaaatcatccgtaccataccaaacgttaacctaaccgataactccaccaataatcaacgtaaaaataaccgacaaattaatattcgcgatataaatccgaaaaacacgctaattttaattaacgacaaaccgataaacaaccgtaactcgatacgtcaaaactaacgtaacgaacgcgatacccgtaataatacttcctaaataccacctaaaataattaaacgtattaaaattctacgtaatccgacnaatacgcgttataacaacgacgcgacgaacgacgtaattaacatcattaccaaaaaaaacaacgacgaataacacgactcctaaaacgcatatttcaatacgccaaaacataaaaaaaaaaataccaccaaacgcactaactttaacctaaccgatccgctaaacgacgaattcaacttccgtttatataacaacctcgacaaaacccaaataacgcgtaaaatatcaaccaaaaccatcaatccgcgcgt

SEQ ID NO: 22971 - DNA, 687 bp, Artificial Sequence
  chemically treated genomic DNA (Homo sapiens) CpG-island No: 22971
  misc_feature (436)..(436): n is either a, c, g or t
ttttttggttttgttggttaatttggggatttatggggtagcgtaggtataagagtcgatcgatatttttgttttatatgacgatattattgtcgttatcgtcgtcgagtagaatttataggcgtttggcgtttcgattattatcgtagatgaaattcgtaaaaattcggttgttcgcgatgtgtcgaagattattcgtattatgttaggcgttaatttgatcggtaattttattagtggttagcgtgggaataatcgatagattgatattcgcggtatgggttcggaaaatacgttgattttgattgacggtaagtcggtaagtagtcgtaattcggtgcgttagggttggcgtggcgagcgcgatattcgtggtgatattttttgggtgttatttgaaatgattgaacgtattgaagttttgcgtggttcggtnagtgcgcgttatggtaacggcgcggcgggcggcgtggttaatattattattaaaaaaggtagcggcgagtggtacggtttttgggacgtatattttaatgcgttagaatataaagaggaaggtgttattaaacgtattaattttagtttgatcggttcgttgggcgacgaatttagttttcgtttgtatggtaatttcgataaaatttaggtgacgcgtgggatattaattagggttattagttcgcgcgt

SEQ ID NO: 22972 - DNA, 687 bp, Artificial Sequence
  chemically treated genomic DNA (Homo sapiens) CpG-island No: 22972
  misc_feature (252)..(252): n is either a, c, g or t
acgcgcgaactaataaccctaattaatatcccacgcgtcacctaaattttatcgaaattaccatacaaacgaaaactaaattcgtcgcccaacgaaccgatcaaactaaaattaatacgtttaataacaccttcctctttatattctaacgcattaaaatatacgtcccaaaaaccgtaccactcgccgctaccttttttaataataatattaaccacgccgcccgccgcgccgttaccataacgcgcactnaccgaaccacgcaaaacttcaatacgttcaatcatttcaaataacacccaaaaaatatcaccacgaatatcgcgctcgccacgccaaccctaacgcaccgaattacgactacttaccgacttaccgtcaatcaaaatcaacgtattttccgaacccataccgcgaatatcaatctatcgattattcccacgctaaccactaataaaattaccgatcaaattaacgcctaacataatacgaataatcttcgacacatcgcgaacaaccgaatttttacgaatttcatctacgataataatcgaaacgccaaacgcctataaattctactcgacgacgataacgacaataatatcgtcatataaaacaaaaatatcgatcgactcttatacctacgctaccccataaatccccaaattaaccaacaaaaccaaaaaa

SEQ ID NO: 22973 - DNA, 634 bp, Artificial Sequence
  chemically treated genomic DNA (Homo sapiens) CpG-island No: 22973
atcgtgattaatcgttttatgtaatagtacgttcggttaatttgcgttaagtattatcggtatggtgttcgttggtgtagtaacggtagaaagattgattagcgttatacgtattgttttttttgtttatgtattcgtacggatttcgtcgtcgagatcggtaaggaagaatttataattaaaacgatcgtcgtcgttattggtatcgcgttcgcgtttgttatttttttcgacgagaacgtttacggaaagacgtattagcggacggatattcgtcgttagcgtgtcgtcggtggtcgtaattaaaattaatttatagatattattgaggttggtagttattttttgtacgcgtttgttcgtttcgcggtaattttatcgacgcgacgtaggatatttagtttttttttacggtttatgttttgtagcggatttatcgaggtatataacgggttatgttttatcgcgtttagcgtttgtattttattattattattattacggacgatggtgcgcgtcgtttgcgtattttgttttagcgttagtaggttgatttggttagcgtaagtaaattcggtttttttatcgttgattgtacgtatattaacgttttgatcgatgttgtaagaattat

SEQ ID NO: 22974 - DNA, 634 bp, Artificial Sequence
  chemically treated genomic DNA (Homo sapiens) CpG-island No: 22974
ataattcttacaacatcgatcaaaacgttaatatacgtacaatcaacgataaaaaaaccgaatttacttacgctaaccaaatcaacctactaacgctaaaacaaaatacgcaaacgacgcgcaccatcgtccgtaataataataataataaaatacaaacgctaaacgcgataaaacataacccgttatatacctcgataaatccgctacaaaacataaaccgtaaaaaaaaactaaatatcctacgtcgcgtcgataaaattaccgcgaaacgaacaaacgcgtacaaaaaataactaccaacctcaataatatctataaattaattttaattacgaccaccgacgacacgctaacgacgaatatccgtccgctaatacgtctttccgtaaacgttctcgtcgaaaaaaataacaaacgcgaacgcgataccaataacgacgacgatcgttttaattataaattcttccttaccgatctcgacgacgaaatccgtacgaatacataaacaaaaaaaacaatacgtataacgctaatcaatctttctaccgttactacaccaacgaacaccataccgataatacttaacgcaaattaaccgaacgtactattacataaaacgattaatcacgat

SEQ ID NO: 22975 - DNA, 634 bp, Artificial Sequence
  chemically treated genomic DNA (Homo sapiens) CpG-island No: 22975
atggtttttataatatcgattagggcgttggtgtgcgtgtaattagcggtgaaaaaatcggatttgtttacgttgattaaattagtttgttggcgttggaatagagtgcgtaagcggcgcgtattatcgttcgtgatagtggtgatggtaaagtatagacgttgggcgcggtagagtatagttcgttgtatatttcggtagattcgttgtaaagtatgagtcgtgaagagaagttggatattttgcgtcgcgtcgataaggttgtcgcgaagcggataagcgcgtataggaagtgattgttagttttagtggtgtttatgaattaattttggttgcggttatcgacggtacgttagcggcggatgttcgttcgttggtgcgttttttcgtgagcgttttcgtcgaagaagatggtaaacgcgaacgcggtgttagtggcggcggcggtcgttttggttatgaatttttttttgtcgatttcgacggcgaagttcgtgcggatgtatgggtaaaagaagtagtgcgtatggcgttggttaatttttttgtcgttgttgtattagcgggtattatgtcggtagtatttggcgtaggttggtcgggcgtgttgttgtatgaagcggttggttacggt

SEQ ID NO: 22976 - DNA, 634 bp, Artificial Sequence
  chemically treated genomic DNA (Homo sapiens) CpG-island No: 22976
accgtaaccaaccgcttcatacaacaacacgcccgaccaacctacgccaaatactaccgacataatacccgctaatacaacaacgacaaaaaaattaaccaacgccatacgcactacttcttttacccatacatccgcacgaacttcgccgtcgaaatcgacaaaaaaaaattcataaccaaaacgaccgccgccgccactaacaccgcgttcgcgtttaccatcttcttcgacgaaaacgctcacgaaaaaacgcaccaacgaacgaacatccgccgctaacgtaccgtcgataaccgcaaccaaaattaattcataaacaccactaaaactaacaatcacttcctatacgcgcttatccgcttcgcgacaaccttatcgacgcgacgcaaaatatccaacttctcttcacgactcatactttacaacgaatctaccgaaatatacaacgaactatactctaccgcgcccaacgtctatactttaccatcaccactatcacgaacgataatacgcgccgcttacgcactctattccaacgccaacaaactaatttaatcaacgtaaacaaatccgattttttcaccgctaattacacgcacaccaacgccctaatcgatattataaaaaccat

SEQ ID NO: 22977 - DNA, 520 bp, Artificial Sequence
  chemically treated genomic DNA (Homo sapiens) CpG-island No: 22977
tgtcgtcgcgatttttgtattcgaattcgatttgtaattgatgattatcgtcgcgggtaatgtttcggttgagaaaattattcgtaatgttttgtaattgttgtatttttggaatgcggagatttcgttcgtttaaggggtcgttgtgttattggtacgcgtatcgcgtgatgcggtatttgtgtacggcgaatcgggaatggttggttacgattttgttgagtataatcgaaagtcgttcgggatatcggcgtttttggcgattcgggatgttttgatgcgtgtattagagtttgttattttggtggttatcgggttcgttaattaatattgcgttgttatttttataatgttcggaatgtaagtcgtatattcgtcgtttggtgattatgggtggttttgtcggacgcggtaattgtacgttaaacgtcgagtttaatattgttgtcgatttagaagttgttgtttgtgtttttcgtagtggtattgaaatcgttatgtgcggtttggatgttattaa

SEQ ID NO: 22978 - DNA, 520 bp, Artificial Sequence
  chemically treated genomic DNA (Homo sapiens) CpG-island No: 22978
ttaataacatccaaaccgcacataacgatttcaataccactacgaaaaacacaaacaacaacttctaaatcgacaacaatattaaactcgacgtttaacgtacaattaccgcgtccgacaaaaccacccataatcaccaaacgacgaatatacgacttacattccgaacattataaaaataacaacgcaatattaattaacgaacccgataaccaccaaaataacaaactctaatacacgcatcaaaacatcccgaatcgccaaaaacgccgatatcccgaacgactttcgattatactcaacaaaatcgtaaccaaccattcccgattcgccgtacacaaataccgcatcacgcgatacgcgtaccaataacacaacgaccccttaaacgaacgaaatctccgcattccaaaaatacaacaattacaaaacattacgaataattttctcaaccgaaacattacccgcgacgataatcatcaattacaaatcgaattcgaatacaaaaatcgcgacgaca

SEQ ID NO: 22979 - DNA, 520 bp, Artificial Sequence
  chemically treated genomic DNA (Homo sapiens) CpG-island No: 22979
ttggtgatatttaaatcgtatatgacgattttaatattattgcggaagatataggtagtagtttttggatcggtagtaatattaaattcggcgtttggcgtatagttgtcgcgttcggtagaattatttatgattattagacggcgaatatacggtttgtatttcgggtattgtgaaagtaatagcgtaatattggttaacgggttcgatggttattagggtaataggttttggtgtacgtattagggtatttcgaatcgttagaaacgtcggtatttcgagcggttttcggttgtgtttaataaagtcgtagttagttattttcgattcgtcgtgtatagatgtcgtattacgcggtgcgcgtattagtggtatagcggttttttgggcgagcggaattttcgtattttagaaatgtagtagttgtagggtattgcgggtagtttttttaatcgagatattattcgcgacggtggttattagttgtaggtcgagttcgggtgtaaaaatcgcggcggta

SEQ ID NO: 22980 - DNA, 520 bp, Artificial Sequence
  chemically treated genomic DNA (Homo sapiens) CpG-island No: 22980
taccgccgcgatttttacacccgaactcgacctacaactaataaccaccgtcgcgaataatatctcgattaaaaaaactacccgcaataccctacaactactacatttctaaaatacgaaaattccgctcgcccaaaaaaccgctataccactaatacgcgcaccgcgtaatacgacatctatacacgacgaatcgaaaataactaactacgactttattaaacacaaccgaaaaccgctcgaaataccgacgtttctaacgattcgaaataccctaatacgtacaccaaaacctattaccctaataaccatcgaacccgttaaccaatattacgctattactttcacaatacccgaaatacaaaccgtatattcgccgtctaataatcataaataattctaccgaacgcgacaactatacgccaaacgccgaatttaatattactaccgatccaaaaactactacctatatcttccgcaataatattaaaatcgtcatatacgatttaaatatcaccaa

SEQ ID NO: 22981 - DNA, 554 bp, Artificial Sequence
  chemically treated genomic DNA (Homo sapiens) CpG-island No: 22981
aattattcgttgtggtatacgttgtggatcgttacggtttgtatgtggtggatgaagttaatattgaaatttacggtatggtgttaatgaatcgtttgatcgatgattcgcgttggttatcggcgatgagcgaacgcggaacgcgaatggtgtagcgcgatcgtaattattcgagtgtgattatttggtcgttggggaatgaattaggttacggcgttaattacgacgcgttgtatcgttggattaaatttgtcgatttttttcgttcggtgtagtatgaaggcggcggatatatttacggttatcgatattatttgttcgatgtacgcgcgcgtagattaagattagtttttttcggttgtgcgaaagtggtttattaaaaaatggttttcgttatttggagatacgcgttcgttgattttttgcgaatacgtttacgcgatgggtaatagttttggcggtttcgttaaatattggtaggcgttttatttttattttcgtttatagggcggtttcgtttgggattgggtggattagtcgttgattaaatatga

SEQ ID NO: 22982 - DNA, 554 bp, Artificial Sequence
  chemically treated genomic DNA (Homo sapiens) CpG-island No: 22982
tcatatttaatcaacgactaatccacccaatcccaaacgaaaccgccctataaacgaaaataaaaataaaacgcctaccaatatttaacgaaaccgccaaaactattacccatcgcgtaaacgtattcgcaaaaaatcaacgaacgcgtatctccaaataacgaaaaccattttttaataaaccactttcgcacaaccgaaaaaaactaatcttaatctacgcgcgcgtacatcgaacaaataatatcgataaccgtaaatatatccgccgccttcatactacaccgaacgaaaaaaatcgacaaatttaatccaacgatacaacgcgtcgtaattaacgccgtaacctaattcattccccaacgaccaaataatcacactcgaataattacgatcgcgctacaccattcgcgttccgcgttcgctcatcgccgataaccaacgcgaatcatcgatcaaacgattcattaacaccataccgtaaatttcaatattaacttcatccaccacatacaaaccgtaacgatccacaacgtataccacaacgaataatt

SEQ ID NO: 22983 - DNA, 554 bp, Artificial Sequence
  chemically treated genomic DNA (Homo sapiens) CpG-island No: 22983
ttatatttaattagcgattgatttatttagttttagacgaagtcgttttgtaaacggagatgaggatgaaacgtttgttagtatttagcgaaatcgttaagattgttatttatcgcgtgggcgtattcgtaaaggattagcgggcgcgtatttttaggtagcgaaagttattttttgatggattattttcgtatagtcgggaagggttggttttaatttacgcgcgcgtatatcgggtaaataatatcggtggtcgtggatgtgttcgtcgtttttatattgtatcgggcgggaaggatcgatagatttgatttagcgatatagcgcgtcgtgattagcgtcgtggtttgatttattttttagcgattagatgattatattcgggtgattacgatcgcgttgtattattcgcgtttcgcgttcgtttatcgtcgatagttagcgcggattatcggttagacgatttattggtattatgtcgtgggttttaatattggttttatttattatatataggtcgtagcggtttatagcgtgtattatagcggatggtt

SEQ ID NO: 22984 - DNA, 554 bp, Artificial Sequence
  chemically treated genomic DNA (Homo sapiens) CpG-island No: 22984
aaccatccgctataatacacgctataaaccgctacgacctatatataataaataaaaccaatattaaaacccacgacataataccaataaatcgtctaaccgataatccgcgctaactatcgacgataaacgaacgcgaaacgcgaataatacaacgcgatcgtaatcacccgaatataatcatctaatcgctaaaaaataaatcaaaccacgacgctaatcacgacgcgctatatcgctaaatcaaatctatcgatccttcccgcccgatacaatataaaaacgacgaacacatccacgaccaccgatattatttacccgatatacgcgcgcgtaaattaaaaccaacccttcccgactatacgaaaataatccatcaaaaaataactttcgctacctaaaaatacgcgcccgctaatcctttacgaatacgcccacgcgataaataacaatcttaacgatttcgctaaatactaacaaacgtttcatcctcatctccgtttacaaaacgacttcgtctaaaactaaataaatcaatcgctaattaaatataa

SEQ ID NO: 22985 - DNA, 847 bp, Artificial Sequence
  chemically treated genomic DNA (Homo sapiens) CpG-island No: 22985
tcggtgtgtgtcgtgtcggttcgtttgtagtggggattaagggtgatggtagagcggatgattaagtgttgtcgcgtgatgttagtagttcggtagtagcgttattgtaataatttcgtacggatgatgagcggatttatcggtattattacgatagttagtatcggttggtcgattatacgcggatataatatgaagagtcgttggtcgaaagtcgttatttttacgattcgttgggtcgtagggtggtaaaacgggtgtggcggcgtgaacgggatttgacgggttggatgtcgttgttacggaaatcgtaagtgatttggtacggttgggacggcgatcggttgattacgatatagaacgataggagtcgtatttagacgatttattagtcggggagttttacgttatttattagggtcgaaattgttatcggtgagttggcgaaaacgtagcgtcgtagtttggcggatgttttttagtagttcggcggcgaagacggtggtagtgtggtgttttcgtcggtgttggtgtagatgttcgatcggttggaaagtgaaattttggttgatcgggtgagtgaggaaagtcgtcgttggttggtatcgtgcggtttgatcgtggagtagatgtaaaattagatggattcggtatatacgtcggcgcgaaaaatttatttgtattattgcgattatcgcggtttgtcgttggtttttattagtacggaagggataatagcgtggtattagaatacgatgaatggggtaatttgttgaatgaagagaattcgtattagttgtagtagtttattcgtttgtcggggtagtagtatgatgaggagttcggt

SEQ ID NO: 22986 - DNA, 847 bp, Artificial Sequence
  chemically treated genomic DNA (Homo sapiens) CpG-island No: 22986
accgaactcctcatcatactactaccccgacaaacgaataaactactacaactaatacgaattctcttcattcaacaaattaccccattcatcgtattctaataccacgctattatcccttccgtactaataaaaaccaacgacaaaccgcgataatcgcaataatacaaataaatttttcgcgccgacgtatataccgaatccatctaattttacatctactccacgatcaaaccgcacgataccaaccaacgacgactttcctcactcacccgatcaaccaaaatttcactttccaaccgatcgaacatctacaccaacaccgacgaaaacaccacactaccaccgtcttcgccgccgaactactaaaaaacatccgccaaactacgacgctacgttttcgccaactcaccgataacaatttcgaccctaataaataacgtaaaactccccgactaataaatcgtctaaatacgactcctatcgttctatatcgtaatcaaccgatcgccgtcccaaccgtaccaaatcacttacgatttccgtaacaacgacatccaacccgtcaaatcccgttcacgccgccacacccgttttaccaccctacgacccaacgaatcgtaaaaataacgactttcgaccaacgactcttcatattatatccgcgtataatcgaccaaccgatactaactatcgtaataataccgataaatccgctcatcatccgtacgaaattattacaataacgctactaccgaactactaacatcacgcgacaacacttaatcatccgctctaccatcacccttaatccccactacaaacgaaccgacacgacacacaccga

SEQ ID NO: 22987 - DNA, 847 bp, Artificial Sequence
  chemically treated genomic DNA (Homo sapiens) CpG-island No: 22987
gtcggattttttattatattgttgtttcggtaggcggataagttgttgtagttgatgcgggttttttttatttagtaggttattttatttatcgtattttggtattacgttgttgtttttttcgtgttgataagggttagcggtaggtcgcgatggtcgtagtggtataggtggatttttcgcgtcggcgtgtatatcgggtttatttggttttgtatttgttttacggttaggtcgtacgatgttagttagcggcggttttttttatttattcggttagttaggattttattttttagtcggtcgagtatttgtattagtatcggcgggaatattatattgttatcgttttcgtcgtcggattgttgaagggtattcgttaggttgcggcgttgcgttttcgttagtttatcggtggtagtttcgattttgatgagtggcgtgaagtttttcggttgataaatcgtttggatgcggtttttgtcgttttgtatcgtggttagtcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggttttttatattgtgttcgcgtgtagtcgattagtcggtgttgattgtcgtaatggtatcggtgagttcgtttattattcgtgcggaattgttgtagtagcgttattatcgggttgttggtattacgcggtaatatttaattattcgttttgttattatttttagtttttattgtaggcgaatcgatacggtatatatcgg

SEQ ID NO: 22988 - DNA, 847 bp, Artificial Sequence
  chemically treated genomic DNA (Homo sapiens) CpG-island No: 22988
ccgatatataccgtatcgattcgcctacaataaaaactaaaaataataacaaaacgaataattaaatattaccgcgtaataccaacaacccgataataacgctactacaacaattccgcacgaataataaacgaactcaccgataccattacgacaatcaacaccgactaatcgactacacgcgaacacaatataaaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgactaaccacgatacaaaacgacaaaaaccgcatccaaacgatttatcaaccgaaaaacttcacgccactcatcaaaatcgaaactaccaccgataaactaacgaaaacgcaacgccgcaacctaacgaatacccttcaacaatccgacgacgaaaacgataacaatataatattcccgccgatactaatacaaatactcgaccgactaaaaaataaaatcctaactaaccgaataaataaaaaaaaccgccgctaactaacatcgtacgacctaaccgtaaaacaaatacaaaaccaaataaacccgatatacacgccgacgcgaaaaatccacctataccactacgaccatcgcgacctaccgctaacccttatcaacacgaaaaaaacaacaacgtaataccaaaatacgataaataaaataacctactaaataaaaaaaacccgcatcaactacaacaacttatccgcctaccgaaacaacaatataataaaaaatccgac

SEQ ID NO: 22989 - DNA, 537 bp, Artificial Sequence
  chemically treated genomic DNA (Homo sapiens) CpG-island No: 22989
gacgggcgatcggtttgttcgtcgcgattaatatgatcgttattaattggcgcgaaatgggttatgcggtgatagtttaatgcggtagatattttatttgtcgattcgtatttttggacgtttttcggtgtagttcgtgtggcgtaaatgtgcgacgattgggggttgatttggggttgttattttaataattatttcgatatttttttggcgatgtttatttatgtgggcgcggcggtatcgggtaattttatcgttatcgatacgtattggatttggtaggagggcgattgtcgtttgatttaaaattcgttggagattaaaaagggaaaaattgtcgtttttgatgcgttcggtttgggcgtggaattggattgggaataggtataaaaggtatatgaggtttataaacgtttgtttggcggtgcgcgtaacgacgtaggttcgatgtagtatttgattttcggttggatttttgatcgtaaacgtttcgttttcggtcgttattgattttgaaaaaggttttaaatatgagtt

SEQ ID NO: 22990 - DNA, 537 bp, Artificial Sequence
  chemically treated genomic DNA (Homo sapiens) CpG-island No: 22990
aactcatatttaaaacctttttcaaaatcaataacgaccgaaaacgaaacgtttacgatcaaaaatccaaccgaaaatcaaatactacatcgaacctacgtcgttacgcgcaccgccaaacaaacgtttataaacctcatataccttttatacctattcccaatccaattccacgcccaaaccgaacgcatcaaaaacgacaatttttccctttttaatctccaacgaattttaaatcaaacgacaatcgccctcctaccaaatccaatacgtatcgataacgataaaattacccgataccgccgcgcccacataaataaacatcgccaaaaaaatatcgaaataattattaaaataacaaccccaaatcaacccccaatcgtcgcacatttacgccacacgaactacaccgaaaaacgtccaaaaatacgaatcgacaaataaaatatctaccgcattaaactatcaccgcataacccatttcgcgccaattaataacgatcatattaatcgcgacgaacaaaccgatcgcccgtc

SEQ ID NO: 22991 - DNA, 537 bp, Artificial Sequence
  chemically treated genomic DNA (Homo sapiens) CpG-island No: 22991
gatttatatttaaggttttttttagaattaatgacggtcgaaaacgggacgtttacggttaaaggtttagtcggggattaggtattgtatcggatttgcgtcgttacgcgtatcgttaggtagacgtttataggttttatgtgttttttgtatttgtttttagtttagttttacgtttagatcgggcgtattaggaacggtaatttttttttttttaatttttagcggattttgggttaggcgataatcgtttttttgttaaatttagtgcgtatcgatagcggtaggattattcggtgtcgtcgcgtttatatgggtaaatatcgttagagagatatcgaaatggttattagaatggtagttttaggttagtttttagtcgtcgtatatttgcgttatacggattgtatcggaaagcgtttagaagtgcggatcggtaagtggaatatttatcgtattgggttattatcgtatgatttatttcgcgttagttggtggcgattatgttagtcgcgacgggtaagtcggtcgttcgtt

SEQ ID NO: 22992 - DNA, 537 bp, Artificial Sequence
  chemically treated genomic DNA (Homo sapiens) CpG-island No: 22992
aacgaacgaccgacttacccgtcgcgactaacataatcgccaccaactaacgcgaaataaatcatacgataataacccaatacgataaatattccacttaccgatccgcacttctaaacgctttccgatacaatccgtataacgcaaatatacgacgactaaaaactaacctaaaactaccattctaataaccatttcgatatctctctaacgatatttacccatataaacgcgacgacaccgaataatcctaccgctatcgatacgcactaaatttaacaaaaaaacgattatcgcctaacccaaaatccgctaaaaattaaaaaaaaaaaaattaccgttcctaatacgcccgatctaaacgtaaaactaaactaaaaacaaatacaaaaaacacataaaacctataaacgtctacctaacgatacgcgtaacgacgcaaatccgatacaatacctaatccccgactaaacctttaaccgtaaacgtcccgttttcgaccgtcattaattctaaaaaaaaccttaaatataaatc

SEQ ID NO: 22993 - DNA, 676 bp, Artificial Sequence
  chemically treated genomic DNA (Homo sapiens) CpG-island No: 22993
  misc_feature (568)..(568): n is either a, c, g or t
gttagcgtcgatattgtttgtttgtaggaagtgatgggcgcgtacgaagtttattcgttgtatgtggaaaattggttcgatatttcgtattacgagtttttcgtcgatattatgtggagcgattttgtttacggtcgtaatgtcgtatattcggaaggtattacggtaacgtcgtattgtcgcgttattttattgaatattatgagaatcgcgatgtttcggtcgatggtgcggaaaagcgcggcgtgttttattgtcgtattgtgtcgtcgatgatcggaaaagcgatttatgtgatgtgcgtatatttgggtttgcgtgaggcgtatcgttaggcgtagtttgcgatgttcgtcgaatgggtgaatgagttatcggacggcgaatcggtattggtggcgggtgattttaatgattggcggtaaaaagttaattattcgttaaaagtgtaggtcggattggatgagatttttattcgcgtttacggacgttcggcgcgtacgttttcggtgtaattttttttattacgattggataggatttacgttaaaaatgttagcgttaggtngttaatcgcgttgtcgttgcggatatggcgatatttttttgattatgtttttttaagtgcggagatttatttatgaaatgtagttggcgcgaaggtaataagatttag

SEQ ID NO: 22994 - DNA, 676 bp, Artificial Sequence
  chemically treated genomic DNA (Homo sapiens) CpG-island No: 22994
  misc_feature (109)..(109): n is either a, c, g or t
ctaaatcttattaccttcgcgccaactacatttcataaataaatctccgcacttaaaaaaacataatcaaaaaaatatcgccatatccgcaacgacaacgcgattaacnacctaacgctaacatttttaacgtaaatcctatccaatcgtaataaaaaaaattacaccgaaaacgtacgcgccgaacgtccgtaaacgcgaataaaaatctcatccaatccgacctacacttttaacgaataattaactttttaccgccaatcattaaaatcacccgccaccaataccgattcgccgtccgataactcattcacccattcgacgaacatcgcaaactacgcctaacgatacgcctcacgcaaacccaaatatacgcacatcacataaatcgcttttccgatcatcgacgacacaatacgacaataaaacacgccgcgcttttccgcaccatcgaccgaaacatcgcgattctcataatattcaataaaataacgcgacaatacgacgttaccgtaataccttccgaatatacgacattacgaccgtaaacaaaatcgctccacataatatcgacgaaaaactcgtaatacgaaatatcgaaccaattttccacatacaacgaataaacttcgtacgcgcccatcacttcctacaaacaaacaatatcgacgctaac

SEQ ID NO: 22995 - DNA, 676 bp, Artificial Sequence
  chemically treated genomic DNA (Homo sapiens) CpG-island No: 22995
  misc_feature (109)..(109): n is either a, c, g or t
ttggattttattgttttcgcgttagttatattttataaatgaattttcgtatttaaaggggtatgattagaaaggtgtcgttatgttcgtagcggtaacgcggttggtngtttggcgttggtatttttgacgtagattttgtttagtcgtagtagaggaaattgtatcggaaacgtgcgcgtcgggcgttcgtgggcgcgggtaaaaattttatttagttcggtttgtatttttaacggatgattagttttttgtcgttagttattgaaattattcgttattaatatcggttcgtcgttcggtagtttatttatttattcggcgagtatcgtaagttgcgtttgacggtgcgttttacgtaggtttagatgtacgtatattatatgaatcgttttttcggttatcggcggtataatgcggtagtagagtacgtcgcgttttttcgtattatcgatcgaaatatcgcgatttttataatgtttaatgggataacgcgatagtacggcgttgtcgtgatgtttttcgggtatacggtattgcgatcgtaggtaaaatcgttttatatagtgtcggcgagaaattcgtagtgcgaggtatcgggttagttttttatatgtagcggatgaatttcgtgcgcgtttattattttttgtaggtaaataatatcggcgttgat

SEQ ID NO: 22996 - DNA, 676 bp, Artificial Sequence
  chemically treated genomic DNA (Homo sapiens) CpG-island No: 22996
  misc_feature (568)..(568): n is either a, c, g or t
atcaacgccgatattatttacctacaaaaaataataaacgcgcacgaaattcatccgctacatataaaaaactaacccgatacctcgcactacgaatttctcgccgacactatataaaacgattttacctacgatcgcaataccgtatacccgaaaaacatcacgacaacgccgtactatcgcgttatcccattaaacattataaaaatcgcgatatttcgatcgataatacgaaaaaacgcgacgtactctactaccgcattataccgccgataaccgaaaaaacgattcatataatatacgtacatctaaacctacgtaaaacgcaccgtcaaacgcaacttacgatactcgccgaataaataaataaactaccgaacgacgaaccgatattaataacgaataatttcaataactaacgacaaaaaactaatcatccgttaaaaatacaaaccgaactaaataaaatttttacccgcgcccacgaacgcccgacgcgcacgtttccgatacaatttcctctactacgactaaacaaaatctacgtcaaaaataccaacgccaaacnaccaaccgcgttaccgctacgaacataacgacacctttctaatcatacccctttaaatacgaaaattcatttataaaatataactaacgcgaaaacaataaaatccaa

SEQ ID NO: 22997 - DNA, 500 bp, Artificial Sequence
  chemically treated genomic DNA (Homo sapiens) CpG-island No: 22997
gtagtagcgtaacgcggggttaaagcggaagttttgttggatggttacggttcgtcggattttagcgatgagtttgttaatgaattgacggtagttggcgtagtgtttcgttattacgattttcgttttcgtttttttggtatgcgtattaatgtgtttcgtcggatgtatcgtaaaattgtggtgatcgacgcgcgtatagtttttattggcgggttgaattatttcgtcgagtatatgtttagttacggtttagaggttaaataggattacgcggtacgttttgaagggtcgattgtcgaagatattttttagtttgagttggaaaatttgtttggatagagcgcggtacgacgttggtggcgacgttattataaagcggaagagaatcgttagtcgggagaagcgtaggtattgttggtttggcgcgataacgaagaatatcgcgatgatattgaacgttattatttgaaaatgtttatttaggcgcggcgggaagt

SEQ ID NO: 22998 - DNA, 500 bp, Artificial Sequence
  chemically treated genomic DNA (Homo sapiens) CpG-island No: 22998
acttcccgccgcgcctaaataaacattttcaaataataacgttcaatatcatcgcgatattcttcgttatcgcgccaaaccaacaatacctacgcttctcccgactaacgattctcttccgctttataataacgtcgccaccaacgtcgtaccgcgctctatccaaacaaattttccaactcaaactaaaaaatatcttcgacaatcgacccttcaaaacgtaccgcgtaatcctatttaacctctaaaccgtaactaaacatatactcgacgaaataattcaacccgccaataaaaactatacgcgcgtcgatcaccacaattttacgatacatccgacgaaacacattaatacgcataccaaaaaaacgaaaacgaaaatcgtaataacgaaacactacgccaactaccgtcaattcattaacaaactcatcgctaaaatccgacgaaccgtaaccatccaacaaaacttccgctttaaccccgcgttacgctactac

SEQ ID NO: 22999 - DNA, 500 bp, Artificial Sequence
  chemically treated genomic DNA (Homo sapiens) CpG-island No: 22999
atttttcgtcgcgtttgagtgagtatttttaaataatggcgtttaatattatcgcgatgtttttcgttatcgcgttagattagtaatatttgcgtttttttcggttggcggttttttttcgttttgtgatgacgtcgttattagcgtcgtgtcgcgttttgtttaggtaggttttttagtttaaattggagaatattttcgataatcggttttttaaggcgtatcgcgtaattttgtttagtttttggatcgtagttggatatatgttcggcggagtaatttagttcgttaataaaggttatacgcgcgtcgattattataattttgcgatgtattcggcgaaatatattggtgcgtatattaaaaaggcgagggcggggatcgtagtagcggaatattacgttagttgtcgttagtttattgataaatttatcgttgagattcggcgaatcgtagttatttagtaagattttcgttttaatttcgcgttgcgttgttgt

SEQ ID NO: 23000 - DNA, 500 bp, Artificial Sequence
  chemically treated genomic DNA (Homo sapiens) CpG-island No: 23000
acaacaacgcaacgcgaaattaaaacgaaaatcttactaaataactacgattcgccgaatctcaacgataaatttatcaataaactaacgacaactaacgtaatattccgctactacgatccccgccctcgcctttttaatatacgcaccaatatatttcgccgaatacatcgcaaaattataataatcgacgcgcgtataacctttattaacgaactaaattactccgccgaacatatatccaactacgatccaaaaactaaacaaaattacgcgatacgccttaaaaaaccgattatcgaaaatattctccaatttaaactaaaaaacctacctaaacaaaacgcgacacgacgctaataacgacgtcatcacaaaacgaaaaaaaaccgccaaccgaaaaaaacgcaaatattactaatctaacgcgataacgaaaaacatcgcgataatattaaacgccattatttaaaaatactcactcaaacgcgacgaaaaat

SEQ ID NO: 23001 - DNA, 894 bp, Artificial Sequence
  chemically treated genomic DNA (Homo sapiens) CpG-island No: 23001
tttattacgttgcgttagttacgttatgttcgtcgttatttgtaataatcgttgtgtaatatttcggaagtacgaaaattgtttttgagtattttgcgttatttcggagcggtgcggcgcgggttattgttaatgtatcgttatagcgtgttcggcgcgtatatgtcgtaatggtcgtatatcgtcgggtagatgtagtttgatttgttttacgtttatacggtggatgaatatattattcgcgtgatgttgaaattggagagttttgttagtgaagaaacgcgttacgttattcgttgtgtgtggacgtttggtcgcgtttgtcgttaattgagttgatttttatcgtcgcgttgttttacgatatcgttaaaggacgcggcggcgattattttattttcggtgtttaggatgtagtgtattttgtcgaattttacgggttgaatttacgcgaaatatagttggtcgtttggttggttcgttagtatttgttgatgtcggtgatcgtttaacgtcgcgatatttaggattcggaagttattaagtagtttgtcgaagaagtgtaaacggaaaatcgtttgcgttatttggtatgtttgattgtggttgatatttgcgttattaacgagacgttgtggattagttggaagtaaagtttgttgcgtaattttattttgttatcggaaattagttacgacgcggaatgcgaaatacgtcggatatgcgcgaacgggtttatttggttggttgtttttttgcgtaaattacgttttaacgatcggcgtaacgaatcggaatatatcggatcggtattgacgaaatttacgttatttagttgcgcggcggtgattttttttttatgtgttaaagggtgattaatcggtaatataatta

SEQ ID NO: 23002 - DNA, 894 bp, Artificial Sequence
  chemically treated genomic DNA (Homo sapiens) CpG-island No: 23002
taattatattaccgattaatcaccctttaacacataaaaaaaaaatcaccgccgcgcaactaaataacgtaaatttcgtcaataccgatccgatatattccgattcgttacgccgatcgttaaaacgtaatttacgcaaaaaaacaaccaaccaaataaacccgttcgcgcatatccgacgtatttcgcattccgcgtcgtaactaatttccgataacaaaataaaattacgcaacaaactttacttccaactaatccacaacgtctcgttaataacgcaaatatcaaccacaatcaaacataccaaataacgcaaacgattttccgtttacacttcttcgacaaactacttaataacttccgaatcctaaatatcgcgacgttaaacgatcaccgacatcaacaaatactaacgaaccaaccaaacgaccaactatatttcgcgtaaattcaacccgtaaaattcgacaaaatacactacatcctaaacaccgaaaataaaataatcgccgccgcgtcctttaacgatatcgtaaaacaacgcgacgataaaaatcaactcaattaacgacaaacgcgaccaaacgtccacacacaacgaataacgtaacgcgtttcttcactaacaaaactctccaatttcaacatcacgcgaataatatattcatccaccgtataaacgtaaaacaaatcaaactacatctacccgacgatatacgaccattacgacatatacgcgccgaacacgctataacgatacattaacaataacccgcgccgcaccgctccgaaataacgcaaaatactcaaaaacaattttcgtacttccgaaatattacacaacgattattacaaataacgacgaacataacgtaactaacgcaacgtaataaa

SEQ ID NO: 23003 - DNA, 894 bp, Artificial Sequence
  chemically treated genomic DNA (Homo sapiens) CpG-island No: 23003
tggttgtgttatcggttgattattttttagtatatgaaaaagagattatcgtcgcgtaattggatggcgtgaatttcgttagtatcgattcggtgtatttcggttcgttgcgtcgatcgttaaagcgtggtttgcgtaagaaaatagttagttaaataaattcgttcgcgtatattcggcgtgtttcgtatttcgcgtcgtagttgattttcggtggtaaagtagagttacgtaatagattttgtttttagttaatttatagcgtttcgttggtggcgtaaatgttagttatagttaggtatattagatagcgtagacgatttttcgtttgtattttttcggtaaattgtttgatgattttcgggttttgaatatcgcggcgttgggcggttatcgatattaataggtgttggcgaattagttaggcgattagttgtgtttcgcgtgagtttagttcgtggagttcggtaaaatgtattatattttgagtatcgagaatggagtggtcgtcgtcgcgttttttggcgatatcgtgaaatagcgcggcgatgaaaattagtttagttgacggtaggcgcggttagacgtttatatataacggatggcgtggcgcgtttttttattggtaaaattttttagttttagtattacgcggatagtatgtttatttatcgtgtaggcgtggaatagattaaattgtatttgttcgacgatatgcgattattgcggtatatacgcgtcgagtacgttatggcgatgtattggtaatagttcgcgtcgtatcgtttcggggtgacgtagaatgtttaaaaatagttttcgtgttttcggaatattatatagcggttgttgtagatggcgacgggtatggcgtaattggcgtagcgtggtgga

SEQ ID NO: 23004 - DNA, 894 bp, Artificial Sequence
  chemically treated genomic DNA (Homo sapiens) CpG-island No: 23004
tccaccacgctacgccaattacgccatacccgtcgccatctacaacaaccgctatataatattccgaaaacacgaaaactatttttaaacattctacgtcaccccgaaacgatacgacgcgaactattaccaatacatcgccataacgtactcgacgcgtatataccgcaataatcgcatatcgtcgaacaaatacaatttaatctattccacgcctacacgataaataaacatactatccgcgtaatactaaaactaaaaaattttaccaataaaaaaacgcgccacgccatccgttatatataaacgtctaaccgcgcctaccgtcaactaaactaattttcatcgccgcgctatttcacgatatcgccaaaaaacgcgacgacgaccactccattctcgatactcaaaatataatacattttaccgaactccacgaactaaactcacgcgaaacacaactaatcgcctaactaattcgccaacacctattaatatcgataaccgcccaacgccgcgatattcaaaacccgaaaatcatcaaacaatttaccgaaaaaatacaaacgaaaaatcgtctacgctatctaatatacctaactataactaacatttacgccaccaacgaaacgctataaattaactaaaaacaaaatctattacgtaactctactttaccaccgaaaatcaactacgacgcgaaatacgaaacacgccgaatatacgcgaacgaatttatttaactaactattttcttacgcaaaccacgctttaacgatcgacgcaacgaaccgaaatacaccgaatcgatactaacgaaattcacgccatccaattacgcgacgataatctctttttcatatactaaaaaataatcaaccgataacacaacca

SEQ ID NO: 23005 - DNA, 614 bp, Artificial Sequence
  chemically treated genomic DNA (Homo sapiens) CpG-island No: 23005
  misc_feature (481)..(481): n is either a, c, g or t
  misc_feature (489)..(489): n is either a, c, g or t
  misc_feature (500)..(501): n is either a, c, g or t
  misc_feature (550)..(550): n is either a, c, g or t
  misc_feature (582)..(582): n is either a, c, g or t
  misc_feature (608)..(608): n is either a, c, g or t
tggtggtcggtagtacgttataggagatgttcgacgcgggttattagtaggtaggtcgcgatttttttgtgtttttgtattcgtaaacgtatgaagagtatgcgttggtacgtatcgaacggaaattcggtttcggttatatcggttttatttgttatgtcgtatcggatgttacgttggaagatgattttaagcgtcgcgatttgattattaatgcgttggtttaggacgataacggcgagattatcgattcgtataacggtttgggcgatttgtaaaatcgtttgttgcgttatgtttttttcgtttttggcgaagattcgttacgcgtattgcgcgtggcgcgttttgttgcgcgttatgtttatttcggttttcgtattgtcgatgaaattttggcgttgatgcgcgagatgatttatgcgggtgaattggaatatttgacgtttgaacgggtatggaaagagatcgaaagcgtttnttatattngtaatttatanngtgttttttaggtattgcgcgattgcggttattgcggtttttatttttngaaattacgtattgtttggcgttttagttttngtaaggtgtattcggaaatcgatatnggtatt

SEQ ID NO: 23006 - DNA, 614 bp, Artificial Sequence
  chemically treated genomic DNA (Homo sapiens) CpG-island No: 23006
  misc_feature (7)..(7): n is either a, c, g or t
  misc_feature (33)..(33): n is either a, c, g or t
  misc_feature (65)..(65): n is either a, c, g or t
  misc_feature (114)..(115): n is either a, c, g or t
  misc_feature (126)..(126): n is either a, c, g or t
  misc_feature (134)..(134): n is either a, c, g or t
aataccnatatcgatttccgaatacaccttacnaaaactaaaacgccaaacaatacgtaatttcnaaaaataaaaaccgcaataaccgcaatcgcgcaatacctaaaaaacacnntataaattacnaatataanaaacgctttcgatctctttccatacccgttcaaacgtcaaatattccaattcacccgcataaatcatctcgcgcatcaacgccaaaatttcatcgacaatacgaaaaccgaaataaacataacgcgcaacaaaacgcgccacgcgcaatacgcgtaacgaatcttcgccaaaaacgaaaaaaacataacgcaacaaacgattttacaaatcgcccaaaccgttatacgaatcgataatctcgccgttatcgtcctaaaccaacgcattaataatcaaatcgcgacgcttaaaatcatcttccaacgtaacatccgatacgacataacaaataaaaccgatataaccgaaaccgaatttccgttcgatacgtaccaacgcatactcttcatacgtttacgaatacaaaaacacaaaaaaatcgcgacctacctactaataacccgcgtcgaacatctcctataacgtactaccgaccacca

SEQ ID NO: 23007 - DNA, 614 bp, Artificial Sequence
  chemically treated genomic DNA (Homo sapiens) CpG-island No: 23007
  misc_feature (7)..(7): n is either a, c, g or t
  misc_feature (33)..(33): n is either a, c, g or t
  misc_feature (65)..(65): n is either a, c, g or t
  misc_feature (114)..(115): n is either a, c, g or t
  misc_feature (126)..(126): n is either a, c, g or t
  misc_feature (134)..(134): n is either a, c, g or t
aatattngtatcgattttcggatgtattttgtnagggttggaacgttaaatagtgcgtaattttngggaataaaaatcgtagtggtcgtaatcgcgtagtatttggaagatatnntgtggattgtnggtgtgangggcgttttcggtttttttttatattcgtttaggcgttaggtgttttagtttattcgtatgggttatttcgcgtattaacgttagagttttatcggtaatacgaaaatcgaggtgggtataacgcgtagtaaaacgcgttacgcgtaatacgcgtaacggattttcgttaaaagcgggggaaatatggcgtaatagacgattttgtagatcgtttagatcgttgtacgggtcgataatttcgtcgttatcgttttgggttagcgtattaatggttagatcgcgacgtttaagattattttttagcgtgatattcggtgcggtatagtaagtaaaatcggtgtaatcggaatcggattttcgttcggtacgtgttagcgtatattttttatgcgtttgcggatgtagaaatataggaaaatcgcggtttatttgttggtagttcgcgtcgagtattttttgtggcgtattgtcgattatta

SEQ ID NO: 23008 - DNA, 614 bp, Artificial Sequence
  chemically treated genomic DNA (Homo sapiens) CpG-island No: 23008
  misc_feature (481)..(481): n is either a, c, g or t
  misc_feature (489)..(489): n is either a, c, g or t
  misc_feature (500)..(501): n is either a, c, g or t
  misc_feature (550)..(550): n is either a, c, g or t
  misc_feature (582)..(582): n is either a, c, g or t
  misc_feature (608)..(608): n is either a, c, g or t
taataatcgacaatacgccacaaaaaatactcgacgcgaactaccaacaaataaaccgcgattttcctatatttctacatccgcaaacgcataaaaaatatacgctaacacgtaccgaacgaaaatccgattccgattacaccgattttacttactataccgcaccgaatatcacgctaaaaaataatcttaaacgtcgcgatctaaccattaatacgctaacccaaaacgataacgacgaaattatcgacccgtacaacgatctaaacgatctacaaaatcgtctattacgccatatttcccccgcttttaacgaaaatccgttacgcgtattacgcgtaacgcgttttactacgcgttatacccacctcgattttcgtattaccgataaaactctaacgttaatacgcgaaataacccatacgaataaactaaaacacctaacgcctaaacgaatataaaaaaaaaccgaaaacgcccntcacaccnacaatccacannatatcttccaaatactacgcgattacgaccactacgatttttattcccnaaaattacgcactatttaacgttccaaccctnacaaaatacatccgaaaatcgatacnaatatt

SEQ ID NO: 23009 - DNA, 549 bp, Artificial Sequence
  chemically treated genomic DNA (Homo sapiens) CpG-island No: 23009
ggttcggcggatttagtttttagtaatttgattatttggaaaggttttgtttcgttgaaggaagatttagcgggtaattatatttattacggggtgcgtgaatttggtatgattcgtatcgttaacggtatcgcgtattacggcggttttgtgtcgtatatcgcgacgtttttgatgtttgttgaatacgttcgtaacgtcgcgcggatggcggtattgatgaaagcgcggtagattatggtttatatttacgatttaattggtttgggcgaagatggttcgacgtattaggttgttgagtaattggttagtttgcgtttaacgttaaattttagtatttggcgatcgtgcgattaggtggaagcggcggtgggttggaagttggcggttgagcgttataacggatcgacggtattgatttttttaaggtagaatttggtttaggtggaacgtacgtcggattaggttaaagagattgttcgtggcggttatgtgttgaaagatagcggcggtaagttagatattattttgattgttatcggtttagag

SEQ ID NO: 23010 - DNA, 549 bp, Artificial Sequence
  chemically treated genomic DNA (Homo sapiens) CpG-island No: 23010
ctctaaaccgataacaatcaaaataatatctaacttaccgccgctatctttcaacacataaccgccacgaacaatctctttaacctaatccgacgtacgttccacctaaaccaaattctaccttaaaaaaatcaataccgtcgatccgttataacgctcaaccgccaacttccaacccaccgccgcttccacctaatcgcacgatcgccaaatactaaaatttaacgttaaacgcaaactaaccaattactcaacaacctaatacgtcgaaccatcttcgcccaaaccaattaaatcgtaaatataaaccataatctaccgcgctttcatcaataccgccatccgcgcgacgttacgaacgtattcaacaaacatcaaaaacgtcgcgatatacgacacaaaaccgccgtaatacgcgataccgttaacgatacgaatcataccaaattcacgcaccccgtaataaatataattacccgctaaatcttccttcaacgaaacaaaacctttccaaataatcaaattactaaaaactaaatccgccgaacc

SEQ ID NO: 23011 - DNA, 549 bp, Artificial Sequence
  chemically treated genomic DNA (Homo sapiens) CpG-island No: 23011
ttttgaatcggtggtaattagaataatatttggtttatcgtcgttgttttttagtatataatcgttacgagtaatttttttaatttgattcggcgtacgttttatttgggttagattttgttttgagaggattagtgtcgtcggttcgttgtggcgtttaatcgttagtttttagtttatcgtcgtttttatttgatcgtacggtcgttaggtgttgaaatttggcgttaagcgtaggttggttagttgtttaatagtttggtgcgtcggattattttcgtttaggttaattgagtcgtgggtataaattataatttgtcgcgtttttattagtgtcgttattcgcgcggcgttacgggcgtatttaataaatattaggaacgtcgcggtatacggtataaagtcgtcgtggtgcgcgatgtcgttggcgatacgggttatgttaaatttacgtatttcgtagtgaatgtagttgttcgttggatttttttttagcgaaatagaatttttttagatggttaggttgttgggagttagattcgtcgaatt

SEQ ID NO: 23012 - DNA, 549 bp, Artificial Sequence
  chemically treated genomic DNA (Homo sapiens) CpG-island No: 23012
aattcgacgaatctaactcccaacaacctaaccatctaaaaaaattctatttcgctaaaaaaaaatccaacgaacaactacattcactacgaaatacgtaaatttaacataacccgtatcgccaacgacatcgcgcaccacgacgactttataccgtataccgcgacgttcctaatatttattaaatacgcccgtaacgccgcgcgaataacgacactaataaaaacgcgacaaattataatttatacccacgactcaattaacctaaacgaaaataatccgacgcaccaaactattaaacaactaaccaacctacgcttaacgccaaatttcaacacctaacgaccgtacgatcaaataaaaacgacgataaactaaaaactaacgattaaacgccacaacgaaccgacgacactaatcctctcaaaacaaaatctaacccaaataaaacgtacgccgaatcaaattaaaaaaattactcgtaacgattatatactaaaaaacaacgacgataaaccaaatattattctaattaccaccgattcaaaa

SEQ ID NO: 23013 - DNA, 1069 bp, Artificial Sequence
  chemically treated genomic DNA (Homo sapiens) CpG-island No: 23013
  misc_feature (958)..(958): n is either a, c, g or t
tttcgatcgatattttcgacgtttaggatgaggaatatcgggagtcggtgttgttttttaacgttgcggtttgcgacgtaaaacgcgaggtggtgtatgatttacgtttttcgtcgattatttattatttgtttgttgttggttttcgtttgtgtggttgtaggtatttggggattacgtagcggtgtcgttacgttggaaatttcgtaggtattcgtcgcgttgatgggcgatgcgtcgcgtagtatgacgatggtggttatcgaatggcgtttattacgcgtgttgatggcgttgttgattggcgtacgattgggcgttagtggcgttattttttagtcgttgatgcgtaattcgttcggtagttttgacgtaatgggttttaatatcggggcgtggagcggcgtgttggtggcgatggtgttgtttggttaggatttgacggttatcgcgttgttagtaatggtgggcggtattgttatttcgttgttggtttggttgttcgtttggcgtaacggtatcgatatttttcggttgattattatcggtatcggcgttcgcgttatgttggtggtttttaatatttggttgttgttgaaagcgtttttagaaacggcgttaatagtaggtttgtggaatgtcggatcgtttaacggtttgacgtgggtaaaaatttcgtttttcgtatttattattatattgatgtttattgtcgtcgttttattggtacgtcggatgcgtttgttggaaatgggcgatgatatcgcgtgtgcgttgggcgttagcgtcgaacgttcgcgtttgttaatgatgttggttgtagtggtgtttatcgttgcggtaatagcgtttgtcgggtcgattttttttattgttttagtcgtatcgtatattgttcgacgtattagcggtatcgttcgttgggggttaatttaggcggcgttatgcggggcgttgntattgttggcggtcgatttttgcgtttaataattgtttatgtcgtattaattttcggttggcgtcgttatcgttagtttcggcggtatttattttatcgttttgttaattt

SEQ ID NO: 23014 - DNA, 1069 bp, Artificial Sequence
  chemically treated genomic DNA (Homo sapiens) CpG-island No: 23014
  misc_feature (112)..(112): n is either a, c, g or t
aaattaacaaaacgataaaataaataccgccgaaactaacgataacgacgccaaccgaaaattaatacgacataaacaattattaaacgcaaaaatcgaccgccaacaatancaacgccccgcataacgccgcctaaattaacccccaacgaacgataccgctaatacgtcgaacaatatacgatacgactaaaacaataaaaaaaatcgacccgacaaacgctattaccgcaacgataaacaccactacaaccaacatcattaacaaacgcgaacgttcgacgctaacgcccaacgcacacgcgatatcatcgcccatttccaacaaacgcatccgacgtaccaataaaacgacgacaataaacatcaatataataataaatacgaaaaacgaaatttttacccacgtcaaaccgttaaacgatccgacattccacaaacctactattaacgccgtttctaaaaacgctttcaacaacaaccaaatattaaaaaccaccaacataacgcgaacgccgataccgataataatcaaccgaaaaatatcgataccgttacgccaaacgaacaaccaaaccaacaacgaaataacaataccgcccaccattactaacaacgcgataaccgtcaaatcctaaccaaacaacaccatcgccaccaacacgccgctccacgccccgatattaaaacccattacgtcaaaactaccgaacgaattacgcatcaacgactaaaaaataacgccactaacgcccaatcgtacgccaatcaacaacgccatcaacacgcgtaataaacgccattcgataaccaccatcgtcatactacgcgacgcatcgcccatcaacgcgacgaatacctacgaaatttccaacgtaacgacaccgctacgtaatccccaaatacctacaaccacacaaacgaaaaccaacaacaaacaaataataaataatcgacgaaaaacgtaaatcatacaccacctcgcgttttacgtcgcaaaccgcaacgttaaaaaacaacaccgactcccgatattcctcatcctaaacgtcgaaaatatcgatcgaaa

SEQ ID NO: 23015 - DNA, 1069 bp, Artificial Sequence
  chemically treated genomic DNA (Homo sapiens) CpG-island No: 23015
  misc_feature (112)..(112): n is either a, c, g or t
gaattaataagacgataaggtaaatatcgtcgaggttgacggtaacgacgttaatcggaagttgatacggtataaatagttgttgggcgtagagatcggtcgttagtagtantagcgtttcgtatagcgtcgtttgggttagtttttagcgagcggtgtcgttaatgcgtcgggtaatgtgcggtgcgattaaagtaataaaggaaatcggttcggtaagcgttgttgtcgtagcggtaagtattattgtaattagtattattaatagacgcgaacgttcgacgttgacgtttagcgtatacgcggtattatcgtttatttttagtaagcgtattcggcgtattagtaaggcggcggtaatgagtattaatataatgatgggtgcggaaggcgaggtttttgtttacgttaggtcgttgagcgattcggtattttataaatttgttgttagcgtcgtttttaaagacgtttttagtaatagttaggtattaaaggttattagtatggcgcgaacgtcgatatcgataataattaatcgaaaggtgtcgatgtcgttgcgttaggcgagtagttagattagtagcgaagtgataatgtcgtttattattgttgatagcgcgatagtcgttaggttttgattaaatagtattatcgttattagtacgtcgttttacgtttcggtgttaaagtttattacgttagggttgtcgagcgggttacgtattagcgattgaaaaatagcgttattgacgtttagtcgtgcgttaattaatagcgttattagtacgcgtggtaaacgttattcggtgattattatcgttatattgcgcggcgtatcgtttattagcgcggcgaatatttgcgaggtttttagcgtgacggtatcgttgcgtaatttttagatatttgtaattatataggcggaaattagtagtaaataggtgatgagtaatcggcgagagacgtaaattatgtattatttcgcgttttacgtcgtaagtcgtaacgttagaaggtaatatcgattttcgatattttttattttgggcgtcgaaaatatcggtcgagg

SEQ ID NO: 23016 - DNA, 1069 bp, Artificial Sequence
  chemically treated genomic DNA (Homo sapiens) CpG-island No: 23016
  misc_feature (958)..(958): n is either a, c, g or t
cctcgaccgatattttcgacgcccaaaataaaaaatatcgaaaatcgatattaccttctaacgttacgacttacgacgtaaaacgcgaaataatacataatttacgtctctcgccgattactcatcacctatttactactaatttccgcctatataattacaaatatctaaaaattacgcaacgataccgtcacgctaaaaacctcgcaaatattcgccgcgctaataaacgatacgccgcgcaatataacgataataatcaccgaataacgtttaccacgcgtactaataacgctattaattaacgcacgactaaacgtcaataacgctatttttcaatcgctaatacgtaacccgctcgacaaccctaacgtaataaactttaacaccgaaacgtaaaacgacgtactaataacgataatactatttaatcaaaacctaacgactatcgcgctatcaacaataataaacgacattatcacttcgctactaatctaactactcgcctaacgcaacgacatcgacacctttcgattaattattatcgatatcgacgttcgcgccatactaataacctttaatacctaactattactaaaaacgtctttaaaaacgacgctaacaacaaatttataaaataccgaatcgctcaacgacctaacgtaaacaaaaacctcgccttccgcacccatcattatattaatactcattaccgccgccttactaatacgccgaatacgcttactaaaaataaacgataataccgcgtatacgctaaacgtcaacgtcgaacgttcgcgtctattaataatactaattacaataatacttaccgctacgacaacaacgcttaccgaaccgatttcctttattactttaatcgcaccgcacattacccgacgcattaacgacaccgctcgctaaaaactaacccaaacgacgctatacgaaacgctantactactaacgaccgatctctacgcccaacaactatttataccgtatcaacttccgattaacgtcgttaccgtcaacctcgacgatatttaccttatcgtcttattaattc

SEQ ID NO: 23017 - DNA, 554 bp, Artificial Sequence
  chemically treated genomic DNA (Homo sapiens) CpG-island No: 23017
acgtttgtttatgggtatgtttggttggatggcgagtatatttaatattacgttagtaaagaggttgtacgtcggattggtttgttggcgtaaaatgttattacgtcgggcgatattatcgtgtaggagttggtggcgcgtggacgttattcgtattaatcgttgtttattcgttggcgtaaagaggatgaagaagcggtaacgaaagtaatgtaggttacgggaataatttatttggtagattaaagcgtggatattttttttggcggataacgtagcgagcgtggatcgcgatggtgttggtttaggaaacggtaattatgttgttcgacgaatttacgatttggttggatattagttattgtggggataattcggttttatcggttttagttttaatttcgagcgggttacgtttagttgcggcgtagaaggtagttagtttatacgttcggcgcgaacgttgaaattaattagatgatcgttgtatttattggtatcggcgagcggggaaagtaatttttgagtagagatttttttatagcgttattggt

SEQ ID NO: 23018 - DNA, 554 bp, Artificial Sequence
  chemically treated genomic DNA (Homo sapiens) CpG-island No: 23018
accaataacgctataaaaaaatctctactcaaaaattactttccccgctcgccgataccaataaatacaacgatcatctaattaatttcaacgttcgcgccgaacgtataaactaactaccttctacgccgcaactaaacgtaacccgctcgaaattaaaactaaaaccgataaaaccgaattatccccacaataactaatatccaaccaaatcgtaaattcgtcgaacaacataattaccgtttcctaaaccaacaccatcgcgatccacgctcgctacgttatccgccaaaaaaaatatccacgctttaatctaccaaataaattattcccgtaacctacattactttcgttaccgcttcttcatcctctttacgccaacgaataaacaacgattaatacgaataacgtccacgcgccaccaactcctacacgataatatcgcccgacgtaataacattttacgccaacaaaccaatccgacgtacaacctctttactaacgtaatattaaatatactcgccatccaaccaaacatacccataaacaaacgt

SEQ ID NO: 23019 - DNA, 554 bp, Artificial Sequence
  chemically treated genomic DNA (Homo sapiens) CpG-island No: 23019
gttaatggcgttatgaaaaagtttttgtttaggagttatttttttcgttcgtcgatgttagtaagtatagcggttatttgattgattttaacgttcgcgtcgaacgtatgggttggttattttttgcgtcgtagttgggcgtaattcgttcgggattaaagttgaagtcgataaggtcggattatttttatagtgattgatatttagttaggtcgtgggttcgtcgagtagtataattgtcgttttttgggttagtattatcgcgatttacgttcgttgcgttgttcgttagaaagggtatttacgttttgatttgttagatgagttattttcgtggtttgtattgttttcgttatcgtttttttattttttttgcgttagcgggtaaatagcggttgatgcggataacgtttacgcgttattagtttttgtacggtgatatcgttcggcgtggtagtattttgcgttaatagattaattcggcgtgtaatttttttattggcgtaatgttgaatgtgttcgttatttagttagatatgtttatgagtaggcgt

SEQ ID NO: 23020 - DNA, 554 bp, Artificial Sequence
  chemically treated genomic DNA (Homo sapiens) CpG-island No: 23020
acgcctactcataaacatatctaactaaataacgaacacattcaacattacgccaataaaaaaattacacgccgaattaatctattaacgcaaaatactaccacgccgaacgatatcaccgtacaaaaactaataacgcgtaaacgttatccgcatcaaccgctatttacccgctaacgcaaaaaaaataaaaaaacgataacgaaaacaatacaaaccacgaaaataactcatctaacaaatcaaaacgtaaataccctttctaacgaacaacgcaacgaacgtaaatcgcgataatactaacccaaaaaacgacaattatactactcgacgaacccacgacctaactaaatatcaatcactataaaaataatccgaccttatcgacttcaactttaatcccgaacgaattacgcccaactacgacgcaaaaaataaccaacccatacgttcgacgcgaacgttaaaatcaatcaaataaccgctatacttactaacatcgacgaacgaaaaaaataactcctaaacaaaaactttttcataacgccattaac

SEQ ID NO: 23021 - DNA, 968 bp, Artificial Sequence
  chemically treated genomic DNA (Homo sapiens) CpG-island No: 23021
  misc_feature (830)..(830): n is either a, c, g or t
  misc_feature (866)..(866): n is either a, c, g or t
  misc_feature (933)..(933): n is either a, c, g or t
  misc_feature (937)..(937): n is either a, c, g or t
tagtagcgcgtagtatacgatttgtagcgtagtaatcgtcgcgtttttttagtattattagtatcggtatgtcggtgtagcgacgtatatagtcggtgaaatattggtttgggttgtcgaggtggaatttacgtagtattacgtggtttatcgttagcgttattgtcgtatcggtgttttgtttcggtgttagttatagatcgtatagtttggcgattttagcgtagtttggtgtgacggtaatagttttggtttttttgtaacgtattttagtaaagaagtgagtattcggggtacgcgtttgcggtacgtttgatttttaggcgatgatgtagttggagttgtattagttagtagatttcggtacgttagtttgttcgttttaggtttgcggagacgtaggaggtaagtcgtagtattagtcgtagaagtttaagtaagtatcgttaattagcgagagatagcgtgtattcgatgcgtaagaaattatcgatattgtcggaattggcgagaaattagtaatacggttcgggtcgtagtttttgatggtgtaaacgttagatgcggcgattagttcgtttattttttgttaggaagaacgaataaatttatcgcgtttacgcgtttgtttaaagtttttcgttttatcggcgtttttaatgatagaagtttatgttttaatcggatcgttatgtagcgttttcgttttacgttatatttttattaggcgtttgcgtattatcgggtattttaggcggttggtattgtaaagatattaggagtagttggtatcgcgcgggtagttgcgagtttatggtttggtagatttngaacggtacgcggatagttagtttgttgggtttttnaggtgatagatcgtttttgacgtagatttttttagttgtagagtaggtgtagtttattcgtgggtanagtngacgattttgttatgttgttaaacgttgcga

SEQ ID NO: 23022 - DNA, 968 bp, Artificial Sequence
  chemically treated genomic DNA (Homo sapiens) CpG-island No: 23022
  misc_feature (32)..(32): n is either a, c, g or t
  misc_feature (36)..(36): n is either a, c, g or t
  misc_feature (103)..(103): n is either a, c, g or t
  misc_feature (139)..(139): n is either a, c, g or t
tcgcaacgtttaacaacataacaaaatcgtcnactntacccacgaataaactacacctactctacaactaaaaaaatctacgtcaaaaacgatctatcacctnaaaaacccaacaaactaactatccgcgtaccgttcnaaatctaccaaaccataaactcgcaactacccgcgcgataccaactactcctaatatctttacaataccaaccgcctaaaatacccgataatacgcaaacgcctaataaaaatataacgtaaaacgaaaacgctacataacgatccgattaaaacataaacttctatcattaaaaacgccgataaaacgaaaaactttaaacaaacgcgtaaacgcgataaatttattcgttcttcctaacaaaaaataaacgaactaatcgccgcatctaacgtttacaccatcaaaaactacgacccgaaccgtattactaatttctcgccaattccgacaatatcgataatttcttacgcatcgaatacacgctatctctcgctaattaacgatacttacttaaacttctacgactaatactacgacttacctcctacgtctccgcaaacctaaaacgaacaaactaacgtaccgaaatctactaactaatacaactccaactacatcatcgcctaaaaatcaaacgtaccgcaaacgcgtaccccgaatactcacttctttactaaaatacgttacaaaaaaaccaaaactattaccgtcacaccaaactacgctaaaatcgccaaactatacgatctataactaacaccgaaacaaaacaccgatacgacaataacgctaacgataaaccacgtaatactacgtaaattccacctcgacaacccaaaccaatatttcaccgactatatacgtcgctacaccgacataccgatactaataatactaaaaaaacgcgacgattactacgctacaaatcgtatactacgcgctacta

SEQ ID NO: 23023 - DNA, 968 bp, Artificial Sequence
  chemically treated genomic DNA (Homo sapiens) CpG-island No: 23023
  misc_feature (32)..(32): n is either a, c, g or t
  misc_feature (36)..(36): n is either a, c, g or t
  misc_feature (103)..(103): n is either a, c, g or t
  misc_feature (139)..(139): n is either a, c, g or t
tcgtagcgtttggtagtatgataaaatcgttngttntatttacgggtaaattgtatttgttttgtagttgggaaaatttacgttaaaaacggtttgttatttngggaatttagtagattgattattcgcgtatcgtttnggatttgttaaattatgaattcgtagttgttcgcgcggtgttagttatttttggtatttttatagtgttaatcgtttgaaatattcgatgatgcgtaaacgtttgatgaaaatgtggcgtgaagcgaaggcgttgtatagcgattcggttgaggtatgggtttttattattgaagacgtcgataaagcgaaaagttttaagtaggcgcgtggacgcggtggatttgttcgttttttttggtaggaggtgaacgaattgatcgtcgtatttaacgtttatattattaaaaattacggttcggatcgtgttgttggtttttcgttaatttcggtaatgtcgatggttttttacgtatcgggtgtacgttatttttcgttgattggcggtatttgtttaagtttttacgattggtattgcgatttgttttttgcgttttcgtaaatttggggcgagtaaattgacgtatcggaatttgttgattggtataattttagttatattatcgtttgggggttaaacgtgtcgtagacgcgtatttcggatgtttatttttttattgaagtgcgttataaagggattaaaattgttgtcgttatattagattacgttgaaatcgttaaattgtgcgatttgtggttggtatcgaaatagggtatcgatgcggtaatggcgttggcgatgggttacgtaatgttgcgtgaattttatttcgataatttaagttagtattttatcgattatgtgcgtcgttatatcgatatgtcgatgttggtgatgttggaagaacgcgacggttattacgttgtaggtcgtatgttgcgcgttgttg

SEQ ID NO: 23024 - DNA, 968 bp, Artificial Sequence
  chemically treated genomic DNA (Homo sapiens) CpG-island No: 23024
  misc_feature (830)..(830): n is either a, c, g or t
  misc_feature (866)..(866): n is either a, c, g or t
  misc_feature (933)..(933): n is either a, c, g or t
  misc_feature (937)..(937): n is either a, c, g or t
caacaacgcgcaacatacgacctacaacgtaataaccgtcgcgttcttccaacatcaccaacatcgacatatcgatataacgacgcacataatcgataaaatactaacttaaattatcgaaataaaattcacgcaacattacgtaacccatcgccaacgccattaccgcatcgataccctatttcgataccaaccacaaatcgcacaatttaacgatttcaacgtaatctaatataacgacaacaattttaatccctttataacgcacttcaataaaaaaataaacatccgaaatacgcgtctacgacacgtttaacccccaaacgataatataactaaaattataccaatcaacaaattccgatacgtcaatttactcgccccaaatttacgaaaacgcaaaaaacaaatcgcaataccaatcgtaaaaacttaaacaaataccgccaatcaacgaaaaataacgtacacccgatacgtaaaaaaccatcgacattaccgaaattaacgaaaaaccaacaacacgatccgaaccgtaatttttaataatataaacgttaaatacgacgatcaattcgttcacctcctaccaaaaaaaacgaacaaatccaccgcgtccacgcgcctacttaaaacttttcgctttatcgacgtcttcaataataaaaacccatacctcaaccgaatcgctatacaacgccttcgcttcacgccacattttcatcaaacgtttacgcatcatcgaatatttcaaacgattaacactataaaaataccaaaaataactaacaccgcgcgaacaactacgaattcataatttaacaaatccnaaacgatacgcgaataatcaatctactaaattcccnaaataacaaaccgtttttaacgtaaattttcccaactacaaaacaaatacaatttacccgtaaatanaacnaacgattttatcatactaccaaacgctacga

SEQ ID NO: 23025 - DNA, 650 bp, Artificial Sequence
  chemically treated genomic DNA (Homo sapiens) CpG-island No: 23025
gcgtagtgcggtaacggtgcgcgttgttttgttcgttttgtgcgtttgaaaggattgattaataagcgtgatattcgcgttagtatcgttaacgggcggatggttttgatcgttatcgatgatgatttggttcgcgtaaatatgggcgaatttaatttcgaatttttcgtcgtgtcgtttcgcgttaataaagcggaaaagatttatattatgcgcgtcgtcgagtagataattttatgcggcgtggtgtcgatgggaaattcgtattgcgtgatttaggtcgatgatgtcgatatcgcggcggtagaaacgtttggttttgttttggaaagttacgagcgtttttcggagcgcgttaatatcggttttatgtaagtggttaagcgcgagtatattcgtttacgcgtttatgagcgtggggtaggagaaatttaggtttgcggtagcggcgcgtgtgcggcggttgtagtagggatttagtaaggtttgttggtcgaagaagtacgcgtggaatttttcggcggtcgttttgatatcgtttggaaaggttcgggttattcgttatatatgattggttcggcggtatatgtttacgacggatttatttatttatgaagtaattaggggaagaattgtaggaaatatttacg

SEQ ID NO: 23026 - DNA, 650 bp, Artificial Sequence
  chemically treated genomic DNA (Homo sapiens) CpG-island No: 23026
cgtaaatatttcctacaattcttcccctaattacttcataaataaataaatccgtcgtaaacatataccgccgaaccaatcatatataacgaataacccgaacctttccaaacgatatcaaaacgaccgccgaaaaattccacgcgtacttcttcgaccaacaaaccttactaaatccctactacaaccgccgcacacgcgccgctaccgcaaacctaaatttctcctaccccacgctcataaacgcgtaaacgaatatactcgcgcttaaccacttacataaaaccgatattaacgcgctccgaaaaacgctcgtaactttccaaaacaaaaccaaacgtttctaccgccgcgatatcgacatcatcgacctaaatcacgcaatacgaatttcccatcgacaccacgccgcataaaattatctactcgacgacgcgcataatataaatcttttccgctttattaacgcgaaacgacacgacgaaaaattcgaaattaaattcgcccatatttacgcgaaccaaatcatcatcgataacgatcaaaaccatccgcccgttaacgatactaacgcgaatatcacgcttattaatcaatcctttcaaacgcacaaaacgaacaaaacaacgcgcaccgttaccgcactacgc

SEQ ID NO: 23027 - DNA, 650 bp, Artificial Sequence
  chemically treated genomic DNA (Homo sapiens) CpG-island No: 23027
cgtgagtgttttttgtagttttttttttggttgttttatagatgaataaattcgtcgtagatatgtatcgtcgggttagttatatataacgggtgattcggatttttttaggcgatattaagacgatcgtcggggagttttacgcgtattttttcggttagtaaattttgttgaatttttattgtaatcgtcgtatacgcgtcgttgtcgtaggtttgggttttttttgttttacgtttataaacgcgtaaacgaatatgttcgcgtttaattatttgtataaaatcgatattggcgcgtttcggaaaacgttcgtggttttttagaataggattaagcgtttttatcgtcgcggtatcgatattatcgatttgaattacgtaatgcggattttttatcgatattacgtcgtataagattgtttgttcggcggcgcgtataatataggtttttttcgttttgttagcgcgaaacggtacggcggaaggttcgaagttgggttcgtttatatttacgcggattagattattatcggtgacggttagaattattcgttcgttggcggtgttgacgcggatattacgtttattggttagtttttttagacgtataaaacgggtaaagtagcgcgtatcgttgtcgtattgcgt

SEQ ID NO: 23028 - DNA, 650 bp, Artificial Sequence
  chemically treated genomic DNA (Homo sapiens) CpG-island No: 23028
acgcaatacgacaacgatacgcgctactttacccgttttatacgtctaaaaaaactaaccaataaacgtaatatccgcgtcaacaccgccaacgaacgaataattctaaccgtcaccgataataatctaatccgcgtaaatataaacgaacccaacttcgaaccttccgccgtaccgtttcgcgctaacaaaacgaaaaaaacctatattatacgcgccgccgaacaaacaatcttatacgacgtaatatcgataaaaaatccgcattacgtaattcaaatcgataatatcgataccgcgacgataaaaacgcttaatcctattctaaaaaaccacgaacgttttccgaaacgcgccaatatcgattttatacaaataattaaacgcgaacatattcgtttacgcgtttataaacgtaaaacaaaaaaaacccaaacctacgacaacgacgcgtatacgacgattacaataaaaattcaacaaaatttactaaccgaaaaaatacgcgtaaaactccccgacgatcgtcttaatatcgcctaaaaaaatccgaatcacccgttatatataactaacccgacgatacatatctacgacgaatttattcatctataaaacaaccaaaaaaaaaactacaaaaaacactcacg

SEQ ID NO: 23029 - DNA, 795 bp, Artificial Sequence
  chemically treated genomic DNA (Homo sapiens) CpG-island No: 23029
  misc_feature (202)..(202): n is either a, c, g or t
  misc_feature (789)..(789): n is either a, c, g or t
gggtatgtattaggatattaattgggataacgataacggtattaagtggtggatcgtcggtattcgttcgatgtataagtggacgttaattatgagtatcgtgatggaaatcggttacgataacgtcgaattttagcgtatcggcgataagaataattagtataaaattattttcgtataataatggtaggttggcgatatnatttggttacgttcggttattcgtgttttcgtaatttacgttaagtgggatgagaaatggggttacgattatatcggtaacgttgataataacgcgaatttcggtaaagcgtttttgttgattttaacggcggtatttcggtcgtggcgatacgacgagtggatttcggtgtttagatggaaatttggtggtaatagtaaaatttgggtcggataaggcgtttacgtcgtattcggtaatcggtgtacgattgtttgatgcgacgtttgcgcgttttattaggtttatagtcgttgtcgaacgtaggttggataagacgtttacgtcgtattcggtatttgtgcgttgatgtttgatgcgacgttgacgcgttttattatgtttataaatttgtacgcgaagtgtagatcggataatgcgtttacgtcgtattcggtagtcgtgcgttatgtttgatgcgacgtttgcgcgttttattagcgtacggtttacgggcgaagtgtaggtcggataaggcgtttacgtcgtattcggtatgaataaagcgtattttgtttataatttgaggttgatttttttcgtatgtntaattt

SEQ ID NO: 23030 - DNA, 795 bp, Artificial Sequence
  chemically treated genomic DNA (Homo sapiens) CpG-island No: 23030
  misc_feature (7)..(7): n is either a, c, g or t
  misc_feature (594)..(594): n is either a, c, g or t
aaattanacatacgaaaaaaatcaacctcaaattataaacaaaatacgctttattcataccgaatacgacgtaaacgccttatccgacctacacttcgcccgtaaaccgtacgctaataaaacgcgcaaacgtcgcatcaaacataacgcacgactaccgaatacgacgtaaacgcattatccgatctacacttcgcgtacaaatttataaacataataaaacgcgtcaacgtcgcatcaaacatcaacgcacaaataccgaatacgacgtaaacgtcttatccaacctacgttcgacaacgactataaacctaataaaacgcgcaaacgtcgcatcaaacaatcgtacaccgattaccgaatacgacgtaaacgccttatccgacccaaattttactattaccaccaaatttccatctaaacaccgaaatccactcgtcgtatcgccacgaccgaaataccgccgttaaaatcaacaaaaacgctttaccgaaattcgcgttattatcaacgttaccgatataatcgtaaccccatttctcatcccacttaacgtaaattacgaaaacacgaataaccgaacgtaaccaaatnatatcgccaacctaccattattatacgaaaataattttatactaattattcttatcgccgatacgctaaaattcgacgttatcgtaaccgatttccatcacgatactcataattaacgtccacttatacatcgaacgaataccgacgatccaccacttaataccgttatcgttatcccaattaatatcctaatacataccc

SEQ ID NO: 23031 - DNA, 795 bp, Artificial Sequence
  chemically treated genomic DNA (Homo sapiens) CpG-island No: 23031
  misc_feature (7)..(7): n is either a, c, g or t
  misc_feature (594)..(594): n is either a, c, g or t
ggattanatatgcggaaagaattagttttagattgtagataaagtgcgttttgtttatgtcggatgcggcgtgaacgttttattcggtttatatttcgttcgtaagtcgtacgttgataagacgcgtaaacgtcgtattaggtatggcgtacgattgtcggatgcggcgtgaacgtattattcggtttatatttcgcgtatagatttgtaggtatgataagacgcgttagcgtcgtattaggtattagcgtataaatgtcggatgcggcgtaaacgttttatttagtttacgttcggtaacggttgtaggtttgataagacgcgtaagcgtcgtattaggtagtcgtgtatcgattgtcggatgcggcgtgaacgttttattcggtttaggttttgttattattattagatttttatttgggtatcgaagtttattcgtcgtgtcgttacgatcgaagtgtcgtcgttgaaattagtaggaacgttttgtcgaagttcgcgttgttattagcgttatcggtgtagtcgtaattttattttttattttatttggcgtaggttgcgaagatacgaatagtcgggcgtgattagatngtgtcgttagtttgttattgttgtgcgagggtaattttgtattgattgtttttgtcgtcggtgcgttgggattcgacgttgtcgtagtcgatttttattacggtgtttatgattggcgtttatttgtatatcgggcgaatatcgacggtttattatttggtgtcgttgtcgttattttagttgatattttggtatatattt

SEQ ID NO: 23032 - DNA, 795 bp, Artificial Sequence
  chemically treated genomic DNA (Homo sapiens) CpG-island No: 23032
  misc_feature (202)..(202): n is either a, c, g or t
  misc_feature (789)..(789): n is either a, c, g or t
aaatatataccaaaatatcaactaaaataacgacaacgacaccaaataataaaccgtcgatattcgcccgatatacaaataaacgccaatcataaacaccgtaataaaaatcgactacgacaacgtcgaatcccaacgcaccgacgacaaaaacaatcaatacaaaattaccctcgcacaacaataacaaactaacgacacnatctaatcacgcccgactattcgtatcttcgcaacctacgccaaataaaataaaaaataaaattacgactacaccgataacgctaataacaacgcgaacttcgacaaaacgttcctactaatttcaacgacgacacttcgatcgtaacgacacgacgaataaacttcgatacccaaataaaaatctaataataataacaaaacctaaaccgaataaaacgttcacgccgcatccgacaatcgatacacgactacctaatacgacgcttacgcgtcttatcaaacctacaaccgttaccgaacgtaaactaaataaaacgtttacgccgcatccgacatttatacgctaatacctaatacgacgctaacgcgtcttatcatacctacaaatctatacgcgaaatataaaccgaataatacgttcacgccgcatccgacaatcgtacgccatacctaatacgacgtttacgcgtcttatcaacgtacgacttacgaacgaaatataaaccgaataaaacgttcacgccgcatccgacataaacaaaacgcactttatctacaatctaaaactaattctttccgcatatntaatcc

SEQ ID NO: 23033 - DNA, 581 bp, Artificial Sequence
  chemically treated genomic DNA (Homo sapiens) CpG-island No: 23033
  misc_feature (530)..(530): n is either a, c, g or t
tagcgtcgacgtgatttattttggtgaagcggtatgtagtaagcgtcgggtaattaaagttggcgattggttggagatggtaaaatcgttcgtcgggagtggtaagtagatggtgttttttaagttggcgttggtgtaggtattatttgaattgggcgaattgaaacgttatgttgagaacggtgagtttttgattgaagttagcgatttcggcgtggtgaatatgtgcgttgaacgtaaattgtcgttcgtcgtcgggtacgcgttgaattgttataacgcggtgatattgaaaatattgtttaaatagggtatgatgcgttggtgtatgttagtggagttttttcgcgattggttggtgaattttgttaattagtgcgatgaattgggtattcgtaattaatttgaagtggaagttttgagttacggttaattgtcgttgggtttattttcgtcggttgtttaatcgcgcggttcgaagatcgttcgaagatgagtgtaaaattgttgtattacgtattcgaatcggncgaacgtgttgtcgtaggaaatttattaggtgttgtattttattgtattta

SEQ ID NO: 23034 - DNA, 581 bp, Artificial Sequence
  chemically treated genomic DNA (Homo sapiens) CpG-island No: 23034
  misc_feature (52)..(52): n is either a, c, g or t
taaatacaataaaatacaacacctaataaatttcctacgacaacacgttcgnccgattcgaatacgtaatacaacaattttacactcatcttcgaacgatcttcgaaccgcgcgattaaacaaccgacgaaaataaacccaacgacaattaaccgtaactcaaaacttccacttcaaattaattacgaatacccaattcatcgcactaattaacaaaattcaccaaccaatcgcgaaaaaactccactaacatacaccaacgcatcataccctatttaaacaatattttcaatatcaccgcgttataacaattcaacgcgtacccgacgacgaacgacaatttacgttcaacgcacatattcaccacgccgaaatcgctaacttcaatcaaaaactcaccgttctcaacataacgtttcaattcgcccaattcaaataatacctacaccaacgccaacttaaaaaacaccatctacttaccactcccgacgaacgattttaccatctccaaccaatcgccaactttaattacccgacgcttactacataccgcttcaccaaaataaatcacgtcgacgcta

SEQ ID NO: 23035 - DNA, 581 bp, Artificial Sequence
  chemically treated genomic DNA (Homo sapiens) CpG-island No: 23035
  misc_feature (52)..(52): n is either a, c, g or t
tgaatgtaatggagtataatatttggtgggttttttgcgatagtacgttcgntcggttcggatacgtaatgtagtagttttatatttattttcgggcggttttcggatcgcgcggttaaataatcggcggaaataggtttagcggtagttgatcgtagtttaggatttttattttaaattggttacgaatgtttagtttatcgtattgattaataggatttattagttagtcgcgggaaagttttattggtatatattagcgtattatgttttgtttgagtaatatttttagtgttatcgcgttgtagtagtttagcgcgtgttcggcgacgaacggtagtttgcgtttagcgtatatatttattacgtcgagatcgttggttttaattagaaatttatcgtttttaatatagcgttttagttcgtttagtttagatgatgtttgtattagcgttagtttggagagtattatttgtttattattttcggcgagcgattttgttatttttagttagtcgttaattttggttgttcgacgtttgttgtatatcgttttattaagataaattacgtcggcgttg

SEQ ID NO: 23036 - DNA, 581 bp, Artificial Sequence
  chemically treated genomic DNA (Homo sapiens) CpG-island No: 23036
  misc_feature (530)..(530): n is either a, c, g or t
caacgccgacgtaatttatcttaataaaacgatatacaacaaacgtcgaacaaccaaaattaacgactaactaaaaataacaaaatcgctcgccgaaaataataaacaaataatactctccaaactaacgctaatacaaacatcatctaaactaaacgaactaaaacgctatattaaaaacgataaatttctaattaaaaccaacgatctcgacgtaataaatatatacgctaaacgcaaactaccgttcgtcgccgaacacgcgctaaactactacaacgcgataacactaaaaatattactcaaacaaaacataatacgctaatatataccaataaaactttcccgcgactaactaataaatcctattaatcaatacgataaactaaacattcgtaaccaatttaaaataaaaatcctaaactacgatcaactaccgctaaacctatttccgccgattatttaaccgcgcgatccgaaaaccgcccgaaaataaatataaaactactacattacgtatccgaaccgancgaacgtactatcgcaaaaaacccaccaaatattatactccattacattca

SEQ ID NO: 23037 - DNA, 537 bp, Artificial Sequence
  chemically treated genomic DNA (Homo sapiens) CpG-island No: 23037
taaattcggattttttttggttttattcgtttttgtatcgtttttagtcgtttcggttatttacgtgtgtttttagtttatcgattacgttttcggtatattttatagtttcgcgttgttttcgggagagcggacggggaaagtcgagggttttcgaggggcgttcgggttttggcgagaggaggaaggatttagggaagtagtcggggaggttcggggtttcggggagaggtcgggaaggtcgaagcgttttggcgaagaggtcggggaggtcgaggggttttcggaagcgggtcgggaggttaggggttttaggggaggtttagcgggtcgtgtagcgggcgcgtgtggcggcgagcggggttttatcgttagttacggtttttatggcgtgcgcggcggcggcggcggcggcggcggcgtaagttgaggcggcggttggcggcggcggaggttaaatttttataatgtagtcgggtaaatagttatggaggaggaggcggcggcgttcgcggtcgtttgttttgataattttat

SEQ ID NO: 23038 - DNA, 537 bp, Artificial Sequence
  chemically treated genomic DNA (Homo sapiens) CpG-island No: 23038
ataaaattatcaaaacaaacgaccgcgaacgccgccgcctcctcctccataactatttacccgactacattataaaaatttaacctccgccgccgccaaccgccgcctcaacttacgccgccgccgccgccgccgccgccgcgcacgccataaaaaccgtaactaacgataaaaccccgctcgccgccacacgcgcccgctacacgacccgctaaacctcccctaaaacccctaacctcccgacccgcttccgaaaacccctcgacctccccgacctcttcgccaaaacgcttcgaccttcccgacctctccccgaaaccccgaacctccccgactacttccctaaatccttcctcctctcgccaaaacccgaacgcccctcgaaaaccctcgactttccccgtccgctctcccgaaaacaacgcgaaactataaaatataccgaaaacgtaatcgataaactaaaaacacacgtaaataaccgaaacgactaaaaacgatacaaaaacgaataaaaccaaaaaaaatccgaattta

SEQ ID NO: 23039 - DNA, 537 bp, Artificial Sequence
  chemically treated genomic DNA (Homo sapiens) CpG-island No: 23039
gtagagttattagagtaggcggtcgcgggcgtcgtcgtttttttttttatggttgtttattcggttgtattgtgggagtttgattttcgtcgtcgttaatcgtcgttttagtttgcgtcgtcgtcgtcgtcgtcgtcgtcgcgtacgttatgggagtcgtgattgacggtgaggtttcgttcgtcgttatacgcgttcgttgtacggttcgttgggttttttttgagatttttggtttttcggttcgttttcgggaatttttcggttttttcggttttttcgttagagcgtttcggttttttcgattttttttcggagtttcgggttttttcggttgtttttttgagtttttttttttttcgttagagttcgagcgtttttcggagattttcggtttttttcgttcgttttttcggaggtagcgcggggttatagggtgtgtcgggagcgtggtcggtgggttgggaatatacgtgggtggtcgagacggttagaagcggtgtaagggcgggtgggattagagggagttcgggtttg

SEQ ID NO: 23040 - DNA, 537 bp, Artificial Sequence
  chemically treated genomic DNA (Homo sapiens) CpG-island No: 23040
caaacccgaactccctctaatcccacccgcccttacaccgcttctaaccgtctcgaccacccacgtatattcccaacccaccgaccacgctcccgacacaccctataaccccgcgctacctccgaaaaaacgaacgaaaaaaaccgaaaatctccgaaaaacgctcgaactctaacgaaaaaaaaaaaaactcaaaaaaacaaccgaaaaaacccgaaactccgaaaaaaaatcgaaaaaaccgaaacgctctaacgaaaaaaccgaaaaaaccgaaaaattcccgaaaacgaaccgaaaaaccaaaaatctcaaaaaaaacccaacgaaccgtacaacgaacgcgtataacgacgaacgaaacctcaccgtcaatcacgactcccataacgtacgcgacgacgacgacgacgacgacgacgcaaactaaaacgacgattaacgacgacgaaaatcaaactcccacaatacaaccgaataaacaaccataaaaaaaaaaacgacgacgcccgcgaccgcctactctaataactctac

SEQ ID NO: 23041 - DNA, 922 bp, Artificial Sequence
  chemically treated genomic DNA (Homo sapiens) CpG-island No: 23041
cgttattgcggcggtcgaggtggaggcggcgtcgggttcgtcgtttttcggtcgtgtgcgtcgtggcggcggtggcgggtgttgttgtcgttggggttgcggaggcggtttttgttgttgttgttgttgttgttgttgttgtcgggcggtcgcggtcgttgtttcgttcgtcgtcgtcgtcgcgcggcgcggtttttttttgacgttattcgcggttcgtttcgatatttttttcgtttttataatgtaataaaaaaaagggggaaagagtcgcgcgggggtcgttttttaaggaggcgttagggagtttcggcggcgtgcgcggttcgcggatcgggtggggtacgttgatagcgtttttatggtcgtttagtttttcgagttcgtttttttaaggttatttttcgtttcgggtttaaagttcgcggcgcgggttagttttcgttttcgattttcgcggtcgttcgagggaggggacgggtagtaggcggttcgttatcgcggcgttgggttttttgtttgtttttgtttagaggatttggcgcggaggttagcgtcggagcggttcggttttaatttcgcgttttattatggtagttcgcgcggggaagttcgagtcgtattttaggatttttagttgtttatttttcggtcgtttgtattttcgggttcggttcggttgtttcgtttttttttttcgttcgcgcgttcgttcgagcggcggtattcggtcggtttttttaagcggagacgtttttcgtcgtttttttttatttgtcggttttttttttttagttcgtttcggcgaagtttgtacgttaagttttcggattggagttagggcgaagtcggaaatgtagttatttatggaggagtcggtcggtcggttttagggtagcgcgggagaggttggtgtaggggg

SEQ ID NO: 23042 - DNA, 922 bp, Artificial Sequence
  chemically treated genomic DNA (Homo sapiens) CpG-island No: 23042
ccccctacaccaacctctcccgcgctaccctaaaaccgaccgaccgactcctccataaataactacatttccgacttcgccctaactccaatccgaaaacttaacgtacaaacttcgccgaaacgaactaaaaaaaaaaaaccgacaaataaaaaaaaacgacgaaaaacgtctccgcttaaaaaaaccgaccgaataccgccgctcgaacgaacgcgcgaacgaaaaaaaaaaacgaaacaaccgaaccgaacccgaaaatacaaacgaccgaaaaataaacaactaaaaatcctaaaatacgactcgaacttccccgcgcgaactaccataataaaacgcgaaattaaaaccgaaccgctccgacgctaacctccgcgccaaatcctctaaacaaaaacaaacaaaaaacccaacgccgcgataacgaaccgcctactacccgtcccctccctcgaacgaccgcgaaaatcgaaaacgaaaactaacccgcgccgcgaactttaaacccgaaacgaaaaataaccttaaaaaaacgaactcgaaaaactaaacgaccataaaaacgctatcaacgtaccccacccgatccgcgaaccgcgcacgccgccgaaactccctaacgcctccttaaaaaacgacccccgcgcgactctttcccccttttttttattacattataaaaacgaaaaaaatatcgaaacgaaccgcgaataacgtcaaaaaaaaaccgcgccgcgcgacgacgacgacgaacgaaacaacgaccgcgaccgcccgacaacaacaacaacaacaacaacaacaacaaaaaccgcctccgcaaccccaacgacaacaacacccgccaccgccgccacgacgcacacgaccgaaaaacgacgaacccgacgccgcctccacctcgaccgccgcaataacg

SEQ ID NO: 23043 - DNA, 922 bp, Artificial Sequence
  chemically treated genomic DNA (Homo sapiens) CpG-island No: 23043
ttttttgtattagtttttttcgcgttgttttggggtcggtcggtcggtttttttataggtggttgtattttcgatttcgttttggttttagttcgggggtttgacgtgtaaatttcgtcggagcgagttgagagggagggatcggtaagtgggaggaggcggcgggaggcgttttcgtttaagggagtcggtcgggtgtcgtcgttcggacggacgcgcggacggaaggaaggagcggggtagtcgggtcgggttcggggatgtaagcggtcgaagggtgggtagttggaggttttggggtgcggttcgggttttttcgcgcgggttgttatggtggggcgcggggttggagtcgggtcgtttcggcgttggttttcgcgttaggttttttgagtagaagtaggtaggggatttagcgtcgcggtggcgggtcgtttgttgttcgttttttttttcgggcggtcgcgggagtcgaaagcgaaagttagttcgcgtcgcggattttgagttcggggcggggggtggttttgaggaggcgggttcggggggttgggcggttatgggggcgttgttagcgtgttttattcggttcgcgggtcgcgtacgtcgtcggaattttttggcgtttttttaaaaaacggttttcgcgcgatttttttttttttttttttgttatattgtaggagcggaaagaatgtcggagcgggtcgcggatgacgttaggggggagtcgcgtcgcgcggcggcggcggcgggcggagtagcggtcgcggtcgttcggtagtagtagtagtagtagtagtagtagtaaaaatcgttttcgtagttttagcggtagtagtattcgttatcgtcgttacggcgtatacggtcggaggacggcgggttcggcgtcgtttttatttcggtcgtcgtaatggcg

SEQ ID NO: 23044 - DNA, 922 bp, Artificial Sequence
  chemically treated genomic DNA (Homo sapiens) CpG-island No: 23044
cgccattacgacgaccgaaataaaaacgacgccgaacccgccgtcctccgaccgtatacgccgtaacgacgataacgaatactactaccgctaaaactacgaaaacgatttttactactactactactactactactactaccgaacgaccgcgaccgctactccgcccgccgccgccgccgcgcgacgcgactcccccctaacgtcatccgcgacccgctccgacattctttccgctcctacaatataacaaaaaaaaaaaaaaaaaaatcgcgcgaaaaccgttttttaaaaaaacgccaaaaaattccgacgacgtacgcgacccgcgaaccgaataaaacacgctaacaacgcccccataaccgcccaaccccccgaacccgcctcctcaaaaccaccccccgccccgaactcaaaatccgcgacgcgaactaactttcgctttcgactcccgcgaccgcccgaaaaaaaaaacgaacaacaaacgacccgccaccgcgacgctaaatcccctacctacttctactcaaaaaacctaacgcgaaaaccaacgccgaaacgacccgactccaaccccgcgccccaccataacaacccgcgcgaaaaaacccgaaccgcaccccaaaacctccaactacccacccttcgaccgcttacatccccgaacccgacccgactaccccgctccttccttccgtccgcgcgtccgtccgaacgacgacacccgaccgactcccttaaacgaaaacgcctcccgccgcctcctcccacttaccgatccctccctctcaactcgctccgacgaaatttacacgtcaaacccccgaactaaaaccaaaacgaaatcgaaaatacaaccacctataaaaaaaccgaccgaccgaccccaaaacaacgcgaaaaaaactaatacaaaaaa

SEQ ID NO: 23045 - DNA, 553 bp, Artificial Sequence
  chemically treated genomic DNA (Homo sapiens) CpG-island No: 23045
agggcggagcgcgatcggcggaataagtttaaaggttagtttgtttttgcggagttcggcgagttcggtattcgtgttcgcggaggaaacgcgttcgtagtttaggagaggcgtttgcgcggatttcgtcgagagtcgagggtagagttttacgagggaagttcgaataacggcggtcgtcggtgtttttttaagtcgtttttcgttgttttttggggcgtagcgtcggcgggtatttagtttttttatttcggtttcgtcggatcgtttatcgtttttcgtattatttattttttttttttttatttttttttatcgttttatttttttttttagtttcgtatcgttacgtttttattttattgtttgtggtcggtttcggtttatttttttttttatttttttttacgtcgttttggttattatacgatttatttgtcgacgcggttatttttcgatggggtttcgattttagttatttaaaaaggaaatgttatttcgtttttttagttttcgggtttcggtttttttaagttttttttggttaatgggg

SEQ ID NO: 23046 - DNA, 553 bp, Artificial Sequence
  chemically treated genomic DNA (Homo sapiens) CpG-island No: 23046
ccccattaaccaaaaaaaacttaaaaaaaccgaaacccgaaaactaaaaaaacgaaataacatttcctttttaaataactaaaatcgaaaccccatcgaaaaataaccgcgtcgacaaataaatcgtataataaccaaaacgacgtaaaaaaaaataaaaaaaaaaataaaccgaaaccgaccacaaacaataaaataaaaacgtaacgatacgaaactaaaaaaaaaaataaaacgataaaaaaaaataaaaaaaaaaaaaataaataatacgaaaaacgataaacgatccgacgaaaccgaaataaaaaaactaaatacccgccgacgctacgccccaaaaaacaacgaaaaacgacttaaaaaaacaccgacgaccgccgttattcgaacttccctcgtaaaactctaccctcgactctcgacgaaatccgcgcaaacgcctctcctaaactacgaacgcgtttcctccgcgaacacgaataccgaactcgccgaactccgcaaaaacaaactaacctttaaacttattccgccgatcgcgctccgccct

SEQ ID NO: 23047 - DNA, 553 bp, Artificial Sequence
  chemically treated genomic DNA (Homo sapiens) CpG-island No: 23047
ttttattggttaggggaagtttagaagagtcggaattcgggagttagagaagcgaaatgatattttttttttaaatagttggagtcggggttttatcgagaaatggtcgcgtcggtaggtgggtcgtgtggtggttagggcggcgtggagggaggtgagggggaaggtgggtcggggtcggttataggtagtgggatgaggacgtagcggtgcggagttagagggaaggatgaagcggtggaggggaatgagaagagggaggatgaatggtgcggagggcggtgggcggttcggcgggatcgggatggggaggttgggtattcgtcggcgttgcgttttaggaggtagcgggaggcggtttgagggggtatcggcggtcgtcgttgttcgagtttttttcgtgaggttttgttttcggttttcggcggagttcgcgtagacgttttttttgggttgcgagcgcgtttttttcgcgagtacgggtgtcgggttcgtcgggtttcgtaggagtaggttggtttttgaatttgtttcgtcgatcgcgtttcgtttt

SEQ ID NO: 23048 - DNA, 553 bp, Artificial Sequence
  chemically treated genomic DNA (Homo sapiens) CpG-island No: 23048
aaaacgaaacgcgatcgacgaaacaaattcaaaaaccaacctactcctacgaaacccgacgaacccgacacccgtactcgcgaaaaaaacgcgctcgcaacccaaaaaaaacgtctacgcgaactccgccgaaaaccgaaaacaaaacctcacgaaaaaaactcgaacaacgacgaccgccgataccccctcaaaccgcctcccgctacctcctaaaacgcaacgccgacgaatacccaacctccccatcccgatcccgccgaaccgcccaccgccctccgcaccattcatcctccctcttctcattcccctccaccgcttcatccttccctctaactccgcaccgctacgtcctcatcccactacctataaccgaccccgacccaccttccccctcacctccctccacgccgccctaaccaccacacgacccacctaccgacgcgaccatttctcgataaaaccccgactccaactatttaaaaaaaaaatatcatttcgcttctctaactcccgaattccgactcttctaaacttcccctaaccaataaaa

SEQ ID NO: 23049 - DNA, 705 bp, Artificial Sequence
  chemically treated genomic DNA (Homo sapiens) CpG-island No: 23049
gcgtgcgtatacgcgagttcgttgcgtttgcgcgcggtgcggtcgtcgttttttttttcgcggcgttttttatttgcgcgggtttgaatggtttttaggagtatagtcggtttgaggagttgacggttatttatcgtcgtgagtttaagtaattcgttttttttcggttagaaatttttcgtttgggttcgcgcgataggagcgcggtttttgaggggagcggcgatttcgttagtttcggtttttttttttggcggcggcggtttttttcgtgggataatatgtttaagagaatggtcgaatttgggtttgatttcggcgggagagtaaaggttagtgttcggatcgtttttttttcggggtggttttttcgtttcggtttttttttgcgcggcgcggggagggtttattgggttttttttcgcgtttttttttttcgggtttgaatcgtggttttaggttggagagcgagttagagttattgagcgaaaaatcggcgtttattgggttttaattttttcgcgttattgttaatttttattttcgttaaaaaataaatagataaatggtggtttggggaaattcggacgtggttgttaaggaaacgggcgatttcgagggttgggaaagtttagtttggtgtatattcgttgttaatttaggttattggtgaagcggtgacgttatttttttggtgtgaggata

SEQ ID NO: 23050 - DNA, 705 bp, Artificial Sequence
  chemically treated genomic DNA (Homo sapiens) CpG-island No: 23050
tatcctcacaccaaaaaaataacgtcaccgcttcaccaataacctaaattaacaacgaatatacaccaaactaaactttcccaaccctcgaaatcgcccgtttccttaacaaccacgtccgaatttccccaaaccaccatttatctatttattttttaacgaaaataaaaattaacaataacgcgaaaaaattaaaacccaataaacgccgatttttcgctcaataactctaactcgctctccaacctaaaaccacgattcaaacccgaaaaaaaaaaacgcgaaaaaaaacccaataaaccctccccgcgccgcgcaaaaaaaaaccgaaacgaaaaaaccaccccgaaaaaaaaacgatccgaacactaacctttactctcccgccgaaatcaaacccaaattcgaccattctcttaaacatattatcccacgaaaaaaaccgccgccgccaaaaaaaaaaaccgaaactaacgaaatcgccgctcccctcaaaaaccgcgctcctatcgcgcgaacccaaacgaaaaatttctaaccgaaaaaaaacgaattacttaaactcacgacgataaataaccgtcaactcctcaaaccgactatactcctaaaaaccattcaaacccgcgcaaataaaaaacgccgcgaaaaaaaaaacgacgaccgcaccgcgcgcaaacgcaacgaactcgcgtatacgcacgc

SEQ ID NO: 23051 - DNA, 705 bp, Artificial Sequence
  chemically treated genomic DNA (Homo sapiens) CpG-island No: 23051
tatttttatattaggagggtggcgttatcgttttattaataatttagattggtagcgaatgtgtattaagttgagtttttttagttttcggagtcgttcgtttttttggtagttacgttcgggtttttttaagttattatttatttgtttgttttttggcgggggtgggagttggtagtgacgcgaggaagttggggtttaatgaacgtcggtttttcgtttaatggttttgattcgttttttaatttgaaattacggtttaaattcgaggagaaaaggcgcgaaaggaaatttagtgggtttttttcgcgtcgcgtagggaggaatcgaggcgggagagttatttcggaagaggggcggttcgggtattgatttttattttttcgtcggagttaggtttaaattcggttatttttttgaatatattgttttacggaagaagtcgtcgtcgttagggaaagagatcggggttggcggggtcgtcgttttttttagagatcgcgtttttgtcgcgcgggtttaggcggagggtttttagtcgaaggagggcgagttatttgggtttacggcggtgagtaatcgttaattttttaggtcgattgtgtttttgaaggttatttaggttcgcgtaggtggagaacgtcgcgaaaagaggggcgacggtcgtatcgcgcgtaggcgtaacgggttcgcgtatgcgtacgt

SEQ ID NO: 23052 - DNA, 705 bp, Artificial Sequence
  chemically treated genomic DNA (Homo sapiens) CpG-island No: 23052
acgtacgcatacgcgaacccgttacgcctacgcgcgatacgaccgtcgcccctcttttcgcgacgttctccacctacgcgaacctaaataaccttcaaaaacacaatcgacctaaaaaattaacgattactcaccgccgtaaacccaaataactcgccctccttcgactaaaaaccctccgcctaaacccgcgcgacaaaaacgcgatctctaaaaaaaacgacgaccccgccaaccccgatctctttccctaacgacgacgacttcttccgtaaaacaatatattcaaaaaaataaccgaatttaaacctaactccgacgaaaaaataaaaatcaatacccgaaccgcccctcttccgaaataactctcccgcctcgattcctccctacgcgacgcgaaaaaaacccactaaatttcctttcgcgccttttctcctcgaatttaaaccgtaatttcaaattaaaaaacgaatcaaaaccattaaacgaaaaaccgacgttcattaaaccccaacttcctcgcgtcactaccaactcccacccccgccaaaaaacaaacaaataaataataacttaaaaaaacccgaacgtaactaccaaaaaaacgaacgactccgaaaactaaaaaaactcaacttaatacacattcgctaccaatctaaattattaataaaacgataacgccaccctcctaatataaaaata

SEQ ID NO: 23053 - DNA, 899 bp, Artificial Sequence
  chemically treated genomic DNA (Homo sapiens) CpG-island No: 23053
aggcgttacgtcgaaatttgtcgtaaattcgagaaggagagtttcggggattgggcgcgcgggatataaagggtcgtgaacgcggttttttatgaggcgatagtgcgcgggtagggagataaaatggagcgatgggaggaatcggagttcgagcggtagcggcggggaaggggcggcggcggcgggtacgcgtttcgttagggttttttttttcgattagcgacgggggagggggcgcggcggcggttagtttttttcgtcgtttatacgcggttttatcgttcgggtttagcgcggcgggaagcgttagtcgggtgtcgttaataatagggagcgaggtagcgtcggcgagggaggagtcggcggtagttgtatagcggttcgcgttcgcgtttcgggtttcgcggcgattcgtcgcgttcgcggttcgtgaaacgacgcggtagaacgaggggcgggggggcgttacgttaggggtcggcggcgcggtttagaggcggtaagggcgtatattttgtagtcgtttcggttcgcggtcgtagcgggtttcgggttagtttttcggtcgtagcgtcgttcgcgtcggcggcggggatttgggtttttacgtatttggttgaatttttcgtcgatattcgcgtaaatgtttatgtggtttacgtcgttcgttatttttttttagtttcggtcgtcgtcgtcgtcgtcgttttttgtaggtttgttcgtcgcggtagtagtagcggatttagcggcggtgggggggcgtttgcgttattttcgaggttcgagggagggaggcgcgggcgataggggtcggtcgggggcggggattttgtagtttagtcgttttgttggttgaggaaaggttgcgtttttgagggtagaggacgttttttttg

SEQ ID NO: 23054 - DNA, 899 bp, Artificial Sequence
  chemically treated genomic DNA (Homo sapiens) CpG-island No: 23054
caaaaaaaacgtcctctaccctcaaaaacgcaacctttcctcaaccaacaaaacgactaaactacaaaatccccgcccccgaccgacccctatcgcccgcgcctccctccctcgaacctcgaaaataacgcaaacgcccccccaccgccgctaaatccgctactactaccgcgacgaacaaacctacaaaaaacgacgacgacgacgacgaccgaaactaaaaaaaaataacgaacgacgtaaaccacataaacatttacgcgaatatcgacgaaaaattcaaccaaatacgtaaaaacccaaatccccgccgccgacgcgaacgacgctacgaccgaaaaactaacccgaaacccgctacgaccgcgaaccgaaacgactacaaaatatacgcccttaccgcctctaaaccgcgccgccgacccctaacgtaacgcccccccgcccctcgttctaccgcgtcgtttcacgaaccgcgaacgcgacgaatcgccgcgaaacccgaaacgcgaacgcgaaccgctatacaactaccgccgactcctccctcgccgacgctacctcgctccctattattaacgacacccgactaacgcttcccgccgcgctaaacccgaacgataaaaccgcgtataaacgacgaaaaaaactaaccgccgccgcgccccctcccccgtcgctaatcgaaaaaaaaaaccctaacgaaacgcgtacccgccgccgccgccccttccccgccgctaccgctcgaactccgattcctcccatcgctccattttatctccctacccgcgcactatcgcctcataaaaaaccgcgttcacgaccctttatatcccgcgcgcccaatccccgaaactctccttctcgaatttacgacaaatttcgacgtaacgcct

SEQ ID NO: 23055 - DNA, 899 bp, Artificial Sequence
  chemically treated genomic DNA (Homo sapiens) CpG-island No: 23055
taaaagaaacgttttttgtttttagaggcgtagtttttttttagttagtagagcggttgggttgtagagttttcgttttcggtcggtttttgtcgttcgcgtttttttttttcgggtttcggaagtgacgtaagcgtttttttatcgtcgttagattcgttgttgttgtcgcggcgggtagatttgtaggaggcggcggcggcggcggcggtcgaggttgaaggaagatggcggacggcgtggattatatagatatttacgcggatgtcggcgaagagtttaattaggtacgtgagagtttaggttttcgtcgtcgacgcgggcggcgttgcggtcgggaagttgattcggggttcgttgcggtcgcgagtcgaagcgattgtagagtgtgcgtttttgtcgtttttgggtcgcgtcgtcgatttttggcgtggcgttttttcgtttttcgttttatcgcgtcgttttacgggtcgcgggcgcggcgagtcgtcgcggggttcggagcgcggacgcgggtcgttgtgtagttgtcgtcggtttttttttcgtcggcgttgtttcgttttttattgttggcggtattcggttggcgtttttcgtcgcgttaggttcgggcggtggggtcgcgtgtaagcggcggagagaattggtcgtcgtcgcgttttttttttcgtcgttggtcggaggaggaagttttggcggggcgcgtgttcgtcgtcgtcgtttttttttcgtcgttgtcgttcgggtttcgattttttttatcgttttattttgtttttttgttcgcgtattgtcgttttatggaaggtcgcgtttacggttttttgtatttcgcgcgtttagttttcggggttttttttttcgggtttgcgataggtttcggcgtggcgttt
